United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 7

SEQ ID NO: 86222 - DNA, 20 bp, Artificial Sequence
  Description of Artificial Sequence: Synthetic oligonucleotide
  Target: ATXN1; (-) strand; PAM type: NRG; PAM sequence: AGG
tttgtttcattttaaggttt

SEQ ID NO: 86223 - DNA, 20 bp, Artificial Sequence
  Description of Artificial Sequence: Synthetic oligonucleotide
  Target: ATXN1; (-) strand; PAM type: NRG; PAM sequence: TAG
atttgtttcattttaaggtt

SEQ ID NO: 86224 - DNA, 20 bp, Artificial Sequence
  Description of Artificial Sequence: Synthetic oligonucleotide
  Target: ATXN1; (-) strand; PAM type: NRG; PAM sequence: AGG
cttgtatttgtttcatttta

SEQ ID NO: 86225 - DNA, 20 bp, Artificial Sequence
  Description of Artificial Sequence: Synthetic oligonucleotide
  Target: ATXN1; (-) strand; PAM type: NRG; PAM sequence: AAG
acttgtatttgtttcatttt

SEQ ID NO: 86226 - DNA, 20 bp, Artificial Sequence
  Description of Artificial Sequence: Synthetic oligonucleotide
  Target: ATXN1; (-) strand; PAM type: NRG; PAM sequence: CAG
ataggctgccttgtatataa

SEQ ID NO: 86227 - DNA, 20 bp, Artificial Sequence
  Description of Artificial Sequence: Synthetic oligonucleotide
  Target: ATXN1; (-) strand; PAM type: NRG; PAM sequence: AGG
ttaagaattatgtggccaat

SEQ ID NO: 86228 - DNA, 20 bp, Artificial Sequence
  Description of Artificial Sequence: Synthetic oligonucleotide
  Target: ATXN1; (-) strand; PAM type: NRG; PAM sequence: TAG
tttaagaattatgtggccaa

SEQ ID NO: 86229 - DNA, 20 bp, Artificial Sequence
  Description of Artificial Sequence: Synthetic oligonucleotide
  Target: ATXN1; (-) strand; PAM type: NRG; PAM sequence: TGG
ctggttgtttaagaattatg

SEQ ID NO: 86230 - DNA, 20 bp, Artificial Sequence
  Description of Artificial Sequence: Synthetic oligonucleotide
  Target: ATXN1; (-) strand; PAM type: NRG; PAM sequence: AAG
cagcttttttctggttgttt

SEQ ID NO: 86231 - DNA, 20 bp, Artificial Sequence
  Description of Artificial Sequence: Synthetic oligonucleotide
  Target: ATXN1; (-) strand; PAM type: NRG; PAM sequence: TGG
gtcatacttcagcttttttc

SEQ ID NO: 86232 - DNA, 20 bp, Artificial Sequence
  Description of Artificial Sequence: Synthetic oligonucleotide
  Target: ATXN1; (-) strand; PAM type: NRG; PAM sequence: CAG
ccgtattgatggtcatactt

SEQ ID NO: 86233 - DNA, 20 bp, Artificial Sequence
  Description of Artificial Sequence: Synthetic oligonucleotide
  Target: ATXN1; (-) strand; PAM type: NRG; PAM sequence: TGG
tgttccatgtcccgtattga

SEQ ID NO: 86234 - DNA, 20 bp, Artificial Sequence
  Description of Artificial Sequence: Synthetic oligonucleotide
  Target: ATXN1; (-) strand; PAM type: NRG; PAM sequence: TGG
gaaagaatctttcgatcttt

SEQ ID NO: 86235 - DNA, 20 bp, Artificial Sequence
  Description of Artificial Sequence: Synthetic oligonucleotide
  Target: ATXN1; (-) strand; PAM type: NRG; PAM sequence: AAG
agtcctaaagagggggaaga

SEQ ID NO: 86236 - DNA, 20 bp, Artificial Sequence
  Description of Artificial Sequence: Synthetic oligonucleotide
  Target: ATXN1; (-) strand; PAM type: NRG; PAM sequence: AAG
gtttagtcctaaagaggggg

SEQ ID NO: 86237 - DNA, 20 bp, Artificial Sequence
  Description of Artificial Sequence: Synthetic oligonucleotide
  Target: ATXN1; (-) strand; PAM type: NRG; PAM sequence: GGG
gctgtttagtcctaaagagg

SEQ ID NO: 86238 - DNA, 20 bp, Artificial Sequence
  Description of Artificial Sequence: Synthetic oligonucleotide
  Target: ATXN1; (-) strand; PAM type: NRG; PAM sequence: GGG
agctgtttagtcctaaagag

SEQ ID NO: 86239 - DNA, 20 bp, Artificial Sequence
  Description of Artificial Sequence: Synthetic oligonucleotide
  Target: ATXN1; (-) strand; PAM type: NRG; PAM sequence: GGG
cagctgtttagtcctaaaga

SEQ ID NO: 86240 - DNA, 20 bp, Artificial Sequence
  Description of Artificial Sequence: Synthetic oligonucleotide
  Target: ATXN1; (-) strand; PAM type: NRG; PAM sequence: AGG
acagctgtttagtcctaaag

SEQ ID NO: 86241 - DNA, 20 bp, Artificial Sequence
  Description of Artificial Sequence: Synthetic oligonucleotide
  Target: ATXN1; (-) strand; PAM type: NRG; PAM sequence: GAG
cacagctgtttagtcctaaa

SEQ ID NO: 86242 - DNA, 20 bp, Artificial Sequence
  Description of Artificial Sequence: Synthetic oligonucleotide
  Target: ATXN1; (-) strand; PAM type: NRG; PAM sequence: AAG
cccacagctgtttagtccta

SEQ ID NO: 86243 - DNA, 20 bp, Artificial Sequence
  Description of Artificial Sequence: Synthetic oligonucleotide
  Target: ATXN1; (-) strand; PAM type: NRG; PAM sequence: TAG
tctttatgcccacagctgtt

SEQ ID NO: 86244 - DNA, 20 bp, Artificial Sequence
  Description of Artificial Sequence: Synthetic oligonucleotide
  Target: ATXN1; (-) strand; PAM type: NRG; PAM sequence: CAG
ttattttttctttatgccca

SEQ ID NO: 86245 - DNA, 20 bp, Artificial Sequence
  Description of Artificial Sequence: Synthetic oligonucleotide
  Target: ATXN1; (-) strand; PAM type: NRG; PAM sequence: TGG
tattatgctttctaaaataa

SEQ ID NO: 86246 - DNA, 20 bp, Artificial Sequence
  Description of Artificial Sequence: Synthetic oligonucleotide
  Target: ATXN1; (-) strand; PAM type: NRG; PAM sequence: TGG
ctcaaagaaataatgaaggg

SEQ ID NO: 86247 - DNA, 20 bp, Artificial Sequence
  Description of Artificial Sequence: Synthetic oligonucleotide
  Target: ATXN1; (-) strand; PAM type: NRG; PAM sequence: GGG
attctcaaagaaataatgaa

SEQ ID NO: 86248 - DNA, 20 bp, Artificial Sequence
  Description of Artificial Sequence: Synthetic oligonucleotide
  Target: ATXN1; (-) strand; PAM type: NRG; PAM sequence: AGG
cattctcaaagaaataatga

SEQ ID NO: 86249 - DNA, 20 bp, Artificial Sequence
  Description of Artificial Sequence: Synthetic oligonucleotide
  Target: ATXN1; (-) strand; PAM type: NRG; PAM sequence: AAG
ccattctcaaagaaataatg

SEQ ID NO: 86250 - DNA, 20 bp, Artificial Sequence
  Description of Artificial Sequence: Synthetic oligonucleotide
  Target: ATXN1; (-) strand; PAM type: NRG; PAM sequence: AAG
aataattccaaccattctca

SEQ ID NO: 86251 - DNA, 20 bp, Artificial Sequence
  Description of Artificial Sequence: Synthetic oligonucleotide
  Target: ATXN1; (-) strand; PAM type: NRG; PAM sequence: TAG
cgatagaggctaacctctcg

SEQ ID NO: 86252 - DNA, 20 bp, Artificial Sequence
  Description of Artificial Sequence: Synthetic oligonucleotide
  Target: ATXN1; (-) strand; PAM type: NRG; PAM sequence: AGG
tgaaatcactcaatcgatag

SEQ ID NO: 86253 - DNA, 20 bp, Artificial Sequence
  Description of Artificial Sequence: Synthetic oligonucleotide
  Target: ATXN1; (-) strand; PAM type: NRG; PAM sequence: GAG
atgaaatcactcaatcgata

SEQ ID NO: 86254 - DNA, 20 bp, Artificial Sequence
  Description of Artificial Sequence: Synthetic oligonucleotide
  Target: ATXN1; (-) strand; PAM type: NRG; PAM sequence: TAG
taatgaaatcactcaatcga

SEQ ID NO: 86255 - DNA, 20 bp, Artificial Sequence
  Description of Artificial Sequence: Synthetic oligonucleotide
  Target: ATXN1; (-) strand; PAM type: NRG; PAM sequence: TGG
actcattttagctcaatcac

SEQ ID NO: 86256 - DNA, 20 bp, Artificial Sequence
  Description of Artificial Sequence: Synthetic oligonucleotide
  Target: ATXN1; (-) strand; PAM type: NRG; PAM sequence: TAG
tgtagcttggccactcattt

SEQ ID NO: 86257 - DNA, 20 bp, Artificial Sequence
  Description of Artificial Sequence: Synthetic oligonucleotide
  Target: ATXN1; (-) strand; PAM type: NRG; PAM sequence: TGG
caatttttggtcttgtagct

SEQ ID NO: 86258 - DNA, 20 bp, Artificial Sequence
  Description of Artificial Sequence: Synthetic oligonucleotide
  Target: ATXN1; (-) strand; PAM type: NRG; PAM sequence: TAG
acacacaatttttggtcttg

SEQ ID NO: 86259 - DNA, 20 bp, Artificial Sequence
  Description of Artificial Sequence: Synthetic oligonucleotide
  Target: ATXN1; (-) strand; PAM type: NRG; PAM sequence: TGG
tgttgaccacacacaatttt

SEQ ID NO: 86260 - DNA, 20 bp, Artificial Sequence
  Description of Artificial Sequence: Synthetic oligonucleotide
  Target: ATXN1; (-) strand; PAM type: NRG; PAM sequence: TAG
ttcctttggaattgattagg

SEQ ID NO: 86261 - DNA, 20 bp, Artificial Sequence
  Description of Artificial Sequence: Synthetic oligonucleotide
  Target: ATXN1; (-) strand; PAM type: NRG; PAM sequence: AGG
cccttcctttggaattgatt

SEQ ID NO: 86262 - DNA, 20 bp, Artificial Sequence
  Description of Artificial Sequence: Synthetic oligonucleotide
  Target: ATXN1; (-) strand; PAM type: NRG; PAM sequence: TAG
tcccttcctttggaattgat

SEQ ID NO: 86263 - DNA, 20 bp, Artificial Sequence
  Description of Artificial Sequence: Synthetic oligonucleotide
  Target: ATXN1; (-) strand; PAM type: NRG; PAM sequence: TGG
tcatcatgtctcccttcctt

SEQ ID NO: 86264 - DNA, 20 bp, Artificial Sequence
  Description of Artificial Sequence: Synthetic oligonucleotide
  Target: ATXN1; (-) strand; PAM type: NRG; PAM sequence: GAG
agcactgtcccattggtggg

SEQ ID NO: 86265 - DNA, 20 bp, Artificial Sequence
  Description of Artificial Sequence: Synthetic oligonucleotide
  Target: ATXN1; (-) strand; PAM type: NRG; PAM sequence: GGG
ggagcactgtcccattggtg

SEQ ID NO: 86266 - DNA, 20 bp, Artificial Sequence
  Description of Artificial Sequence: Synthetic oligonucleotide
  Target: ATXN1; (-) strand; PAM type: NRG; PAM sequence: GGG
tggagcactgtcccattggt

SEQ ID NO: 86267 - DNA, 20 bp, Artificial Sequence
  Description of Artificial Sequence: Synthetic oligonucleotide
  Target: ATXN1; (-) strand; PAM type: NRG; PAM sequence: TGG
ctggagcactgtcccattgg

SEQ ID NO: 86268 - DNA, 20 bp, Artificial Sequence
  Description of Artificial Sequence: Synthetic oligonucleotide
  Target: ATXN1; (-) strand; PAM type: NRG; PAM sequence: TGG
ctactggagcactgtcccat

SEQ ID NO: 86269 - DNA, 20 bp, Artificial Sequence
  Description of Artificial Sequence: Synthetic oligonucleotide
  Target: ATXN1; (-) strand; PAM type: NRG; PAM sequence: GAG
gaagatcctggggtctactg

SEQ ID NO: 86270 - DNA, 20 bp, Artificial Sequence
  Description of Artificial Sequence: Synthetic oligonucleotide
  Target: ATXN1; (-) strand; PAM type: NRG; PAM sequence: TGG
tagaagatcctggggtctac

SEQ ID NO: 86271 - DNA, 20 bp, Artificial Sequence
  Description of Artificial Sequence: Synthetic oligonucleotide
  Target: ATXN1; (-) strand; PAM type: NRG; PAM sequence: GGG
ccattaaatagaagatcctg

SEQ ID NO: 86272 - DNA, 20 bp, Artificial Sequence
  Description of Artificial Sequence: Synthetic oligonucleotide
  Target: ATXN1; (-) strand; PAM type: NRG; PAM sequence: GGG
gccattaaatagaagatcct

SEQ ID NO: 86273 - DNA, 20 bp, Artificial Sequence
  Description of Artificial Sequence: Synthetic oligonucleotide
  Target: ATXN1; (-) strand; PAM type: NRG; PAM sequence: TGG
agccattaaatagaagatcc

SEQ ID NO: 86274 - DNA, 20 bp, Artificial Sequence
  Description of Artificial Sequence: Synthetic oligonucleotide
  Target: ATXN1; (-) strand; PAM type: NRG; PAM sequence: AAG
ttacaacagccattaaatag

SEQ ID NO: 86275 - DNA, 20 bp, Artificial Sequence
  Description of Artificial Sequence: Synthetic oligonucleotide
  Target: ATXN1; (-) strand; PAM type: NRG; PAM sequence: TAG
gtcttacaacagccattaaa

SEQ ID NO: 86276 - DNA, 20 bp, Artificial Sequence
  Description of Artificial Sequence: Synthetic oligonucleotide
  Target: ATXN1; (-) strand; PAM type: NRG; PAM sequence: CAG
acagagatagagtcttacaa

SEQ ID NO: 86277 - DNA, 20 bp, Artificial Sequence
  Description of Artificial Sequence: Synthetic oligonucleotide
  Target: ATXN1; (-) strand; PAM type: NRG; PAM sequence: GAG
ttccaagaggaacagagata

SEQ ID NO: 86278 - DNA, 20 bp, Artificial Sequence
  Description of Artificial Sequence: Synthetic oligonucleotide
  Target: ATXN1; (-) strand; PAM type: NRG; PAM sequence: TAG
tcttccaagaggaacagaga

SEQ ID NO: 86279 - DNA, 20 bp, Artificial Sequence
  Description of Artificial Sequence: Synthetic oligonucleotide
  Target: ATXN1; (-) strand; PAM type: NRG; PAM sequence: GAG
cttttcttccaagaggaaca

SEQ ID NO: 86280 - DNA, 20 bp, Artificial Sequence
  Description of Artificial Sequence: Synthetic oligonucleotide
  Target: ATXN1; (-) strand; PAM type: NRG; PAM sequence: CAG
accttttcttccaagaggaa

SEQ ID NO: 86281 - DNA, 20 bp, Artificial Sequence
  Description of Artificial Sequence: Synthetic oligonucleotide
  Target: ATXN1; (-) strand; PAM type: NRG; PAM sequence: AGG
gtggcaccttttcttccaag

SEQ ID NO: 86282 - DNA, 20 bp, Artificial Sequence
  Description of Artificial Sequence: Synthetic oligonucleotide
  Target: ATXN1; (-) strand; PAM type: NRG; PAM sequence: GAG
agtggcaccttttcttccaa

SEQ ID NO: 86283 - DNA, 20 bp, Artificial Sequence
  Description of Artificial Sequence: Synthetic oligonucleotide
  Target: ATXN1; (-) strand; PAM type: NRG; PAM sequence: AAG
tcagtggcaccttttcttcc

SEQ ID NO: 86284 - DNA, 20 bp, Artificial Sequence
  Description of Artificial Sequence: Synthetic oligonucleotide
  Target: ATXN1; (-) strand; PAM type: NRG; PAM sequence: TGG
tcttgttcccttgtcctcag

SEQ ID NO: 86285 - DNA, 20 bp, Artificial Sequence
  Description of Artificial Sequence: Synthetic oligonucleotide
  Target: ATXN1; (-) strand; PAM type: NRG; PAM sequence: CAG
gattcttgttcccttgtcct

SEQ ID NO: 86286 - DNA, 20 bp, Artificial Sequence
  Description of Artificial Sequence: Synthetic oligonucleotide
  Target: ATXN1; (-) strand; PAM type: NRG; PAM sequence: CAG
aggggcattgttgattgaca

SEQ ID NO: 86287 - DNA, 20 bp, Artificial Sequence
  Description of Artificial Sequence: Synthetic oligonucleotide
  Target: ATXN1; (-) strand; PAM type: NRG; PAM sequence: GGG
acctgcctggtttacttcag

SEQ ID NO: 86288 - DNA, 20 bp, Artificial Sequence
  Description of Artificial Sequence: Synthetic oligonucleotide
  Target: ATXN1; (-) strand; PAM type: NRG; PAM sequence: GGG
gacctgcctggtttacttca

SEQ ID NO: 86289 - DNA, 20 bp, Artificial Sequence
  Description of Artificial Sequence: Synthetic oligonucleotide
  Target: ATXN1; (-) strand; PAM type: NRG; PAM sequence: AGG
ggacctgcctggtttacttc

SEQ ID NO: 86290 - DNA, 20 bp, Artificial Sequence
  Description of Artificial Sequence: Synthetic oligonucleotide
  Target: ATXN1; (-) strand; PAM type: NRG; PAM sequence: CAG
cggacctgcctggtttactt

SEQ ID NO: 86291 - DNA, 20 bp, Artificial Sequence
  Description of Artificial Sequence: Synthetic oligonucleotide
  Target: ATXN1; (-) strand; PAM type: NRG; PAM sequence: TGG
ctgtgcagtgcggacctgcc

SEQ ID NO: 86292 - DNA, 20 bp, Artificial Sequence
  Description of Artificial Sequence: Synthetic oligonucleotide
  Target: ATXN1; (-) strand; PAM type: NRG; PAM sequence: CGG
acagctgagactgtgcagtg

SEQ ID NO: 86293 - DNA, 20 bp, Artificial Sequence
  Description of Artificial Sequence: Synthetic oligonucleotide
  Target: ATXN1; (-) strand; PAM type: NRG; PAM sequence: CAG
gaattacagctgagactgtg

SEQ ID NO: 86294 - DNA, 20 bp, Artificial Sequence
  Description of Artificial Sequence: Synthetic oligonucleotide
  Target: ATXN1; (-) strand; PAM type: NRG; PAM sequence: GAG
cttgggatagaattacagct

SEQ ID NO: 86295 - DNA, 20 bp, Artificial Sequence
  Description of Artificial Sequence: Synthetic oligonucleotide
  Target: ATXN1; (-) strand; PAM type: NRG; PAM sequence: CAG
ggtttcttgggatagaatta

SEQ ID NO: 86296 - DNA, 20 bp, Artificial Sequence
  Description of Artificial Sequence: Synthetic oligonucleotide
  Target: ATXN1; (-) strand; PAM type: NRG; PAM sequence: TAG
tgtgctctggtttcttggga

SEQ ID NO: 86297 - DNA, 20 bp, Artificial Sequence
  Description of Artificial Sequence: Synthetic oligonucleotide
  Target: ATXN1; (-) strand; PAM type: NRG; PAM sequence: GGG
gtcctgtgctctggtttctt

SEQ ID NO: 86298 - DNA, 20 bp, Artificial Sequence
  Description of Artificial Sequence: Synthetic oligonucleotide
  Target: ATXN1; (-) strand; PAM type: NRG; PAM sequence: TGG
ggtcctgtgctctggtttct

SEQ ID NO: 86299 - DNA, 20 bp, Artificial Sequence
  Description of Artificial Sequence: Synthetic oligonucleotide
  Target: ATXN1; (-) strand; PAM type: NRG; PAM sequence: TGG
gtggctctggtcctgtgctc

SEQ ID NO: 86300 - DNA, 20 bp, Artificial Sequence
  Description of Artificial Sequence: Synthetic oligonucleotide
  Target: ATXN1; (-) strand; PAM type: NRG; PAM sequence: TGG
tgcaggcttaagtgtggctc

SEQ ID NO: 86301 - DNA, 20 bp, Artificial Sequence
  Description of Artificial Sequence: Synthetic oligonucleotide
  Target: ATXN1; (-) strand; PAM type: NRG; PAM sequence: TGG
ctacactgcaggcttaagtg

SEQ ID NO: 86302 - DNA, 20 bp, Artificial Sequence
  Description of Artificial Sequence: Synthetic oligonucleotide
  Target: ATXN1; (-) strand; PAM type: NRG; PAM sequence: AAG
tcaccctacactgcaggctt

SEQ ID NO: 86303 - DNA, 20 bp, Artificial Sequence
  Description of Artificial Sequence: Synthetic oligonucleotide
  Target: ATXN1; (-) strand; PAM type: NRG; PAM sequence: AGG
atggcgtcaccctacactgc

SEQ ID NO: 86304 - DNA, 20 bp, Artificial Sequence
  Description of Artificial Sequence: Synthetic oligonucleotide
  Target: ATXN1; (-) strand; PAM type: NRG; PAM sequence: CAG
catggcgtcaccctacactg

SEQ ID NO: 86305 - DNA, 20 bp, Artificial Sequence
  Description of Artificial Sequence: Synthetic oligonucleotide
  Target: ATXN1; (-) strand; PAM type: NRG; PAM sequence: TGG
caggctgtcacgtggcccca

SEQ ID NO: 86306 - DNA, 20 bp, Artificial Sequence
  Description of Artificial Sequence: Synthetic oligonucleotide
  Target: ATXN1; (-) strand; PAM type: NRG; PAM sequence: TGG
tggagaggcaggctgtcacg

SEQ ID NO: 86307 - DNA, 20 bp, Artificial Sequence
  Description of Artificial Sequence: Synthetic oligonucleotide
  Target: ATXN1; (-) strand; PAM type: NRG; PAM sequence: AGG
agtaacagctttggagaggc

SEQ ID NO: 86308 - DNA, 20 bp, Artificial Sequence
  Description of Artificial Sequence: Synthetic oligonucleotide
  Target: ATXN1; (-) strand; PAM type: NRG; PAM sequence: CAG
cagtaacagctttggagagg

SEQ ID NO: 86309 - DNA, 20 bp, Artificial Sequence
  Description of Artificial Sequence: Synthetic oligonucleotide
  Target: ATXN1; (-) strand; PAM type: NRG; PAM sequence: AGG
tgacagtaacagctttggag

SEQ ID NO: 86310 - DNA, 20 bp, Artificial Sequence
  Description of Artificial Sequence: Synthetic oligonucleotide
  Target: ATXN1; (-) strand; PAM type: NRG; PAM sequence: GAG
ctgacagtaacagctttgga

SEQ ID NO: 86311 - DNA, 20 bp, Artificial Sequence
  Description of Artificial Sequence: Synthetic oligonucleotide
  Target: ATXN1; (-) strand; PAM type: NRG; PAM sequence: GAG
tactgacagtaacagctttg

SEQ ID NO: 86312 - DNA, 20 bp, Artificial Sequence
  Description of Artificial Sequence: Synthetic oligonucleotide
  Target: ATXN1; (-) strand; PAM type: NRG; PAM sequence: TGG
actactgacagtaacagctt

SEQ ID NO: 86313 - DNA, 20 bp, Artificial Sequence
  Description of Artificial Sequence: Synthetic oligonucleotide
  Target: ATXN1; (-) strand; PAM type: NRG; PAM sequence: CAG
ctaaatactactgacagtaa

SEQ ID NO: 86314 - DNA, 20 bp, Artificial Sequence
  Description of Artificial Sequence: Synthetic oligonucleotide
  Target: ATXN1; (-) strand; PAM type: NRG; PAM sequence: CAG
tttcctctaaatactactga

SEQ ID NO: 86315 - DNA, 20 bp, Artificial Sequence
  Description of Artificial Sequence: Synthetic oligonucleotide
  Target: ATXN1; (-) strand; PAM type: NRG; PAM sequence: TGG
cgtcctaattggctctgact

SEQ ID NO: 86316 - DNA, 20 bp, Artificial Sequence
  Description of Artificial Sequence: Synthetic oligonucleotide
  Target: ATXN1; (-) strand; PAM type: NRG; PAM sequence: TGG
tgccaaattatcgtcctaat

SEQ ID NO: 86317 - DNA, 20 bp, Artificial Sequence
  Description of Artificial Sequence: Synthetic oligonucleotide
  Target: ATXN1; (-) strand; PAM type: NRG; PAM sequence: GAG
ttttcatatgcatgaggcag

SEQ ID NO: 86318 - DNA, 20 bp, Artificial Sequence
  Description of Artificial Sequence: Synthetic oligonucleotide
  Target: ATXN1; (-) strand; PAM type: NRG; PAM sequence: AGG
ctttttcatatgcatgaggc

SEQ ID NO: 86319 - DNA, 20 bp, Artificial Sequence
  Description of Artificial Sequence: Synthetic oligonucleotide
  Target: ATXN1; (-) strand; PAM type: NRG; PAM sequence: CAG
cctttttcatatgcatgagg

SEQ ID NO: 86320 - DNA, 20 bp, Artificial Sequence
  Description of Artificial Sequence: Synthetic oligonucleotide
  Target: ATXN1; (-) strand; PAM type: NRG; PAM sequence: AGG
gatcctttttcatatgcatg

SEQ ID NO: 86321 - DNA, 20 bp, Artificial Sequence
  Description of Artificial Sequence: Synthetic oligonucleotide
  Target: ATXN1; (-) strand; PAM type: NRG; PAM sequence: GAG
ggatcctttttcatatgcat

SEQ ID NO: 86322 - DNA, 20 bp, Artificial Sequence
  Description of Artificial Sequence: Synthetic oligonucleotide
  Target: ATXN1; (-) strand; PAM type: NRG; PAM sequence: CGG
gcattattgctcattgatgg

SEQ ID NO: 86323 - DNA, 20 bp, Artificial Sequence
  Description of Artificial Sequence: Synthetic oligonucleotide
  Target: ATXN1; (-) strand; PAM type: NRG; PAM sequence: TGG
catgcattattgctcattga

SEQ ID NO: 86324 - DNA, 20 bp, Artificial Sequence
  Description of Artificial Sequence: Synthetic oligonucleotide
  Target: ATXN1; (-) strand; PAM type: NRG; PAM sequence: GAG
tctttgatgtattgaagtta

SEQ ID NO: 86325 - DNA, 20 bp, Artificial Sequence
  Description of Artificial Sequence: Synthetic oligonucleotide
  Target: ATXN1; (-) strand; PAM type: NRG; PAM sequence: TAG
cgtctttgatgtattgaagt

SEQ ID NO: 86326 - DNA, 20 bp, Artificial Sequence
  Description of Artificial Sequence: Synthetic oligonucleotide
  Target: ATXN1; (-) strand; PAM type: NRG; PAM sequence: AAG
gcagcgtctttgatgtattg

SEQ ID NO: 86327 - DNA, 20 bp, Artificial Sequence
  Description of Artificial Sequence: Synthetic oligonucleotide
  Target: ATXN1; (-) strand; PAM type: NRG; PAM sequence: CAG
aaaaagacggaggtgtgcag

SEQ ID NO: 86328 - DNA, 20 bp, Artificial Sequence
  Description of Artificial Sequence: Synthetic oligonucleotide
  Target: ATXN1; (-) strand; PAM type: NRG; PAM sequence: CAG
ataaaaaagacggaggtgtg

SEQ ID NO: 86329 - DNA, 20 bp, Artificial Sequence
  Description of Artificial Sequence: Synthetic oligonucleotide
  Target: ATXN1; (-) strand; PAM type: NRG; PAM sequence: AGG
aatgggaataaaaaagacgg

SEQ ID NO: 86330 - DNA, 20 bp, Artificial Sequence
  Description of Artificial Sequence: Synthetic oligonucleotide
  Target: ATXN1; (-) strand; PAM type: NRG; PAM sequence: GAG
taatgggaataaaaaagacg

SEQ ID NO: 86331 - DNA, 20 bp, Artificial Sequence
  Description of Artificial Sequence: Synthetic oligonucleotide
  Target: ATXN1; (-) strand; PAM type: NRG; PAM sequence: CGG
gctaatgggaataaaaaaga

SEQ ID NO: 86332 - DNA, 20 bp, Artificial Sequence
  Description of Artificial Sequence: Synthetic oligonucleotide
  Target: ATXN1; (-) strand; PAM type: NRG; PAM sequence: AAG
gtgagctaatgggaataaaa

SEQ ID NO: 86333 - DNA, 20 bp, Artificial Sequence
  Description of Artificial Sequence: Synthetic oligonucleotide
  Target: ATXN1; (-) strand; PAM type: NRG; PAM sequence: GGG
ccagacaagggtgagctaat

SEQ ID NO: 86334 - DNA, 20 bp, Artificial Sequence
  Description of Artificial Sequence: Synthetic oligonucleotide
  Target: ATXN1; (-) strand; PAM type: NRG; PAM sequence: TGG
tccagacaagggtgagctaa

SEQ ID NO: 86335 - DNA, 20 bp, Artificial Sequence
  Description of Artificial Sequence: Synthetic oligonucleotide
  Target: ATXN1; (-) strand; PAM type: NRG; PAM sequence: GAG
tctttcatccagacaagggt

SEQ ID NO: 86336 - DNA, 20 bp, Artificial Sequence
  Description of Artificial Sequence: Synthetic oligonucleotide
  Target: ATXN1; (-) strand; PAM type: NRG; PAM sequence: GGG
gagctctttcatccagacaa

SEQ ID NO: 86337 - DNA, 20 bp, Artificial Sequence
  Description of Artificial Sequence: Synthetic oligonucleotide
  Target: ATXN1; (-) strand; PAM type: NRG; PAM sequence: AGG
tgagctctttcatccagaca

SEQ ID NO: 86338 - DNA, 20 bp, Artificial Sequence
  Description of Artificial Sequence: Synthetic oligonucleotide
  Target: ATXN1; (-) strand; PAM type: NRG; PAM sequence: AAG
ctgagctctttcatccagac

SEQ ID NO: 86339 - DNA, 20 bp, Artificial Sequence
  Description of Artificial Sequence: Synthetic oligonucleotide
  Target: ATXN1; (-) strand; PAM type: NRG; PAM sequence: CAG
attcactgagctctttcatc

SEQ ID NO: 86340 - DNA, 20 bp, Artificial Sequence
  Description of Artificial Sequence: Synthetic oligonucleotide
  Target: ATXN1; (-) strand; PAM type: NRG; PAM sequence: GAG
acagaagcagttgattcact

SEQ ID NO: 86341 - DNA, 20 bp, Artificial Sequence
  Description of Artificial Sequence: Synthetic oligonucleotide
  Target: ATXN1; (-) strand; PAM type: NRG; PAM sequence: CAG
tataaacagttcaacagaag

SEQ ID NO: 86342 - DNA, 20 bp, Artificial Sequence
  Description of Artificial Sequence: Synthetic oligonucleotide
  Target: ATXN1; (-) strand; PAM type: NRG; PAM sequence: AAG
atatataaacagttcaacag

SEQ ID NO: 86343 - DNA, 20 bp, Artificial Sequence
  Description of Artificial Sequence: Synthetic oligonucleotide
  Target: ATXN1; (-) strand; PAM type: NRG; PAM sequence: CAG
aaaatatataaacagttcaa

SEQ ID NO: 86344 - DNA, 20 bp, Artificial Sequence
  Description of Artificial Sequence: Synthetic oligonucleotide
  Target: ATXN1; (-) strand; PAM type: NRG; PAM sequence: CAG
tgacttgaaaaatatataaa

SEQ ID NO: 86345 - DNA, 20 bp, Artificial Sequence
  Description of Artificial Sequence: Synthetic oligonucleotide
  Target: ATXN1; (-) strand; PAM type: NRG; PAM sequence: TGG
gcaatatgctcagtgactaa

SEQ ID NO: 86346 - DNA, 20 bp, Artificial Sequence
  Description of Artificial Sequence: Synthetic oligonucleotide
  Target: ATXN1; (-) strand; PAM type: NRG; PAM sequence: CAG
agtttactgtgcaatatgct

SEQ ID NO: 86347 - DNA, 20 bp, Artificial Sequence
  Description of Artificial Sequence: Synthetic oligonucleotide
  Target: ATXN1; (-) strand; PAM type: NRG; PAM sequence: TAG
ttgcataatggcagttactc

SEQ ID NO: 86348 - DNA, 20 bp, Artificial Sequence
  Description of Artificial Sequence: Synthetic oligonucleotide
  Target: ATXN1; (-) strand; PAM type: NRG; PAM sequence: CAG
cttgggaagttgcataatgg

SEQ ID NO: 86349 - DNA, 20 bp, Artificial Sequence
  Description of Artificial Sequence: Synthetic oligonucleotide
  Target: ATXN1; (-) strand; PAM type: NRG; PAM sequence: TGG
gttcttgggaagttgcataa

SEQ ID NO: 86350 - DNA, 20 bp, Artificial Sequence
  Description of Artificial Sequence: Synthetic oligonucleotide
  Target: ATXN1; (-) strand; PAM type: NRG; PAM sequence: AAG
gctctctgtatgttcttggg

SEQ ID NO: 86351 - DNA, 20 bp, Artificial Sequence
  Description of Artificial Sequence: Synthetic oligonucleotide
  Target: ATXN1; (-) strand; PAM type: NRG; PAM sequence: GGG
aatgctctctgtatgttctt

SEQ ID NO: 86352 - DNA, 20 bp, Artificial Sequence
  Description of Artificial Sequence: Synthetic oligonucleotide
  Target: ATXN1; (-) strand; PAM type: NRG; PAM sequence: TGG
aaatgctctctgtatgttct

SEQ ID NO: 86353 - DNA, 20 bp, Artificial Sequence
  Description of Artificial Sequence: Synthetic oligonucleotide
  Target: ATXN1; (-) strand; PAM type: NRG; PAM sequence: TGG
tgcacattttgctggcactg

SEQ ID NO: 86354 - DNA, 20 bp, Artificial Sequence
  Description of Artificial Sequence: Synthetic oligonucleotide
  Target: ATXN1; (-) strand; PAM type: NRG; PAM sequence: TGG
gtctccattgcacattttgc

SEQ ID NO: 86355 - DNA, 20 bp, Artificial Sequence
  Description of Artificial Sequence: Synthetic oligonucleotide
  Target: ATXN1; (-) strand; PAM type: NRG; PAM sequence: TAG
ttcttataattgctgataaa

SEQ ID NO: 86356 - DNA, 20 bp, Artificial Sequence
  Description of Artificial Sequence: Synthetic oligonucleotide
  Target: ATXN1; (-) strand; PAM type: NRG; PAM sequence: CAG
ttatttggcatttaaatgca

SEQ ID NO: 86357 - DNA, 20 bp, Artificial Sequence
  Description of Artificial Sequence: Synthetic oligonucleotide
  Target: ATXN1; (-) strand; PAM type: NRG; PAM sequence: TGG
tgccacgtgtatattttatt

SEQ ID NO: 86358 - DNA, 20 bp, Artificial Sequence
  Description of Artificial Sequence: Synthetic oligonucleotide
  Target: ATXN1; (-) strand; PAM type: NRG; PAM sequence: AAG
tcatgcatcttttccccctc

SEQ ID NO: 86359 - DNA, 20 bp, Artificial Sequence
  Description of Artificial Sequence: Synthetic oligonucleotide
  Target: ATXN1; (-) strand; PAM type: NRG; PAM sequence: TGG
acattcagaagagcaaatat

SEQ ID NO: 86360 - DNA, 20 bp, Artificial Sequence
  Description of Artificial Sequence: Synthetic oligonucleotide
  Target: ATXN1; (-) strand; PAM type: NRG; PAM sequence: GAG
aggctctaatacattcagaa

SEQ ID NO: 86361 - DNA, 20 bp, Artificial Sequence
  Description of Artificial Sequence: Synthetic oligonucleotide
  Target: ATXN1; (-) strand; PAM type: NRG; PAM sequence: AAG
tcaggctctaatacattcag

SEQ ID NO: 86362 - DNA, 20 bp, Artificial Sequence
  Description of Artificial Sequence: Synthetic oligonucleotide
  Target: ATXN1; (-) strand; PAM type: NRG; PAM sequence: CAG
ttttcaggctctaatacatt

SEQ ID NO: 86363 - DNA, 20 bp, Artificial Sequence
  Description of Artificial Sequence: Synthetic oligonucleotide
  Target: ATXN1; (-) strand; PAM type: NRG; PAM sequence: AGG
tcagggggactttcgttttc

SEQ ID NO: 86364 - DNA, 20 bp, Artificial Sequence
  Description of Artificial Sequence: Synthetic oligonucleotide
  Target: ATXN1; (-) strand; PAM type: NRG; PAM sequence: CAG
ttcagggggactttcgtttt

SEQ ID NO: 86365 - DNA, 20 bp, Artificial Sequence
  Description of Artificial Sequence: Synthetic oligonucleotide
  Target: ATXN1; (-) strand; PAM type: NRG; PAM sequence: GGG
agattcgcttctggttcagg

SEQ ID NO: 86366 - DNA, 20 bp, Artificial Sequence
  Description of Artificial Sequence: Synthetic oligonucleotide
  Target: ATXN1; (-) strand; PAM type: NRG; PAM sequence: GGG
aagattcgcttctggttcag

SEQ ID NO: 86367 - DNA, 20 bp, Artificial Sequence
  Description of Artificial Sequence: Synthetic oligonucleotide
  Target: ATXN1; (-) strand; PAM type: NRG; PAM sequence: GGG
caagattcgcttctggttca

SEQ ID NO: 86368 - DNA, 20 bp, Artificial Sequence
  Description of Artificial Sequence: Synthetic oligonucleotide
  Target: ATXN1; (-) strand; PAM type: NRG; PAM sequence: AGG
tcaagattcgcttctggttc

SEQ ID NO: 86369 - DNA, 20 bp, Artificial Sequence
  Description of Artificial Sequence: Synthetic oligonucleotide
  Target: ATXN1; (-) strand; PAM type: NRG; PAM sequence: CAG
ttcaagattcgcttctggtt

SEQ ID NO: 86370 - DNA, 20 bp, Artificial Sequence
  Description of Artificial Sequence: Synthetic oligonucleotide
  Target: ATXN1; (-) strand; PAM type: NRG; PAM sequence: TGG
ctgagttcaagattcgcttc

SEQ ID NO: 86371 - DNA, 20 bp, Artificial Sequence
  Description of Artificial Sequence: Synthetic oligonucleotide
  Target: ATXN1; (-) strand; PAM type: NRG; PAM sequence: AAG
agctaactgagactgagttc

SEQ ID NO: 86372 - DNA, 20 bp, Artificial Sequence
  Description of Artificial Sequence: Synthetic oligonucleotide
  Target: ATXN1; (-) strand; PAM type: NRG; PAM sequence: GAG
taaccaagctaactgagact

SEQ ID NO: 86373 - DNA, 20 bp, Artificial Sequence
  Description of Artificial Sequence: Synthetic oligonucleotide
  Target: ATXN1; (-) strand; PAM type: NRG; PAM sequence: GAG
agcggctaaccaagctaact

SEQ ID NO: 86374 - DNA, 20 bp, Artificial Sequence
  Description of Artificial Sequence: Synthetic oligonucleotide
  Target: ATXN1; (-) strand; PAM type: NRG; PAM sequence: AAG
aaggagaacagcggctaacc

SEQ ID NO: 86375 - DNA, 20 bp, Artificial Sequence
  Description of Artificial Sequence: Synthetic oligonucleotide
  Target: ATXN1; (-) strand; PAM type: NRG; PAM sequence: CGG
ggcattcggaaggagaacag

SEQ ID NO: 86376 - DNA, 20 bp, Artificial Sequence
  Description of Artificial Sequence: Synthetic oligonucleotide
  Target: ATXN1; (-) strand; PAM type: NRG; PAM sequence: CAG
gggggcattcggaaggagaa

SEQ ID NO: 86377 - DNA, 20 bp, Artificial Sequence
  Description of Artificial Sequence: Synthetic oligonucleotide
  Target: ATXN1; (-) strand; PAM type: NRG; PAM sequence: GAG
ggtatgggggcattcggaag

SEQ ID NO: 86378 - DNA, 20 bp, Artificial Sequence
  Description of Artificial Sequence: Synthetic oligonucleotide
  Target: ATXN1; (-) strand; PAM type: NRG; PAM sequence: AGG
caggtatgggggcattcgga

SEQ ID NO: 86379 - DNA, 20 bp, Artificial Sequence
  Description of Artificial Sequence: Synthetic oligonucleotide
  Target: ATXN1; (-) strand; PAM type: NRG; PAM sequence: AAG
gcaggtatgggggcattcgg

SEQ ID NO: 86380 - DNA, 20 bp, Artificial Sequence
  Description of Artificial Sequence: Synthetic oligonucleotide
  Target: ATXN1; (-) strand; PAM type: NRG; PAM sequence: CGG
ttggcaggtatgggggcatt

SEQ ID NO: 86381 - DNA, 20 bp, Artificial Sequence
  Description of Artificial Sequence: Synthetic oligonucleotide
  Target: ATXN1; (-) strand; PAM type: NRG; PAM sequence: GGG
acagatgttggcaggtatgg

SEQ ID NO: 86382 - DNA, 20 bp, Artificial Sequence
  Description of Artificial Sequence: Synthetic oligonucleotide
  Target: ATXN1; (-) strand; PAM type: NRG; PAM sequence: GGG
tacagatgttggcaggtatg

SEQ ID NO: 86383 - DNA, 20 bp, Artificial Sequence
  Description of Artificial Sequence: Synthetic oligonucleotide
  Target: ATXN1; (-) strand; PAM type: NRG; PAM sequence: GGG
atacagatgttggcaggtat

SEQ ID NO: 86384 - DNA, 20 bp, Artificial Sequence
  Description of Artificial Sequence: Synthetic oligonucleotide
  Target: ATXN1; (-) strand; PAM type: NRG; PAM sequence: TGG
gatacagatgttggcaggta

SEQ ID NO: 86385 - DNA, 20 bp, Artificial Sequence
  Description of Artificial Sequence: Synthetic oligonucleotide
  Target: ATXN1; (-) strand; PAM type: NRG; PAM sequence: AGG
gttcagatacagatgttggc

SEQ ID NO: 86386 - DNA, 20 bp, Artificial Sequence
  Description of Artificial Sequence: Synthetic oligonucleotide
  Target: ATXN1; (-) strand; PAM type: NRG; PAM sequence: CAG
tgttcagatacagatgttgg

SEQ ID NO: 86387 - DNA, 20 bp, Artificial Sequence
  Description of Artificial Sequence: Synthetic oligonucleotide
  Target: ATXN1; (-) strand; PAM type: NRG; PAM sequence: TGG
gtgtgttcagatacagatgt

SEQ ID NO: 86388 - DNA, 20 bp, Artificial Sequence
  Description of Artificial Sequence: Synthetic oligonucleotide
  Target: ATXN1; (-) strand; PAM type: NRG; PAM sequence: CAG
acattgagtgtgttcagata

SEQ ID NO: 86389 - DNA, 20 bp, Artificial Sequence
  Description of Artificial Sequence: Synthetic oligonucleotide
  Target: ATXN1; (-) strand; PAM type: NRG; PAM sequence: CAG
gacccaacattgagtgtgtt

SEQ ID NO: 86390 - DNA, 20 bp, Artificial Sequence
  Description of Artificial Sequence: Synthetic oligonucleotide
  Target: ATXN1; (-) strand; PAM type: NRG; PAM sequence: GAG
cttatgttggacccaacatt

SEQ ID NO: 86391 - DNA, 20 bp, Artificial Sequence
  Description of Artificial Sequence: Synthetic oligonucleotide
  Target: ATXN1; (-) strand; PAM type: NRG; PAM sequence: TGG
agaagggaaattccttatgt

SEQ ID NO: 86392 - DNA, 20 bp, Artificial Sequence
  Description of Artificial Sequence: Synthetic oligonucleotide
  Target: ATXN1; (-) strand; PAM type: NRG; PAM sequence: GGG
tctttaataagaaagaagaa

SEQ ID NO: 86393 - DNA, 20 bp, Artificial Sequence
  Description of Artificial Sequence: Synthetic oligonucleotide
  Target: ATXN1; (-) strand; PAM type: NRG; PAM sequence: AGG
atctttaataagaaagaaga

SEQ ID NO: 86394 - DNA, 20 bp, Artificial Sequence
  Description of Artificial Sequence: Synthetic oligonucleotide
  Target: ATXN1; (-) strand; PAM type: NRG; PAM sequence: AAG
aatctttaataagaaagaag

SEQ ID NO: 86395 - DNA, 20 bp, Artificial Sequence
  Description of Artificial Sequence: Synthetic oligonucleotide
  Target: ATXN1; (-) strand; PAM type: NRG; PAM sequence: AAG
gggaatctttaataagaaag

SEQ ID NO: 86396 - DNA, 20 bp, Artificial Sequence
  Description of Artificial Sequence: Synthetic oligonucleotide
  Target: ATXN1; (-) strand; PAM type: NRG; PAM sequence: AAG
cctgggaatctttaataaga

SEQ ID NO: 86397 - DNA, 20 bp, Artificial Sequence
  Description of Artificial Sequence: Synthetic oligonucleotide
  Target: ATXN1; (-) strand; PAM type: NRG; PAM sequence: AAG
gaggcctgggaatctttaat

SEQ ID NO: 86398 - DNA, 20 bp, Artificial Sequence
  Description of Artificial Sequence: Synthetic oligonucleotide
  Target: ATXN1; (-) strand; PAM type: NRG; PAM sequence: GGG
agggggtgatgctgaggcct

SEQ ID NO: 86399 - DNA, 20 bp, Artificial Sequence
  Description of Artificial Sequence: Synthetic oligonucleotide
  Target: ATXN1; (-) strand; PAM type: NRG; PAM sequence: TGG
tagggggtgatgctgaggcc

SEQ ID NO: 86400 - DNA, 20 bp, Artificial Sequence
  Description of Artificial Sequence: Synthetic oligonucleotide
  Target: ATXN1; (-) strand; PAM type: NRG; PAM sequence: AGG
ttgggtagggggtgatgctg

SEQ ID NO: 86401 - DNA, 20 bp, Artificial Sequence
  Description of Artificial Sequence: Synthetic oligonucleotide
  Target: ATXN1; (-) strand; PAM type: NRG; PAM sequence: GAG
cttgggtagggggtgatgct

SEQ ID NO: 86402 - DNA, 20 bp, Artificial Sequence
  Description of Artificial Sequence: Synthetic oligonucleotide
  Target: ATXN1; (-) strand; PAM type: NRG; PAM sequence: GGG
tatccaagtgcttgggtagg

SEQ ID NO: 86403 - DNA, 20 bp, Artificial Sequence
  Description of Artificial Sequence: Synthetic oligonucleotide
  Target: ATXN1; (-) strand; PAM type: NRG; PAM sequence: GGG
ttatccaagtgcttgggtag

SEQ ID NO: 86404 - DNA, 20 bp, Artificial Sequence
  Description of Artificial Sequence: Synthetic oligonucleotide
  Target: ATXN1; (-) strand; PAM type: NRG; PAM sequence: GGG
attatccaagtgcttgggta

SEQ ID NO: 86405 - DNA, 20 bp, Artificial Sequence
  Description of Artificial Sequence: Synthetic oligonucleotide
  Target: ATXN1; (-) strand; PAM type: NRG; PAM sequence: AGG
aattatccaagtgcttgggt

SEQ ID NO: 86406 - DNA, 20 bp, Artificial Sequence
  Description of Artificial Sequence: Synthetic oligonucleotide
  Target: ATXN1; (-) strand; PAM type: NRG; PAM sequence: TAG
gaattatccaagtgcttggg

SEQ ID NO: 86407 - DNA, 20 bp, Artificial Sequence
  Description of Artificial Sequence: Synthetic oligonucleotide
  Target: ATXN1; (-) strand; PAM type: NRG; PAM sequence: GGG
actgaattatccaagtgctt

SEQ ID NO: 86408 - DNA, 20 bp, Artificial Sequence
  Description of Artificial Sequence: Synthetic oligonucleotide
  Target: ATXN1; (-) strand; PAM type: NRG; PAM sequence: TGG
tactgaattatccaagtgct

SEQ ID NO: 86409 - DNA, 20 bp, Artificial Sequence
  Description of Artificial Sequence: Synthetic oligonucleotide
  Target: ATXN1; (-) strand; PAM type: NRG; PAM sequence: AAG
tggcctctactgaattatcc

SEQ ID NO: 86410 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaagttctccccag

SEQ ID NO: 86411 - DNA, 20 bp, Artificial Sequence
  Description of Artificial Sequence: Synthetic oligonucleotide
  Target: ATXN1; (-) strand; PAM type: NRG; PAM sequence: CAG
caaaaaaaaaaagttctccc

SEQ ID NO: 86412 - DNA, 20 bp, Artificial Sequence
  Description of Artificial Sequence: Synthetic oligonucleotide
  Target: ATXN1; (-) strand; PAM type: NRG; PAM sequence: AAG
gactccatctcaaaaaaaaa

SEQ ID NO: 86413 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagt

SEQ ID NO: 86414 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtgaca

SEQ ID NO: 86415 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggtga

SEQ ID NO: 86416 - DNA, 20 bp, Artificial Sequence
  Description of Artificial Sequence: Synthetic oligonucleotide
  Target: ATXN1; (-) strand; PAM type: NRG; PAM sequence: GGG
gcatcactgcactccagcct

SEQ ID NO: 86417 - DNA, 20 bp, Artificial Sequence
  Description of Artificial Sequence: Synthetic oligonucleotide
  Target: ATXN1; (-) strand; PAM type: NRG; PAM sequence: TGG
tgcatcactgcactccagcc

SEQ ID NO: 86418 - DNA, 20 bp, Artificial Sequence
  Description of Artificial Sequence: Synthetic oligonucleotide
  Target: ATXN1; (-) strand; PAM type: NRG; PAM sequence: CAG
gagattgcatcactgcactc

SEQ ID NO: 86419 - DNA, 20 bp, Artificial Sequence
  Description of Artificial Sequence: Synthetic oligonucleotide
  Target: ATXN1; (-) strand; PAM type: NRG; PAM sequence: GAG
ggtggaggttgcagtgagct

SEQ ID NO: 86420 - DNA, 20 bp, Artificial Sequence
  Description of Artificial Sequence: Synthetic oligonucleotide
  Target: ATXN1; (-) strand; PAM type: NRG; PAM sequence: GAG
tgggaggtggaggttgcagt

SEQ ID NO: 86421 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggtggaggttg

SEQ ID NO: 86422 - DNA, 20 bp, Artificial Sequence
  Description of Artificial Sequence: Synthetic oligonucleotide
  Target: ATXN1; (-) strand; PAM type: NRG; PAM sequence: AGG
cacttgaacctgggaggtgg

SEQ ID NO: 86423 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacctgggaggtg

SEQ ID NO: 86424 - DNA, 20 bp, Artificial Sequence
  Description of Artificial Sequence: Synthetic oligonucleotide
  Target: ATXN1; (-) strand; PAM type: NRG; PAM sequence: TGG
aatcacttgaacctgggagg

SEQ ID NO: 86425 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttgaacctggg

SEQ ID NO: 86426 - DNA, 20 bp, Artificial Sequence
  Description of Artificial Sequence: Synthetic oligonucleotide
  Target: ATXN1; (-) strand; PAM type: NRG; PAM sequence: GAG
cgagaatcacttgaacctgg

SEQ ID NO: 86427 - DNA, 20 bp, Artificial Sequence
  Description of Artificial Sequence: Synthetic oligonucleotide
  Target: ATXN1; (-) strand; PAM type: NRG; PAM sequence: GGG
cacgagaatcacttgaacct

SEQ ID NO: 86428 - DNA, 20 bp, Artificial Sequence
  Description of Artificial Sequence: Synthetic oligonucleotide
  Target: ATXN1; (-) strand; PAM type: NRG; PAM sequence: TGG
gcacgagaatcacttgaacc

SEQ ID NO: 86429 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcac

SEQ ID NO: 86430 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 86431 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 86432 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 86433 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 86434 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagctactt

SEQ ID NO: 86435 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagctact

SEQ ID NO: 86436 - DNA, 20 bp, Artificial Sequence
  Description of Artificial Sequence: Synthetic oligonucleotide
  Target: ATXN1; (-) strand; PAM type: NRG; PAM sequence: CAG
gtggtgcacacctgtaatcc

SEQ ID NO: 86437 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctgggtgtgg

SEQ ID NO: 86438 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagctgggtg

SEQ ID NO: 86439 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattagct

SEQ ID NO: 86440 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaattagc

SEQ ID NO: 86441 - DNA, 20 bp, Artificial Sequence
  Description of Artificial Sequence: Synthetic oligonucleotide
  Target: ATXN1; (-) strand; PAM type: NRG; PAM sequence: TAG
tttactaaaaatacaaaaat

SEQ ID NO: 86442 - DNA, 20 bp, Artificial Sequence
  Description of Artificial Sequence: Synthetic oligonucleotide
  Target: ATXN1; (-) strand; PAM type: NRG; PAM sequence: TGG
cgagacaagcctggccatca

SEQ ID NO: 86443 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagacaagcc

SEQ ID NO: 86444 - DNA, 20 bp, Artificial Sequence
  Description of Artificial Sequence: Synthetic oligonucleotide
  Target: ATXN1; (-) strand; PAM type: NRG; PAM sequence: AAG
tgaggtcaggagttcgagac

SEQ ID NO: 86445 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 86446 - DNA, 20 bp, Artificial Sequence
  Description of Artificial Sequence: Synthetic oligonucleotide
  Target: ATXN1; (-) strand; PAM type: NRG; PAM sequence: GAG
gacagatcacctgaggtcag

SEQ ID NO: 86447 - DNA, 20 bp, Artificial Sequence
  Description of Artificial Sequence: Synthetic oligonucleotide
  Target: ATXN1; (-) strand; PAM type: NRG; PAM sequence: AGG
cggacagatcacctgaggtc

SEQ ID NO: 86448 - DNA, 20 bp, Artificial Sequence
  Description of Artificial Sequence: Synthetic oligonucleotide
  Target: ATXN1; (-) strand; PAM type: NRG; PAM sequence: CAG
gcggacagatcacctgaggt

SEQ ID NO: 86449 - DNA, 20 bp, Artificial Sequence
  Description of Artificial Sequence: Synthetic oligonucleotide
  Target: ATXN1; (-) strand; PAM type: NRG; PAM sequence: AGG
cgaggcggacagatcacctg

SEQ ID NO: 86450 - DNA, 20 bp, Artificial Sequence
  Description of Artificial Sequence: Synthetic oligonucleotide
  Target: ATXN1; (-) strand; PAM type: NRG; PAM sequence: GAG
ccgaggcggacagatcacct

SEQ ID NO: 86451 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggccgaggcgga

SEQ ID NO: 86452 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggccgagg

SEQ ID NO: 86453 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 86454 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 86455 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 86456 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 86457 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 86458 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 86459 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 86460 - DNA, 20 bp, Artificial Sequence
  Description of Artificial Sequence: Synthetic oligonucleotide
  Target: ATXN1; (-) strand; PAM type: NRG; PAM sequence: TGG
cccagagaggccaggcgcgg

SEQ ID NO: 86461 - DNA, 20 bp, Artificial Sequence
  Description of Artificial Sequence: Synthetic oligonucleotide
  Target: ATXN1; (-) strand; PAM type: NRG; PAM sequence: CGG
aaccccagagaggccaggcg

SEQ ID NO: 86462 - DNA, 20 bp, Artificial Sequence
  Description of Artificial Sequence: Synthetic oligonucleotide
  Target: ATXN1; (-) strand; PAM type: NRG; PAM sequence: AGG
cagaaaaccccagagaggcc

SEQ ID NO: 86463 - DNA, 20 bp, Artificial Sequence
  Description of Artificial Sequence: Synthetic oligonucleotide
  Target: ATXN1; (-) strand; PAM type: NRG; PAM sequence: CAG
tcagaaaaccccagagaggc

SEQ ID NO: 86464 - DNA, 20 bp, Artificial Sequence
  Description of Artificial Sequence: Synthetic oligonucleotide
  Target: ATXN1; (-) strand; PAM type: NRG; PAM sequence: AGG
ggcttcagaaaaccccagag

SEQ ID NO: 86465 - DNA, 20 bp, Artificial Sequence
  Description of Artificial Sequence: Synthetic oligonucleotide
  Target: ATXN1; (-) strand; PAM type: NRG; PAM sequence: GAG
tggcttcagaaaaccccaga

SEQ ID NO: 86466 - DNA, 20 bp, Artificial Sequence
  Description of Artificial Sequence: Synthetic oligonucleotide
  Target: ATXN1; (-) strand; PAM type: NRG; PAM sequence: GAG
tgtggcttcagaaaacccca

SEQ ID NO: 86467 - DNA, 20 bp, Artificial Sequence
  Description of Artificial Sequence: Synthetic oligonucleotide
  Target: ATXN1; (-) strand; PAM type: NRG; PAM sequence: CAG
tatgtggcttcagaaaaccc

SEQ ID NO: 86468 - DNA, 20 bp, Artificial Sequence
  Description of Artificial Sequence: Synthetic oligonucleotide
  Target: ATXN1; (-) strand; PAM type: NRG; PAM sequence: CAG
catgtaagtctatgtggctt

SEQ ID NO: 86469 - DNA, 20 bp, Artificial Sequence
  Description of Artificial Sequence: Synthetic oligonucleotide
  Target: ATXN1; (-) strand; PAM type: NRG; PAM sequence: TGG
ctcaaacatgtaagtctatg

SEQ ID NO: 86470 - DNA, 20 bp, Artificial Sequence
  Description of Artificial Sequence: Synthetic oligonucleotide
  Target: ATXN1; (-) strand; PAM type: NRG; PAM sequence: AAG
tgggaaatcctcaaacatgt

SEQ ID NO: 86471 - DNA, 20 bp, Artificial Sequence
  Description of Artificial Sequence: Synthetic oligonucleotide
  Target: ATXN1; (-) strand; PAM type: NRG; PAM sequence: GGG
tgttctttaggactttgaat

SEQ ID NO: 86472 - DNA, 20 bp, Artificial Sequence
  Description of Artificial Sequence: Synthetic oligonucleotide
  Target: ATXN1; (-) strand; PAM type: NRG; PAM sequence: TGG
gtgttctttaggactttgaa

SEQ ID NO: 86473 - DNA, 20 bp, Artificial Sequence
  Description of Artificial Sequence: Synthetic oligonucleotide
  Target: ATXN1; (-) strand; PAM type: NRG; PAM sequence: AGG
ttcttctattagtgttcttt

SEQ ID NO: 86474 - DNA, 20 bp, Artificial Sequence
  Description of Artificial Sequence: Synthetic oligonucleotide
  Target: ATXN1; (-) strand; PAM type: NRG; PAM sequence: TAG
tttcttctattagtgttctt

SEQ ID NO: 86475 - DNA, 20 bp, Artificial Sequence
  Description of Artificial Sequence: Synthetic oligonucleotide
  Target: ATXN1; (-) strand; PAM type: NRG; PAM sequence: TAG
ttcctttctttttcttctat

SEQ ID NO: 86476 - DNA, 20 bp, Artificial Sequence
  Description of Artificial Sequence: Synthetic oligonucleotide
  Target: ATXN1; (-) strand; PAM type: NRG; PAM sequence: GGG
atgtatgtgaatgtgactaa

SEQ ID NO: 86477 - DNA, 20 bp, Artificial Sequence
  Description of Artificial Sequence: Synthetic oligonucleotide
  Target: ATXN1; (-) strand; PAM type: NRG; PAM sequence: AGG
aatgtatgtgaatgtgacta

SEQ ID NO: 86478 - DNA, 20 bp, Artificial Sequence
  Description of Artificial Sequence: Synthetic oligonucleotide
  Target: ATXN1; (-) strand; PAM type: NRG; PAM sequence: AAG
caatgtatgtgaatgtgact

SEQ ID NO: 86479 - DNA, 20 bp, Artificial Sequence
  Description of Artificial Sequence: Synthetic oligonucleotide
  Target: ATXN1; (-) strand; PAM type: NRG; PAM sequence: GGG
atttgtcactggcttatcat

SEQ ID NO: 86480 - DNA, 20 bp, Artificial Sequence
  Description of Artificial Sequence: Synthetic oligonucleotide
  Target: ATXN1; (-) strand; PAM type: NRG; PAM sequence: TGG
tatttgtcactggcttatca

SEQ ID NO: 86481 - DNA, 20 bp, Artificial Sequence
  Description of Artificial Sequence: Synthetic oligonucleotide
  Target: ATXN1; (-) strand; PAM type: NRG; PAM sequence: TGG
acttcaattatatttgtcac

SEQ ID NO: 86482 - DNA, 20 bp, Artificial Sequence
  Description of Artificial Sequence: Synthetic oligonucleotide
  Target: ATXN1; (-) strand; PAM type: NRG; PAM sequence: TAG
tcctgctgggaggtttcaag

SEQ ID NO: 86483 - DNA, 20 bp, Artificial Sequence
  Description of Artificial Sequence: Synthetic oligonucleotide
  Target: ATXN1; (-) strand; PAM type: NRG; PAM sequence: AAG
ttttcctgctgggaggtttc

SEQ ID NO: 86484 - DNA, 20 bp, Artificial Sequence
  Description of Artificial Sequence: Synthetic oligonucleotide
  Target: ATXN1; (-) strand; PAM type: NRG; PAM sequence: AGG
tttcttgttttcctgctggg

SEQ ID NO: 86485 - DNA, 20 bp, Artificial Sequence
  Description of Artificial Sequence: Synthetic oligonucleotide
  Target: ATXN1; (-) strand; PAM type: NRG; PAM sequence: GAG
atttcttgttttcctgctgg

SEQ ID NO: 86486 - DNA, 20 bp, Artificial Sequence
  Description of Artificial Sequence: Synthetic oligonucleotide
  Target: ATXN1; (-) strand; PAM type: NRG; PAM sequence: GGG
ttatttcttgttttcctgct

SEQ ID NO: 86487 - DNA, 20 bp, Artificial Sequence
  Description of Artificial Sequence: Synthetic oligonucleotide
  Target: ATXN1; (-) strand; PAM type: NRG; PAM sequence: TGG
cttatttcttgttttcctgc

SEQ ID NO: 86488 - DNA, 20 bp, Artificial Sequence
  Description of Artificial Sequence: Synthetic oligonucleotide
  Target: ATXN1; (-) strand; PAM type: NRG; PAM sequence: TGG
agacctggatctcttcctca

SEQ ID NO: 86489 - DNA, 20 bp, Artificial Sequence
  Description of Artificial Sequence: Synthetic oligonucleotide
  Target: ATXN1; (-) strand; PAM type: NRG; PAM sequence: TGG
gtacagtaaatgtggagacc

SEQ ID NO: 86490 - DNA, 20 bp, Artificial Sequence
  Description of Artificial Sequence: Synthetic oligonucleotide
  Target: ATXN1; (-) strand; PAM type: NRG; PAM sequence: GAG
ttacttgtacagtaaatgtg

SEQ ID NO: 86491 - DNA, 20 bp, Artificial Sequence
  Description of Artificial Sequence: Synthetic oligonucleotide
  Target: ATXN1; (-) strand; PAM type: NRG; PAM sequence: TGG
tattacttgtacagtaaatg

SEQ ID NO: 86492 - DNA, 20 bp, Artificial Sequence
  Description of Artificial Sequence: Synthetic oligonucleotide
  Target: ATXN1; (-) strand; PAM type: NRG; PAM sequence: CAG
tgcttatgttattacttgta

SEQ ID NO: 86493 - DNA, 20 bp, Artificial Sequence
  Description of Artificial Sequence: Synthetic oligonucleotide
  Target: ATXN1; (-) strand; PAM type: NRG; PAM sequence: AAG
tactataaaacactcttagg

SEQ ID NO: 86494 - DNA, 20 bp, Artificial Sequence
  Description of Artificial Sequence: Synthetic oligonucleotide
  Target: ATXN1; (-) strand; PAM type: NRG; PAM sequence: AGG
aaatactataaaacactctt

SEQ ID NO: 86495 - DNA, 20 bp, Artificial Sequence
  Description of Artificial Sequence: Synthetic oligonucleotide
  Target: ATXN1; (-) strand; PAM type: NRG; PAM sequence: TAG
aaaatactataaaacactct

SEQ ID NO: 86496 - DNA, 20 bp, Artificial Sequence
  Description of Artificial Sequence: Synthetic oligonucleotide
  Target: ATXN1; (-) strand; PAM type: NRG; PAM sequence: GAG
attaacagactggagagtaa

SEQ ID NO: 86497 - DNA, 20 bp, Artificial Sequence
  Description of Artificial Sequence: Synthetic oligonucleotide
  Target: ATXN1; (-) strand; PAM type: NRG; PAM sequence: AAG
ggattaacagactggagagt

SEQ ID NO: 86498 - DNA, 20 bp, Artificial Sequence
  Description of Artificial Sequence: Synthetic oligonucleotide
  Target: ATXN1; (-) strand; PAM type: NRG; PAM sequence: GAG
gtgaggattaacagactgga

SEQ ID NO: 86499 - DNA, 20 bp, Artificial Sequence
  Description of Artificial Sequence: Synthetic oligonucleotide
  Target: ATXN1; (-) strand; PAM type: NRG; PAM sequence: GAG
aagtgaggattaacagactg

SEQ ID NO: 86500 - DNA, 20 bp, Artificial Sequence
  Description of Artificial Sequence: Synthetic oligonucleotide
  Target: ATXN1; (-) strand; PAM type: NRG; PAM sequence: TGG
gaaagtgaggattaacagac

SEQ ID NO: 86501 - DNA, 20 bp, Artificial Sequence
  Description of Artificial Sequence: Synthetic oligonucleotide
  Target: ATXN1; (-) strand; PAM type: NRG; PAM sequence: CAG
agcgggaaagtgaggattaa

SEQ ID NO: 86502 - DNA, 20 bp, Artificial Sequence
  Description of Artificial Sequence: Synthetic oligonucleotide
  Target: ATXN1; (-) strand; PAM type: NRG; PAM sequence: AGG
tgaatagaagcgggaaagtg

SEQ ID NO: 86503 - DNA, 20 bp, Artificial Sequence
  Description of Artificial Sequence: Synthetic oligonucleotide
  Target: ATXN1; (-) strand; PAM type: NRG; PAM sequence: GAG
atgaatagaagcgggaaagt

SEQ ID NO: 86504 - DNA, 20 bp, Artificial Sequence
  Description of Artificial Sequence: Synthetic oligonucleotide
  Target: ATXN1; (-) strand; PAM type: NRG; PAM sequence: AAG
gcatatgaatagaagcggga

SEQ ID NO: 86505 - DNA, 20 bp, Artificial Sequence
  Description of Artificial Sequence: Synthetic oligonucleotide
  Target: ATXN1; (-) strand; PAM type: NRG; PAM sequence: GGG
taaagcatatgaatagaagc

SEQ ID NO: 86506 - DNA, 20 bp, Artificial Sequence
  Description of Artificial Sequence: Synthetic oligonucleotide
  Target: ATXN1; (-) strand; PAM type: NRG; PAM sequence: CGG
ataaagcatatgaatagaag

SEQ ID NO: 86507 - DNA, 20 bp, Artificial Sequence
  Description of Artificial Sequence: Synthetic oligonucleotide
  Target: ATXN1; (-) strand; PAM type: NRG; PAM sequence: AAG
catataaagcatatgaatag

SEQ ID NO: 86508 - DNA, 20 bp, Artificial Sequence
  Description of Artificial Sequence: Synthetic oligonucleotide
  Target: ATXN1; (-) strand; PAM type: NRG; PAM sequence: TAG
atacatataaagcatatgaa

SEQ ID NO: 86509 - DNA, 20 bp, Artificial Sequence
  Description of Artificial Sequence: Synthetic oligonucleotide
  Target: ATXN1; (-) strand; PAM type: NRG; PAM sequence: AAG
tcaacaaataaatacatata

SEQ ID NO: 86510 - DNA, 20 bp, Artificial Sequence
  Description of Artificial Sequence: Synthetic oligonucleotide
  Target: ATXN1; (-) strand; PAM type: NRG; PAM sequence: CAG
aataactgtcattccaagtt

SEQ ID NO: 86511 - DNA, 20 bp, Artificial Sequence
  Description of Artificial Sequence: Synthetic oligonucleotide
  Target: ATXN1; (-) strand; PAM type: NRG; PAM sequence: AAG
ttaaaaataactgtcattcc

SEQ ID NO: 86512 - DNA, 20 bp, Artificial Sequence
  Description of Artificial Sequence: Synthetic oligonucleotide
  Target: ATXN1; (-) strand; PAM type: NRG; PAM sequence: TAG
ttcttcctgacccatgttgg

SEQ ID NO: 86513 - DNA, 20 bp, Artificial Sequence
  Description of Artificial Sequence: Synthetic oligonucleotide
  Target: ATXN1; (-) strand; PAM type: NRG; PAM sequence: TGG
aggttcttcctgacccatgt

SEQ ID NO: 86514 - DNA, 20 bp, Artificial Sequence
  Description of Artificial Sequence: Synthetic oligonucleotide
  Target: ATXN1; (-) strand; PAM type: NRG; PAM sequence: AGG
aactgtgagccaggtttctg

SEQ ID NO: 86515 - DNA, 20 bp, Artificial Sequence
  Description of Artificial Sequence: Synthetic oligonucleotide
  Target: ATXN1; (-) strand; PAM type: NRG; PAM sequence: GAG
caactgtgagccaggtttct

SEQ ID NO: 86516 - DNA, 20 bp, Artificial Sequence
  Description of Artificial Sequence: Synthetic oligonucleotide
  Target: ATXN1; (-) strand; PAM type: NRG; PAM sequence: AGG
tgccagagcaactgtgagcc

SEQ ID NO: 86517 - DNA, 20 bp, Artificial Sequence
  Description of Artificial Sequence: Synthetic oligonucleotide
  Target: ATXN1; (-) strand; PAM type: NRG; PAM sequence: CAG
atgccagagcaactgtgagc

SEQ ID NO: 86518 - DNA, 20 bp, Artificial Sequence
  Description of Artificial Sequence: Synthetic oligonucleotide
  Target: ATXN1; (-) strand; PAM type: NRG; PAM sequence: GAG
ttttatgccagagcaactgt

SEQ ID NO: 86519 - DNA, 20 bp, Artificial Sequence
  Description of Artificial Sequence: Synthetic oligonucleotide
  Target: ATXN1; (-) strand; PAM type: NRG; PAM sequence: GAG
ggtcaaggctttttatgcca

SEQ ID NO: 86520 - DNA, 20 bp, Artificial Sequence
  Description of Artificial Sequence: Synthetic oligonucleotide
  Target: ATXN1; (-) strand; PAM type: NRG; PAM sequence: CAG
gcggtcaaggctttttatgc

SEQ ID NO: 86521 - DNA, 20 bp, Artificial Sequence
  Description of Artificial Sequence: Synthetic oligonucleotide
  Target: ATXN1; (-) strand; PAM type: NRG; PAM sequence: AGG
ctggttggttttggcggtca

SEQ ID NO: 86522 - DNA, 20 bp, Artificial Sequence
  Description of Artificial Sequence: Synthetic oligonucleotide
  Target: ATXN1; (-) strand; PAM type: NRG; PAM sequence: AAG
cctggttggttttggcggtc

SEQ ID NO: 86523 - DNA, 20 bp, Artificial Sequence
  Description of Artificial Sequence: Synthetic oligonucleotide
  Target: ATXN1; (-) strand; PAM type: NRG; PAM sequence: CGG
aactccctggttggttttgg

SEQ ID NO: 86524 - DNA, 20 bp, Artificial Sequence
  Description of Artificial Sequence: Synthetic oligonucleotide
  Target: ATXN1; (-) strand; PAM type: NRG; PAM sequence: TGG
atcaactccctggttggttt

SEQ ID NO: 86525 - DNA, 20 bp, Artificial Sequence
  Description of Artificial Sequence: Synthetic oligonucleotide
  Target: ATXN1; (-) strand; PAM type: NRG; PAM sequence: TGG
gatctcatcaactccctggt

SEQ ID NO: 86526 - DNA, 20 bp, Artificial Sequence
  Description of Artificial Sequence: Synthetic oligonucleotide
  Target: ATXN1; (-) strand; PAM type: NRG; PAM sequence: TGG
cctagatctcatcaactccc

SEQ ID NO: 86527 - DNA, 20 bp, Artificial Sequence
  Description of Artificial Sequence: Synthetic oligonucleotide
  Target: ATXN1; (-) strand; PAM type: NRG; PAM sequence: TAG
ttcgtggtgttttggaaacc

SEQ ID NO: 86528 - DNA, 20 bp, Artificial Sequence
  Description of Artificial Sequence: Synthetic oligonucleotide
  Target: ATXN1; (-) strand; PAM type: NRG; PAM sequence: TGG
gatgccttttcgtggtgttt

SEQ ID NO: 86529 - DNA, 20 bp, Artificial Sequence
  Description of Artificial Sequence: Synthetic oligonucleotide
  Target: ATXN1; (-) strand; PAM type: NRG; PAM sequence: TGG
aagcaaaagatgccttttcg

SEQ ID NO: 86530 - DNA, 20 bp, Artificial Sequence
  Description of Artificial Sequence: Synthetic oligonucleotide
  Target: ATXN1; (-) strand; PAM type: NRG; PAM sequence: AAG
ggccagatgggagaaagcaa

SEQ ID NO: 86531 - DNA, 20 bp, Artificial Sequence
  Description of Artificial Sequence: Synthetic oligonucleotide
  Target: ATXN1; (-) strand; PAM type: NRG; PAM sequence: AAG
tttaatggccagatgggaga

SEQ ID NO: 86532 - DNA, 20 bp, Artificial Sequence
  Description of Artificial Sequence: Synthetic oligonucleotide
  Target: ATXN1; (-) strand; PAM type: NRG; PAM sequence: GAG
tttttttaatggccagatgg

SEQ ID NO: 86533 - DNA, 20 bp, Artificial Sequence
  Description of Artificial Sequence: Synthetic oligonucleotide
  Target: ATXN1; (-) strand; PAM type: NRG; PAM sequence: GGG
tttttttttaatggccagat

SEQ ID NO: 86534 - DNA, 20 bp, Artificial Sequence
  Description of Artificial Sequence: Synthetic oligonucleotide
  Target: ATXN1; (-) strand; PAM type: NRG; PAM sequence: TGG
ttttttttttaatggccaga

SEQ ID NO: 86535 - DNA, 20 bp, Artificial Sequence
  Description of Artificial Sequence: Synthetic oligonucleotide
  Target: ATXN1; (-) strand; PAM type: NRG; PAM sequence: CAG
ctatttttttttttaatggc

SEQ ID NO: 86536 - DNA, 20 bp, Artificial Sequence
  Description of Artificial Sequence: Synthetic oligonucleotide
  Target: ATXN1; (-) strand; PAM type: NRG; PAM sequence: TGG
ataactatttttttttttaa

SEQ ID NO: 86537 - DNA, 20 bp, Artificial Sequence
  Description of Artificial Sequence: Synthetic oligonucleotide
  Target: ATXN1; (-) strand; PAM type: NRG; PAM sequence: TGG
attacaaaaagaatcttctt

SEQ ID NO: 86538 - DNA, 20 bp, Artificial Sequence
  Description of Artificial Sequence: Synthetic oligonucleotide
  Target: ATXN1; (-) strand; PAM type: NRG; PAM sequence: AAG
gtgattgattgtattacaaa

SEQ ID NO: 86539 - DNA, 20 bp, Artificial Sequence
  Description of Artificial Sequence: Synthetic oligonucleotide
  Target: ATXN1; (-) strand; PAM type: NRG; PAM sequence: AAG
tgaaccctaaacacaggagg

SEQ ID NO: 86540 - DNA, 20 bp, Artificial Sequence
  Description of Artificial Sequence: Synthetic oligonucleotide
  Target: ATXN1; (-) strand; PAM type: NRG; PAM sequence: AGG
atttgaaccctaaacacagg

SEQ ID NO: 86541 - DNA, 20 bp, Artificial Sequence
  Description of Artificial Sequence: Synthetic oligonucleotide
  Target: ATXN1; (-) strand; PAM type: NRG; PAM sequence: GAG
gatttgaaccctaaacacag

SEQ ID NO: 86542 - DNA, 20 bp, Artificial Sequence
  Description of Artificial Sequence: Synthetic oligonucleotide
  Target: ATXN1; (-) strand; PAM type: NRG; PAM sequence: AGG
tagatttgaaccctaaacac

SEQ ID NO: 86543 - DNA, 20 bp, Artificial Sequence
  Description of Artificial Sequence: Synthetic oligonucleotide
  Target: ATXN1; (-) strand; PAM type: NRG; PAM sequence: CAG
ctagatttgaaccctaaaca

SEQ ID NO: 86544 - DNA, 20 bp, Artificial Sequence
  Description of Artificial Sequence: Synthetic oligonucleotide
  Target: ATXN1; (-) strand; PAM type: NRG; PAM sequence: TAG
tagactgacatatggacttc

SEQ ID NO: 86545 - DNA, 20 bp, Artificial Sequence
  Description of Artificial Sequence: Synthetic oligonucleotide
  Target: ATXN1; (-) strand; PAM type: NRG; PAM sequence: TGG
ctctaagctagactgacata

SEQ ID NO: 86546 - DNA, 20 bp, Artificial Sequence
  Description of Artificial Sequence: Synthetic oligonucleotide
  Target: ATXN1; (-) strand; PAM type: NRG; PAM sequence: TAG
agctacattttgctctaagc

SEQ ID NO: 86547 - DNA, 20 bp, Artificial Sequence
  Description of Artificial Sequence: Synthetic oligonucleotide
  Target: ATXN1; (-) strand; PAM type: NRG; PAM sequence: AAG
agaaagctacattttgctct

SEQ ID NO: 86548 - DNA, 20 bp, Artificial Sequence
  Description of Artificial Sequence: Synthetic oligonucleotide
  Target: ATXN1; (-) strand; PAM type: NRG; PAM sequence: AAG
gttctagtccaaggtgaaga

SEQ ID NO: 86549 - DNA, 20 bp, Artificial Sequence
  Description of Artificial Sequence: Synthetic oligonucleotide
  Target: ATXN1; (-) strand; PAM type: NRG; PAM sequence: AAG
ggttgttctagtccaaggtg

SEQ ID NO: 86550 - DNA, 20 bp, Artificial Sequence
  Description of Artificial Sequence: Synthetic oligonucleotide
  Target: ATXN1; (-) strand; PAM type: NRG; PAM sequence: AGG
tcataggttgttctagtcca

SEQ ID NO: 86551 - DNA, 20 bp, Artificial Sequence
  Description of Artificial Sequence: Synthetic oligonucleotide
  Target: ATXN1; (-) strand; PAM type: NRG; PAM sequence: AAG
ctcataggttgttctagtcc

SEQ ID NO: 86552 - DNA, 20 bp, Artificial Sequence
  Description of Artificial Sequence: Synthetic oligonucleotide
  Target: ATXN1; (-) strand; PAM type: NRG; PAM sequence: TAG
ctttctctcataggttgttc

SEQ ID NO: 86553 - DNA, 20 bp, Artificial Sequence
  Description of Artificial Sequence: Synthetic oligonucleotide
  Target: ATXN1; (-) strand; PAM type: NRG; PAM sequence: AGG
gggcaccatctttctctcat

SEQ ID NO: 86554 - DNA, 20 bp, Artificial Sequence
  Description of Artificial Sequence: Synthetic oligonucleotide
  Target: ATXN1; (-) strand; PAM type: NRG; PAM sequence: TAG
tgggcaccatctttctctca

SEQ ID NO: 86555 - DNA, 20 bp, Artificial Sequence
  Description of Artificial Sequence: Synthetic oligonucleotide
  Target: ATXN1; (-) strand; PAM type: NRG; PAM sequence: GGG
cagctgtgtgctggcccatt

SEQ ID NO: 86556 - DNA, 20 bp, Artificial Sequence
  Description of Artificial Sequence: Synthetic oligonucleotide
  Target: ATXN1; (-) strand; PAM type: NRG; PAM sequence: TGG
gcagctgtgtgctggcccat

SEQ ID NO: 86557 - DNA, 20 bp, Artificial Sequence
  Description of Artificial Sequence: Synthetic oligonucleotide
  Target: ATXN1; (-) strand; PAM type: NRG; PAM sequence: TGG
tttagaaagcagctgtgtgc

SEQ ID NO: 86558 - DNA, 20 bp, Artificial Sequence
  Description of Artificial Sequence: Synthetic oligonucleotide
  Target: ATXN1; (-) strand; PAM type: NRG; PAM sequence: CAG
agggctgtcaatttagaaag

SEQ ID NO: 86559 - DNA, 20 bp, Artificial Sequence
  Description of Artificial Sequence: Synthetic oligonucleotide
  Target: ATXN1; (-) strand; PAM type: NRG; PAM sequence: AAG
ctcagggctgtcaatttaga

SEQ ID NO: 86560 - DNA, 20 bp, Artificial Sequence
  Description of Artificial Sequence: Synthetic oligonucleotide
  Target: ATXN1; (-) strand; PAM type: NRG; PAM sequence: TAG
gaagctcagggctgtcaatt

SEQ ID NO: 86561 - DNA, 20 bp, Artificial Sequence
  Description of Artificial Sequence: Synthetic oligonucleotide
  Target: ATXN1; (-) strand; PAM type: NRG; PAM sequence: GGG
actgtccatggagaagctca

SEQ ID NO: 86562 - DNA, 20 bp, Artificial Sequence
  Description of Artificial Sequence: Synthetic oligonucleotide
  Target: ATXN1; (-) strand; PAM type: NRG; PAM sequence: AGG
cactgtccatggagaagctc

SEQ ID NO: 86563 - DNA, 20 bp, Artificial Sequence
  Description of Artificial Sequence: Synthetic oligonucleotide
  Target: ATXN1; (-) strand; PAM type: NRG; PAM sequence: CAG
acactgtccatggagaagct

SEQ ID NO: 86564 - DNA, 20 bp, Artificial Sequence
  Description of Artificial Sequence: Synthetic oligonucleotide
  Target: ATXN1; (-) strand; PAM type: NRG; PAM sequence: AAG
ttggaacactgtccatggag

SEQ ID NO: 86565 - DNA, 20 bp, Artificial Sequence
  Description of Artificial Sequence: Synthetic oligonucleotide
  Target: ATXN1; (-) strand; PAM type: NRG; PAM sequence: GAG
gttttggaacactgtccatg

SEQ ID NO: 86566 - DNA, 20 bp, Artificial Sequence
  Description of Artificial Sequence: Synthetic oligonucleotide
  Target: ATXN1; (-) strand; PAM type: NRG; PAM sequence: TGG
tagttttggaacactgtcca

SEQ ID NO: 86567 - DNA, 20 bp, Artificial Sequence
  Description of Artificial Sequence: Synthetic oligonucleotide
  Target: ATXN1; (-) strand; PAM type: NRG; PAM sequence: TGG
ctaacagccacagttagttt

SEQ ID NO: 86568 - DNA, 20 bp, Artificial Sequence
  Description of Artificial Sequence: Synthetic oligonucleotide
  Target: ATXN1; (-) strand; PAM type: NRG; PAM sequence: TAG
tttatcctaacagccacagt

SEQ ID NO: 86569 - DNA, 20 bp, Artificial Sequence
  Description of Artificial Sequence: Synthetic oligonucleotide
  Target: ATXN1; (-) strand; PAM type: NRG; PAM sequence: CAG
cctctttatcctaacagcca

SEQ ID NO: 86570 - DNA, 20 bp, Artificial Sequence
  Description of Artificial Sequence: Synthetic oligonucleotide
  Target: ATXN1; (-) strand; PAM type: NRG; PAM sequence: CAG
aactgccctctttatcctaa

SEQ ID NO: 86571 - DNA, 20 bp, Artificial Sequence
  Description of Artificial Sequence: Synthetic oligonucleotide
  Target: ATXN1; (-) strand; PAM type: NRG; PAM sequence: GAG
accttaaaggcactgaagct

SEQ ID NO: 86572 - DNA, 20 bp, Artificial Sequence
  Description of Artificial Sequence: Synthetic oligonucleotide
  Target: ATXN1; (-) strand; PAM type: NRG; PAM sequence: AAG
aaataaccttaaaggcactg

SEQ ID NO: 86573 - DNA, 20 bp, Artificial Sequence
  Description of Artificial Sequence: Synthetic oligonucleotide
  Target: ATXN1; (-) strand; PAM type: NRG; PAM sequence: AGG
gaaagttgaaataaccttaa

SEQ ID NO: 86574 - DNA, 20 bp, Artificial Sequence
  Description of Artificial Sequence: Synthetic oligonucleotide
  Target: ATXN1; (-) strand; PAM type: NRG; PAM sequence: AAG
ggaaagttgaaataacctta

SEQ ID NO: 86575 - DNA, 20 bp, Artificial Sequence
  Description of Artificial Sequence: Synthetic oligonucleotide
  Target: ATXN1; (-) strand; PAM type: NRG; PAM sequence: AAG
gcgtagttaacagaggtgga

SEQ ID NO: 86576 - DNA, 20 bp, Artificial Sequence
  Description of Artificial Sequence: Synthetic oligonucleotide
  Target: ATXN1; (-) strand; PAM type: NRG; PAM sequence: TGG
tgcagcgtagttaacagagg

SEQ ID NO: 86577 - DNA, 20 bp, Artificial Sequence
  Description of Artificial Sequence: Synthetic oligonucleotide
  Target: ATXN1; (-) strand; PAM type: NRG; PAM sequence: AGG
ttctgcagcgtagttaacag

SEQ ID NO: 86578 - DNA, 20 bp, Artificial Sequence
  Description of Artificial Sequence: Synthetic oligonucleotide
  Target: ATXN1; (-) strand; PAM type: NRG; PAM sequence: GAG
tttctgcagcgtagttaaca

SEQ ID NO: 86579 - DNA, 20 bp, Artificial Sequence
  Description of Artificial Sequence: Synthetic oligonucleotide
  Target: ATXN1; (-) strand; PAM type: NRG; PAM sequence: CAG
agtttctgcagcgtagttaa

SEQ ID NO: 86580 - DNA, 20 bp, Artificial Sequence
  Description of Artificial Sequence: Synthetic oligonucleotide
  Target: ATXN1; (-) strand; PAM type: NRG; PAM sequence: TAG
tgtcaaaagtttctgcagcg

SEQ ID NO: 86581 - DNA, 20 bp, Artificial Sequence
  Description of Artificial Sequence: Synthetic oligonucleotide
  Target: ATXN1; (-) strand; PAM type: NRG; PAM sequence: CAG
ttcagtgtcaaaagtttctg

SEQ ID NO: 86582 - DNA, 20 bp, Artificial Sequence
  Description of Artificial Sequence: Synthetic oligonucleotide
  Target: ATXN1; (-) strand; PAM type: NRG; PAM sequence: AAG
taaggagagttcagtgtcaa

SEQ ID NO: 86583 - DNA, 20 bp, Artificial Sequence
  Description of Artificial Sequence: Synthetic oligonucleotide
  Target: ATXN1; (-) strand; PAM type: NRG; PAM sequence: CAG
tatggatattaaggagagtt

SEQ ID NO: 86584 - DNA, 20 bp, Artificial Sequence
  Description of Artificial Sequence: Synthetic oligonucleotide
  Target: ATXN1; (-) strand; PAM type: NRG; PAM sequence: GAG
tggcttatggatattaagga

SEQ ID NO: 86585 - DNA, 20 bp, Artificial Sequence
  Description of Artificial Sequence: Synthetic oligonucleotide
  Target: ATXN1; (-) strand; PAM type: NRG; PAM sequence: GAG
tctggcttatggatattaag

SEQ ID NO: 86586 - DNA, 20 bp, Artificial Sequence
  Description of Artificial Sequence: Synthetic oligonucleotide
  Target: ATXN1; (-) strand; PAM type: NRG; PAM sequence: AGG
tctctggcttatggatatta

SEQ ID NO: 86587 - DNA, 20 bp, Artificial Sequence
  Description of Artificial Sequence: Synthetic oligonucleotide
  Target: ATXN1; (-) strand; PAM type: NRG; PAM sequence: AAG
atctctggcttatggatatt

SEQ ID NO: 86588 - DNA, 20 bp, Artificial Sequence
  Description of Artificial Sequence: Synthetic oligonucleotide
  Target: ATXN1; (-) strand; PAM type: NRG; PAM sequence: TGG
taatgaacatctctggctta

SEQ ID NO: 86589 - DNA, 20 bp, Artificial Sequence
  Description of Artificial Sequence: Synthetic oligonucleotide
  Target: ATXN1; (-) strand; PAM type: NRG; PAM sequence: TGG
atttttctaatgaacatctc

SEQ ID NO: 86590 - DNA, 20 bp, Artificial Sequence
  Description of Artificial Sequence: Synthetic oligonucleotide
  Target: ATXN1; (-) strand; PAM type: NRG; PAM sequence: GAG
tcagctgtctgatgaggagt

SEQ ID NO: 86591 - DNA, 20 bp, Artificial Sequence
  Description of Artificial Sequence: Synthetic oligonucleotide
  Target: ATXN1; (-) strand; PAM type: NRG; PAM sequence: GAG
gtcttcagctgtctgatgag

SEQ ID NO: 86592 - DNA, 20 bp, Artificial Sequence
  Description of Artificial Sequence: Synthetic oligonucleotide
  Target: ATXN1; (-) strand; PAM type: NRG; PAM sequence: AGG
aggtcttcagctgtctgatg

SEQ ID NO: 86593 - DNA, 20 bp, Artificial Sequence
  Description of Artificial Sequence: Synthetic oligonucleotide
  Target: ATXN1; (-) strand; PAM type: NRG; PAM sequence: GAG
caggtcttcagctgtctgat

SEQ ID NO: 86594 - DNA, 20 bp, Artificial Sequence
  Description of Artificial Sequence: Synthetic oligonucleotide
  Target: ATXN1; (-) strand; PAM type: NRG; PAM sequence: CAG
agacaaaggactcaggtctt

SEQ ID NO: 86595 - DNA, 20 bp, Artificial Sequence
  Description of Artificial Sequence: Synthetic oligonucleotide
  Target: ATXN1; (-) strand; PAM type: NRG; PAM sequence: AGG
taggggaagacaaaggactc

SEQ ID NO: 86596 - DNA, 20 bp, Artificial Sequence
  Description of Artificial Sequence: Synthetic oligonucleotide
  Target: ATXN1; (-) strand; PAM type: NRG; PAM sequence: CAG
ataggggaagacaaaggact

SEQ ID NO: 86597 - DNA, 20 bp, Artificial Sequence
  Description of Artificial Sequence: Synthetic oligonucleotide
  Target: ATXN1; (-) strand; PAM type: NRG; PAM sequence: AGG
tccagaataggggaagacaa

SEQ ID NO: 86598 - DNA, 20 bp, Artificial Sequence
  Description of Artificial Sequence: Synthetic oligonucleotide
  Target: ATXN1; (-) strand; PAM type: NRG; PAM sequence: AAG
ctccagaataggggaagaca

SEQ ID NO: 86599 - DNA, 20 bp, Artificial Sequence
  Description of Artificial Sequence: Synthetic oligonucleotide
  Target: ATXN1; (-) strand; PAM type: NRG; PAM sequence: AAG
tgtgatctccagaatagggg

SEQ ID NO: 86600 - DNA, 20 bp, Artificial Sequence
  Description of Artificial Sequence: Synthetic oligonucleotide
  Target: ATXN1; (-) strand; PAM type: NRG; PAM sequence: GGG
caatgtgatctccagaatag

SEQ ID NO: 86601 - DNA, 20 bp, Artificial Sequence
  Description of Artificial Sequence: Synthetic oligonucleotide
  Target: ATXN1; (-) strand; PAM type: NRG; PAM sequence: GGG
tcaatgtgatctccagaata

SEQ ID NO: 86602 - DNA, 20 bp, Artificial Sequence
  Description of Artificial Sequence: Synthetic oligonucleotide
  Target: ATXN1; (-) strand; PAM type: NRG; PAM sequence: AGG
ttcaatgtgatctccagaat

SEQ ID NO: 86603 - DNA, 20 bp, Artificial Sequence
  Description of Artificial Sequence: Synthetic oligonucleotide
  Target: ATXN1; (-) strand; PAM type: NRG; PAM sequence: TAG
cttcaatgtgatctccagaa

SEQ ID NO: 86604 - DNA, 20 bp, Artificial Sequence
  Description of Artificial Sequence: Synthetic oligonucleotide
  Target: ATXN1; (-) strand; PAM type: NRG; PAM sequence: CAG
aatcccttcaatgtgatctc

SEQ ID NO: 86605 - DNA, 20 bp, Artificial Sequence
  Description of Artificial Sequence: Synthetic oligonucleotide
  Target: ATXN1; (-) strand; PAM type: NRG; PAM sequence: TAG
ctgtcataaacactttcagg

SEQ ID NO: 86606 - DNA, 20 bp, Artificial Sequence
  Description of Artificial Sequence: Synthetic oligonucleotide
  Target: ATXN1; (-) strand; PAM type: NRG; PAM sequence: AGG
tgtctgtcataaacactttc

SEQ ID NO: 86607 - DNA, 20 bp, Artificial Sequence
  Description of Artificial Sequence: Synthetic oligonucleotide
  Target: ATXN1; (-) strand; PAM type: NRG; PAM sequence: CAG
ctgtctgtcataaacacttt

SEQ ID NO: 86608 - DNA, 20 bp, Artificial Sequence
  Description of Artificial Sequence: Synthetic oligonucleotide
  Target: ATXN1; (-) strand; PAM type: NRG; PAM sequence: GAG
tgtcctaagcctgaatccaa

SEQ ID NO: 86609 - DNA, 20 bp, Artificial Sequence
  Description of Artificial Sequence: Synthetic oligonucleotide
  Target: ATXN1; (-) strand; PAM type: NRG; PAM sequence: AAG
cttgtcctaagcctgaatcc

SEQ ID NO: 86610 - DNA, 20 bp, Artificial Sequence
  Description of Artificial Sequence: Synthetic oligonucleotide
  Target: ATXN1; (-) strand; PAM type: NRG; PAM sequence: AAG
atgaaaggtttgcttgtcct

SEQ ID NO: 86611 - DNA, 20 bp, Artificial Sequence
  Description of Artificial Sequence: Synthetic oligonucleotide
  Target: ATXN1; (-) strand; PAM type: NRG; PAM sequence: AGG
tttttaaggactcatatgaa

SEQ ID NO: 86612 - DNA, 20 bp, Artificial Sequence
  Description of Artificial Sequence: Synthetic oligonucleotide
  Target: ATXN1; (-) strand; PAM type: NRG; PAM sequence: AAG
gtttttaaggactcatatga

SEQ ID NO: 86613 - DNA, 20 bp, Artificial Sequence
  Description of Artificial Sequence: Synthetic oligonucleotide
  Target: ATXN1; (-) strand; PAM type: NRG; PAM sequence: AGG
cagagcactgtctgttttta

SEQ ID NO: 86614 - DNA, 20 bp, Artificial Sequence
  Description of Artificial Sequence: Synthetic oligonucleotide
  Target: ATXN1; (-) strand; PAM type: NRG; PAM sequence: AAG
acagagcactgtctgttttt

SEQ ID NO: 86615 - DNA, 20 bp, Artificial Sequence
  Description of Artificial Sequence: Synthetic oligonucleotide
  Target: ATXN1; (-) strand; PAM type: NRG; PAM sequence: GAG
ggagttcaaagttacaaaca

SEQ ID NO: 86616 - DNA, 20 bp, Artificial Sequence
  Description of Artificial Sequence: Synthetic oligonucleotide
  Target: ATXN1; (-) strand; PAM type: NRG; PAM sequence: CAG
atggagttcaaagttacaaa

SEQ ID NO: 86617 - DNA, 20 bp, Artificial Sequence
  Description of Artificial Sequence: Synthetic oligonucleotide
  Target: ATXN1; (-) strand; PAM type: NRG; PAM sequence: AAG
ttgtactagaatggagttca

SEQ ID NO: 86618 - DNA, 20 bp, Artificial Sequence
  Description of Artificial Sequence: Synthetic oligonucleotide
  Target: ATXN1; (-) strand; PAM type: NRG; PAM sequence: GAG
agcatgtttgtactagaatg

SEQ ID NO: 86619 - DNA, 20 bp, Artificial Sequence
  Description of Artificial Sequence: Synthetic oligonucleotide
  Target: ATXN1; (-) strand; PAM type: NRG; PAM sequence: TGG
caagcatgtttgtactagaa

SEQ ID NO: 86620 - DNA, 20 bp, Artificial Sequence
  Description of Artificial Sequence: Synthetic oligonucleotide
  Target: ATXN1; (-) strand; PAM type: NRG; PAM sequence: TAG
gttgccaagcatgtttgtac

SEQ ID NO: 86621 - DNA, 20 bp, Artificial Sequence
  Description of Artificial Sequence: Synthetic oligonucleotide
  Target: ATXN1; (-) strand; PAM type: NRG; PAM sequence: AAG
accctccggcactagttgcc

SEQ ID NO: 86622 - DNA, 20 bp, Artificial Sequence
  Description of Artificial Sequence: Synthetic oligonucleotide
  Target: ATXN1; (-) strand; PAM type: NRG; PAM sequence: TAG
tctggttaaccctccggcac

SEQ ID NO: 86623 - DNA, 20 bp, Artificial Sequence
  Description of Artificial Sequence: Synthetic oligonucleotide
  Target: ATXN1; (-) strand; PAM type: NRG; PAM sequence: CGG
aaactctctggttaaccctc

SEQ ID NO: 86624 - DNA, 20 bp, Artificial Sequence
  Description of Artificial Sequence: Synthetic oligonucleotide
  Target: ATXN1; (-) strand; PAM type: NRG; PAM sequence: TGG
ttgccaggaagaaaactctc

SEQ ID NO: 86625 - DNA, 20 bp, Artificial Sequence
  Description of Artificial Sequence: Synthetic oligonucleotide
  Target: ATXN1; (-) strand; PAM type: NRG; PAM sequence: AAG
cggcagagcaatttgccagg

SEQ ID NO: 86626 - DNA, 20 bp, Artificial Sequence
  Description of Artificial Sequence: Synthetic oligonucleotide
  Target: ATXN1; (-) strand; PAM type: NRG; PAM sequence: AGG
tggcggcagagcaatttgcc

SEQ ID NO: 86627 - DNA, 20 bp, Artificial Sequence
  Description of Artificial Sequence: Synthetic oligonucleotide
  Target: ATXN1; (-) strand; PAM type: NRG; PAM sequence: CAG
gtggcggcagagcaatttgc

SEQ ID NO: 86628 - DNA, 20 bp, Artificial Sequence
  Description of Artificial Sequence: Synthetic oligonucleotide
  Target: ATXN1; (-) strand; PAM type: NRG; PAM sequence: GAG
taatacccatggtggcggca

SEQ ID NO: 86629 - DNA, 20 bp, Artificial Sequence
  Description of Artificial Sequence: Synthetic oligonucleotide
  Target: ATXN1; (-) strand; PAM type: NRG; PAM sequence: CAG
gttaatacccatggtggcgg

SEQ ID NO: 86630 - DNA, 20 bp, Artificial Sequence
  Description of Artificial Sequence: Synthetic oligonucleotide
  Target: ATXN1; (-) strand; PAM type: NRG; PAM sequence: CGG
agtgttaatacccatggtgg

SEQ ID NO: 86631 - DNA, 20 bp, Artificial Sequence
  Description of Artificial Sequence: Synthetic oligonucleotide
  Target: ATXN1; (-) strand; PAM type: NRG; PAM sequence: TGG
tggagtgttaatacccatgg

SEQ ID NO: 86632 - DNA, 20 bp, Artificial Sequence
  Description of Artificial Sequence: Synthetic oligonucleotide
  Target: ATXN1; (-) strand; PAM type: NRG; PAM sequence: TGG
tcctggagtgttaataccca

SEQ ID NO: 86633 - DNA, 20 bp, Artificial Sequence
  Description of Artificial Sequence: Synthetic oligonucleotide
  Target: ATXN1; (-) strand; PAM type: NRG; PAM sequence: GAG
ggaaagttgcagggatcctg

SEQ ID NO: 86634 - DNA, 20 bp, Artificial Sequence
  Description of Artificial Sequence: Synthetic oligonucleotide
  Target: ATXN1; (-) strand; PAM type: NRG; PAM sequence: TGG
agggaaagttgcagggatcc

SEQ ID NO: 86635 - DNA, 20 bp, Artificial Sequence
  Description of Artificial Sequence: Synthetic oligonucleotide
  Target: ATXN1; (-) strand; PAM type: NRG; PAM sequence: GGG
aggaagaagggaaagttgca

SEQ ID NO: 86636 - DNA, 20 bp, Artificial Sequence
  Description of Artificial Sequence: Synthetic oligonucleotide
  Target: ATXN1; (-) strand; PAM type: NRG; PAM sequence: AGG
gaggaagaagggaaagttgc

SEQ ID NO: 86637 - DNA, 20 bp, Artificial Sequence
  Description of Artificial Sequence: Synthetic oligonucleotide
  Target: ATXN1; (-) strand; PAM type: NRG; PAM sequence: CAG
agaggaagaagggaaagttg

SEQ ID NO: 86638 - DNA, 20 bp, Artificial Sequence
  Description of Artificial Sequence: Synthetic oligonucleotide
  Target: ATXN1; (-) strand; PAM type: NRG; PAM sequence: AAG
aggaatagaggaagaaggga

SEQ ID NO: 86639 - DNA, 20 bp, Artificial Sequence
  Description of Artificial Sequence: Synthetic oligonucleotide
  Target: ATXN1; (-) strand; PAM type: NRG; PAM sequence: GGG
gatgaggaatagaggaagaa

SEQ ID NO: 86640 - DNA, 20 bp, Artificial Sequence
  Description of Artificial Sequence: Synthetic oligonucleotide
  Target: ATXN1; (-) strand; PAM type: NRG; PAM sequence: AGG
ggatgaggaatagaggaaga

SEQ ID NO: 86641 - DNA, 20 bp, Artificial Sequence
  Description of Artificial Sequence: Synthetic oligonucleotide
  Target: ATXN1; (-) strand; PAM type: NRG; PAM sequence: AAG
gggatgaggaatagaggaag

SEQ ID NO: 86642 - DNA, 20 bp, Artificial Sequence
  Description of Artificial Sequence: Synthetic oligonucleotide
  Target: ATXN1; (-) strand; PAM type: NRG; PAM sequence: AAG
caggggatgaggaatagagg

SEQ ID NO: 86643 - DNA, 20 bp, Artificial Sequence
  Description of Artificial Sequence: Synthetic oligonucleotide
  Target: ATXN1; (-) strand; PAM type: NRG; PAM sequence: AGG
gggcaggggatgaggaatag

SEQ ID NO: 86644 - DNA, 20 bp, Artificial Sequence
  Description of Artificial Sequence: Synthetic oligonucleotide
  Target: ATXN1; (-) strand; PAM type: NRG; PAM sequence: GAG
agggcaggggatgaggaata

SEQ ID NO: 86645 - DNA, 20 bp, Artificial Sequence
  Description of Artificial Sequence: Synthetic oligonucleotide
  Target: ATXN1; (-) strand; PAM type: NRG; PAM sequence: TAG
tcagggcaggggatgaggaa

SEQ ID NO: 86646 - DNA, 20 bp, Artificial Sequence
  Description of Artificial Sequence: Synthetic oligonucleotide
  Target: ATXN1; (-) strand; PAM type: NRG; PAM sequence: AGG
atatctcagggcaggggatg

SEQ ID NO: 86647 - DNA, 20 bp, Artificial Sequence
  Description of Artificial Sequence: Synthetic oligonucleotide
  Target: ATXN1; (-) strand; PAM type: NRG; PAM sequence: GAG
aatatctcagggcaggggat

SEQ ID NO: 86648 - DNA, 20 bp, Artificial Sequence
  Description of Artificial Sequence: Synthetic oligonucleotide
  Target: ATXN1; (-) strand; PAM type: NRG; PAM sequence: GGG
cagataatatctcagggcag

SEQ ID NO: 86649 - DNA, 20 bp, Artificial Sequence
  Description of Artificial Sequence: Synthetic oligonucleotide
  Target: ATXN1; (-) strand; PAM type: NRG; PAM sequence: GGG
acagataatatctcagggca

SEQ ID NO: 86650 - DNA, 20 bp, Artificial Sequence
  Description of Artificial Sequence: Synthetic oligonucleotide
  Target: ATXN1; (-) strand; PAM type: NRG; PAM sequence: AGG
cacagataatatctcagggc

SEQ ID NO: 86651 - DNA, 20 bp, Artificial Sequence
  Description of Artificial Sequence: Synthetic oligonucleotide
  Target: ATXN1; (-) strand; PAM type: NRG; PAM sequence: CAG
gcacagataatatctcaggg

SEQ ID NO: 86652 - DNA, 20 bp, Artificial Sequence
  Description of Artificial Sequence: Synthetic oligonucleotide
  Target: ATXN1; (-) strand; PAM type: NRG; PAM sequence: GGG
tgggcacagataatatctca

SEQ ID NO: 86653 - DNA, 20 bp, Artificial Sequence
  Description of Artificial Sequence: Synthetic oligonucleotide
  Target: ATXN1; (-) strand; PAM type: NRG; PAM sequence: AGG
ttgggcacagataatatctc

SEQ ID NO: 86654 - DNA, 20 bp, Artificial Sequence
  Description of Artificial Sequence: Synthetic oligonucleotide
  Target: ATXN1; (-) strand; PAM type: NRG; PAM sequence: CAG
cttgggcacagataatatct

SEQ ID NO: 86655 - DNA, 20 bp, Artificial Sequence
  Description of Artificial Sequence: Synthetic oligonucleotide
  Target: ATXN1; (-) strand; PAM type: NRG; PAM sequence: CAG
caacccctgcagcttgggca

SEQ ID NO: 86656 - DNA, 20 bp, Artificial Sequence
  Description of Artificial Sequence: Synthetic oligonucleotide
  Target: ATXN1; (-) strand; PAM type: NRG; PAM sequence: GGG
gacctcaacccctgcagctt

SEQ ID NO: 86657 - DNA, 20 bp, Artificial Sequence
  Description of Artificial Sequence: Synthetic oligonucleotide
  Target: ATXN1; (-) strand; PAM type: NRG; PAM sequence: TGG
tgacctcaacccctgcagct

SEQ ID NO: 86658 - DNA, 20 bp, Artificial Sequence
  Description of Artificial Sequence: Synthetic oligonucleotide
  Target: ATXN1; (-) strand; PAM type: NRG; PAM sequence: CAG
atgtgtgacctcaacccctg

SEQ ID NO: 86659 - DNA, 20 bp, Artificial Sequence
  Description of Artificial Sequence: Synthetic oligonucleotide
  Target: ATXN1; (-) strand; PAM type: NRG; PAM sequence: CAG
cactgacagctccttggcac

SEQ ID NO: 86660 - DNA, 20 bp, Artificial Sequence
  Description of Artificial Sequence: Synthetic oligonucleotide
  Target: ATXN1; (-) strand; PAM type: NRG; PAM sequence: TGG
tggaggcactgacagctcct

SEQ ID NO: 86661 - DNA, 20 bp, Artificial Sequence
  Description of Artificial Sequence: Synthetic oligonucleotide
  Target: ATXN1; (-) strand; PAM type: NRG; PAM sequence: CAG
gccactgctggaggcactga

SEQ ID NO: 86662 - DNA, 20 bp, Artificial Sequence
  Description of Artificial Sequence: Synthetic oligonucleotide
  Target: ATXN1; (-) strand; PAM type: NRG; PAM sequence: AGG
atgaactgtgccactgctgg

SEQ ID NO: 86663 - DNA, 20 bp, Artificial Sequence
  Description of Artificial Sequence: Synthetic oligonucleotide
  Target: ATXN1; (-) strand; PAM type: NRG; PAM sequence: GAG
catgaactgtgccactgctg

SEQ ID NO: 86664 - DNA, 20 bp, Artificial Sequence
  Description of Artificial Sequence: Synthetic oligonucleotide
  Target: ATXN1; (-) strand; PAM type: NRG; PAM sequence: TGG
accatgaactgtgccactgc

SEQ ID NO: 86665 - DNA, 20 bp, Artificial Sequence
  Description of Artificial Sequence: Synthetic oligonucleotide
  Target: ATXN1; (-) strand; PAM type: NRG; PAM sequence: AAG
accaagggaggggccaggag

SEQ ID NO: 86666 - DNA, 20 bp, Artificial Sequence
  Description of Artificial Sequence: Synthetic oligonucleotide
  Target: ATXN1; (-) strand; PAM type: NRG; PAM sequence: GAG
cagaccaagggaggggccag

SEQ ID NO: 86667 - DNA, 20 bp, Artificial Sequence
  Description of Artificial Sequence: Synthetic oligonucleotide
  Target: ATXN1; (-) strand; PAM type: NRG; PAM sequence: AGG
gccagaccaagggaggggcc

SEQ ID NO: 86668 - DNA, 20 bp, Artificial Sequence
  Description of Artificial Sequence: Synthetic oligonucleotide
  Target: ATXN1; (-) strand; PAM type: NRG; PAM sequence: CAG
tgccagaccaagggaggggc

SEQ ID NO: 86669 - DNA, 20 bp, Artificial Sequence
  Description of Artificial Sequence: Synthetic oligonucleotide
  Target: ATXN1; (-) strand; PAM type: NRG; PAM sequence: GGG
agcatgccagaccaagggag

SEQ ID NO: 86670 - DNA, 20 bp, Artificial Sequence
  Description of Artificial Sequence: Synthetic oligonucleotide
  Target: ATXN1; (-) strand; PAM type: NRG; PAM sequence: GGG
cagcatgccagaccaaggga

SEQ ID NO: 86671 - DNA, 20 bp, Artificial Sequence
  Description of Artificial Sequence: Synthetic oligonucleotide
  Target: ATXN1; (-) strand; PAM type: NRG; PAM sequence: AGG
tcagcatgccagaccaaggg

SEQ ID NO: 86672 - DNA, 20 bp, Artificial Sequence
  Description of Artificial Sequence: Synthetic oligonucleotide
  Target: ATXN1; (-) strand; PAM type: NRG; PAM sequence: GAG
gtcagcatgccagaccaagg

SEQ ID NO: 86673 - DNA, 20 bp, Artificial Sequence
  Description of Artificial Sequence: Synthetic oligonucleotide
  Target: ATXN1; (-) strand; PAM type: NRG; PAM sequence: GGG
ctgtcagcatgccagaccaa

SEQ ID NO: 86674 - DNA, 20 bp, Artificial Sequence
  Description of Artificial Sequence: Synthetic oligonucleotide
  Target: ATXN1; (-) strand; PAM type: NRG; PAM sequence: AGG
tctgtcagcatgccagacca

SEQ ID NO: 86675 - DNA, 20 bp, Artificial Sequence
  Description of Artificial Sequence: Synthetic oligonucleotide
  Target: ATXN1; (-) strand; PAM type: NRG; PAM sequence: AAG
ttctgtcagcatgccagacc

SEQ ID NO: 86676 - DNA, 20 bp, Artificial Sequence
  Description of Artificial Sequence: Synthetic oligonucleotide
  Target: ATXN1; (-) strand; PAM type: NRG; PAM sequence: CAG
acaattttctgtcagcatgc

SEQ ID NO: 86677 - DNA, 20 bp, Artificial Sequence
  Description of Artificial Sequence: Synthetic oligonucleotide
  Target: ATXN1; (-) strand; PAM type: NRG; PAM sequence: CAG
aaaaaagaacaattttctgt

SEQ ID NO: 86678 - DNA, 20 bp, Artificial Sequence
  Description of Artificial Sequence: Synthetic oligonucleotide
  Target: ATXN1; (-) strand; PAM type: NRG; PAM sequence: AAG
cacagacaaatgatgaaaaa

SEQ ID NO: 86679 - DNA, 20 bp, Artificial Sequence
  Description of Artificial Sequence: Synthetic oligonucleotide
  Target: ATXN1; (-) strand; PAM type: NRG; PAM sequence: CAG
catggtctgcctctgagtca

SEQ ID NO: 86680 - DNA, 20 bp, Artificial Sequence
  Description of Artificial Sequence: Synthetic oligonucleotide
  Target: ATXN1; (-) strand; PAM type: NRG; PAM sequence: GAG
tggccccatggtctgcctct

SEQ ID NO: 86681 - DNA, 20 bp, Artificial Sequence
  Description of Artificial Sequence: Synthetic oligonucleotide
  Target: ATXN1; (-) strand; PAM type: NRG; PAM sequence: TGG
ggctggatttgttggcccca

SEQ ID NO: 86682 - DNA, 20 bp, Artificial Sequence
  Description of Artificial Sequence: Synthetic oligonucleotide
  Target: ATXN1; (-) strand; PAM type: NRG; PAM sequence: TGG
tgatcatgggctggatttgt

SEQ ID NO: 86683 - DNA, 20 bp, Artificial Sequence
  Description of Artificial Sequence: Synthetic oligonucleotide
  Target: ATXN1; (-) strand; PAM type: NRG; PAM sequence: TGG
cttcaagcgtgatcatgggc

SEQ ID NO: 86684 - DNA, 20 bp, Artificial Sequence
  Description of Artificial Sequence: Synthetic oligonucleotide
  Target: ATXN1; (-) strand; PAM type: NRG; PAM sequence: GGG
gtgccttcaagcgtgatcat

SEQ ID NO: 86685 - DNA, 20 bp, Artificial Sequence
  Description of Artificial Sequence: Synthetic oligonucleotide
  Target: ATXN1; (-) strand; PAM type: NRG; PAM sequence: TGG
tgtgccttcaagcgtgatca

SEQ ID NO: 86686 - DNA, 20 bp, Artificial Sequence
  Description of Artificial Sequence: Synthetic oligonucleotide
  Target: ATXN1; (-) strand; PAM type: NRG; PAM sequence: AAG
ctagatatccctgtgccttc

SEQ ID NO: 86687 - DNA, 20 bp, Artificial Sequence
  Description of Artificial Sequence: Synthetic oligonucleotide
  Target: ATXN1; (-) strand; PAM type: NRG; PAM sequence: TAG
gaagtttgggggatgacttc

SEQ ID NO: 86688 - DNA, 20 bp, Artificial Sequence
  Description of Artificial Sequence: Synthetic oligonucleotide
  Target: ATXN1; (-) strand; PAM type: NRG; PAM sequence: GGG
caatagtccctgaagtttgg

SEQ ID NO: 86689 - DNA, 20 bp, Artificial Sequence
  Description of Artificial Sequence: Synthetic oligonucleotide
  Target: ATXN1; (-) strand; PAM type: NRG; PAM sequence: GGG
acaatagtccctgaagtttg

SEQ ID NO: 86690 - DNA, 20 bp, Artificial Sequence
  Description of Artificial Sequence: Synthetic oligonucleotide
  Target: ATXN1; (-) strand; PAM type: NRG; PAM sequence: GGG
gacaatagtccctgaagttt

SEQ ID NO: 86691 - DNA, 20 bp, Artificial Sequence
  Description of Artificial Sequence: Synthetic oligonucleotide
  Target: ATXN1; (-) strand; PAM type: NRG; PAM sequence: TGG
tgacaatagtccctgaagtt

SEQ ID NO: 86692 - DNA, 20 bp, Artificial Sequence
  Description of Artificial Sequence: Synthetic oligonucleotide
  Target: ATXN1; (-) strand; PAM type: NRG; PAM sequence: AAG
aggtttgacaatagtccctg

SEQ ID NO: 86693 - DNA, 20 bp, Artificial Sequence
  Description of Artificial Sequence: Synthetic oligonucleotide
  Target: ATXN1; (-) strand; PAM type: NRG; PAM sequence: TAG
atcccaagaaggtttgacaa

SEQ ID NO: 86694 - DNA, 20 bp, Artificial Sequence
  Description of Artificial Sequence: Synthetic oligonucleotide
  Target: ATXN1; (-) strand; PAM type: NRG; PAM sequence: AGG
aatatgtctgtatcccaaga

SEQ ID NO: 86695 - DNA, 20 bp, Artificial Sequence
  Description of Artificial Sequence: Synthetic oligonucleotide
  Target: ATXN1; (-) strand; PAM type: NRG; PAM sequence: AAG
aaatatgtctgtatcccaag

SEQ ID NO: 86696 - DNA, 20 bp, Artificial Sequence
  Description of Artificial Sequence: Synthetic oligonucleotide
  Target: ATXN1; (-) strand; PAM type: NRG; PAM sequence: AAG
gagaaatatgtctgtatccc

SEQ ID NO: 86697 - DNA, 20 bp, Artificial Sequence
  Description of Artificial Sequence: Synthetic oligonucleotide
  Target: ATXN1; (-) strand; PAM type: NRG; PAM sequence: GAG
gatctttccaaaggagatct

SEQ ID NO: 86698 - DNA, 20 bp, Artificial Sequence
  Description of Artificial Sequence: Synthetic oligonucleotide
  Target: ATXN1; (-) strand; PAM type: NRG; PAM sequence: GAG
agtctaagatctttccaaag

SEQ ID NO: 86699 - DNA, 20 bp, Artificial Sequence
  Description of Artificial Sequence: Synthetic oligonucleotide
  Target: ATXN1; (-) strand; PAM type: NRG; PAM sequence: AGG
caagtctaagatctttccaa

SEQ ID NO: 86700 - DNA, 20 bp, Artificial Sequence
  Description of Artificial Sequence: Synthetic oligonucleotide
  Target: ATXN1; (-) strand; PAM type: NRG; PAM sequence: AAG
gcaagtctaagatctttcca

SEQ ID NO: 86701 - DNA, 20 bp, Artificial Sequence
  Description of Artificial Sequence: Synthetic oligonucleotide
  Target: ATXN1; (-) strand; PAM type: NRG; PAM sequence: AAG
gacccctgtcaagcaagtct

SEQ ID NO: 86702 - DNA, 20 bp, Artificial Sequence
  Description of Artificial Sequence: Synthetic oligonucleotide
  Target: ATXN1; (-) strand; PAM type: NRG; PAM sequence: AAG
tccaaggacccctgtcaagc

SEQ ID NO: 86703 - DNA, 20 bp, Artificial Sequence
  Description of Artificial Sequence: Synthetic oligonucleotide
  Target: ATXN1; (-) strand; PAM type: NRG; PAM sequence: AAG
catctccaaggacccctgtc

SEQ ID NO: 86704 - DNA, 20 bp, Artificial Sequence
  Description of Artificial Sequence: Synthetic oligonucleotide
  Target: ATXN1; (-) strand; PAM type: NRG; PAM sequence: AGG
tatggatttgatcatctcca

SEQ ID NO: 86705 - DNA, 20 bp, Artificial Sequence
  Description of Artificial Sequence: Synthetic oligonucleotide
  Target: ATXN1; (-) strand; PAM type: NRG; PAM sequence: AAG
ttatggatttgatcatctcc

SEQ ID NO: 86706 - DNA, 20 bp, Artificial Sequence
  Description of Artificial Sequence: Synthetic oligonucleotide
  Target: ATXN1; (-) strand; PAM type: NRG; PAM sequence: TGG
ttaaaatgagaggagggtta

SEQ ID NO: 86707 - DNA, 20 bp, Artificial Sequence
  Description of Artificial Sequence: Synthetic oligonucleotide
  Target: ATXN1; (-) strand; PAM type: NRG; PAM sequence: GGG
aaaactttaaaatgagagga

SEQ ID NO: 86708 - DNA, 20 bp, Artificial Sequence
  Description of Artificial Sequence: Synthetic oligonucleotide
  Target: ATXN1; (-) strand; PAM type: NRG; PAM sequence: AGG
gaaaactttaaaatgagagg

SEQ ID NO: 86709 - DNA, 20 bp, Artificial Sequence
  Description of Artificial Sequence: Synthetic oligonucleotide
  Target: ATXN1; (-) strand; PAM type: NRG; PAM sequence: GAG
agaaaactttaaaatgagag

SEQ ID NO: 86710 - DNA, 20 bp, Artificial Sequence
  Description of Artificial Sequence: Synthetic oligonucleotide
  Target: ATXN1; (-) strand; PAM type: NRG; PAM sequence: AGG
aaagaaaactttaaaatgag

SEQ ID NO: 86711 - DNA, 20 bp, Artificial Sequence
  Description of Artificial Sequence: Synthetic oligonucleotide
  Target: ATXN1; (-) strand; PAM type: NRG; PAM sequence: GAG
taaagaaaactttaaaatga

SEQ ID NO: 86712 - DNA, 20 bp, Artificial Sequence
  Description of Artificial Sequence: Synthetic oligonucleotide
  Target: ATXN1; (-) strand; PAM type: NRG; PAM sequence: GAG
aataaagaaaactttaaaat

SEQ ID NO: 86713 - DNA, 20 bp, Artificial Sequence
  Description of Artificial Sequence: Synthetic oligonucleotide
  Target: ATXN1; (-) strand; PAM type: NRG; PAM sequence: AAG
ctcccataaagaatccaata

SEQ ID NO: 86714 - DNA, 20 bp, Artificial Sequence
  Description of Artificial Sequence: Synthetic oligonucleotide
  Target: ATXN1; (-) strand; PAM type: NRG; PAM sequence: AAG
aaggaacttggtctcccata

SEQ ID NO: 86715 - DNA, 20 bp, Artificial Sequence
  Description of Artificial Sequence: Synthetic oligonucleotide
  Target: ATXN1; (-) strand; PAM type: NRG; PAM sequence: TGG
aagcaatccaataaggaact

SEQ ID NO: 86716 - DNA, 20 bp, Artificial Sequence
  Description of Artificial Sequence: Synthetic oligonucleotide
  Target: ATXN1; (-) strand; PAM type: NRG; PAM sequence: AGG
ccacaggaagcaatccaata

SEQ ID NO: 86717 - DNA, 20 bp, Artificial Sequence
  Description of Artificial Sequence: Synthetic oligonucleotide
  Target: ATXN1; (-) strand; PAM type: NRG; PAM sequence: AAG
tccacaggaagcaatccaat

SEQ ID NO: 86718 - DNA, 20 bp, Artificial Sequence
  Description of Artificial Sequence: Synthetic oligonucleotide
  Target: ATXN1; (-) strand; PAM type: NRG; PAM sequence: AAG
catcatccttggtccacagg

SEQ ID NO: 86719 - DNA, 20 bp, Artificial Sequence
  Description of Artificial Sequence: Synthetic oligonucleotide
  Target: ATXN1; (-) strand; PAM type: NRG; PAM sequence: AGG
aaacatcatccttggtccac

SEQ ID NO: 86720 - DNA, 20 bp, Artificial Sequence
  Description of Artificial Sequence: Synthetic oligonucleotide
  Target: ATXN1; (-) strand; PAM type: NRG; PAM sequence: CAG
aaaacatcatccttggtcca

SEQ ID NO: 86721 - DNA, 20 bp, Artificial Sequence
  Description of Artificial Sequence: Synthetic oligonucleotide
  Target: ATXN1; (-) strand; PAM type: NRG; PAM sequence: TGG
tccctagaaaacatcatcct

SEQ ID NO: 86722 - DNA, 20 bp, Artificial Sequence
  Description of Artificial Sequence: Synthetic oligonucleotide
  Target: ATXN1; (-) strand; PAM type: NRG; PAM sequence: TAG
ctcaagtttcaataagtccc

SEQ ID NO: 86723 - DNA, 20 bp, Artificial Sequence
  Description of Artificial Sequence: Synthetic oligonucleotide
  Target: ATXN1; (-) strand; PAM type: NRG; PAM sequence: AAG
tccgactctcaagtttcaat

SEQ ID NO: 86724 - DNA, 20 bp, Artificial Sequence
  Description of Artificial Sequence: Synthetic oligonucleotide
  Target: ATXN1; (-) strand; PAM type: NRG; PAM sequence: AAG
tcagaccacttccgactctc

SEQ ID NO: 86725 - DNA, 20 bp, Artificial Sequence
  Description of Artificial Sequence: Synthetic oligonucleotide
  Target: ATXN1; (-) strand; PAM type: NRG; PAM sequence: CAG
cactaaatcaaacaatcctt

SEQ ID NO: 86726 - DNA, 20 bp, Artificial Sequence
  Description of Artificial Sequence: Synthetic oligonucleotide
  Target: ATXN1; (-) strand; PAM type: NRG; PAM sequence: AGG
attaggcaatgtcagttcac

SEQ ID NO: 86727 - DNA, 20 bp, Artificial Sequence
  Description of Artificial Sequence: Synthetic oligonucleotide
  Target: ATXN1; (-) strand; PAM type: NRG; PAM sequence: CAG
tattaggcaatgtcagttca

SEQ ID NO: 86728 - DNA, 20 bp, Artificial Sequence
  Description of Artificial Sequence: Synthetic oligonucleotide
  Target: ATXN1; (-) strand; PAM type: NRG; PAM sequence: CAG
caacagctattaggcaatgt

SEQ ID NO: 86729 - DNA, 20 bp, Artificial Sequence
  Description of Artificial Sequence: Synthetic oligonucleotide
  Target: ATXN1; (-) strand; PAM type: NRG; PAM sequence: AGG
tttatgttacaacagctatt

SEQ ID NO: 86730 - DNA, 20 bp, Artificial Sequence
  Description of Artificial Sequence: Synthetic oligonucleotide
  Target: ATXN1; (-) strand; PAM type: NRG; PAM sequence: TAG
ctttatgttacaacagctat

SEQ ID NO: 86731 - DNA, 20 bp, Artificial Sequence
  Description of Artificial Sequence: Synthetic oligonucleotide
  Target: ATXN1; (-) strand; PAM type: NRG; PAM sequence: CAG
tgagaatctttatgttacaa

SEQ ID NO: 86732 - DNA, 20 bp, Artificial Sequence
  Description of Artificial Sequence: Synthetic oligonucleotide
  Target: ATXN1; (-) strand; PAM type: NRG; PAM sequence: GAG
aaggggtggggctgagacct

SEQ ID NO: 86733 - DNA, 20 bp, Artificial Sequence
  Description of Artificial Sequence: Synthetic oligonucleotide
  Target: ATXN1; (-) strand; PAM type: NRG; PAM sequence: GAG
tttgggtaaggggtggggct

SEQ ID NO: 86734 - DNA, 20 bp, Artificial Sequence
  Description of Artificial Sequence: Synthetic oligonucleotide
  Target: ATXN1; (-) strand; PAM type: NRG; PAM sequence: GGG
aagggtttgggtaaggggtg

SEQ ID NO: 86735 - DNA, 20 bp, Artificial Sequence
  Description of Artificial Sequence: Synthetic oligonucleotide
  Target: ATXN1; (-) strand; PAM type: NRG; PAM sequence: GGG
caagggtttgggtaaggggt

SEQ ID NO: 86736 - DNA, 20 bp, Artificial Sequence
  Description of Artificial Sequence: Synthetic oligonucleotide
  Target: ATXN1; (-) strand; PAM type: NRG; PAM sequence: TGG
ccaagggtttgggtaagggg

SEQ ID NO: 86737 - DNA, 20 bp, Artificial Sequence
  Description of Artificial Sequence: Synthetic oligonucleotide
  Target: ATXN1; (-) strand; PAM type: NRG; PAM sequence: GGG
tagccaagggtttgggtaag

SEQ ID NO: 86738 - DNA, 20 bp, Artificial Sequence
  Description of Artificial Sequence: Synthetic oligonucleotide
  Target: ATXN1; (-) strand; PAM type: NRG; PAM sequence: GGG
ttagccaagggtttgggtaa

SEQ ID NO: 86739 - DNA, 20 bp, Artificial Sequence
  Description of Artificial Sequence: Synthetic oligonucleotide
  Target: ATXN1; (-) strand; PAM type: NRG; PAM sequence: AGG
attagccaagggtttgggta

SEQ ID NO: 86740 - DNA, 20 bp, Artificial Sequence
  Description of Artificial Sequence: Synthetic oligonucleotide
  Target: ATXN1; (-) strand; PAM type: NRG; PAM sequence: AAG
aattagccaagggtttgggt

SEQ ID NO: 86741 - DNA, 20 bp, Artificial Sequence
  Description of Artificial Sequence: Synthetic oligonucleotide
  Target: ATXN1; (-) strand; PAM type: NRG; PAM sequence: GGG
gtggaattagccaagggttt

SEQ ID NO: 86742 - DNA, 20 bp, Artificial Sequence
  Description of Artificial Sequence: Synthetic oligonucleotide
  Target: ATXN1; (-) strand; PAM type: NRG; PAM sequence: TGG
tgtggaattagccaagggtt

SEQ ID NO: 86743 - DNA, 20 bp, Artificial Sequence
  Description of Artificial Sequence: Synthetic oligonucleotide
  Target: ATXN1; (-) strand; PAM type: NRG; PAM sequence: GGG
gcctctgtggaattagccaa

SEQ ID NO: 86744 - DNA, 20 bp, Artificial Sequence
  Description of Artificial Sequence: Synthetic oligonucleotide
  Target: ATXN1; (-) strand; PAM type: NRG; PAM sequence: AGG
ggcctctgtggaattagcca

SEQ ID NO: 86745 - DNA, 20 bp, Artificial Sequence
  Description of Artificial Sequence: Synthetic oligonucleotide
  Target: ATXN1; (-) strand; PAM type: NRG; PAM sequence: AAG
aggcctctgtggaattagcc

SEQ ID NO: 86746 - DNA, 20 bp, Artificial Sequence
  Description of Artificial Sequence: Synthetic oligonucleotide
  Target: ATXN1; (-) strand; PAM type: NRG; PAM sequence: TAG
gagacaggcctctgtggaat

SEQ ID NO: 86747 - DNA, 20 bp, Artificial Sequence
  Description of Artificial Sequence: Synthetic oligonucleotide
  Target: ATXN1; (-) strand; PAM type: NRG; PAM sequence: TGG
cagagtgagacaggcctctg

SEQ ID NO: 86748 - DNA, 20 bp, Artificial Sequence
  Description of Artificial Sequence: Synthetic oligonucleotide
  Target: ATXN1; (-) strand; PAM type: NRG; PAM sequence: AGG
cctgggcgacagagtgagac

SEQ ID NO: 86749 - DNA, 20 bp, Artificial Sequence
  Description of Artificial Sequence: Synthetic oligonucleotide
  Target: ATXN1; (-) strand; PAM type: NRG; PAM sequence: CAG
gcctgggcgacagagtgaga

SEQ ID NO: 86750 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcgacagagt

SEQ ID NO: 86751 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 86752 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 86753 - DNA, 20 bp, Artificial Sequence
  Description of Artificial Sequence: Synthetic oligonucleotide
  Target: ATXN1; (-) strand; PAM type: NRG; PAM sequence: GGG
gagccactgcactccagcct

SEQ ID NO: 86754 - DNA, 20 bp, Artificial Sequence
  Description of Artificial Sequence: Synthetic oligonucleotide
  Target: ATXN1; (-) strand; PAM type: NRG; PAM sequence: TGG
agagccactgcactccagcc

SEQ ID NO: 86755 - DNA, 20 bp, Artificial Sequence
  Description of Artificial Sequence: Synthetic oligonucleotide
  Target: ATXN1; (-) strand; PAM type: NRG; PAM sequence: CAG
cctggagagccactgcactc

SEQ ID NO: 86756 - DNA, 20 bp, Artificial Sequence
  Description of Artificial Sequence: Synthetic oligonucleotide
  Target: ATXN1; (-) strand; PAM type: NRG; PAM sequence: GAG
tggcttcagaaaaccctgga

SEQ ID NO: 86757 - DNA, 20 bp, Artificial Sequence
  Description of Artificial Sequence: Synthetic oligonucleotide
  Target: ATXN1; (-) strand; PAM type: NRG; PAM sequence: GAG
tgtggcttcagaaaaccctg

SEQ ID NO: 86758 - DNA, 20 bp, Artificial Sequence
  Description of Artificial Sequence: Synthetic oligonucleotide
  Target: ATXN1; (-) strand; PAM type: NRG; PAM sequence: TGG
aatgtggcttcagaaaaccc

SEQ ID NO: 86759 - DNA, 20 bp, Artificial Sequence
  Description of Artificial Sequence: Synthetic oligonucleotide
  Target: ATXN1; (-) strand; PAM type: NRG; PAM sequence: CAG
gtggttttcaaatgtggctt

SEQ ID NO: 86760 - DNA, 20 bp, Artificial Sequence
  Description of Artificial Sequence: Synthetic oligonucleotide
  Target: ATXN1; (-) strand; PAM type: NRG; PAM sequence: TGG
atataagtggttttcaaatg

SEQ ID NO: 86761 - DNA, 20 bp, Artificial Sequence
  Description of Artificial Sequence: Synthetic oligonucleotide
  Target: ATXN1; (-) strand; PAM type: NRG; PAM sequence: TGG
aggaagttgggttatataag

SEQ ID NO: 86762 - DNA, 20 bp, Artificial Sequence
  Description of Artificial Sequence: Synthetic oligonucleotide
  Target: ATXN1; (-) strand; PAM type: NRG; PAM sequence: AAG
atgaggaagttgggttatat

SEQ ID NO: 86763 - DNA, 20 bp, Artificial Sequence
  Description of Artificial Sequence: Synthetic oligonucleotide
  Target: ATXN1; (-) strand; PAM type: NRG; PAM sequence: GGG
cttaggaaaatgaggaagtt

SEQ ID NO: 86764 - DNA, 20 bp, Artificial Sequence
  Description of Artificial Sequence: Synthetic oligonucleotide
  Target: ATXN1; (-) strand; PAM type: NRG; PAM sequence: TGG
ccttaggaaaatgaggaagt

SEQ ID NO: 86765 - DNA, 20 bp, Artificial Sequence
  Description of Artificial Sequence: Synthetic oligonucleotide
  Target: ATXN1; (-) strand; PAM type: NRG; PAM sequence: AAG
tgagccttaggaaaatgagg

SEQ ID NO: 86766 - DNA, 20 bp, Artificial Sequence
  Description of Artificial Sequence: Synthetic oligonucleotide
  Target: ATXN1; (-) strand; PAM type: NRG; PAM sequence: AGG
ctctgagccttaggaaaatg

SEQ ID NO: 86767 - DNA, 20 bp, Artificial Sequence
  Description of Artificial Sequence: Synthetic oligonucleotide
  Target: ATXN1; (-) strand; PAM type: NRG; PAM sequence: GAG
tctctgagccttaggaaaat

SEQ ID NO: 86768 - DNA, 20 bp, Artificial Sequence
  Description of Artificial Sequence: Synthetic oligonucleotide
  Target: ATXN1; (-) strand; PAM type: NRG; PAM sequence: AGG
accgaagttctctgagcctt

SEQ ID NO: 86769 - DNA, 20 bp, Artificial Sequence
  Description of Artificial Sequence: Synthetic oligonucleotide
  Target: ATXN1; (-) strand; PAM type: NRG; PAM sequence: TAG
aaccgaagttctctgagcct

SEQ ID NO: 86770 - DNA, 20 bp, Artificial Sequence
  Description of Artificial Sequence: Synthetic oligonucleotide
  Target: ATXN1; (-) strand; PAM type: NRG; PAM sequence: GAG
gcaaataaccgaagttctct

SEQ ID NO: 86771 - DNA, 20 bp, Artificial Sequence
  Description of Artificial Sequence: Synthetic oligonucleotide
  Target: ATXN1; (-) strand; PAM type: NRG; PAM sequence: AAG
cggcctttggcaaataaccg

SEQ ID NO: 86772 - DNA, 20 bp, Artificial Sequence
  Description of Artificial Sequence: Synthetic oligonucleotide
  Target: ATXN1; (-) strand; PAM type: NRG; PAM sequence: TGG
attaactgttgtgcggcctt

SEQ ID NO: 86773 - DNA, 20 bp, Artificial Sequence
  Description of Artificial Sequence: Synthetic oligonucleotide
  Target: ATXN1; (-) strand; PAM type: NRG; PAM sequence: CGG
gcctgtcattaactgttgtg

SEQ ID NO: 86774 - DNA, 20 bp, Artificial Sequence
  Description of Artificial Sequence: Synthetic oligonucleotide
  Target: ATXN1; (-) strand; PAM type: NRG; PAM sequence: AGG
gggaactgggtggaagtctt

SEQ ID NO: 86775 - DNA, 20 bp, Artificial Sequence
  Description of Artificial Sequence: Synthetic oligonucleotide
  Target: ATXN1; (-) strand; PAM type: NRG; PAM sequence: TAG
tgggaactgggtggaagtct

SEQ ID NO: 86776 - DNA, 20 bp, Artificial Sequence
  Description of Artificial Sequence: Synthetic oligonucleotide
  Target: ATXN1; (-) strand; PAM type: NRG; PAM sequence: AAG
gcacgctgggaactgggtgg

SEQ ID NO: 86777 - DNA, 20 bp, Artificial Sequence
  Description of Artificial Sequence: Synthetic oligonucleotide
  Target: ATXN1; (-) strand; PAM type: NRG; PAM sequence: TGG
tgagcacgctgggaactggg

SEQ ID NO: 86778 - DNA, 20 bp, Artificial Sequence
  Description of Artificial Sequence: Synthetic oligonucleotide
  Target: ATXN1; (-) strand; PAM type: NRG; PAM sequence: GGG
ggttgagcacgctgggaact

SEQ ID NO: 86779 - DNA, 20 bp, Artificial Sequence
  Description of Artificial Sequence: Synthetic oligonucleotide
  Target: ATXN1; (-) strand; PAM type: NRG; PAM sequence: TGG
tggttgagcacgctgggaac

SEQ ID NO: 86780 - DNA, 20 bp, Artificial Sequence
  Description of Artificial Sequence: Synthetic oligonucleotide
  Target: ATXN1; (-) strand; PAM type: NRG; PAM sequence: GGG
catcactggttgagcacgct

SEQ ID NO: 86781 - DNA, 20 bp, Artificial Sequence
  Description of Artificial Sequence: Synthetic oligonucleotide
  Target: ATXN1; (-) strand; PAM type: NRG; PAM sequence: TGG
ccatcactggttgagcacgc

SEQ ID NO: 86782 - DNA, 20 bp, Artificial Sequence
  Description of Artificial Sequence: Synthetic oligonucleotide
  Target: ATXN1; (-) strand; PAM type: NRG; PAM sequence: GAG
tgcaaagaccatcactggtt

SEQ ID NO: 86783 - DNA, 20 bp, Artificial Sequence
  Description of Artificial Sequence: Synthetic oligonucleotide
  Target: ATXN1; (-) strand; PAM type: NRG; PAM sequence: TGG
gtaaatgcaaagaccatcac

SEQ ID NO: 86784 - DNA, 20 bp, Artificial Sequence
  Description of Artificial Sequence: Synthetic oligonucleotide
  Target: ATXN1; (-) strand; PAM type: NRG; PAM sequence: AAG
atgctcagaaagtaaatgca

SEQ ID NO: 86785 - DNA, 20 bp, Artificial Sequence
  Description of Artificial Sequence: Synthetic oligonucleotide
  Target: ATXN1; (-) strand; PAM type: NRG; PAM sequence: AAG
ctgaacgctaaatgctcaga

SEQ ID NO: 86786 - DNA, 20 bp, Artificial Sequence
  Description of Artificial Sequence: Synthetic oligonucleotide
  Target: ATXN1; (-) strand; PAM type: NRG; PAM sequence: CAG
tttactgaacgctaaatgct

SEQ ID NO: 86787 - DNA, 20 bp, Artificial Sequence
  Description of Artificial Sequence: Synthetic oligonucleotide
  Target: ATXN1; (-) strand; PAM type: NRG; PAM sequence: AGG
tagcagagagtaaatgattg

SEQ ID NO: 86788 - DNA, 20 bp, Artificial Sequence
  Description of Artificial Sequence: Synthetic oligonucleotide
  Target: ATXN1; (-) strand; PAM type: NRG; PAM sequence: GAG
ttagcagagagtaaatgatt

SEQ ID NO: 86789 - DNA, 20 bp, Artificial Sequence
  Description of Artificial Sequence: Synthetic oligonucleotide
  Target: ATXN1; (-) strand; PAM type: NRG; PAM sequence: GAG
acattatctctattagcaga

SEQ ID NO: 86790 - DNA, 20 bp, Artificial Sequence
  Description of Artificial Sequence: Synthetic oligonucleotide
  Target: ATXN1; (-) strand; PAM type: NRG; PAM sequence: GAG
atacattatctctattagca

SEQ ID NO: 86791 - DNA, 20 bp, Artificial Sequence
  Description of Artificial Sequence: Synthetic oligonucleotide
  Target: ATXN1; (-) strand; PAM type: NRG; PAM sequence: CAG
gaatacattatctctattag

SEQ ID NO: 86792 - DNA, 20 bp, Artificial Sequence
  Description of Artificial Sequence: Synthetic oligonucleotide
  Target: ATXN1; (-) strand; PAM type: NRG; PAM sequence: TAG
taagaatacattatctctat

SEQ ID NO: 86793 - DNA, 20 bp, Artificial Sequence
  Description of Artificial Sequence: Synthetic oligonucleotide
  Target: ATXN1; (-) strand; PAM type: NRG; PAM sequence: AAG
aattgaattatatattcatt

SEQ ID NO: 86794 - DNA, 20 bp, Artificial Sequence
  Description of Artificial Sequence: Synthetic oligonucleotide
  Target: ATXN1; (-) strand; PAM type: NRG; PAM sequence: AGG
taggttatataatacattca

SEQ ID NO: 86795 - DNA, 20 bp, Artificial Sequence
  Description of Artificial Sequence: Synthetic oligonucleotide
  Target: ATXN1; (-) strand; PAM type: NRG; PAM sequence: AAG
ataggttatataatacattc

SEQ ID NO: 86796 - DNA, 20 bp, Artificial Sequence
  Description of Artificial Sequence: Synthetic oligonucleotide
  Target: ATXN1; (-) strand; PAM type: NRG; PAM sequence: AGG
ataagatcctaaaattttat

SEQ ID NO: 86797 - DNA, 20 bp, Artificial Sequence
  Description of Artificial Sequence: Synthetic oligonucleotide
  Target: ATXN1; (-) strand; PAM type: NRG; PAM sequence: TAG
aataagatcctaaaatttta

SEQ ID NO: 86798 - DNA, 20 bp, Artificial Sequence
  Description of Artificial Sequence: Synthetic oligonucleotide
  Target: ATXN1; (-) strand; PAM type: NRG; PAM sequence: AAG
gagacatttaacttgctaat

SEQ ID NO: 86799 - DNA, 20 bp, Artificial Sequence
  Description of Artificial Sequence: Synthetic oligonucleotide
  Target: ATXN1; (-) strand; PAM type: NRG; PAM sequence: GAG
ccagccctaatttaagaaag

SEQ ID NO: 86800 - DNA, 20 bp, Artificial Sequence
  Description of Artificial Sequence: Synthetic oligonucleotide
  Target: ATXN1; (-) strand; PAM type: NRG; PAM sequence: AGG
aaccagccctaatttaagaa

SEQ ID NO: 86801 - DNA, 20 bp, Artificial Sequence
  Description of Artificial Sequence: Synthetic oligonucleotide
  Target: ATXN1; (-) strand; PAM type: NRG; PAM sequence: AAG
aaaccagccctaatttaaga

SEQ ID NO: 86802 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaccagccctaattt

SEQ ID NO: 86803 - DNA, 20 bp, Artificial Sequence
  Description of Artificial Sequence: Synthetic oligonucleotide
  Target: ATXN1; (-) strand; PAM type: NRG; PAM sequence: CAG
attcttcaaaaaaaaaaaac

SEQ ID NO: 86804 - DNA, 20 bp, Artificial Sequence
  Description of Artificial Sequence: Synthetic oligonucleotide
  Target: ATXN1; (-) strand; PAM type: NRG; PAM sequence: AAG
aacatgaaggcgaattaatg

SEQ ID NO: 86805 - DNA, 20 bp, Artificial Sequence
  Description of Artificial Sequence: Synthetic oligonucleotide
  Target: ATXN1; (-) strand; PAM type: NRG; PAM sequence: AGG
ttatcactcttagaacatga

SEQ ID NO: 86806 - DNA, 20 bp, Artificial Sequence
  Description of Artificial Sequence: Synthetic oligonucleotide
  Target: ATXN1; (-) strand; PAM type: NRG; PAM sequence: AAG
cttatcactcttagaacatg

SEQ ID NO: 86807 - DNA, 20 bp, Artificial Sequence
  Description of Artificial Sequence: Synthetic oligonucleotide
  Target: ATXN1; (-) strand; PAM type: NRG; PAM sequence: TAG
gtgaagtctcttatcactct

SEQ ID NO: 86808 - DNA, 20 bp, Artificial Sequence
  Description of Artificial Sequence: Synthetic oligonucleotide
  Target: ATXN1; (-) strand; PAM type: NRG; PAM sequence: AAG
cttctgatttgtttcccgtg

SEQ ID NO: 86809 - DNA, 20 bp, Artificial Sequence
  Description of Artificial Sequence: Synthetic oligonucleotide
  Target: ATXN1; (-) strand; PAM type: NRG; PAM sequence: AAG
ccatttctttcgttgtccta

SEQ ID NO: 86810 - DNA, 20 bp, Artificial Sequence
  Description of Artificial Sequence: Synthetic oligonucleotide
  Target: ATXN1; (-) strand; PAM type: NRG; PAM sequence: TAG
gtagaagttaacaaatatgt

SEQ ID NO: 86811 - DNA, 20 bp, Artificial Sequence
  Description of Artificial Sequence: Synthetic oligonucleotide
  Target: ATXN1; (-) strand; PAM type: NRG; PAM sequence: AAG
tgtgtgtgtgttgtctgtag

SEQ ID NO: 86812 - DNA, 20 bp, Artificial Sequence
  Description of Artificial Sequence: Synthetic oligonucleotide
  Target: ATXN1; (-) strand; PAM type: NRG; PAM sequence: TAG
gtgtgtgtgtgtgttgtctg

SEQ ID NO: 86813 - DNA, 20 bp, Artificial Sequence
  Description of Artificial Sequence: Synthetic oligonucleotide
  Target: ATXN1; (-) strand; PAM type: NRG; PAM sequence: GGG
ttctggagccagaagtggga

SEQ ID NO: 86814 - DNA, 20 bp, Artificial Sequence
  Description of Artificial Sequence: Synthetic oligonucleotide
  Target: ATXN1; (-) strand; PAM type: NRG; PAM sequence: AGG
tttctggagccagaagtggg

SEQ ID NO: 86815 - DNA, 20 bp, Artificial Sequence
  Description of Artificial Sequence: Synthetic oligonucleotide
  Target: ATXN1; (-) strand; PAM type: NRG; PAM sequence: GAG
atttctggagccagaagtgg

SEQ ID NO: 86816 - DNA, 20 bp, Artificial Sequence
  Description of Artificial Sequence: Synthetic oligonucleotide
  Target: ATXN1; (-) strand; PAM type: NRG; PAM sequence: GGG
taatttctggagccagaagt

SEQ ID NO: 86817 - DNA, 20 bp, Artificial Sequence
  Description of Artificial Sequence: Synthetic oligonucleotide
  Target: ATXN1; (-) strand; PAM type: NRG; PAM sequence: TGG
gtaatttctggagccagaag

SEQ ID NO: 86818 - DNA, 20 bp, Artificial Sequence
  Description of Artificial Sequence: Synthetic oligonucleotide
  Target: ATXN1; (-) strand; PAM type: NRG; PAM sequence: AAG
caagtaatttctggagccag

SEQ ID NO: 86819 - DNA, 20 bp, Artificial Sequence
  Description of Artificial Sequence: Synthetic oligonucleotide
  Target: ATXN1; (-) strand; PAM type: NRG; PAM sequence: CAG
taacaagtaatttctggagc

SEQ ID NO: 86820 - DNA, 20 bp, Artificial Sequence
  Description of Artificial Sequence: Synthetic oligonucleotide
  Target: ATXN1; (-) strand; PAM type: NRG; PAM sequence: GAG
taagtaacaagtaatttctg

SEQ ID NO: 86821 - DNA, 20 bp, Artificial Sequence
  Description of Artificial Sequence: Synthetic oligonucleotide
  Target: ATXN1; (-) strand; PAM type: NRG; PAM sequence: TGG
agtaagtaacaagtaatttc

SEQ ID NO: 86822 - DNA, 20 bp, Artificial Sequence
  Description of Artificial Sequence: Synthetic oligonucleotide
  Target: ATXN1; (-) strand; PAM type: NRG; PAM sequence: AAG
cttcccacatagtaagtaac

SEQ ID NO: 86823 - DNA, 20 bp, Artificial Sequence
  Description of Artificial Sequence: Synthetic oligonucleotide
  Target: ATXN1; (-) strand; PAM type: NRG; PAM sequence: AAG
tgaattccttcccacatagt

SEQ ID NO: 86824 - DNA, 20 bp, Artificial Sequence
  Description of Artificial Sequence: Synthetic oligonucleotide
  Target: ATXN1; (-) strand; PAM type: NRG; PAM sequence: TAG
catttgaattccttcccaca

SEQ ID NO: 86825 - DNA, 20 bp, Artificial Sequence
  Description of Artificial Sequence: Synthetic oligonucleotide
  Target: ATXN1; (-) strand; PAM type: NRG; PAM sequence: AAG
ttgacctgacataacagtga

SEQ ID NO: 86826 - DNA, 20 bp, Artificial Sequence
  Description of Artificial Sequence: Synthetic oligonucleotide
  Target: ATXN1; (-) strand; PAM type: NRG; PAM sequence: CAG
aacagattgacctgacataa

SEQ ID NO: 86827 - DNA, 20 bp, Artificial Sequence
  Description of Artificial Sequence: Synthetic oligonucleotide
  Target: ATXN1; (-) strand; PAM type: NRG; PAM sequence: CAG
aaaatttacaatacacttaa

SEQ ID NO: 86828 - DNA, 20 bp, Artificial Sequence
  Description of Artificial Sequence: Synthetic oligonucleotide
  Target: ATXN1; (-) strand; PAM type: NRG; PAM sequence: TGG
atcaaagtgggatactgatg

SEQ ID NO: 86829 - DNA, 20 bp, Artificial Sequence
  Description of Artificial Sequence: Synthetic oligonucleotide
  Target: ATXN1; (-) strand; PAM type: NRG; PAM sequence: GGG
atggcattagtgatcaaagt

SEQ ID NO: 86830 - DNA, 20 bp, Artificial Sequence
  Description of Artificial Sequence: Synthetic oligonucleotide
  Target: ATXN1; (-) strand; PAM type: NRG; PAM sequence: TGG
aatggcattagtgatcaaag

SEQ ID NO: 86831 - DNA, 20 bp, Artificial Sequence
  Description of Artificial Sequence: Synthetic oligonucleotide
  Target: ATXN1; (-) strand; PAM type: NRG; PAM sequence: AAG
acaaatggcattagtgatca

SEQ ID NO: 86832 - DNA, 20 bp, Artificial Sequence
  Description of Artificial Sequence: Synthetic oligonucleotide
  Target: ATXN1; (-) strand; PAM type: NRG; PAM sequence: TAG
agctaatatacaaatggcat

SEQ ID NO: 86833 - DNA, 20 bp, Artificial Sequence
  Description of Artificial Sequence: Synthetic oligonucleotide
  Target: ATXN1; (-) strand; PAM type: NRG; PAM sequence: TGG
attacaagctaatatacaaa

SEQ ID NO: 86834 - DNA, 20 bp, Artificial Sequence
  Description of Artificial Sequence: Synthetic oligonucleotide
  Target: ATXN1; (-) strand; PAM type: NRG; PAM sequence: AAG
ttatgatcagtgtgtattac

SEQ ID NO: 86835 - DNA, 20 bp, Artificial Sequence
  Description of Artificial Sequence: Synthetic oligonucleotide
  Target: ATXN1; (-) strand; PAM type: NRG; PAM sequence: CAG
cagttttattgctttatgat

SEQ ID NO: 86836 - DNA, 20 bp, Artificial Sequence
  Description of Artificial Sequence: Synthetic oligonucleotide
  Target: ATXN1; (-) strand; PAM type: NRG; PAM sequence: CAG
ttttaaagtttagcaaaatg

SEQ ID NO: 86837 - DNA, 20 bp, Artificial Sequence
  Description of Artificial Sequence: Synthetic oligonucleotide
  Target: ATXN1; (-) strand; PAM type: NRG; PAM sequence: TAG
aagccttcatttttaaagtt

SEQ ID NO: 86838 - DNA, 20 bp, Artificial Sequence
  Description of Artificial Sequence: Synthetic oligonucleotide
  Target: ATXN1; (-) strand; PAM type: NRG; PAM sequence: AAG
ggcaaaagccttcattttta

SEQ ID NO: 86839 - DNA, 20 bp, Artificial Sequence
  Description of Artificial Sequence: Synthetic oligonucleotide
  Target: ATXN1; (-) strand; PAM type: NRG; PAM sequence: AAG
atgtcagtgtcattgggcaa

SEQ ID NO: 86840 - DNA, 20 bp, Artificial Sequence
  Description of Artificial Sequence: Synthetic oligonucleotide
  Target: ATXN1; (-) strand; PAM type: NRG; PAM sequence: GGG
gtgaggatgtcagtgtcatt

SEQ ID NO: 86841 - DNA, 20 bp, Artificial Sequence
  Description of Artificial Sequence: Synthetic oligonucleotide
  Target: ATXN1; (-) strand; PAM type: NRG; PAM sequence: TGG
cgtgaggatgtcagtgtcat

SEQ ID NO: 86842 - DNA, 20 bp, Artificial Sequence
  Description of Artificial Sequence: Synthetic oligonucleotide
  Target: ATXN1; (-) strand; PAM type: NRG; PAM sequence: CAG
aggtggtggcgtgaggatgt

SEQ ID NO: 86843 - DNA, 20 bp, Artificial Sequence
  Description of Artificial Sequence: Synthetic oligonucleotide
  Target: ATXN1; (-) strand; PAM type: NRG; PAM sequence: AGG
ggcggggaggtggtggcgtg

SEQ ID NO: 86844 - DNA, 20 bp, Artificial Sequence
  Description of Artificial Sequence: Synthetic oligonucleotide
  Target: ATXN1; (-) strand; PAM type: NRG; PAM sequence: GAG
gggcggggaggtggtggcgt

SEQ ID NO: 86845 - DNA, 20 bp, Artificial Sequence
  Description of Artificial Sequence: Synthetic oligonucleotide
  Target: ATXN1; (-) strand; PAM type: NRG; PAM sequence: TGG
taatgggggcggggaggtgg

SEQ ID NO: 86846 - DNA, 20 bp, Artificial Sequence
  Description of Artificial Sequence: Synthetic oligonucleotide
  Target: ATXN1; (-) strand; PAM type: NRG; PAM sequence: TGG
gaataatgggggcggggagg

SEQ ID NO: 86847 - DNA, 20 bp, Artificial Sequence
  Description of Artificial Sequence: Synthetic oligonucleotide
  Target: ATXN1; (-) strand; PAM type: NRG; PAM sequence: AGG
tctgaataatgggggcgggg

SEQ ID NO: 86848 - DNA, 20 bp, Artificial Sequence
  Description of Artificial Sequence: Synthetic oligonucleotide
  Target: ATXN1; (-) strand; PAM type: NRG; PAM sequence: GAG
ttctgaataatgggggcggg

SEQ ID NO: 86849 - DNA, 20 bp, Artificial Sequence
  Description of Artificial Sequence: Synthetic oligonucleotide
  Target: ATXN1; (-) strand; PAM type: NRG; PAM sequence: GGG
tattctgaataatgggggcg

SEQ ID NO: 86850 - DNA, 20 bp, Artificial Sequence
  Description of Artificial Sequence: Synthetic oligonucleotide
  Target: ATXN1; (-) strand; PAM type: NRG; PAM sequence: GGG
ttattctgaataatgggggc

SEQ ID NO: 86851 - DNA, 20 bp, Artificial Sequence
  Description of Artificial Sequence: Synthetic oligonucleotide
  Target: ATXN1; (-) strand; PAM type: NRG; PAM sequence: CGG
cttattctgaataatggggg

SEQ ID NO: 86852 - DNA, 20 bp, Artificial Sequence
  Description of Artificial Sequence: Synthetic oligonucleotide
  Target: ATXN1; (-) strand; PAM type: NRG; PAM sequence: GGG
ccacttattctgaataatgg

SEQ ID NO: 86853 - DNA, 20 bp, Artificial Sequence
  Description of Artificial Sequence: Synthetic oligonucleotide
  Target: ATXN1; (-) strand; PAM type: NRG; PAM sequence: GGG
tccacttattctgaataatg

SEQ ID NO: 86854 - DNA, 20 bp, Artificial Sequence
  Description of Artificial Sequence: Synthetic oligonucleotide
  Target: ATXN1; (-) strand; PAM type: NRG; PAM sequence: GGG
ctccacttattctgaataat

SEQ ID NO: 86855 - DNA, 20 bp, Artificial Sequence
  Description of Artificial Sequence: Synthetic oligonucleotide
  Target: ATXN1; (-) strand; PAM type: NRG; PAM sequence: TGG
actccacttattctgaataa

SEQ ID NO: 86856 - DNA, 20 bp, Artificial Sequence
  Description of Artificial Sequence: Synthetic oligonucleotide
  Target: ATXN1; (-) strand; PAM type: NRG; PAM sequence: GGG
catttgttcctccccagaaa

SEQ ID NO: 86857 - DNA, 20 bp, Artificial Sequence
  Description of Artificial Sequence: Synthetic oligonucleotide
  Target: ATXN1; (-) strand; PAM type: NRG; PAM sequence: AGG
tcatttgttcctccccagaa

SEQ ID NO: 86858 - DNA, 20 bp, Artificial Sequence
  Description of Artificial Sequence: Synthetic oligonucleotide
  Target: ATXN1; (-) strand; PAM type: NRG; PAM sequence: AAG
ttcatttgttcctccccaga

SEQ ID NO: 86859 - DNA, 20 bp, Artificial Sequence
  Description of Artificial Sequence: Synthetic oligonucleotide
  Target: ATXN1; (-) strand; PAM type: NRG; PAM sequence: CAG
ctcattcatttgttcctccc

SEQ ID NO: 86860 - DNA, 20 bp, Artificial Sequence
  Description of Artificial Sequence: Synthetic oligonucleotide
  Target: ATXN1; (-) strand; PAM type: NRG; PAM sequence: TAG
actccctaagatgccctcac

SEQ ID NO: 86861 - DNA, 20 bp, Artificial Sequence
  Description of Artificial Sequence: Synthetic oligonucleotide
  Target: ATXN1; (-) strand; PAM type: NRG; PAM sequence: AAG
tgtgggcgggggaactccct

SEQ ID NO: 86862 - DNA, 20 bp, Artificial Sequence
  Description of Artificial Sequence: Synthetic oligonucleotide
  Target: ATXN1; (-) strand; PAM type: NRG; PAM sequence: GGG
gcctcatagtctgtgggcgg

SEQ ID NO: 86863 - DNA, 20 bp, Artificial Sequence
  Description of Artificial Sequence: Synthetic oligonucleotide
  Target: ATXN1; (-) strand; PAM type: NRG; PAM sequence: GGG
tgcctcatagtctgtgggcg

SEQ ID NO: 86864 - DNA, 20 bp, Artificial Sequence
  Description of Artificial Sequence: Synthetic oligonucleotide
  Target: ATXN1; (-) strand; PAM type: NRG; PAM sequence: GGG
atgcctcatagtctgtgggc

SEQ ID NO: 86865 - DNA, 20 bp, Artificial Sequence
  Description of Artificial Sequence: Synthetic oligonucleotide
  Target: ATXN1; (-) strand; PAM type: NRG; PAM sequence: CGG
gatgcctcatagtctgtggg

SEQ ID NO: 86866 - DNA, 20 bp, Artificial Sequence
  Description of Artificial Sequence: Synthetic oligonucleotide
  Target: ATXN1; (-) strand; PAM type: NRG; PAM sequence: GGG
caagatgcctcatagtctgt

SEQ ID NO: 86867 - DNA, 20 bp, Artificial Sequence
  Description of Artificial Sequence: Synthetic oligonucleotide
  Target: ATXN1; (-) strand; PAM type: NRG; PAM sequence: TGG
tcaagatgcctcatagtctg

SEQ ID NO: 86868 - DNA, 20 bp, Artificial Sequence
  Description of Artificial Sequence: Synthetic oligonucleotide
  Target: ATXN1; (-) strand; PAM type: NRG; PAM sequence: TAG
tttcaaatcaagatgcctca

SEQ ID NO: 86869 - DNA, 20 bp, Artificial Sequence
  Description of Artificial Sequence: Synthetic oligonucleotide
  Target: ATXN1; (-) strand; PAM type: NRG; PAM sequence: AAG
ttgtgtattcctttcaaatc

SEQ ID NO: 86870 - DNA, 20 bp, Artificial Sequence
  Description of Artificial Sequence: Synthetic oligonucleotide
  Target: ATXN1; (-) strand; PAM type: NRG; PAM sequence: CAG
tgcgtgtggtgtgggtgcag

SEQ ID NO: 86871 - DNA, 20 bp, Artificial Sequence
  Description of Artificial Sequence: Synthetic oligonucleotide
  Target: ATXN1; (-) strand; PAM type: NRG; PAM sequence: CAG
gtgtgcgtgtggtgtgggtg

SEQ ID NO: 86872 - DNA, 20 bp, Artificial Sequence
  Description of Artificial Sequence: Synthetic oligonucleotide
  Target: ATXN1; (-) strand; PAM type: NRG; PAM sequence: GGG
tttttgtgtgcgtgtggtgt

SEQ ID NO: 86873 - DNA, 20 bp, Artificial Sequence
  Description of Artificial Sequence: Synthetic oligonucleotide
  Target: ATXN1; (-) strand; PAM type: NRG; PAM sequence: TGG
gtttttgtgtgcgtgtggtg

SEQ ID NO: 86874 - DNA, 20 bp, Artificial Sequence
  Description of Artificial Sequence: Synthetic oligonucleotide
  Target: ATXN1; (-) strand; PAM type: NRG; PAM sequence: TGG
aaagtgtttttgtgtgcgtg

SEQ ID NO: 86875 - DNA, 20 bp, Artificial Sequence
  Description of Artificial Sequence: Synthetic oligonucleotide
  Target: ATXN1; (-) strand; PAM type: NRG; PAM sequence: AAG
atgtaagaagtcaactttaa

SEQ ID NO: 86876 - DNA, 20 bp, Artificial Sequence
  Description of Artificial Sequence: Synthetic oligonucleotide
  Target: ATXN1; (-) strand; PAM type: NRG; PAM sequence: AAG
actgctggcttttatgtaag

SEQ ID NO: 86877 - DNA, 20 bp, Artificial Sequence
  Description of Artificial Sequence: Synthetic oligonucleotide
  Target: ATXN1; (-) strand; PAM type: NRG; PAM sequence: AAG
agtactgctggcttttatgt

SEQ ID NO: 86878 - DNA, 20 bp, Artificial Sequence
  Description of Artificial Sequence: Synthetic oligonucleotide
  Target: ATXN1; (-) strand; PAM type: NRG; PAM sequence: TGG
attctagcagggagtactgc

SEQ ID NO: 86879 - DNA, 20 bp, Artificial Sequence
  Description of Artificial Sequence: Synthetic oligonucleotide
  Target: ATXN1; (-) strand; PAM type: NRG; PAM sequence: GAG
tttcttcagattctagcagg

SEQ ID NO: 86880 - DNA, 20 bp, Artificial Sequence
  Description of Artificial Sequence: Synthetic oligonucleotide
  Target: ATXN1; (-) strand; PAM type: NRG; PAM sequence: GGG
cttttcttcagattctagca

SEQ ID NO: 86881 - DNA, 20 bp, Artificial Sequence
  Description of Artificial Sequence: Synthetic oligonucleotide
  Target: ATXN1; (-) strand; PAM type: NRG; PAM sequence: AGG
tcttttcttcagattctagc

SEQ ID NO: 86882 - DNA, 20 bp, Artificial Sequence
  Description of Artificial Sequence: Synthetic oligonucleotide
  Target: ATXN1; (-) strand; PAM type: NRG; PAM sequence: CAG
ttcttttcttcagattctag

SEQ ID NO: 86883 - DNA, 20 bp, Artificial Sequence
  Description of Artificial Sequence: Synthetic oligonucleotide
  Target: ATXN1; (-) strand; PAM type: NRG; PAM sequence: TAG
atattcttttcttcagattc

SEQ ID NO: 86884 - DNA, 20 bp, Artificial Sequence
  Description of Artificial Sequence: Synthetic oligonucleotide
  Target: ATXN1; (-) strand; PAM type: NRG; PAM sequence: CAG
aataataatattcttttctt

SEQ ID NO: 86885 - DNA, 20 bp, Artificial Sequence
  Description of Artificial Sequence: Synthetic oligonucleotide
  Target: ATXN1; (-) strand; PAM type: NRG; PAM sequence: TAG
ccttgccagtaaaataataa

SEQ ID NO: 86886 - DNA, 20 bp, Artificial Sequence
  Description of Artificial Sequence: Synthetic oligonucleotide
  Target: ATXN1; (-) strand; PAM type: NRG; PAM sequence: CAG
aaccccctgaaaggccttgc

SEQ ID NO: 86887 - DNA, 20 bp, Artificial Sequence
  Description of Artificial Sequence: Synthetic oligonucleotide
  Target: ATXN1; (-) strand; PAM type: NRG; PAM sequence: AGG
atgaagcataaccccctgaa

SEQ ID NO: 86888 - DNA, 20 bp, Artificial Sequence
  Description of Artificial Sequence: Synthetic oligonucleotide
  Target: ATXN1; (-) strand; PAM type: NRG; PAM sequence: AAG
aatgaagcataaccccctga

SEQ ID NO: 86889 - DNA, 20 bp, Artificial Sequence
  Description of Artificial Sequence: Synthetic oligonucleotide
  Target: ATXN1; (-) strand; PAM type: NRG; PAM sequence: AAG
caattaggctcaattgaatg

SEQ ID NO: 86890 - DNA, 20 bp, Artificial Sequence
  Description of Artificial Sequence: Synthetic oligonucleotide
  Target: ATXN1; (-) strand; PAM type: NRG; PAM sequence: AGG
atgtgttagctttatcaatt

SEQ ID NO: 86891 - DNA, 20 bp, Artificial Sequence
  Description of Artificial Sequence: Synthetic oligonucleotide
  Target: ATXN1; (-) strand; PAM type: NRG; PAM sequence: TAG
catgtgttagctttatcaat

SEQ ID NO: 86892 - DNA, 20 bp, Artificial Sequence
  Description of Artificial Sequence: Synthetic oligonucleotide
  Target: ATXN1; (-) strand; PAM type: NRG; PAM sequence: TAG
tattacctgtaaacatgtgt

SEQ ID NO: 86893 - DNA, 20 bp, Artificial Sequence
  Description of Artificial Sequence: Synthetic oligonucleotide
  Target: ATXN1; (-) strand; PAM type: NRG; PAM sequence: TAG
ctgatttgtttccatgtaga

SEQ ID NO: 86894 - DNA, 20 bp, Artificial Sequence
  Description of Artificial Sequence: Synthetic oligonucleotide
  Target: ATXN1; (-) strand; PAM type: NRG; PAM sequence: TAG
ctccctgatttgtttccatg

SEQ ID NO: 86895 - DNA, 20 bp, Artificial Sequence
  Description of Artificial Sequence: Synthetic oligonucleotide
  Target: ATXN1; (-) strand; PAM type: NRG; PAM sequence: TGG
tttaaagaatgaataatgac

SEQ ID NO: 86896 - DNA, 20 bp, Artificial Sequence
  Description of Artificial Sequence: Synthetic oligonucleotide
  Target: ATXN1; (-) strand; PAM type: NRG; PAM sequence: AAG
attttagtttttacagttta

SEQ ID NO: 86897 - DNA, 20 bp, Artificial Sequence
  Description of Artificial Sequence: Synthetic oligonucleotide
  Target: ATXN1; (-) strand; PAM type: NRG; PAM sequence: CAG
agagaacattttagttttta

SEQ ID NO: 86898 - DNA, 20 bp, Artificial Sequence
  Description of Artificial Sequence: Synthetic oligonucleotide
  Target: ATXN1; (-) strand; PAM type: NRG; PAM sequence: TAG
ataatgcttagagaacattt

SEQ ID NO: 86899 - DNA, 20 bp, Artificial Sequence
  Description of Artificial Sequence: Synthetic oligonucleotide
  Target: ATXN1; (-) strand; PAM type: NRG; PAM sequence: GAG
ttaggacttgataatgctta

SEQ ID NO: 86900 - DNA, 20 bp, Artificial Sequence
  Description of Artificial Sequence: Synthetic oligonucleotide
  Target: ATXN1; (-) strand; PAM type: NRG; PAM sequence: TAG
gtttaggacttgataatgct

SEQ ID NO: 86901 - DNA, 20 bp, Artificial Sequence
  Description of Artificial Sequence: Synthetic oligonucleotide
  Target: ATXN1; (-) strand; PAM type: NRG; PAM sequence: AGG
gtgaaattatatttttgttt

SEQ ID NO: 86902 - DNA, 20 bp, Artificial Sequence
  Description of Artificial Sequence: Synthetic oligonucleotide
  Target: ATXN1; (-) strand; PAM type: NRG; PAM sequence: TAG
tgtgaaattatatttttgtt

SEQ ID NO: 86903 - DNA, 20 bp, Artificial Sequence
  Description of Artificial Sequence: Synthetic oligonucleotide
  Target: ATXN1; (-) strand; PAM type: NRG; PAM sequence: CAG
tataccagtaaagctaaagt

SEQ ID NO: 86904 - DNA, 20 bp, Artificial Sequence
  Description of Artificial Sequence: Synthetic oligonucleotide
  Target: ATXN1; (-) strand; PAM type: NRG; PAM sequence: AAG
taaatataccagtaaagcta

SEQ ID NO: 86905 - DNA, 20 bp, Artificial Sequence
  Description of Artificial Sequence: Synthetic oligonucleotide
  Target: ATXN1; (-) strand; PAM type: NRG; PAM sequence: AAG
aacaaataaatataccagta

SEQ ID NO: 86906 - DNA, 20 bp, Artificial Sequence
  Description of Artificial Sequence: Synthetic oligonucleotide
  Target: ATXN1; (-) strand; PAM type: NRG; PAM sequence: CAG
gagataacaaataaatatac

SEQ ID NO: 86907 - DNA, 20 bp, Artificial Sequence
  Description of Artificial Sequence: Synthetic oligonucleotide
  Target: ATXN1; (-) strand; PAM type: NRG; PAM sequence: GAG
atattccatttttaagaaca

SEQ ID NO: 86908 - DNA, 20 bp, Artificial Sequence
  Description of Artificial Sequence: Synthetic oligonucleotide
  Target: ATXN1; (-) strand; PAM type: NRG; PAM sequence: CAG
aaatattccatttttaagaa

SEQ ID NO: 86909 - DNA, 20 bp, Artificial Sequence
  Description of Artificial Sequence: Synthetic oligonucleotide
  Target: ATXN1; (-) strand; PAM type: NRG; PAM sequence: AAG
cctggaaatattccattttt

SEQ ID NO: 86910 - DNA, 20 bp, Artificial Sequence
  Description of Artificial Sequence: Synthetic oligonucleotide
  Target: ATXN1; (-) strand; PAM type: NRG; PAM sequence: TGG
ttacttatactttttgtccc

SEQ ID NO: 86911 - DNA, 20 bp, Artificial Sequence
  Description of Artificial Sequence: Synthetic oligonucleotide
  Target: ATXN1; (-) strand; PAM type: NRG; PAM sequence: CAG
taagatattgttttaaatgt

SEQ ID NO: 86912 - DNA, 20 bp, Artificial Sequence
  Description of Artificial Sequence: Synthetic oligonucleotide
  Target: ATXN1; (-) strand; PAM type: NRG; PAM sequence: AAG
cattaagaatattcggtatt

SEQ ID NO: 86913 - DNA, 20 bp, Artificial Sequence
  Description of Artificial Sequence: Synthetic oligonucleotide
  Target: ATXN1; (-) strand; PAM type: NRG; PAM sequence: CGG
aacttttcattaagaatatt

SEQ ID NO: 86914 - DNA, 20 bp, Artificial Sequence
  Description of Artificial Sequence: Synthetic oligonucleotide
  Target: ATXN1; (-) strand; PAM type: NRG; PAM sequence: AAG
aaaaaacagaacttttcatt

SEQ ID NO: 86915 - DNA, 20 bp, Artificial Sequence
  Description of Artificial Sequence: Synthetic oligonucleotide
  Target: ATXN1; (-) strand; PAM type: NRG; PAM sequence: CAG
ggaggacttttcaaaaaaaa

SEQ ID NO: 86916 - DNA, 20 bp, Artificial Sequence
  Description of Artificial Sequence: Synthetic oligonucleotide
  Target: ATXN1; (-) strand; PAM type: NRG; PAM sequence: AGG
gaattgacatgtatgtatgg

SEQ ID NO: 86917 - DNA, 20 bp, Artificial Sequence
  Description of Artificial Sequence: Synthetic oligonucleotide
  Target: ATXN1; (-) strand; PAM type: NRG; PAM sequence: GAG
tgaattgacatgtatgtatg

SEQ ID NO: 86918 - DNA, 20 bp, Artificial Sequence
  Description of Artificial Sequence: Synthetic oligonucleotide
  Target: ATXN1; (-) strand; PAM type: NRG; PAM sequence: TGG
tgtgaattgacatgtatgta

SEQ ID NO: 86919 - DNA, 20 bp, Artificial Sequence
  Description of Artificial Sequence: Synthetic oligonucleotide
  Target: ATXN1; (-) strand; PAM type: NRG; PAM sequence: TAG
aatgcattttgagtaatttt

SEQ ID NO: 86920 - DNA, 20 bp, Artificial Sequence
  Description of Artificial Sequence: Synthetic oligonucleotide
  Target: ATXN1; (-) strand; PAM type: NRG; PAM sequence: GAG
gcgaaaagacaatgcatttt

SEQ ID NO: 86921 - DNA, 20 bp, Artificial Sequence
  Description of Artificial Sequence: Synthetic oligonucleotide
  Target: ATXN1; (-) strand; PAM type: NRG; PAM sequence: AAG
atatagtatcaggaagcgaa

SEQ ID NO: 86922 - DNA, 20 bp, Artificial Sequence
  Description of Artificial Sequence: Synthetic oligonucleotide
  Target: ATXN1; (-) strand; PAM type: NRG; PAM sequence: AAG
ctgcaaaatatagtatcagg

SEQ ID NO: 86923 - DNA, 20 bp, Artificial Sequence
  Description of Artificial Sequence: Synthetic oligonucleotide
  Target: ATXN1; (-) strand; PAM type: NRG; PAM sequence: AGG
gcactgcaaaatatagtatc

SEQ ID NO: 86924 - DNA, 20 bp, Artificial Sequence
  Description of Artificial Sequence: Synthetic oligonucleotide
  Target: ATXN1; (-) strand; PAM type: NRG; PAM sequence: CAG
tgcactgcaaaatatagtat

SEQ ID NO: 86925 - DNA, 20 bp, Artificial Sequence
  Description of Artificial Sequence: Synthetic oligonucleotide
  Target: ATXN1; (-) strand; PAM type: NRG; PAM sequence: TAG
ccaccatgcactgcaaaata

SEQ ID NO: 86926 - DNA, 20 bp, Artificial Sequence
  Description of Artificial Sequence: Synthetic oligonucleotide
  Target: ATXN1; (-) strand; PAM type: NRG; PAM sequence: AGG
tataaataatctgtgtaaca

SEQ ID NO: 86927 - DNA, 20 bp, Artificial Sequence
  Description of Artificial Sequence: Synthetic oligonucleotide
  Target: ATXN1; (-) strand; PAM type: NRG; PAM sequence: AAG
ctataaataatctgtgtaac

SEQ ID NO: 86928 - DNA, 20 bp, Artificial Sequence
  Description of Artificial Sequence: Synthetic oligonucleotide
  Target: ATXN1; (-) strand; PAM type: NRG; PAM sequence: GGG
ctctgtgttatgtatgtttt

SEQ ID NO: 86929 - DNA, 20 bp, Artificial Sequence
  Description of Artificial Sequence: Synthetic oligonucleotide
  Target: ATXN1; (-) strand; PAM type: NRG; PAM sequence: TGG
actctgtgttatgtatgttt

SEQ ID NO: 86930 - DNA, 20 bp, Artificial Sequence
  Description of Artificial Sequence: Synthetic oligonucleotide
  Target: ATXN1; (-) strand; PAM type: NRG; PAM sequence: AAG
ctgatatggttttaaaattt

SEQ ID NO: 86931 - DNA, 20 bp, Artificial Sequence
  Description of Artificial Sequence: Synthetic oligonucleotide
  Target: ATXN1; (-) strand; PAM type: NRG; PAM sequence: TGG
gtatattttagtatctgata

SEQ ID NO: 86932 - DNA, 20 bp, Artificial Sequence
  Description of Artificial Sequence: Synthetic oligonucleotide
  Target: ATXN1; (-) strand; PAM type: NRG; PAM sequence: TAG
gaaggataagttgtatattt

SEQ ID NO: 86933 - DNA, 20 bp, Artificial Sequence
  Description of Artificial Sequence: Synthetic oligonucleotide
  Target: ATXN1; (-) strand; PAM type: NRG; PAM sequence: AAG
taggaaagacctggaaggat

SEQ ID NO: 86934 - DNA, 20 bp, Artificial Sequence
  Description of Artificial Sequence: Synthetic oligonucleotide
  Target: ATXN1; (-) strand; PAM type: NRG; PAM sequence: AGG
ccttttaggaaagacctgga

SEQ ID NO: 86935 - DNA, 20 bp, Artificial Sequence
  Description of Artificial Sequence: Synthetic oligonucleotide
  Target: ATXN1; (-) strand; PAM type: NRG; PAM sequence: AAG
accttttaggaaagacctgg

SEQ ID NO: 86936 - DNA, 20 bp, Artificial Sequence
  Description of Artificial Sequence: Synthetic oligonucleotide
  Target: ATXN1; (-) strand; PAM type: NRG; PAM sequence: TGG
tataccttttaggaaagacc

SEQ ID NO: 86937 - DNA, 20 bp, Artificial Sequence
  Description of Artificial Sequence: Synthetic oligonucleotide
  Target: ATXN1; (-) strand; PAM type: NRG; PAM sequence: AAG
tgtatgtataccttttagga

SEQ ID NO: 86938 - DNA, 20 bp, Artificial Sequence
  Description of Artificial Sequence: Synthetic oligonucleotide
  Target: ATXN1; (-) strand; PAM type: NRG; PAM sequence: AGG
gaagtgtatgtatacctttt

SEQ ID NO: 86939 - DNA, 20 bp, Artificial Sequence
  Description of Artificial Sequence: Synthetic oligonucleotide
  Target: ATXN1; (-) strand; PAM type: NRG; PAM sequence: TAG
ggaagtgtatgtataccttt

SEQ ID NO: 86940 - DNA, 20 bp, Artificial Sequence
  Description of Artificial Sequence: Synthetic oligonucleotide
  Target: ATXN1; (-) strand; PAM type: NRG; PAM sequence: AAG
ttttttttatactacttcgg

SEQ ID NO: 86941 - DNA, 20 bp, Artificial Sequence
  Description of Artificial Sequence: Synthetic oligonucleotide
  Target: ATXN1; (-) strand; PAM type: NRG; PAM sequence: CGG
ctcttttttttatactactt

SEQ ID NO: 86942 - DNA, 20 bp, Artificial Sequence
  Description of Artificial Sequence: Synthetic oligonucleotide
  Target: ATXN1; (-) strand; PAM type: NRG; PAM sequence: CAG
actaattcacagtgcgttat

SEQ ID NO: 86943 - DNA, 20 bp, Artificial Sequence
  Description of Artificial Sequence: Synthetic oligonucleotide
  Target: ATXN1; (-) strand; PAM type: NRG; PAM sequence: CAG
taagataattcactaattca

SEQ ID NO: 86944 - DNA, 20 bp, Artificial Sequence
  Description of Artificial Sequence: Synthetic oligonucleotide
  Target: ATXN1; (-) strand; PAM type: NRG; PAM sequence: AAG
ttaattaggacagtgttgtt

SEQ ID NO: 86945 - DNA, 20 bp, Artificial Sequence
  Description of Artificial Sequence: Synthetic oligonucleotide
  Target: ATXN1; (-) strand; PAM type: NRG; PAM sequence: CAG
cttattggtcttaattagga

SEQ ID NO: 86946 - DNA, 20 bp, Artificial Sequence
  Description of Artificial Sequence: Synthetic oligonucleotide
  Target: ATXN1; (-) strand; PAM type: NRG; PAM sequence: AGG
ctttcttattggtcttaatt

SEQ ID NO: 86947 - DNA, 20 bp, Artificial Sequence
  Description of Artificial Sequence: Synthetic oligonucleotide
  Target: ATXN1; (-) strand; PAM type: NRG; PAM sequence: TAG
gctttcttattggtcttaat

SEQ ID NO: 86948 - DNA, 20 bp, Artificial Sequence
  Description of Artificial Sequence: Synthetic oligonucleotide
  Target: ATXN1; (-) strand; PAM type: NRG; PAM sequence: TGG
tggatggatggctttcttat

SEQ ID NO: 86949 - DNA, 20 bp, Artificial Sequence
  Description of Artificial Sequence: Synthetic oligonucleotide
  Target: ATXN1; (-) strand; PAM type: NRG; PAM sequence: TGG
ctcgtggaatattggatgga

SEQ ID NO: 86950 - DNA, 20 bp, Artificial Sequence
  Description of Artificial Sequence: Synthetic oligonucleotide
  Target: ATXN1; (-) strand; PAM type: NRG; PAM sequence: TGG
ctgtctcgtggaatattgga

SEQ ID NO: 86951 - DNA, 20 bp, Artificial Sequence
  Description of Artificial Sequence: Synthetic oligonucleotide
  Target: ATXN1; (-) strand; PAM type: NRG; PAM sequence: TGG
ctggctgtctcgtggaatat

SEQ ID NO: 86952 - DNA, 20 bp, Artificial Sequence
  Description of Artificial Sequence: Synthetic oligonucleotide
  Target: ATXN1; (-) strand; PAM type: NRG; PAM sequence: TGG
cgggaagcctggctgtctcg

SEQ ID NO: 86953 - DNA, 20 bp, Artificial Sequence
  Description of Artificial Sequence: Synthetic oligonucleotide
  Target: ATXN1; (-) strand; PAM type: NRG; PAM sequence: TGG
taattacacaacgggaagcc

SEQ ID NO: 86954 - DNA, 20 bp, Artificial Sequence
  Description of Artificial Sequence: Synthetic oligonucleotide
  Target: ATXN1; (-) strand; PAM type: NRG; PAM sequence: AAG
gtgaataattacacaacggg

SEQ ID NO: 86955 - DNA, 20 bp, Artificial Sequence
  Description of Artificial Sequence: Synthetic oligonucleotide
  Target: ATXN1; (-) strand; PAM type: NRG; PAM sequence: GGG
gaggtgaataattacacaac

SEQ ID NO: 86956 - DNA, 20 bp, Artificial Sequence
  Description of Artificial Sequence: Synthetic oligonucleotide
  Target: ATXN1; (-) strand; PAM type: NRG; PAM sequence: CGG
tgaggtgaataattacacaa

SEQ ID NO: 86957 - DNA, 20 bp, Artificial Sequence
  Description of Artificial Sequence: Synthetic oligonucleotide
  Target: ATXN1; (-) strand; PAM type: NRG; PAM sequence: AGG
cttcaaggtggaccactatg

SEQ ID NO: 86958 - DNA, 20 bp, Artificial Sequence
  Description of Artificial Sequence: Synthetic oligonucleotide
  Target: ATXN1; (-) strand; PAM type: NRG; PAM sequence: GAG
ccttcaaggtggaccactat

SEQ ID NO: 86959 - DNA, 20 bp, Artificial Sequence
  Description of Artificial Sequence: Synthetic oligonucleotide
  Target: ATXN1; (-) strand; PAM type: NRG; PAM sequence: TGG
tgtgttgcatgccttcaagg

SEQ ID NO: 86960 - DNA, 20 bp, Artificial Sequence
  Description of Artificial Sequence: Synthetic oligonucleotide
  Target: ATXN1; (-) strand; PAM type: NRG; PAM sequence: AGG
taatgtgttgcatgccttca

SEQ ID NO: 86961 - DNA, 20 bp, Artificial Sequence
  Description of Artificial Sequence: Synthetic oligonucleotide
  Target: ATXN1; (-) strand; PAM type: NRG; PAM sequence: AAG
ataatgtgttgcatgccttc

SEQ ID NO: 86962 - DNA, 20 bp, Artificial Sequence
  Description of Artificial Sequence: Synthetic oligonucleotide
  Target: ATXN1; (-) strand; PAM type: NRG; PAM sequence: CGG
tctatataaatatctctttt

SEQ ID NO: 86963 - DNA, 20 bp, Artificial Sequence
  Description of Artificial Sequence: Synthetic oligonucleotide
  Target: ATXN1; (-) strand; PAM type: NRG; PAM sequence: AAG
tagggacatccgcatgtcct

SEQ ID NO: 86964 - DNA, 20 bp, Artificial Sequence
  Description of Artificial Sequence: Synthetic oligonucleotide
  Target: ATXN1; (-) strand; PAM type: NRG; PAM sequence: GGG
ggtcaagaatctttatttta

SEQ ID NO: 86965 - DNA, 20 bp, Artificial Sequence
  Description of Artificial Sequence: Synthetic oligonucleotide
  Target: ATXN1; (-) strand; PAM type: NRG; PAM sequence: AGG
tggtcaagaatctttatttt

SEQ ID NO: 86966 - DNA, 20 bp, Artificial Sequence
  Description of Artificial Sequence: Synthetic oligonucleotide
  Target: ATXN1; (-) strand; PAM type: NRG; PAM sequence: TAG
gtggtcaagaatctttattt

SEQ ID NO: 86967 - DNA, 20 bp, Artificial Sequence
  Description of Artificial Sequence: Synthetic oligonucleotide
  Target: ATXN1; (-) strand; PAM type: NRG; PAM sequence: AAG
actgagtagctcgagtggtc

SEQ ID NO: 86968 - DNA, 20 bp, Artificial Sequence
  Description of Artificial Sequence: Synthetic oligonucleotide
  Target: ATXN1; (-) strand; PAM type: NRG; PAM sequence: TGG
gaaatactgagtagctcgag

SEQ ID NO: 86969 - DNA, 20 bp, Artificial Sequence
  Description of Artificial Sequence: Synthetic oligonucleotide
  Target: ATXN1; (-) strand; PAM type: NRG; PAM sequence: GAG
agagaaatactgagtagctc

SEQ ID NO: 86970 - DNA, 20 bp, Artificial Sequence
  Description of Artificial Sequence: Synthetic oligonucleotide
  Target: ATXN1; (-) strand; PAM type: NRG; PAM sequence: TAG
gcctagagagaaatactgag

SEQ ID NO: 86971 - DNA, 20 bp, Artificial Sequence
  Description of Artificial Sequence: Synthetic oligonucleotide
  Target: ATXN1; (-) strand; PAM type: NRG; PAM sequence: GAG
ctagcctagagagaaatact

SEQ ID NO: 86972 - DNA, 20 bp, Artificial Sequence
  Description of Artificial Sequence: Synthetic oligonucleotide
  Target: ATXN1; (-) strand; PAM type: NRG; PAM sequence: GAG
ttttctgtttctagcctaga

SEQ ID NO: 86973 - DNA, 20 bp, Artificial Sequence
  Description of Artificial Sequence: Synthetic oligonucleotide
  Target: ATXN1; (-) strand; PAM type: NRG; PAM sequence: GAG
tcttttctgtttctagccta

SEQ ID NO: 86974 - DNA, 20 bp, Artificial Sequence
  Description of Artificial Sequence: Synthetic oligonucleotide
  Target: ATXN1; (-) strand; PAM type: NRG; PAM sequence: TAG
aatcttttctgtttctagcc

SEQ ID NO: 86975 - DNA, 20 bp, Artificial Sequence
  Description of Artificial Sequence: Synthetic oligonucleotide
  Target: ATXN1; (-) strand; PAM type: NRG; PAM sequence: TAG
tatttaatcttttctgtttc

SEQ ID NO: 86976 - DNA, 20 bp, Artificial Sequence
  Description of Artificial Sequence: Synthetic oligonucleotide
  Target: ATXN1; (-) strand; PAM type: NRG; PAM sequence: TGG
ggtttcttgcttttcattga

SEQ ID NO: 86977 - DNA, 20 bp, Artificial Sequence
  Description of Artificial Sequence: Synthetic oligonucleotide
  Target: ATXN1; (-) strand; PAM type: NRG; PAM sequence: CGG
cttgccttgaaatgctctta

SEQ ID NO: 86978 - DNA, 20 bp, Artificial Sequence
  Description of Artificial Sequence: Synthetic oligonucleotide
  Target: ATXN1; (-) strand; PAM type: NRG; PAM sequence: AAG
aaatatttgtaggactttaa

SEQ ID NO: 86979 - DNA, 20 bp, Artificial Sequence
  Description of Artificial Sequence: Synthetic oligonucleotide
  Target: ATXN1; (-) strand; PAM type: NRG; PAM sequence: AGG
ggttatacttaaatatttgt

SEQ ID NO: 86980 - DNA, 20 bp, Artificial Sequence
  Description of Artificial Sequence: Synthetic oligonucleotide
  Target: ATXN1; (-) strand; PAM type: NRG; PAM sequence: TAG
aggttatacttaaatatttg

SEQ ID NO: 86981 - DNA, 20 bp, Artificial Sequence
  Description of Artificial Sequence: Synthetic oligonucleotide
  Target: ATXN1; (-) strand; PAM type: NRG; PAM sequence: AGG
tatttttaaaaagtgtagag

SEQ ID NO: 86982 - DNA, 20 bp, Artificial Sequence
  Description of Artificial Sequence: Synthetic oligonucleotide
  Target: ATXN1; (-) strand; PAM type: NRG; PAM sequence: GAG
gtatttttaaaaagtgtaga

SEQ ID NO: 86983 - DNA, 20 bp, Artificial Sequence
  Description of Artificial Sequence: Synthetic oligonucleotide
  Target: ATXN1; (-) strand; PAM type: NRG; PAM sequence: GAG
ctgtatttttaaaaagtgta

SEQ ID NO: 86984 - DNA, 20 bp, Artificial Sequence
  Description of Artificial Sequence: Synthetic oligonucleotide
  Target: ATXN1; (-) strand; PAM type: NRG; PAM sequence: TAG
aactgtatttttaaaaagtg

SEQ ID NO: 86985 - DNA, 20 bp, Artificial Sequence
  Description of Artificial Sequence: Synthetic oligonucleotide
  Target: ATXN1; (-) strand; PAM type: NRG; PAM sequence: AAG
aaataaactgtatttttaaa

SEQ ID NO: 86986 - DNA, 20 bp, Artificial Sequence
  Description of Artificial Sequence: Synthetic oligonucleotide
  Target: ATXN1; (-) strand; PAM type: NRG; PAM sequence: TGG
aatatttcttgtttatttga

SEQ ID NO: 86987 - DNA, 20 bp, Artificial Sequence
  Description of Artificial Sequence: Synthetic oligonucleotide
  Target: ATXN1; (-) strand; PAM type: NRG; PAM sequence: CAG
ctggccacaaaggaggttct

SEQ ID NO: 86988 - DNA, 20 bp, Artificial Sequence
  Description of Artificial Sequence: Synthetic oligonucleotide
  Target: ATXN1; (-) strand; PAM type: NRG; PAM sequence: AGG
cataatcctggccacaaagg

SEQ ID NO: 86989 - DNA, 20 bp, Artificial Sequence
  Description of Artificial Sequence: Synthetic oligonucleotide
  Target: ATXN1; (-) strand; PAM type: NRG; PAM sequence: GAG
acataatcctggccacaaag

SEQ ID NO: 86990 - DNA, 20 bp, Artificial Sequence
  Description of Artificial Sequence: Synthetic oligonucleotide
  Target: ATXN1; (-) strand; PAM type: NRG; PAM sequence: AGG
aaacataatcctggccacaa

SEQ ID NO: 86991 - DNA, 20 bp, Artificial Sequence
  Description of Artificial Sequence: Synthetic oligonucleotide
  Target: ATXN1; (-) strand; PAM type: NRG; PAM sequence: AAG
gaaacataatcctggccaca

SEQ ID NO: 86992 - DNA, 20 bp, Artificial Sequence
  Description of Artificial Sequence: Synthetic oligonucleotide
  Target: ATXN1; (-) strand; PAM type: NRG; PAM sequence: TGG
cttagatagaaacataatcc

SEQ ID NO: 86993 - DNA, 20 bp, Artificial Sequence
  Description of Artificial Sequence: Synthetic oligonucleotide
  Target: ATXN1; (-) strand; PAM type: NRG; PAM sequence: TAG
ccaagttcatgggacttaga

SEQ ID NO: 86994 - DNA, 20 bp, Artificial Sequence
  Description of Artificial Sequence: Synthetic oligonucleotide
  Target: ATXN1; (-) strand; PAM type: NRG; PAM sequence: TAG
tgctccaagttcatgggact

SEQ ID NO: 86995 - DNA, 20 bp, Artificial Sequence
  Description of Artificial Sequence: Synthetic oligonucleotide
  Target: ATXN1; (-) strand; PAM type: NRG; PAM sequence: GGG
taaatatgctccaagttcat

SEQ ID NO: 86996 - DNA, 20 bp, Artificial Sequence
  Description of Artificial Sequence: Synthetic oligonucleotide
  Target: ATXN1; (-) strand; PAM type: NRG; PAM sequence: TGG
gtaaatatgctccaagttca

SEQ ID NO: 86997 - DNA, 20 bp, Artificial Sequence
  Description of Artificial Sequence: Synthetic oligonucleotide
  Target: ATXN1; (-) strand; PAM type: NRG; PAM sequence: AAG
taattttgtaaatatgctcc

SEQ ID NO: 86998 - DNA, 20 bp, Artificial Sequence
  Description of Artificial Sequence: Synthetic oligonucleotide
  Target: ATXN1; (-) strand; PAM type: NRG; PAM sequence: AAG
attcattgaaatactttata

SEQ ID NO: 86999 - DNA, 20 bp, Artificial Sequence
  Description of Artificial Sequence: Synthetic oligonucleotide
  Target: ATXN1; (-) strand; PAM type: NRG; PAM sequence: AAG
cagccccatgcacattttgg

SEQ ID NO: 87000 - DNA, 20 bp, Artificial Sequence
  Description of Artificial Sequence: Synthetic oligonucleotide
  Target: ATXN1; (-) strand; PAM type: NRG; PAM sequence: TGG
ttacagccccatgcacattt

SEQ ID NO: 87001 - DNA, 20 bp, Artificial Sequence
  Description of Artificial Sequence: Synthetic oligonucleotide
  Target: ATXN1; (-) strand; PAM type: NRG; PAM sequence: CAG
gtaaacactagatggaatta

SEQ ID NO: 87002 - DNA, 20 bp, Artificial Sequence
  Description of Artificial Sequence: Synthetic oligonucleotide
  Target: ATXN1; (-) strand; PAM type: NRG; PAM sequence: TGG
gtgtcattgtaaacactaga

SEQ ID NO: 87003 - DNA, 20 bp, Artificial Sequence
  Description of Artificial Sequence: Synthetic oligonucleotide
  Target: ATXN1; (-) strand; PAM type: NRG; PAM sequence: TAG
tatagtgtcattgtaaacac

SEQ ID NO: 87004 - DNA, 20 bp, Artificial Sequence
  Description of Artificial Sequence: Synthetic oligonucleotide
  Target: ATXN1; (-) strand; PAM type: NRG; PAM sequence: TAG
gtaattccatccaaggctta

SEQ ID NO: 87005 - DNA, 20 bp, Artificial Sequence
  Description of Artificial Sequence: Synthetic oligonucleotide
  Target: ATXN1; (-) strand; PAM type: NRG; PAM sequence: AGG
taagattgtaattccatcca

SEQ ID NO: 87006 - DNA, 20 bp, Artificial Sequence
  Description of Artificial Sequence: Synthetic oligonucleotide
  Target: ATXN1; (-) strand; PAM type: NRG; PAM sequence: AAG
ttaagattgtaattccatcc

SEQ ID NO: 87007 - DNA, 20 bp, Artificial Sequence
  Description of Artificial Sequence: Synthetic oligonucleotide
  Target: ATXN1; (-) strand; PAM type: NRG; PAM sequence: AAG
gcactctgattgttcccatt

SEQ ID NO: 87008 - DNA, 20 bp, Artificial Sequence
  Description of Artificial Sequence: Synthetic oligonucleotide
  Target: ATXN1; (-) strand; PAM type: NRG; PAM sequence: TAG
aattctctgagcatatggag

SEQ ID NO: 87009 - DNA, 20 bp, Artificial Sequence
  Description of Artificial Sequence: Synthetic oligonucleotide
  Target: ATXN1; (-) strand; PAM type: NRG; PAM sequence: GAG
ctgaattctctgagcatatg

SEQ ID NO: 87010 - DNA, 20 bp, Artificial Sequence
  Description of Artificial Sequence: Synthetic oligonucleotide
  Target: ATXN1; (-) strand; PAM type: NRG; PAM sequence: TGG
tcctgaattctctgagcata

SEQ ID NO: 87011 - DNA, 20 bp, Artificial Sequence
  Description of Artificial Sequence: Synthetic oligonucleotide
  Target: ATXN1; (-) strand; PAM type: NRG; PAM sequence: GAG
gagttcatcctgaattctct

SEQ ID NO: 87012 - DNA, 20 bp, Artificial Sequence
  Description of Artificial Sequence: Synthetic oligonucleotide
  Target: ATXN1; (-) strand; PAM type: NRG; PAM sequence: GAG
tgctttttattttagaagtt

SEQ ID NO: 87013 - DNA, 20 bp, Artificial Sequence
  Description of Artificial Sequence: Synthetic oligonucleotide
  Target: ATXN1; (-) strand; PAM type: NRG; PAM sequence: AAG
cttggtgctttttattttag

SEQ ID NO: 87014 - DNA, 20 bp, Artificial Sequence
  Description of Artificial Sequence: Synthetic oligonucleotide
  Target: ATXN1; (-) strand; PAM type: NRG; PAM sequence: TAG
tggcttggtgctttttattt

SEQ ID NO: 87015 - DNA, 20 bp, Artificial Sequence
  Description of Artificial Sequence: Synthetic oligonucleotide
  Target: ATXN1; (-) strand; PAM type: NRG; PAM sequence: TGG
gtaattacatgccaatggct

SEQ ID NO: 87016 - DNA, 20 bp, Artificial Sequence
  Description of Artificial Sequence: Synthetic oligonucleotide
  Target: ATXN1; (-) strand; PAM type: NRG; PAM sequence: TGG
tggttgtaattacatgccaa

SEQ ID NO: 87017 - DNA, 20 bp, Artificial Sequence
  Description of Artificial Sequence: Synthetic oligonucleotide
  Target: ATXN1; (-) strand; PAM type: NRG; PAM sequence: TGG
aagcagacagcttggcctcc

SEQ ID NO: 87018 - DNA, 20 bp, Artificial Sequence
  Description of Artificial Sequence: Synthetic oligonucleotide
  Target: ATXN1; (-) strand; PAM type: NRG; PAM sequence: TGG
atactagcaagcagacagct

SEQ ID NO: 87019 - DNA, 20 bp, Artificial Sequence
  Description of Artificial Sequence: Synthetic oligonucleotide
  Target: ATXN1; (-) strand; PAM type: NRG; PAM sequence: CAG
ctcatatactagcaagcaga

SEQ ID NO: 87020 - DNA, 20 bp, Artificial Sequence
  Description of Artificial Sequence: Synthetic oligonucleotide
  Target: ATXN1; (-) strand; PAM type: NRG; PAM sequence: CAG
atttctcatatactagcaag

SEQ ID NO: 87021 - DNA, 20 bp, Artificial Sequence
  Description of Artificial Sequence: Synthetic oligonucleotide
  Target: ATXN1; (-) strand; PAM type: NRG; PAM sequence: AAG
agcatttctcatatactagc

SEQ ID NO: 87022 - DNA, 20 bp, Artificial Sequence
  Description of Artificial Sequence: Synthetic oligonucleotide
  Target: ATXN1; (-) strand; PAM type: NRG; PAM sequence: TAG
attgagcatttctcatatac

SEQ ID NO: 87023 - DNA, 20 bp, Artificial Sequence
  Description of Artificial Sequence: Synthetic oligonucleotide
  Target: ATXN1; (-) strand; PAM type: NRG; PAM sequence: GAG
gtgagatggtactttcaatt

SEQ ID NO: 87024 - DNA, 20 bp, Artificial Sequence
  Description of Artificial Sequence: Synthetic oligonucleotide
  Target: ATXN1; (-) strand; PAM type: NRG; PAM sequence: TGG
tttgctacaataaggtgaga

SEQ ID NO: 87025 - DNA, 20 bp, Artificial Sequence
  Description of Artificial Sequence: Synthetic oligonucleotide
  Target: ATXN1; (-) strand; PAM type: NRG; PAM sequence: GAG
aggttttgctacaataaggt

SEQ ID NO: 87026 - DNA, 20 bp, Artificial Sequence
  Description of Artificial Sequence: Synthetic oligonucleotide
  Target: ATXN1; (-) strand; PAM type: NRG; PAM sequence: AGG
aaataggttttgctacaata

SEQ ID NO: 87027 - DNA, 20 bp, Artificial Sequence
  Description of Artificial Sequence: Synthetic oligonucleotide
  Target: ATXN1; (-) strand; PAM type: NRG; PAM sequence: AAG
taaataggttttgctacaat

SEQ ID NO: 87028 - DNA, 20 bp, Artificial Sequence
  Description of Artificial Sequence: Synthetic oligonucleotide
  Target: ATXN1; (-) strand; PAM type: NRG; PAM sequence: AGG
gtttttcagatacattaaat

SEQ ID NO: 87029 - DNA, 20 bp, Artificial Sequence
  Description of Artificial Sequence: Synthetic oligonucleotide
  Target: ATXN1; (-) strand; PAM type: NRG; PAM sequence: TAG
ggtttttcagatacattaaa

SEQ ID NO: 87030 - DNA, 20 bp, Artificial Sequence
  Description of Artificial Sequence: Synthetic oligonucleotide
  Target: ATXN1; (-) strand; PAM type: NRG; PAM sequence: CAG
ttggagaggaagaggttttt

SEQ ID NO: 87031 - DNA, 20 bp, Artificial Sequence
  Description of Artificial Sequence: Synthetic oligonucleotide
  Target: ATXN1; (-) strand; PAM type: NRG; PAM sequence: AGG
gtttaattttggagaggaag

SEQ ID NO: 87032 - DNA, 20 bp, Artificial Sequence
  Description of Artificial Sequence: Synthetic oligonucleotide
  Target: ATXN1; (-) strand; PAM type: NRG; PAM sequence: GAG
agtttaattttggagaggaa

SEQ ID NO: 87033 - DNA, 20 bp, Artificial Sequence
  Description of Artificial Sequence: Synthetic oligonucleotide
  Target: ATXN1; (-) strand; PAM type: NRG; PAM sequence: AAG
aaagtttaattttggagagg

SEQ ID NO: 87034 - DNA, 20 bp, Artificial Sequence
  Description of Artificial Sequence: Synthetic oligonucleotide
  Target: ATXN1; (-) strand; PAM type: NRG; PAM sequence: AGG
tcgaaagtttaattttggag

SEQ ID NO: 87035 - DNA, 20 bp, Artificial Sequence
  Description of Artificial Sequence: Synthetic oligonucleotide
  Target: ATXN1; (-) strand; PAM type: NRG; PAM sequence: GAG
gtcgaaagtttaattttgga

SEQ ID NO: 87036 - DNA, 20 bp, Artificial Sequence
  Description of Artificial Sequence: Synthetic oligonucleotide
  Target: ATXN1; (-) strand; PAM type: NRG; PAM sequence: GAG
aagtcgaaagtttaattttg

SEQ ID NO: 87037 - DNA, 20 bp, Artificial Sequence
  Description of Artificial Sequence: Synthetic oligonucleotide
  Target: ATXN1; (-) strand; PAM type: NRG; PAM sequence: TGG
gaaagtcgaaagtttaattt

SEQ ID NO: 87038 - DNA, 20 bp, Artificial Sequence
  Description of Artificial Sequence: Synthetic oligonucleotide
  Target: ATXN1; (-) strand; PAM type: NRG; PAM sequence: AAG
tttctcatcacgaaagtcga

SEQ ID NO: 87039 - DNA, 20 bp, Artificial Sequence
  Description of Artificial Sequence: Synthetic oligonucleotide
  Target: ATXN1; (-) strand; PAM type: NRG; PAM sequence: AAG
tggaaattttctcatcacga

SEQ ID NO: 87040 - DNA, 20 bp, Artificial Sequence
  Description of Artificial Sequence: Synthetic oligonucleotide
  Target: ATXN1; (-) strand; PAM type: NRG; PAM sequence: TGG
ctctatgtggtagacccttg

SEQ ID NO: 87041 - DNA, 20 bp, Artificial Sequence
  Description of Artificial Sequence: Synthetic oligonucleotide
  Target: ATXN1; (-) strand; PAM type: NRG; PAM sequence: TAG
tatatatcacctctatgtgg

SEQ ID NO: 87042 - DNA, 20 bp, Artificial Sequence
  Description of Artificial Sequence: Synthetic oligonucleotide
  Target: ATXN1; (-) strand; PAM type: NRG; PAM sequence: TGG
cgatatatatcacctctatg

SEQ ID NO: 87043 - DNA, 20 bp, Artificial Sequence
  Description of Artificial Sequence: Synthetic oligonucleotide
  Target: ATXN1; (-) strand; PAM type: NRG; PAM sequence: CAG
tagattttattggtagcatc

SEQ ID NO: 87044 - DNA, 20 bp, Artificial Sequence
  Description of Artificial Sequence: Synthetic oligonucleotide
  Target: ATXN1; (-) strand; PAM type: NRG; PAM sequence: TAG
agattcttagattttattgg

SEQ ID NO: 87045 - DNA, 20 bp, Artificial Sequence
  Description of Artificial Sequence: Synthetic oligonucleotide
  Target: ATXN1; (-) strand; PAM type: NRG; PAM sequence: TGG
agaagattcttagattttat

SEQ ID NO: 87046 - DNA, 20 bp, Artificial Sequence
  Description of Artificial Sequence: Synthetic oligonucleotide
  Target: ATXN1; (-) strand; PAM type: NRG; PAM sequence: TAG
aggtggtattagaagattct

SEQ ID NO: 87047 - DNA, 20 bp, Artificial Sequence
  Description of Artificial Sequence: Synthetic oligonucleotide
  Target: ATXN1; (-) strand; PAM type: NRG; PAM sequence: AAG
gtgcatgtaggtggtattag

SEQ ID NO: 87048 - DNA, 20 bp, Artificial Sequence
  Description of Artificial Sequence: Synthetic oligonucleotide
  Target: ATXN1; (-) strand; PAM type: NRG; PAM sequence: TAG
taggtgcatgtaggtggtat

SEQ ID NO: 87049 - DNA, 20 bp, Artificial Sequence
  Description of Artificial Sequence: Synthetic oligonucleotide
  Target: ATXN1; (-) strand; PAM type: NRG; PAM sequence: TGG
taagtttaggtgcatgtagg

SEQ ID NO: 87050 - DNA, 20 bp, Artificial Sequence
  Description of Artificial Sequence: Synthetic oligonucleotide
  Target: ATXN1; (-) strand; PAM type: NRG; PAM sequence: AGG
gtttaagtttaggtgcatgt

SEQ ID NO: 87051 - DNA, 20 bp, Artificial Sequence
  Description of Artificial Sequence: Synthetic oligonucleotide
  Target: ATXN1; (-) strand; PAM type: NRG; PAM sequence: TAG
agtttaagtttaggtgcatg

SEQ ID NO: 87052 - DNA, 20 bp, Artificial Sequence
  Description of Artificial Sequence: Synthetic oligonucleotide
  Target: ATXN1; (-) strand; PAM type: NRG; PAM sequence: AGG
acttttcagagtttaagttt

SEQ ID NO: 87053 - DNA, 20 bp, Artificial Sequence
  Description of Artificial Sequence: Synthetic oligonucleotide
  Target: ATXN1; (-) strand; PAM type: NRG; PAM sequence: TAG
tacttttcagagtttaagtt

SEQ ID NO: 87054 - DNA, 20 bp, Artificial Sequence
  Description of Artificial Sequence: Synthetic oligonucleotide
  Target: ATXN1; (-) strand; PAM type: NRG; PAM sequence: AAG
cattgtacttttcagagttt

SEQ ID NO: 87055 - DNA, 20 bp, Artificial Sequence
  Description of Artificial Sequence: Synthetic oligonucleotide
  Target: ATXN1; (-) strand; PAM type: NRG; PAM sequence: GAG
ttaatacattgtacttttca

SEQ ID NO: 87056 - DNA, 20 bp, Artificial Sequence
  Description of Artificial Sequence: Synthetic oligonucleotide
  Target: ATXN1; (-) strand; PAM type: NRG; PAM sequence: CAG
tcttaatacattgtactttt

SEQ ID NO: 87057 - DNA, 20 bp, Artificial Sequence
  Description of Artificial Sequence: Synthetic oligonucleotide
  Target: ATXN1; (-) strand; PAM type: NRG; PAM sequence: GAG
agtaatttcaaagggctctt

SEQ ID NO: 87058 - DNA, 20 bp, Artificial Sequence
  Description of Artificial Sequence: Synthetic oligonucleotide
  Target: ATXN1; (-) strand; PAM type: NRG; PAM sequence: GGG
gaaatgccagtaatttcaaa

SEQ ID NO: 87059 - DNA, 20 bp, Artificial Sequence
  Description of Artificial Sequence: Synthetic oligonucleotide
  Target: ATXN1; (-) strand; PAM type: NRG; PAM sequence: AGG
agaaatgccagtaatttcaa

SEQ ID NO: 87060 - DNA, 20 bp, Artificial Sequence
  Description of Artificial Sequence: Synthetic oligonucleotide
  Target: ATXN1; (-) strand; PAM type: NRG; PAM sequence: AAG
aagaaatgccagtaatttca

SEQ ID NO: 87061 - DNA, 20 bp, Artificial Sequence
  Description of Artificial Sequence: Synthetic oligonucleotide
  Target: ATXN1; (-) strand; PAM type: NRG; PAM sequence: CAG
ccaaaaattagaagaaatgc

SEQ ID NO: 87062 - DNA, 20 bp, Artificial Sequence
  Description of Artificial Sequence: Synthetic oligonucleotide
  Target: ATXN1; (-) strand; PAM type: NRG; PAM sequence: AAG
gactagcccccaaaaattag

SEQ ID NO: 87063 - DNA, 20 bp, Artificial Sequence
  Description of Artificial Sequence: Synthetic oligonucleotide
  Target: ATXN1; (-) strand; PAM type: NRG; PAM sequence: TAG
tcagactagcccccaaaaat

SEQ ID NO: 87064 - DNA, 20 bp, Artificial Sequence
  Description of Artificial Sequence: Synthetic oligonucleotide
  Target: ATXN1; (-) strand; PAM type: NRG; PAM sequence: TAG
tatgctaataaatgtcagac

SEQ ID NO: 87065 - DNA, 20 bp, Artificial Sequence
  Description of Artificial Sequence: Synthetic oligonucleotide
  Target: ATXN1; (-) strand; PAM type: NRG; PAM sequence: CAG
ttgtttatgctaataaatgt

SEQ ID NO: 87066 - DNA, 20 bp, Artificial Sequence
  Description of Artificial Sequence: Synthetic oligonucleotide
  Target: ATXN1; (-) strand; PAM type: NRG; PAM sequence: AGG
ttttccctcttgcggacaca

SEQ ID NO: 87067 - DNA, 20 bp, Artificial Sequence
  Description of Artificial Sequence: Synthetic oligonucleotide
  Target: ATXN1; (-) strand; PAM type: NRG; PAM sequence: AAG
tttttccctcttgcggacac

SEQ ID NO: 87068 - DNA, 20 bp, Artificial Sequence
  Description of Artificial Sequence: Synthetic oligonucleotide
  Target: ATXN1; (-) strand; PAM type: NRG; PAM sequence: CGG
gtttttttttttccctcttg

SEQ ID NO: 87069 - DNA, 20 bp, Artificial Sequence
  Description of Artificial Sequence: Synthetic oligonucleotide
  Target: ATXN1; (-) strand; PAM type: NRG; PAM sequence: AAG
ctctgagtttaatctctcta

SEQ ID NO: 87070 - DNA, 20 bp, Artificial Sequence
  Description of Artificial Sequence: Synthetic oligonucleotide
  Target: ATXN1; (-) strand; PAM type: NRG; PAM sequence: GAG
taaactttttctacaactct

SEQ ID NO: 87071 - DNA, 20 bp, Artificial Sequence
  Description of Artificial Sequence: Synthetic oligonucleotide
  Target: ATXN1; (-) strand; PAM type: NRG; PAM sequence: TAG
tatacgaaaatgctgattca

SEQ ID NO: 87072 - DNA, 20 bp, Artificial Sequence
  Description of Artificial Sequence: Synthetic oligonucleotide
  Target: ATXN1; (-) strand; PAM type: NRG; PAM sequence: AGG
tgtatttcttctttgattcc

SEQ ID NO: 87073 - DNA, 20 bp, Artificial Sequence
  Description of Artificial Sequence: Synthetic oligonucleotide
  Target: ATXN1; (-) strand; PAM type: NRG; PAM sequence: CAG
gtgtatttcttctttgattc

SEQ ID NO: 87074 - DNA, 20 bp, Artificial Sequence
  Description of Artificial Sequence: Synthetic oligonucleotide
  Target: ATXN1; (-) strand; PAM type: NRG; PAM sequence: CGG
atttgtgtcttcattcttca

SEQ ID NO: 87075 - DNA, 20 bp, Artificial Sequence
  Description of Artificial Sequence: Synthetic oligonucleotide
  Target: ATXN1; (-) strand; PAM type: NRG; PAM sequence: CAG
gtattctaaatataaatata

SEQ ID NO: 87076 - DNA, 20 bp, Artificial Sequence
  Description of Artificial Sequence: Synthetic oligonucleotide
  Target: ATXN1; (-) strand; PAM type: NRG; PAM sequence: AAG
aaggcacaaaaagaccgtag

SEQ ID NO: 87077 - DNA, 20 bp, Artificial Sequence
  Description of Artificial Sequence: Synthetic oligonucleotide
  Target: ATXN1; (-) strand; PAM type: NRG; PAM sequence: TAG
ataaaggcacaaaaagaccg

SEQ ID NO: 87078 - DNA, 20 bp, Artificial Sequence
  Description of Artificial Sequence: Synthetic oligonucleotide
  Target: ATXN1; (-) strand; PAM type: NRG; PAM sequence: AAG
aggtatgataaaggcacaaa

SEQ ID NO: 87079 - DNA, 20 bp, Artificial Sequence
  Description of Artificial Sequence: Synthetic oligonucleotide
  Target: ATXN1; (-) strand; PAM type: NRG; PAM sequence: AGG
gataaagttaggtatgataa

SEQ ID NO: 87080 - DNA, 20 bp, Artificial Sequence
  Description of Artificial Sequence: Synthetic oligonucleotide
  Target: ATXN1; (-) strand; PAM type: NRG; PAM sequence: AAG
agataaagttaggtatgata

SEQ ID NO: 87081 - DNA, 20 bp, Artificial Sequence
  Description of Artificial Sequence: Synthetic oligonucleotide
  Target: ATXN1; (-) strand; PAM type: NRG; PAM sequence: AGG
tatgagtaccagataaagtt

SEQ ID NO: 87082 - DNA, 20 bp, Artificial Sequence
  Description of Artificial Sequence: Synthetic oligonucleotide
  Target: ATXN1; (-) strand; PAM type: NRG; PAM sequence: TAG
ctatgagtaccagataaagt

SEQ ID NO: 87083 - DNA, 20 bp, Artificial Sequence
  Description of Artificial Sequence: Synthetic oligonucleotide
  Target: ATXN1; (-) strand; PAM type: NRG; PAM sequence: AAG
acctctatgagtaccagata

SEQ ID NO: 87084 - DNA, 20 bp, Artificial Sequence
  Description of Artificial Sequence: Synthetic oligonucleotide
  Target: ATXN1; (-) strand; PAM type: NRG; PAM sequence: CAG
ttggtgacctctatgagtac

SEQ ID NO: 87085 - DNA, 20 bp, Artificial Sequence
  Description of Artificial Sequence: Synthetic oligonucleotide
  Target: ATXN1; (-) strand; PAM type: NRG; PAM sequence: GAG
acagctttggtgacctctat

SEQ ID NO: 87086 - DNA, 20 bp, Artificial Sequence
  Description of Artificial Sequence: Synthetic oligonucleotide
  Target: ATXN1; (-) strand; PAM type: NRG; PAM sequence: TGG
gctatgattttatacagctt

SEQ ID NO: 87087 - DNA, 20 bp, Artificial Sequence
  Description of Artificial Sequence: Synthetic oligonucleotide
  Target: ATXN1; (-) strand; PAM type: NRG; PAM sequence: CAG
ctggttgctatgattttata

SEQ ID NO: 87088 - DNA, 20 bp, Artificial Sequence
  Description of Artificial Sequence: Synthetic oligonucleotide
  Target: ATXN1; (-) strand; PAM type: NRG; PAM sequence: TGG
gtttgtttcctttagttttc

SEQ ID NO: 87089 - DNA, 20 bp, Artificial Sequence
  Description of Artificial Sequence: Synthetic oligonucleotide
  Target: ATXN1; (-) strand; PAM type: NRG; PAM sequence: TAG
ccagaggtgtttgtttcctt

SEQ ID NO: 87090 - DNA, 20 bp, Artificial Sequence
  Description of Artificial Sequence: Synthetic oligonucleotide
  Target: ATXN1; (-) strand; PAM type: NRG; PAM sequence: AGG
ttggtgaggatttctgccag

SEQ ID NO: 87091 - DNA, 20 bp, Artificial Sequence
  Description of Artificial Sequence: Synthetic oligonucleotide
  Target: ATXN1; (-) strand; PAM type: NRG; PAM sequence: GAG
tttggtgaggatttctgcca

SEQ ID NO: 87092 - DNA, 20 bp, Artificial Sequence
  Description of Artificial Sequence: Synthetic oligonucleotide
  Target: ATXN1; (-) strand; PAM type: NRG; PAM sequence: CAG
tgtttggtgaggatttctgc

SEQ ID NO: 87093 - DNA, 20 bp, Artificial Sequence
  Description of Artificial Sequence: Synthetic oligonucleotide
  Target: ATXN1; (-) strand; PAM type: NRG; PAM sequence: AGG
gccttatactttgtttggtg

SEQ ID NO: 87094 - DNA, 20 bp, Artificial Sequence
  Description of Artificial Sequence: Synthetic oligonucleotide
  Target: ATXN1; (-) strand; PAM type: NRG; PAM sequence: GAG
tgccttatactttgtttggt

SEQ ID NO: 87095 - DNA, 20 bp, Artificial Sequence
  Description of Artificial Sequence: Synthetic oligonucleotide
  Target: ATXN1; (-) strand; PAM type: NRG; PAM sequence: TGG
tttatgccttatactttgtt

SEQ ID NO: 87096 - DNA, 20 bp, Artificial Sequence
  Description of Artificial Sequence: Synthetic oligonucleotide
  Target: ATXN1; (-) strand; PAM type: NRG; PAM sequence: TAG
aaaagtggccaatgaaagta

SEQ ID NO: 87097 - DNA, 20 bp, Artificial Sequence
  Description of Artificial Sequence: Synthetic oligonucleotide
  Target: ATXN1; (-) strand; PAM type: NRG; PAM sequence: AAG
atgttaaaagtggccaatga

SEQ ID NO: 87098 - DNA, 20 bp, Artificial Sequence
  Description of Artificial Sequence: Synthetic oligonucleotide
  Target: ATXN1; (-) strand; PAM type: NRG; PAM sequence: TGG
aagcatggctatgttaaaag

SEQ ID NO: 87099 - DNA, 20 bp, Artificial Sequence
  Description of Artificial Sequence: Synthetic oligonucleotide
  Target: ATXN1; (-) strand; PAM type: NRG; PAM sequence: AAG
tagaagcatggctatgttaa

SEQ ID NO: 87100 - DNA, 20 bp, Artificial Sequence
  Description of Artificial Sequence: Synthetic oligonucleotide
  Target: ATXN1; (-) strand; PAM type: NRG; PAM sequence: TGG
taccttcacaggtagaagca

SEQ ID NO: 87101 - DNA, 20 bp, Artificial Sequence
  Description of Artificial Sequence: Synthetic oligonucleotide
  Target: ATXN1; (-) strand; PAM type: NRG; PAM sequence: AAG
tcccataccttcacaggtag

SEQ ID NO: 87102 - DNA, 20 bp, Artificial Sequence
  Description of Artificial Sequence: Synthetic oligonucleotide
  Target: ATXN1; (-) strand; PAM type: NRG; PAM sequence: TAG
ttgtcccataccttcacagg

SEQ ID NO: 87103 - DNA, 20 bp, Artificial Sequence
  Description of Artificial Sequence: Synthetic oligonucleotide
  Target: ATXN1; (-) strand; PAM type: NRG; PAM sequence: AGG
gaattgtcccataccttcac

SEQ ID NO: 87104 - DNA, 20 bp, Artificial Sequence
  Description of Artificial Sequence: Synthetic oligonucleotide
  Target: ATXN1; (-) strand; PAM type: NRG; PAM sequence: CAG
ggaattgtcccataccttca

SEQ ID NO: 87105 - DNA, 20 bp, Artificial Sequence
  Description of Artificial Sequence: Synthetic oligonucleotide
  Target: ATXN1; (-) strand; PAM type: NRG; PAM sequence: TGG
ctccgtgaactcagttttca

SEQ ID NO: 87106 - DNA, 20 bp, Artificial Sequence
  Description of Artificial Sequence: Synthetic oligonucleotide
  Target: ATXN1; (-) strand; PAM type: NRG; PAM sequence: CAG
aggagggccctccgtgaact

SEQ ID NO: 87107 - DNA, 20 bp, Artificial Sequence
  Description of Artificial Sequence: Synthetic oligonucleotide
  Target: ATXN1; (-) strand; PAM type: NRG; PAM sequence: GGG
aggatacataacccacagga

SEQ ID NO: 87108 - DNA, 20 bp, Artificial Sequence
  Description of Artificial Sequence: Synthetic oligonucleotide
  Target: ATXN1; (-) strand; PAM type: NRG; PAM sequence: AGG
caggatacataacccacagg

SEQ ID NO: 87109 - DNA, 20 bp, Artificial Sequence
  Description of Artificial Sequence: Synthetic oligonucleotide
  Target: ATXN1; (-) strand; PAM type: NRG; PAM sequence: GAG
ccaggatacataacccacag

SEQ ID NO: 87110 - DNA, 20 bp, Artificial Sequence
  Description of Artificial Sequence: Synthetic oligonucleotide
  Target: ATXN1; (-) strand; PAM type: NRG; PAM sequence: AGG
acccaggatacataacccac

SEQ ID NO: 87111 - DNA, 20 bp, Artificial Sequence
  Description of Artificial Sequence: Synthetic oligonucleotide
  Target: ATXN1; (-) strand; PAM type: NRG; PAM sequence: CAG
aacccaggatacataaccca

SEQ ID NO: 87112 - DNA, 20 bp, Artificial Sequence
  Description of Artificial Sequence: Synthetic oligonucleotide
  Target: ATXN1; (-) strand; PAM type: NRG; PAM sequence: AGG
caggggttatgctggaaccc

SEQ ID NO: 87113 - DNA, 20 bp, Artificial Sequence
  Description of Artificial Sequence: Synthetic oligonucleotide
  Target: ATXN1; (-) strand; PAM type: NRG; PAM sequence: CAG
ccaggggttatgctggaacc

SEQ ID NO: 87114 - DNA, 20 bp, Artificial Sequence
  Description of Artificial Sequence: Synthetic oligonucleotide
  Target: ATXN1; (-) strand; PAM type: NRG; PAM sequence: TGG
ttctcaaccaggggttatgc

SEQ ID NO: 87115 - DNA, 20 bp, Artificial Sequence
  Description of Artificial Sequence: Synthetic oligonucleotide
  Target: ATXN1; (-) strand; PAM type: NRG; PAM sequence: GGG
aatagtaagttctcaaccag

SEQ ID NO: 87116 - DNA, 20 bp, Artificial Sequence
  Description of Artificial Sequence: Synthetic oligonucleotide
  Target: ATXN1; (-) strand; PAM type: NRG; PAM sequence: GGG
taatagtaagttctcaacca

SEQ ID NO: 87117 - DNA, 20 bp, Artificial Sequence
  Description of Artificial Sequence: Synthetic oligonucleotide
  Target: ATXN1; (-) strand; PAM type: NRG; PAM sequence: AGG
ttaatagtaagttctcaacc

SEQ ID NO: 87118 - DNA, 20 bp, Artificial Sequence
  Description of Artificial Sequence: Synthetic oligonucleotide
  Target: ATXN1; (-) strand; PAM type: NRG; PAM sequence: CAG
gttaatagtaagttctcaac

SEQ ID NO: 87119 - DNA, 20 bp, Artificial Sequence
  Description of Artificial Sequence: Synthetic oligonucleotide
  Target: ATXN1; (-) strand; PAM type: NRG; PAM sequence: AAG
gaagagctaatgttaatagt

SEQ ID NO: 87120 - DNA, 20 bp, Artificial Sequence
  Description of Artificial Sequence: Synthetic oligonucleotide
  Target: ATXN1; (-) strand; PAM type: NRG; PAM sequence: TAG
aattgaagagctaatgttaa

SEQ ID NO: 87121 - DNA, 20 bp, Artificial Sequence
  Description of Artificial Sequence: Synthetic oligonucleotide
  Target: ATXN1; (-) strand; PAM type: NRG; PAM sequence: GAG
gatcatgaaaataaattgaa

SEQ ID NO: 87122 - DNA, 20 bp, Artificial Sequence
  Description of Artificial Sequence: Synthetic oligonucleotide
  Target: ATXN1; (-) strand; PAM type: NRG; PAM sequence: AAG
tggatcatgaaaataaattg

SEQ ID NO: 87123 - DNA, 20 bp, Artificial Sequence
  Description of Artificial Sequence: Synthetic oligonucleotide
  Target: ATXN1; (-) strand; PAM type: NRG; PAM sequence: TGG
atacaatatacacaagtccc

SEQ ID NO: 87124 - DNA, 20 bp, Artificial Sequence
  Description of Artificial Sequence: Synthetic oligonucleotide
  Target: ATXN1; (-) strand; PAM type: NRG; PAM sequence: AAG
cactgtgatacaatatacac

SEQ ID NO: 87125 - DNA, 20 bp, Artificial Sequence
  Description of Artificial Sequence: Synthetic oligonucleotide
  Target: ATXN1; (-) strand; PAM type: NRG; PAM sequence: AGG
atctggttactttttatttt

SEQ ID NO: 87126 - DNA, 20 bp, Artificial Sequence
  Description of Artificial Sequence: Synthetic oligonucleotide
  Target: ATXN1; (-) strand; PAM type: NRG; PAM sequence: TAG
tatctggttactttttattt

SEQ ID NO: 87127 - DNA, 20 bp, Artificial Sequence
  Description of Artificial Sequence: Synthetic oligonucleotide
  Target: ATXN1; (-) strand; PAM type: NRG; PAM sequence: TGG
ttgttttactgtctcctatc

SEQ ID NO: 87128 - DNA, 20 bp, Artificial Sequence
  Description of Artificial Sequence: Synthetic oligonucleotide
  Target: ATXN1; (-) strand; PAM type: NRG; PAM sequence: TGG
aatgatatgtctcattctca

SEQ ID NO: 87129 - DNA, 20 bp, Artificial Sequence
  Description of Artificial Sequence: Synthetic oligonucleotide
  Target: ATXN1; (-) strand; PAM type: NRG; PAM sequence: AAG
agcaggaaggtttttaagta

SEQ ID NO: 87130 - DNA, 20 bp, Artificial Sequence
  Description of Artificial Sequence: Synthetic oligonucleotide
  Target: ATXN1; (-) strand; PAM type: NRG; PAM sequence: AAG
tgtttagcaggaaggttttt

SEQ ID NO: 87131 - DNA, 20 bp, Artificial Sequence
  Description of Artificial Sequence: Synthetic oligonucleotide
  Target: ATXN1; (-) strand; PAM type: NRG; PAM sequence: AGG
tttttgtttgtttagcagga

SEQ ID NO: 87132 - DNA, 20 bp, Artificial Sequence
  Description of Artificial Sequence: Synthetic oligonucleotide
  Target: ATXN1; (-) strand; PAM type: NRG; PAM sequence: AAG
ttttttgtttgtttagcagg

SEQ ID NO: 87133 - DNA, 20 bp, Artificial Sequence
  Description of Artificial Sequence: Synthetic oligonucleotide
  Target: ATXN1; (-) strand; PAM type: NRG; PAM sequence: AGG
tccttttttgtttgtttagc

SEQ ID NO: 87134 - DNA, 20 bp, Artificial Sequence
  Description of Artificial Sequence: Synthetic oligonucleotide
  Target: ATXN1; (-) strand; PAM type: NRG; PAM sequence: CAG
gtccttttttgtttgtttag

SEQ ID NO: 87135 - DNA, 20 bp, Artificial Sequence
  Description of Artificial Sequence: Synthetic oligonucleotide
  Target: ATXN1; (-) strand; PAM type: NRG; PAM sequence: TAG
ttagtccttttttgtttgtt

SEQ ID NO: 87136 - DNA, 20 bp, Artificial Sequence
  Description of Artificial Sequence: Synthetic oligonucleotide
  Target: ATXN1; (-) strand; PAM type: NRG; PAM sequence: TAG
ccaagagacagatatcgcat

SEQ ID NO: 87137 - DNA, 20 bp, Artificial Sequence
  Description of Artificial Sequence: Synthetic oligonucleotide
  Target: ATXN1; (-) strand; PAM type: NRG; PAM sequence: CAG
gcatgggagaccccaagaga

SEQ ID NO: 87138 - DNA, 20 bp, Artificial Sequence
  Description of Artificial Sequence: Synthetic oligonucleotide
  Target: ATXN1; (-) strand; PAM type: NRG; PAM sequence: GAG
ataagcatgggagaccccaa

SEQ ID NO: 87139 - DNA, 20 bp, Artificial Sequence
  Description of Artificial Sequence: Synthetic oligonucleotide
  Target: ATXN1; (-) strand; PAM type: NRG; PAM sequence: AAG
tcataagcatgggagacccc

SEQ ID NO: 87140 - DNA, 20 bp, Artificial Sequence
  Description of Artificial Sequence: Synthetic oligonucleotide
  Target: ATXN1; (-) strand; PAM type: NRG; PAM sequence: GAG
ttctcaattcataagcatgg

SEQ ID NO: 87141 - DNA, 20 bp, Artificial Sequence
  Description of Artificial Sequence: Synthetic oligonucleotide
  Target: ATXN1; (-) strand; PAM type: NRG; PAM sequence: GGG
ttttctcaattcataagcat

SEQ ID NO: 87142 - DNA, 20 bp, Artificial Sequence
  Description of Artificial Sequence: Synthetic oligonucleotide
  Target: ATXN1; (-) strand; PAM type: NRG; PAM sequence: TGG
gttttctcaattcataagca

SEQ ID NO: 87143 - DNA, 20 bp, Artificial Sequence
  Description of Artificial Sequence: Synthetic oligonucleotide
  Target: ATXN1; (-) strand; PAM type: NRG; PAM sequence: AAG
agtgtgttttctcaattcat

SEQ ID NO: 87144 - DNA, 20 bp, Artificial Sequence
  Description of Artificial Sequence: Synthetic oligonucleotide
  Target: ATXN1; (-) strand; PAM type: NRG; PAM sequence: AAG
tttcttcatttacttatatc

SEQ ID NO: 87145 - DNA, 20 bp, Artificial Sequence
  Description of Artificial Sequence: Synthetic oligonucleotide
  Target: ATXN1; (-) strand; PAM type: NRG; PAM sequence: GGG
ccattttttctgtcacttca

SEQ ID NO: 87146 - DNA, 20 bp, Artificial Sequence
  Description of Artificial Sequence: Synthetic oligonucleotide
  Target: ATXN1; (-) strand; PAM type: NRG; PAM sequence: AGG
tccattttttctgtcacttc

SEQ ID NO: 87147 - DNA, 20 bp, Artificial Sequence
  Description of Artificial Sequence: Synthetic oligonucleotide
  Target: ATXN1; (-) strand; PAM type: NRG; PAM sequence: CAG
ttccattttttctgtcactt

SEQ ID NO: 87148 - DNA, 20 bp, Artificial Sequence
  Description of Artificial Sequence: Synthetic oligonucleotide
  Target: ATXN1; (-) strand; PAM type: NRG; PAM sequence: TAG
cttgcctctggagttgagct

SEQ ID NO: 87149 - DNA, 20 bp, Artificial Sequence
  Description of Artificial Sequence: Synthetic oligonucleotide
  Target: ATXN1; (-) strand; PAM type: NRG; PAM sequence: GAG
accaccttgcctctggagtt

SEQ ID NO: 87150 - DNA, 20 bp, Artificial Sequence
  Description of Artificial Sequence: Synthetic oligonucleotide
  Target: ATXN1; (-) strand; PAM type: NRG; PAM sequence: GAG
tctgtaccaccttgcctctg

SEQ ID NO: 87151 - DNA, 20 bp, Artificial Sequence
  Description of Artificial Sequence: Synthetic oligonucleotide
  Target: ATXN1; (-) strand; PAM type: NRG; PAM sequence: TGG
attctgtaccaccttgcctc

SEQ ID NO: 87152 - DNA, 20 bp, Artificial Sequence
  Description of Artificial Sequence: Synthetic oligonucleotide
  Target: ATXN1; (-) strand; PAM type: NRG; PAM sequence: TGG
ctttgaactgttcatccagc

SEQ ID NO: 87153 - DNA, 20 bp, Artificial Sequence
  Description of Artificial Sequence: Synthetic oligonucleotide
  Target: ATXN1; (-) strand; PAM type: NRG; PAM sequence: CAG
gaagctttgaactgttcatc

SEQ ID NO: 87154 - DNA, 20 bp, Artificial Sequence
  Description of Artificial Sequence: Synthetic oligonucleotide
  Target: ATXN1; (-) strand; PAM type: NRG; PAM sequence: AAG
gtagagaccctcaactaggg

SEQ ID NO: 87155 - DNA, 20 bp, Artificial Sequence
  Description of Artificial Sequence: Synthetic oligonucleotide
  Target: ATXN1; (-) strand; PAM type: NRG; PAM sequence: GGG
gaggtagagaccctcaacta

SEQ ID NO: 87156 - DNA, 20 bp, Artificial Sequence
  Description of Artificial Sequence: Synthetic oligonucleotide
  Target: ATXN1; (-) strand; PAM type: NRG; PAM sequence: AGG
tgaggtagagaccctcaact

SEQ ID NO: 87157 - DNA, 20 bp, Artificial Sequence
  Description of Artificial Sequence: Synthetic oligonucleotide
  Target: ATXN1; (-) strand; PAM type: NRG; PAM sequence: TAG
ttgaggtagagaccctcaac

SEQ ID NO: 87158 - DNA, 20 bp, Artificial Sequence
  Description of Artificial Sequence: Synthetic oligonucleotide
  Target: ATXN1; (-) strand; PAM type: NRG; PAM sequence: GAG
ttttgtctgtcattgaggta

SEQ ID NO: 87159 - DNA, 20 bp, Artificial Sequence
  Description of Artificial Sequence: Synthetic oligonucleotide
  Target: ATXN1; (-) strand; PAM type: NRG; PAM sequence: TAG
agttttgtctgtcattgagg

SEQ ID NO: 87160 - DNA, 20 bp, Artificial Sequence
  Description of Artificial Sequence: Synthetic oligonucleotide
  Target: ATXN1; (-) strand; PAM type: NRG; PAM sequence: AGG
aggagttttgtctgtcattg

SEQ ID NO: 87161 - DNA, 20 bp, Artificial Sequence
  Description of Artificial Sequence: Synthetic oligonucleotide
  Target: ATXN1; (-) strand; PAM type: NRG; PAM sequence: GAG
taggagttttgtctgtcatt

SEQ ID NO: 87162 - DNA, 20 bp, Artificial Sequence
  Description of Artificial Sequence: Synthetic oligonucleotide
  Target: ATXN1; (-) strand; PAM type: NRG; PAM sequence: GAG
atggagaaagccaaagttag

SEQ ID NO: 87163 - DNA, 20 bp, Artificial Sequence
  Description of Artificial Sequence: Synthetic oligonucleotide
  Target: ATXN1; (-) strand; PAM type: NRG; PAM sequence: AGG
ctatggagaaagccaaagtt

SEQ ID NO: 87164 - DNA, 20 bp, Artificial Sequence
  Description of Artificial Sequence: Synthetic oligonucleotide
  Target: ATXN1; (-) strand; PAM type: NRG; PAM sequence: TAG
tctatggagaaagccaaagt

SEQ ID NO: 87165 - DNA, 20 bp, Artificial Sequence
  Description of Artificial Sequence: Synthetic oligonucleotide
  Target: ATXN1; (-) strand; PAM type: NRG; PAM sequence: AAG
atgctctatggagaaagcca

SEQ ID NO: 87166 - DNA, 20 bp, Artificial Sequence
  Description of Artificial Sequence: Synthetic oligonucleotide
  Target: ATXN1; (-) strand; PAM type: NRG; PAM sequence: AAG
tggttgatgctctatggaga

SEQ ID NO: 87167 - DNA, 20 bp, Artificial Sequence
  Description of Artificial Sequence: Synthetic oligonucleotide
  Target: ATXN1; (-) strand; PAM type: NRG; PAM sequence: GAG
aatttggttgatgctctatg

SEQ ID NO: 87168 - DNA, 20 bp, Artificial Sequence
  Description of Artificial Sequence: Synthetic oligonucleotide
  Target: ATXN1; (-) strand; PAM type: NRG; PAM sequence: TGG
tgaatttggttgatgctcta

SEQ ID NO: 87169 - DNA, 20 bp, Artificial Sequence
  Description of Artificial Sequence: Synthetic oligonucleotide
  Target: ATXN1; (-) strand; PAM type: NRG; PAM sequence: TGG
tacttcatcattactgaatt

SEQ ID NO: 87170 - DNA, 20 bp, Artificial Sequence
  Description of Artificial Sequence: Synthetic oligonucleotide
  Target: ATXN1; (-) strand; PAM type: NRG; PAM sequence: AGG
ttcaacctatagtgttaagc

SEQ ID NO: 87171 - DNA, 20 bp, Artificial Sequence
  Description of Artificial Sequence: Synthetic oligonucleotide
  Target: ATXN1; (-) strand; PAM type: NRG; PAM sequence: CAG
attcaacctatagtgttaag

SEQ ID NO: 87172 - DNA, 20 bp, Artificial Sequence
  Description of Artificial Sequence: Synthetic oligonucleotide
  Target: ATXN1; (-) strand; PAM type: NRG; PAM sequence: AAG
gttattcaacctatagtgtt

SEQ ID NO: 87173 - DNA, 20 bp, Artificial Sequence
  Description of Artificial Sequence: Synthetic oligonucleotide
  Target: ATXN1; (-) strand; PAM type: NRG; PAM sequence: TAG
gtcaaaagttattcaaccta

SEQ ID NO: 87174 - DNA, 20 bp, Artificial Sequence
  Description of Artificial Sequence: Synthetic oligonucleotide
  Target: ATXN1; (-) strand; PAM type: NRG; PAM sequence: AAG
aggatgttacagcttgtcaa

SEQ ID NO: 87175 - DNA, 20 bp, Artificial Sequence
  Description of Artificial Sequence: Synthetic oligonucleotide
  Target: ATXN1; (-) strand; PAM type: NRG; PAM sequence: CAG
tttccaccaacaggatgtta

SEQ ID NO: 87176 - DNA, 20 bp, Artificial Sequence
  Description of Artificial Sequence: Synthetic oligonucleotide
  Target: ATXN1; (-) strand; PAM type: NRG; PAM sequence: AGG
gctggctattttccaccaac

SEQ ID NO: 87177 - DNA, 20 bp, Artificial Sequence
  Description of Artificial Sequence: Synthetic oligonucleotide
  Target: ATXN1; (-) strand; PAM type: NRG; PAM sequence: CAG
ggctggctattttccaccaa

SEQ ID NO: 87178 - DNA, 20 bp, Artificial Sequence
  Description of Artificial Sequence: Synthetic oligonucleotide
  Target: ATXN1; (-) strand; PAM type: NRG; PAM sequence: TGG
aatattatgttgagcaaggc

SEQ ID NO: 87179 - DNA, 20 bp, Artificial Sequence
  Description of Artificial Sequence: Synthetic oligonucleotide
  Target: ATXN1; (-) strand; PAM type: NRG; PAM sequence: AGG
ttgcaatattatgttgagca

SEQ ID NO: 87180 - DNA, 20 bp, Artificial Sequence
  Description of Artificial Sequence: Synthetic oligonucleotide
  Target: ATXN1; (-) strand; PAM type: NRG; PAM sequence: AAG
tttgcaatattatgttgagc

SEQ ID NO: 87181 - DNA, 20 bp, Artificial Sequence
  Description of Artificial Sequence: Synthetic oligonucleotide
  Target: ATXN1; (-) strand; PAM type: NRG; PAM sequence: GAG
tgggtttgcaatattatgtt

SEQ ID NO: 87182 - DNA, 20 bp, Artificial Sequence
  Description of Artificial Sequence: Synthetic oligonucleotide
  Target: ATXN1; (-) strand; PAM type: NRG; PAM sequence: GGG
ttgcacaattaccctgtttt

SEQ ID NO: 87183 - DNA, 20 bp, Artificial Sequence
  Description of Artificial Sequence: Synthetic oligonucleotide
  Target: ATXN1; (-) strand; PAM type: NRG; PAM sequence: TGG
tttgcacaattaccctgttt

SEQ ID NO: 87184 - DNA, 20 bp, Artificial Sequence
  Description of Artificial Sequence: Synthetic oligonucleotide
  Target: ATXN1; (-) strand; PAM type: NRG; PAM sequence: GGG
ccagaatattttctggaaag

SEQ ID NO: 87185 - DNA, 20 bp, Artificial Sequence
  Description of Artificial Sequence: Synthetic oligonucleotide
  Target: ATXN1; (-) strand; PAM type: NRG; PAM sequence: GGG
cccagaatattttctggaaa

SEQ ID NO: 87186 - DNA, 20 bp, Artificial Sequence
  Description of Artificial Sequence: Synthetic oligonucleotide
  Target: ATXN1; (-) strand; PAM type: NRG; PAM sequence: AGG
acccagaatattttctggaa

SEQ ID NO: 87187 - DNA, 20 bp, Artificial Sequence
  Description of Artificial Sequence: Synthetic oligonucleotide
  Target: ATXN1; (-) strand; PAM type: NRG; PAM sequence: AAG
cacccagaatattttctgga

SEQ ID NO: 87188 - DNA, 20 bp, Artificial Sequence
  Description of Artificial Sequence: Synthetic oligonucleotide
  Target: ATXN1; (-) strand; PAM type: NRG; PAM sequence: TGG
atgtcacccagaatattttc

SEQ ID NO: 87189 - DNA, 20 bp, Artificial Sequence
  Description of Artificial Sequence: Synthetic oligonucleotide
  Target: ATXN1; (-) strand; PAM type: NRG; PAM sequence: CAG
aaagcagattggatgtcacc

SEQ ID NO: 87190 - DNA, 20 bp, Artificial Sequence
  Description of Artificial Sequence: Synthetic oligonucleotide
  Target: ATXN1; (-) strand; PAM type: NRG; PAM sequence: TGG
tgagccgggtaaaagcagat

SEQ ID NO: 87191 - DNA, 20 bp, Artificial Sequence
  Description of Artificial Sequence: Synthetic oligonucleotide
  Target: ATXN1; (-) strand; PAM type: NRG; PAM sequence: CAG
ataagtgagccgggtaaaag

SEQ ID NO: 87192 - DNA, 20 bp, Artificial Sequence
  Description of Artificial Sequence: Synthetic oligonucleotide
  Target: ATXN1; (-) strand; PAM type: NRG; PAM sequence: AAG
taaataagtgagccgggtaa

SEQ ID NO: 87193 - DNA, 20 bp, Artificial Sequence
  Description of Artificial Sequence: Synthetic oligonucleotide
  Target: ATXN1; (-) strand; PAM type: NRG; PAM sequence: GGG
caattgtaaataagtgagcc

SEQ ID NO: 87194 - DNA, 20 bp, Artificial Sequence
  Description of Artificial Sequence: Synthetic oligonucleotide
  Target: ATXN1; (-) strand; PAM type: NRG; PAM sequence: CGG
ccaattgtaaataagtgagc

SEQ ID NO: 87195 - DNA, 20 bp, Artificial Sequence
  Description of Artificial Sequence: Synthetic oligonucleotide
  Target: ATXN1; (-) strand; PAM type: NRG; PAM sequence: GAG
agccccaattgtaaataagt

SEQ ID NO: 87196 - DNA, 20 bp, Artificial Sequence
  Description of Artificial Sequence: Synthetic oligonucleotide
  Target: ATXN1; (-) strand; PAM type: NRG; PAM sequence: AAG
aggcagccccaattgtaaat

SEQ ID NO: 87197 - DNA, 20 bp, Artificial Sequence
  Description of Artificial Sequence: Synthetic oligonucleotide
  Target: ATXN1; (-) strand; PAM type: NRG; PAM sequence: CAG
gaatggcattgcattttagg

SEQ ID NO: 87198 - DNA, 20 bp, Artificial Sequence
  Description of Artificial Sequence: Synthetic oligonucleotide
  Target: ATXN1; (-) strand; PAM type: NRG; PAM sequence: AGG
ttagaatggcattgcatttt

SEQ ID NO: 87199 - DNA, 20 bp, Artificial Sequence
  Description of Artificial Sequence: Synthetic oligonucleotide
  Target: ATXN1; (-) strand; PAM type: NRG; PAM sequence: TAG
tttagaatggcattgcattt

SEQ ID NO: 87200 - DNA, 20 bp, Artificial Sequence
  Description of Artificial Sequence: Synthetic oligonucleotide
  Target: ATXN1; (-) strand; PAM type: NRG; PAM sequence: TGG
gtttattggtagttttagaa

SEQ ID NO: 87201 - DNA, 20 bp, Artificial Sequence
  Description of Artificial Sequence: Synthetic oligonucleotide
  Target: ATXN1; (-) strand; PAM type: NRG; PAM sequence: TAG
aaatagtttattggtagttt

SEQ ID NO: 87202 - DNA, 20 bp, Artificial Sequence
  Description of Artificial Sequence: Synthetic oligonucleotide
  Target: ATXN1; (-) strand; PAM type: NRG; PAM sequence: TAG
ttcacaaaatagtttattgg

SEQ ID NO: 87203 - DNA, 20 bp, Artificial Sequence
  Description of Artificial Sequence: Synthetic oligonucleotide
  Target: ATXN1; (-) strand; PAM type: NRG; PAM sequence: TGG
gatttcacaaaatagtttat

SEQ ID NO: 87204 - DNA, 20 bp, Artificial Sequence
  Description of Artificial Sequence: Synthetic oligonucleotide
  Target: ATXN1; (-) strand; PAM type: NRG; PAM sequence: TAG
ctaaacttgatttcacaaaa

SEQ ID NO: 87205 - DNA, 20 bp, Artificial Sequence
  Description of Artificial Sequence: Synthetic oligonucleotide
  Target: ATXN1; (-) strand; PAM type: NRG; PAM sequence: AAG
atatcataaatgagaatctc

SEQ ID NO: 87206 - DNA, 20 bp, Artificial Sequence
  Description of Artificial Sequence: Synthetic oligonucleotide
  Target: ATXN1; (-) strand; PAM type: NRG; PAM sequence: GAG
ttgtcagggatatcataaat

SEQ ID NO: 87207 - DNA, 20 bp, Artificial Sequence
  Description of Artificial Sequence: Synthetic oligonucleotide
  Target: ATXN1; (-) strand; PAM type: NRG; PAM sequence: GGG
tcaggttttggtggttgtca

SEQ ID NO: 87208 - DNA, 20 bp, Artificial Sequence
  Description of Artificial Sequence: Synthetic oligonucleotide
  Target: ATXN1; (-) strand; PAM type: NRG; PAM sequence: AGG
atcaggttttggtggttgtc

SEQ ID NO: 87209 - DNA, 20 bp, Artificial Sequence
  Description of Artificial Sequence: Synthetic oligonucleotide
  Target: ATXN1; (-) strand; PAM type: NRG; PAM sequence: CAG
aatcaggttttggtggttgt

SEQ ID NO: 87210 - DNA, 20 bp, Artificial Sequence
  Description of Artificial Sequence: Synthetic oligonucleotide
  Target: ATXN1; (-) strand; PAM type: NRG; PAM sequence: TGG
gatgtctaatcaggttttgg

SEQ ID NO: 87211 - DNA, 20 bp, Artificial Sequence
  Description of Artificial Sequence: Synthetic oligonucleotide
  Target: ATXN1; (-) strand; PAM type: NRG; PAM sequence: TGG
agagatgtctaatcaggttt

SEQ ID NO: 87212 - DNA, 20 bp, Artificial Sequence
  Description of Artificial Sequence: Synthetic oligonucleotide
  Target: ATXN1; (-) strand; PAM type: NRG; PAM sequence: AGG
aaggagagagatgtctaatc

SEQ ID NO: 87213 - DNA, 20 bp, Artificial Sequence
  Description of Artificial Sequence: Synthetic oligonucleotide
  Target: ATXN1; (-) strand; PAM type: NRG; PAM sequence: CAG
aaaggagagagatgtctaat

SEQ ID NO: 87214 - DNA, 20 bp, Artificial Sequence
  Description of Artificial Sequence: Synthetic oligonucleotide
  Target: ATXN1; (-) strand; PAM type: NRG; PAM sequence: GAG
aagcacctagacaaaggaga

SEQ ID NO: 87215 - DNA, 20 bp, Artificial Sequence
  Description of Artificial Sequence: Synthetic oligonucleotide
  Target: ATXN1; (-) strand; PAM type: NRG; PAM sequence: GAG
taaagcacctagacaaagga

SEQ ID NO: 87216 - DNA, 20 bp, Artificial Sequence
  Description of Artificial Sequence: Synthetic oligonucleotide
  Target: ATXN1; (-) strand; PAM type: NRG; PAM sequence: GAG
agtaaagcacctagacaaag

SEQ ID NO: 87217 - DNA, 20 bp, Artificial Sequence
  Description of Artificial Sequence: Synthetic oligonucleotide
  Target: ATXN1; (-) strand; PAM type: NRG; PAM sequence: AGG
tcagtaaagcacctagacaa

SEQ ID NO: 87218 - DNA, 20 bp, Artificial Sequence
  Description of Artificial Sequence: Synthetic oligonucleotide
  Target: ATXN1; (-) strand; PAM type: NRG; PAM sequence: AAG
ttcagtaaagcacctagaca

SEQ ID NO: 87219 - DNA, 20 bp, Artificial Sequence
  Description of Artificial Sequence: Synthetic oligonucleotide
  Target: ATXN1; (-) strand; PAM type: NRG; PAM sequence: TAG
ctttttttcagtaaagcacc

SEQ ID NO: 87220 - DNA, 20 bp, Artificial Sequence
  Description of Artificial Sequence: Synthetic oligonucleotide
  Target: ATXN1; (-) strand; PAM type: NRG; PAM sequence: AAG
ttccatgctttttttcagta

SEQ ID NO: 87221 - DNA, 20 bp, Artificial Sequence
  Description of Artificial Sequence: Synthetic oligonucleotide
  Target: ATXN1; (-) strand; PAM type: NRG; PAM sequence: CAG
tctatttccatgcttttttt

SEQ ID NO: 87222 - DNA, 20 bp, Artificial Sequence
  Description of Artificial Sequence: Synthetic oligonucleotide
  Target: ATXN1; (-) strand; PAM type: NRG; PAM sequence: AAG
atacacacacatgcatctcc

SEQ ID NO: 87223 - DNA, 20 bp, Artificial Sequence
  Description of Artificial Sequence: Synthetic oligonucleotide
  Target: ATXN1; (-) strand; PAM type: NRG; PAM sequence: GAG
cacacacatacacacacaca

SEQ ID NO: 87224 - DNA, 20 bp, Artificial Sequence
  Description of Artificial Sequence: Synthetic oligonucleotide
  Target: ATXN1; (-) strand; PAM type: NRG; PAM sequence: CAG
cacacacacatacacacaca

SEQ ID NO: 87225 - DNA, 20 bp, Artificial Sequence
  Description of Artificial Sequence: Synthetic oligonucleotide
  Target: ATXN1; (-) strand; PAM type: NRG; PAM sequence: TGG
aagcagtgtgtttaaataca

SEQ ID NO: 87226 - DNA, 20 bp, Artificial Sequence
  Description of Artificial Sequence: Synthetic oligonucleotide
  Target: ATXN1; (-) strand; PAM type: NRG; PAM sequence: CAG
cctgctgcatataggaaaag

SEQ ID NO: 87227 - DNA, 20 bp, Artificial Sequence
  Description of Artificial Sequence: Synthetic oligonucleotide
  Target: ATXN1; (-) strand; PAM type: NRG; PAM sequence: AAG
attcctgctgcatataggaa

SEQ ID NO: 87228 - DNA, 20 bp, Artificial Sequence
  Description of Artificial Sequence: Synthetic oligonucleotide
  Target: ATXN1; (-) strand; PAM type: NRG; PAM sequence: AGG
aggaaattcctgctgcatat

SEQ ID NO: 87229 - DNA, 20 bp, Artificial Sequence
  Description of Artificial Sequence: Synthetic oligonucleotide
  Target: ATXN1; (-) strand; PAM type: NRG; PAM sequence: TAG
taggaaattcctgctgcata

SEQ ID NO: 87230 - DNA, 20 bp, Artificial Sequence
  Description of Artificial Sequence: Synthetic oligonucleotide
  Target: ATXN1; (-) strand; PAM type: NRG; PAM sequence: AGG
attgtcttcatatgccagat

SEQ ID NO: 87231 - DNA, 20 bp, Artificial Sequence
  Description of Artificial Sequence: Synthetic oligonucleotide
  Target: ATXN1; (-) strand; PAM type: NRG; PAM sequence: TAG
tattgtcttcatatgccaga

SEQ ID NO: 87232 - DNA, 20 bp, Artificial Sequence
  Description of Artificial Sequence: Synthetic oligonucleotide
  Target: ATXN1; (-) strand; PAM type: NRG; PAM sequence: CAG
tatgtattgtcttcatatgc

SEQ ID NO: 87233 - DNA, 20 bp, Artificial Sequence
  Description of Artificial Sequence: Synthetic oligonucleotide
  Target: ATXN1; (-) strand; PAM type: NRG; PAM sequence: GAG
ctcaccagctccatccaaaa

SEQ ID NO: 87234 - DNA, 20 bp, Artificial Sequence
  Description of Artificial Sequence: Synthetic oligonucleotide
  Target: ATXN1; (-) strand; PAM type: NRG; PAM sequence: AAG
gactcaccagctccatccaa

SEQ ID NO: 87235 - DNA, 20 bp, Artificial Sequence
  Description of Artificial Sequence: Synthetic oligonucleotide
  Target: ATXN1; (-) strand; PAM type: NRG; PAM sequence: CAG
caaaacactgcctgactcac

SEQ ID NO: 87236 - DNA, 20 bp, Artificial Sequence
  Description of Artificial Sequence: Synthetic oligonucleotide
  Target: ATXN1; (-) strand; PAM type: NRG; PAM sequence: CAG
tcatgcagactcaagtattg

SEQ ID NO: 87237 - DNA, 20 bp, Artificial Sequence
  Description of Artificial Sequence: Synthetic oligonucleotide
  Target: ATXN1; (-) strand; PAM type: NRG; PAM sequence: AAG
ctcatgagtcatgcagactc

SEQ ID NO: 87238 - DNA, 20 bp, Artificial Sequence
  Description of Artificial Sequence: Synthetic oligonucleotide
  Target: ATXN1; (-) strand; PAM type: NRG; PAM sequence: CAG
tgctttcctcatgagtcatg

SEQ ID NO: 87239 - DNA, 20 bp, Artificial Sequence
  Description of Artificial Sequence: Synthetic oligonucleotide
  Target: ATXN1; (-) strand; PAM type: NRG; PAM sequence: GAG
cccagacttgctttcctcat

SEQ ID NO: 87240 - DNA, 20 bp, Artificial Sequence
  Description of Artificial Sequence: Synthetic oligonucleotide
  Target: ATXN1; (-) strand; PAM type: NRG; PAM sequence: CAG
gatacaacagtcccagaccc

SEQ ID NO: 87241 - DNA, 20 bp, Artificial Sequence
  Description of Artificial Sequence: Synthetic oligonucleotide
  Target: ATXN1; (-) strand; PAM type: NRG; PAM sequence: CAG
ccattttgatacaacagtcc

SEQ ID NO: 87242 - DNA, 20 bp, Artificial Sequence
  Description of Artificial Sequence: Synthetic oligonucleotide
  Target: ATXN1; (-) strand; PAM type: NRG; PAM sequence: CAG
tccttcccattttgatacaa

SEQ ID NO: 87243 - DNA, 20 bp, Artificial Sequence
  Description of Artificial Sequence: Synthetic oligonucleotide
  Target: ATXN1; (-) strand; PAM type: NRG; PAM sequence: AAG
ataaaaatttaaattataaa

SEQ ID NO: 87244 - DNA, 20 bp, Artificial Sequence
  Description of Artificial Sequence: Synthetic oligonucleotide
  Target: ATXN1; (-) strand; PAM type: NRG; PAM sequence: AAG
agagtgataccctgtctcaa

SEQ ID NO: 87245 - DNA, 20 bp, Artificial Sequence
  Description of Artificial Sequence: Synthetic oligonucleotide
  Target: ATXN1; (-) strand; PAM type: NRG; PAM sequence: GAG
gcgctctagcctgagcaaga

SEQ ID NO: 87246 - DNA, 20 bp, Artificial Sequence
  Description of Artificial Sequence: Synthetic oligonucleotide
  Target: ATXN1; (-) strand; PAM type: NRG; PAM sequence: GAG
ctgcgctctagcctgagcaa

SEQ ID NO: 87247 - DNA, 20 bp, Artificial Sequence
  Description of Artificial Sequence: Synthetic oligonucleotide
  Target: ATXN1; (-) strand; PAM type: NRG; PAM sequence: AAG
cactgcgctctagcctgagc

SEQ ID NO: 87248 - DNA, 20 bp, Artificial Sequence
  Description of Artificial Sequence: Synthetic oligonucleotide
  Target: ATXN1; (-) strand; PAM type: NRG; PAM sequence: GAG
atgccactgcgctctagcct

SEQ ID NO: 87249 - DNA, 20 bp, Artificial Sequence
  Description of Artificial Sequence: Synthetic oligonucleotide
  Target: ATXN1; (-) strand; PAM type: NRG; PAM sequence: TAG
atgatcatgccactgcgctc

SEQ ID NO: 87250 - DNA, 20 bp, Artificial Sequence
  Description of Artificial Sequence: Synthetic oligonucleotide
  Target: ATXN1; (-) strand; PAM type: NRG; PAM sequence: GAG
caggagtttgtggctgtagt

SEQ ID NO: 87251 - DNA, 20 bp, Artificial Sequence
  Description of Artificial Sequence: Synthetic oligonucleotide
  Target: ATXN1; (-) strand; PAM type: NRG; PAM sequence: TAG
ggcccaggagtttgtggctg

SEQ ID NO: 87252 - DNA, 20 bp, Artificial Sequence
  Description of Artificial Sequence: Synthetic oligonucleotide
  Target: ATXN1; (-) strand; PAM type: NRG; PAM sequence: TGG
cccatgggcccaggagtttg

SEQ ID NO: 87253 - DNA, 20 bp, Artificial Sequence
  Description of Artificial Sequence: Synthetic oligonucleotide
  Target: ATXN1; (-) strand; PAM type: NRG; PAM sequence: GAG
ggaggatcccatgggcccag

SEQ ID NO: 87254 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcccatgggccc

SEQ ID NO: 87255 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcccatgggcc

SEQ ID NO: 87256 - DNA, 20 bp, Artificial Sequence
  Description of Artificial Sequence: Synthetic oligonucleotide
  Target: ATXN1; (-) strand; PAM type: NRG; PAM sequence: GGG
ctgaggtgggaggatcccat

SEQ ID NO: 87257 - DNA, 20 bp, Artificial Sequence
  Description of Artificial Sequence: Synthetic oligonucleotide
  Target: ATXN1; (-) strand; PAM type: NRG; PAM sequence: TGG
gctgaggtgggaggatccca

SEQ ID NO: 87258 - DNA, 20 bp, Artificial Sequence
  Description of Artificial Sequence: Synthetic oligonucleotide
  Target: ATXN1; (-) strand; PAM type: NRG; PAM sequence: AGG
tgctcgggagctgaggtggg

SEQ ID NO: 87259 - DNA, 20 bp, Artificial Sequence
  Description of Artificial Sequence: Synthetic oligonucleotide
  Target: ATXN1; (-) strand; PAM type: NRG; PAM sequence: GAG
ctgctcgggagctgaggtgg

SEQ ID NO: 87260 - DNA, 20 bp, Artificial Sequence
  Description of Artificial Sequence: Synthetic oligonucleotide
  Target: ATXN1; (-) strand; PAM type: NRG; PAM sequence: GGG
agctgctcgggagctgaggt

SEQ ID NO: 87261 - DNA, 20 bp, Artificial Sequence
  Description of Artificial Sequence: Synthetic oligonucleotide
  Target: ATXN1; (-) strand; PAM type: NRG; PAM sequence: TGG
cagctgctcgggagctgagg

SEQ ID NO: 87262 - DNA, 20 bp, Artificial Sequence
  Description of Artificial Sequence: Synthetic oligonucleotide
  Target: ATXN1; (-) strand; PAM type: NRG; PAM sequence: AGG
tctcagctgctcgggagctg

SEQ ID NO: 87263 - DNA, 20 bp, Artificial Sequence
  Description of Artificial Sequence: Synthetic oligonucleotide
  Target: ATXN1; (-) strand; PAM type: NRG; PAM sequence: GAG
gtctcagctgctcgggagct

SEQ ID NO: 87264 - DNA, 20 bp, Artificial Sequence
  Description of Artificial Sequence: Synthetic oligonucleotide
  Target: ATXN1; (-) strand; PAM type: NRG; PAM sequence: GAG
ctgtagtctcagctgctcgg

SEQ ID NO: 87265 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtctcagctgctc

SEQ ID NO: 87266 - DNA, 20 bp, Artificial Sequence
  Description of Artificial Sequence: Synthetic oligonucleotide
  Target: ATXN1; (-) strand; PAM type: NRG; PAM sequence: CGG
tgcctgtagtctcagctgct

SEQ ID NO: 87267 - DNA, 20 bp, Artificial Sequence
  Description of Artificial Sequence: Synthetic oligonucleotide
  Target: ATXN1; (-) strand; PAM type: NRG; PAM sequence: CAG
gtggctcttgcctgtagtct

SEQ ID NO: 87268 - DNA, 20 bp, Artificial Sequence
  Description of Artificial Sequence: Synthetic oligonucleotide
  Target: ATXN1; (-) strand; PAM type: NRG; PAM sequence: TAG
ggtgtggtggctcttgcctg

SEQ ID NO: 87269 - DNA, 20 bp, Artificial Sequence
  Description of Artificial Sequence: Synthetic oligonucleotide
  Target: ATXN1; (-) strand; PAM type: NRG; PAM sequence: TGG
aaaaaattgactgggtgtgg

SEQ ID NO: 87270 - DNA, 20 bp, Artificial Sequence
  Description of Artificial Sequence: Synthetic oligonucleotide
  Target: ATXN1; (-) strand; PAM type: NRG; PAM sequence: TGG
aagaaaaaattgactgggtg

SEQ ID NO: 87271 - DNA, 20 bp, Artificial Sequence
  Description of Artificial Sequence: Synthetic oligonucleotide
  Target: ATXN1; (-) strand; PAM type: NRG; PAM sequence: GGG
aaaaaaagaaaaaattgact

SEQ ID NO: 87272 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaagaaaaaattgac

SEQ ID NO: 87273 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaggaaggaaaaaa

SEQ ID NO: 87274 - DNA, 20 bp, Artificial Sequence
  Description of Artificial Sequence: Synthetic oligonucleotide
  Target: ATXN1; (-) strand; PAM type: NRG; PAM sequence: AGG
aaaaaaagaaaaaaaaagga

SEQ ID NO: 87275 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaagaaaaaaaaagg

SEQ ID NO: 87276 - DNA, 20 bp, Artificial Sequence
  Description of Artificial Sequence: Synthetic oligonucleotide
  Target: ATXN1; (-) strand; PAM type: NRG; PAM sequence: AGG
gaaaaaaaaaagaaaaaaaa

SEQ ID NO: 87277 - DNA, 20 bp, Artificial Sequence
  Description of Artificial Sequence: Synthetic oligonucleotide
  Target: ATXN1; (-) strand; PAM type: NRG; PAM sequence: AAG
agaaaaaaaaaagaaaaaaa

SEQ ID NO: 87278 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaagaaaaaaaa

SEQ ID NO: 87279 - DNA, 20 bp, Artificial Sequence
  Description of Artificial Sequence: Synthetic oligonucleotide
  Target: ATXN1; (-) strand; PAM type: NRG; PAM sequence: AAG
atctctacaaaaaaaaaaaa

SEQ ID NO: 87280 - DNA, 20 bp, Artificial Sequence
  Description of Artificial Sequence: Synthetic oligonucleotide
  Target: ATXN1; (-) strand; PAM type: NRG; PAM sequence: GAG
agcagcttgggcaacatagg

SEQ ID NO: 87281 - DNA, 20 bp, Artificial Sequence
  Description of Artificial Sequence: Synthetic oligonucleotide
  Target: ATXN1; (-) strand; PAM type: NRG; PAM sequence: GGG
acagcagcttgggcaacata

SEQ ID NO: 87282 - DNA, 20 bp, Artificial Sequence
  Description of Artificial Sequence: Synthetic oligonucleotide
  Target: ATXN1; (-) strand; PAM type: NRG; PAM sequence: AGG
gacagcagcttgggcaacat

SEQ ID NO: 87283 - DNA, 20 bp, Artificial Sequence
  Description of Artificial Sequence: Synthetic oligonucleotide
  Target: ATXN1; (-) strand; PAM type: NRG; PAM sequence: TAG
tgacagcagcttgggcaaca

SEQ ID NO: 87284 - DNA, 20 bp, Artificial Sequence
  Description of Artificial Sequence: Synthetic oligonucleotide
  Target: ATXN1; (-) strand; PAM type: NRG; PAM sequence: GGG
caggagtttgacagcagctt

SEQ ID NO: 87285 - DNA, 20 bp, Artificial Sequence
  Description of Artificial Sequence: Synthetic oligonucleotide
  Target: ATXN1; (-) strand; PAM type: NRG; PAM sequence: TGG
ccaggagtttgacagcagct

SEQ ID NO: 87286 - DNA, 20 bp, Artificial Sequence
  Description of Artificial Sequence: Synthetic oligonucleotide
  Target: ATXN1; (-) strand; PAM type: NRG; PAM sequence: CAG
tgagcccaggagtttgacag

SEQ ID NO: 87287 - DNA, 20 bp, Artificial Sequence
  Description of Artificial Sequence: Synthetic oligonucleotide
  Target: ATXN1; (-) strand; PAM type: NRG; PAM sequence: CAG
ccttgagcccaggagtttga

SEQ ID NO: 87288 - DNA, 20 bp, Artificial Sequence
  Description of Artificial Sequence: Synthetic oligonucleotide
  Target: ATXN1; (-) strand; PAM type: NRG; PAM sequence: GAG
ggaggatcccttgagcccag

SEQ ID NO: 87289 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcccttgagccc

SEQ ID NO: 87290 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcccttgagcc

SEQ ID NO: 87291 - DNA, 20 bp, Artificial Sequence
  Description of Artificial Sequence: Synthetic oligonucleotide
  Target: ATXN1; (-) strand; PAM type: NRG; PAM sequence: GAG
ccaaggtgggaggatccctt

SEQ ID NO: 87292 - DNA, 20 bp, Artificial Sequence
  Description of Artificial Sequence: Synthetic oligonucleotide
  Target: ATXN1; (-) strand; PAM type: NRG; PAM sequence: AGG
caaatctaggccaaggtggg

SEQ ID NO: 87293 - DNA, 20 bp, Artificial Sequence
  Description of Artificial Sequence: Synthetic oligonucleotide
  Target: ATXN1; (-) strand; PAM type: NRG; PAM sequence: GAG
acaaatctaggccaaggtgg

SEQ ID NO: 87294 - DNA, 20 bp, Artificial Sequence
  Description of Artificial Sequence: Synthetic oligonucleotide
  Target: ATXN1; (-) strand; PAM type: NRG; PAM sequence: GGG
atacaaatctaggccaaggt

SEQ ID NO: 87295 - DNA, 20 bp, Artificial Sequence
  Description of Artificial Sequence: Synthetic oligonucleotide
  Target: ATXN1; (-) strand; PAM type: NRG; PAM sequence: TGG
aatacaaatctaggccaagg

SEQ ID NO: 87296 - DNA, 20 bp, Artificial Sequence
  Description of Artificial Sequence: Synthetic oligonucleotide
  Target: ATXN1; (-) strand; PAM type: NRG; PAM sequence: AGG
aaaaatacaaatctaggcca

SEQ ID NO: 87297 - DNA, 20 bp, Artificial Sequence
  Description of Artificial Sequence: Synthetic oligonucleotide
  Target: ATXN1; (-) strand; PAM type: NRG; PAM sequence: AAG
taaaaatacaaatctaggcc

SEQ ID NO: 87298 - DNA, 20 bp, Artificial Sequence
  Description of Artificial Sequence: Synthetic oligonucleotide
  Target: ATXN1; (-) strand; PAM type: NRG; PAM sequence: AGG
tcaattaaaaatacaaatct

SEQ ID NO: 87299 - DNA, 20 bp, Artificial Sequence
  Description of Artificial Sequence: Synthetic oligonucleotide
  Target: ATXN1; (-) strand; PAM type: NRG; PAM sequence: TAG
gtcaattaaaaatacaaatc

SEQ ID NO: 87300 - DNA, 20 bp, Artificial Sequence
  Description of Artificial Sequence: Synthetic oligonucleotide
  Target: ATXN1; (-) strand; PAM type: NRG; PAM sequence: TAG
taatcattttatagtatatg

SEQ ID NO: 87301 - DNA, 20 bp, Artificial Sequence
  Description of Artificial Sequence: Synthetic oligonucleotide
  Target: ATXN1; (-) strand; PAM type: NRG; PAM sequence: TAG
agcttaatataatcatttta

SEQ ID NO: 87302 - DNA, 20 bp, Artificial Sequence
  Description of Artificial Sequence: Synthetic oligonucleotide
  Target: ATXN1; (-) strand; PAM type: NRG; PAM sequence: CAG
gaggtgatggacatattaat

SEQ ID NO: 87303 - DNA, 20 bp, Artificial Sequence
  Description of Artificial Sequence: Synthetic oligonucleotide
  Target: ATXN1; (-) strand; PAM type: NRG; PAM sequence: TGG
aaaataagtatgtgaggtga

SEQ ID NO: 87304 - DNA, 20 bp, Artificial Sequence
  Description of Artificial Sequence: Synthetic oligonucleotide
  Target: ATXN1; (-) strand; PAM type: NRG; PAM sequence: AGG
ttataaaaaataagtatgtg

SEQ ID NO: 87305 - DNA, 20 bp, Artificial Sequence
  Description of Artificial Sequence: Synthetic oligonucleotide
  Target: ATXN1; (-) strand; PAM type: NRG; PAM sequence: GAG
attataaaaaataagtatgt

SEQ ID NO: 87306 - DNA, 20 bp, Artificial Sequence
  Description of Artificial Sequence: Synthetic oligonucleotide
  Target: ATXN1; (-) strand; PAM type: NRG; PAM sequence: AAG
atgtcttcattataaaaaat

SEQ ID NO: 87307 - DNA, 20 bp, Artificial Sequence
  Description of Artificial Sequence: Synthetic oligonucleotide
  Target: ATXN1; (-) strand; PAM type: NRG; PAM sequence: AAG
ataaatgtcaagattgctaa

SEQ ID NO: 87308 - DNA, 20 bp, Artificial Sequence
  Description of Artificial Sequence: Synthetic oligonucleotide
  Target: ATXN1; (-) strand; PAM type: NRG; PAM sequence: AAG
aataaggtattataaatgtc

SEQ ID NO: 87309 - DNA, 20 bp, Artificial Sequence
  Description of Artificial Sequence: Synthetic oligonucleotide
  Target: ATXN1; (-) strand; PAM type: NRG; PAM sequence: AGG
catttttagccctcataata

SEQ ID NO: 87310 - DNA, 20 bp, Artificial Sequence
  Description of Artificial Sequence: Synthetic oligonucleotide
  Target: ATXN1; (-) strand; PAM type: NRG; PAM sequence: AAG
tcatttttagccctcataat

SEQ ID NO: 87311 - DNA, 20 bp, Artificial Sequence
  Description of Artificial Sequence: Synthetic oligonucleotide
  Target: ATXN1; (-) strand; PAM type: NRG; PAM sequence: TAG
ttattaatattattcatttt

SEQ ID NO: 87312 - DNA, 20 bp, Artificial Sequence
  Description of Artificial Sequence: Synthetic oligonucleotide
  Target: ATXN1; (-) strand; PAM type: NRG; PAM sequence: AGG
gtttctgagacccattgtac

SEQ ID NO: 87313 - DNA, 20 bp, Artificial Sequence
  Description of Artificial Sequence: Synthetic oligonucleotide
  Target: ATXN1; (-) strand; PAM type: NRG; PAM sequence: CAG
agtttctgagacccattgta

SEQ ID NO: 87314 - DNA, 20 bp, Artificial Sequence
  Description of Artificial Sequence: Synthetic oligonucleotide
  Target: ATXN1; (-) strand; PAM type: NRG; PAM sequence: GAG
gacaagagggctaagtttct

SEQ ID NO: 87315 - DNA, 20 bp, Artificial Sequence
  Description of Artificial Sequence: Synthetic oligonucleotide
  Target: ATXN1; (-) strand; PAM type: NRG; PAM sequence: AAG
ttcagttagacaagagggct

SEQ ID NO: 87316 - DNA, 20 bp, Artificial Sequence
  Description of Artificial Sequence: Synthetic oligonucleotide
  Target: ATXN1; (-) strand; PAM type: NRG; PAM sequence: GGG
gacgtttcagttagacaaga

SEQ ID NO: 87317 - DNA, 20 bp, Artificial Sequence
  Description of Artificial Sequence: Synthetic oligonucleotide
  Target: ATXN1; (-) strand; PAM type: NRG; PAM sequence: AGG
agacgtttcagttagacaag

SEQ ID NO: 87318 - DNA, 20 bp, Artificial Sequence
  Description of Artificial Sequence: Synthetic oligonucleotide
  Target: ATXN1; (-) strand; PAM type: NRG; PAM sequence: GAG
cagacgtttcagttagacaa

SEQ ID NO: 87319 - DNA, 20 bp, Artificial Sequence
  Description of Artificial Sequence: Synthetic oligonucleotide
  Target: ATXN1; (-) strand; PAM type: NRG; PAM sequence: AAG
tacagacgtttcagttagac

SEQ ID NO: 87320 - DNA, 20 bp, Artificial Sequence
  Description of Artificial Sequence: Synthetic oligonucleotide
  Target: ATXN1; (-) strand; PAM type: NRG; PAM sequence: TAG
aacggtacagacgtttcagt

SEQ ID NO: 87321 - DNA, 20 bp, Artificial Sequence
  Description of Artificial Sequence: Synthetic oligonucleotide
  Target: ATXN1; (-) strand; PAM type: NRG; PAM sequence: CAG
atcaaacggtacagacgttt

SEQ ID NO: 87322 - DNA, 20 bp, Artificial Sequence
  Description of Artificial Sequence: Synthetic oligonucleotide
  Target: ATXN1; (-) strand; PAM type: NRG; PAM sequence: CAG
ctttggttgatcaaacggta

SEQ ID NO: 87323 - DNA, 20 bp, Artificial Sequence
  Description of Artificial Sequence: Synthetic oligonucleotide
  Target: ATXN1; (-) strand; PAM type: NRG; PAM sequence: CGG
gccatctttggttgatcaaa

SEQ ID NO: 87324 - DNA, 20 bp, Artificial Sequence
  Description of Artificial Sequence: Synthetic oligonucleotide
  Target: ATXN1; (-) strand; PAM type: NRG; PAM sequence: TGG
ttgccaacaaaagccatctt

SEQ ID NO: 87325 - DNA, 20 bp, Artificial Sequence
  Description of Artificial Sequence: Synthetic oligonucleotide
  Target: ATXN1; (-) strand; PAM type: NRG; PAM sequence: AAG
aaaaattgaattgccaacaa

SEQ ID NO: 87326 - DNA, 20 bp, Artificial Sequence
  Description of Artificial Sequence: Synthetic oligonucleotide
  Target: ATXN1; (-) strand; PAM type: NRG; PAM sequence: AGG
tccaaatgaagacaaaaatg

SEQ ID NO: 87327 - DNA, 20 bp, Artificial Sequence
  Description of Artificial Sequence: Synthetic oligonucleotide
  Target: ATXN1; (-) strand; PAM type: NRG; PAM sequence: GAG
ctccaaatgaagacaaaaat

SEQ ID NO: 87328 - DNA, 20 bp, Artificial Sequence
  Description of Artificial Sequence: Synthetic oligonucleotide
  Target: ATXN1; (-) strand; PAM type: NRG; PAM sequence: AAG
atggataaaaactccaaatg

SEQ ID NO: 87329 - DNA, 20 bp, Artificial Sequence
  Description of Artificial Sequence: Synthetic oligonucleotide
  Target: ATXN1; (-) strand; PAM type: NRG; PAM sequence: TGG
gtcatcttcctctcttgtaa

SEQ ID NO: 87330 - DNA, 20 bp, Artificial Sequence
  Description of Artificial Sequence: Synthetic oligonucleotide
  Target: ATXN1; (-) strand; PAM type: NRG; PAM sequence: TGG
tgtttcatcttcctctattc

SEQ ID NO: 87331 - DNA, 20 bp, Artificial Sequence
  Description of Artificial Sequence: Synthetic oligonucleotide
  Target: ATXN1; (-) strand; PAM type: NRG; PAM sequence: TGG
gttcccttcagaatcctgag

SEQ ID NO: 87332 - DNA, 20 bp, Artificial Sequence
  Description of Artificial Sequence: Synthetic oligonucleotide
  Target: ATXN1; (-) strand; PAM type: NRG; PAM sequence: GAG
agtgttcccttcagaatcct

SEQ ID NO: 87333 - DNA, 20 bp, Artificial Sequence
  Description of Artificial Sequence: Synthetic oligonucleotide
  Target: ATXN1; (-) strand; PAM type: NRG; PAM sequence: CAG
acccaacccagtgttccctt

SEQ ID NO: 87334 - DNA, 20 bp, Artificial Sequence
  Description of Artificial Sequence: Synthetic oligonucleotide
  Target: ATXN1; (-) strand; PAM type: NRG; PAM sequence: CAG
aaattaaaaaaaacccaacc

SEQ ID NO: 87335 - DNA, 20 bp, Artificial Sequence
  Description of Artificial Sequence: Synthetic oligonucleotide
  Target: ATXN1; (-) strand; PAM type: NRG; PAM sequence: AAG
catagtgagaccccgtctct

SEQ ID NO: 87336 - DNA, 20 bp, Artificial Sequence
  Description of Artificial Sequence: Synthetic oligonucleotide
  Target: ATXN1; (-) strand; PAM type: NRG; PAM sequence: GAG
gccaacttgggcaacatagt

SEQ ID NO: 87337 - DNA, 20 bp, Artificial Sequence
  Description of Artificial Sequence: Synthetic oligonucleotide
  Target: ATXN1; (-) strand; PAM type: NRG; PAM sequence: TAG
caaggccaacttgggcaaca

SEQ ID NO: 87338 - DNA, 20 bp, Artificial Sequence
  Description of Artificial Sequence: Synthetic oligonucleotide
  Target: ATXN1; (-) strand; PAM type: NRG; PAM sequence: GGG
gaggagttcaaggccaactt

SEQ ID NO: 87339 - DNA, 20 bp, Artificial Sequence
  Description of Artificial Sequence: Synthetic oligonucleotide
  Target: ATXN1; (-) strand; PAM type: NRG; PAM sequence: TGG
agaggagttcaaggccaact

SEQ ID NO: 87340 - DNA, 20 bp, Artificial Sequence
  Description of Artificial Sequence: Synthetic oligonucleotide
  Target: ATXN1; (-) strand; PAM type: NRG; PAM sequence: AGG
cacttgagcagaggagttca

SEQ ID NO: 87341 - DNA, 20 bp, Artificial Sequence
  Description of Artificial Sequence: Synthetic oligonucleotide
  Target: ATXN1; (-) strand; PAM type: NRG; PAM sequence: AAG
tcacttgagcagaggagttc

SEQ ID NO: 87342 - DNA, 20 bp, Artificial Sequence
  Description of Artificial Sequence: Synthetic oligonucleotide
  Target: ATXN1; (-) strand; PAM type: NRG; PAM sequence: GAG
aaagggtcacttgagcagag

SEQ ID NO: 87343 - DNA, 20 bp, Artificial Sequence
  Description of Artificial Sequence: Synthetic oligonucleotide
  Target: ATXN1; (-) strand; PAM type: NRG; PAM sequence: AGG
ccaaagggtcacttgagcag

SEQ ID NO: 87344 - DNA, 20 bp, Artificial Sequence
  Description of Artificial Sequence: Synthetic oligonucleotide
  Target: ATXN1; (-) strand; PAM type: NRG; PAM sequence: GAG
gccaaagggtcacttgagca

SEQ ID NO: 87345 - DNA, 20 bp, Artificial Sequence
  Description of Artificial Sequence: Synthetic oligonucleotide
  Target: ATXN1; (-) strand; PAM type: NRG; PAM sequence: CAG
cagccaaagggtcacttgag

SEQ ID NO: 87346 - DNA, 20 bp, Artificial Sequence
  Description of Artificial Sequence: Synthetic oligonucleotide
  Target: ATXN1; (-) strand; PAM type: NRG; PAM sequence: GAG
tcccagccaaagggtcactt

SEQ ID NO: 87347 - DNA, 20 bp, Artificial Sequence
  Description of Artificial Sequence: Synthetic oligonucleotide
  Target: ATXN1; (-) strand; PAM type: NRG; PAM sequence: GGG
ctcatgcagtcccagccaaa

SEQ ID NO: 87348 - DNA, 20 bp, Artificial Sequence
  Description of Artificial Sequence: Synthetic oligonucleotide
  Target: ATXN1; (-) strand; PAM type: NRG; PAM sequence: AGG
gctcatgcagtcccagccaa

SEQ ID NO: 87349 - DNA, 20 bp, Artificial Sequence
  Description of Artificial Sequence: Synthetic oligonucleotide
  Target: ATXN1; (-) strand; PAM type: NRG; PAM sequence: AAG
tgctcatgcagtcccagcca

SEQ ID NO: 87350 - DNA, 20 bp, Artificial Sequence
  Description of Artificial Sequence: Synthetic oligonucleotide
  Target: ATXN1; (-) strand; PAM type: NRG; PAM sequence: CAG
gtggtgtgctcatgcagtcc

SEQ ID NO: 87351 - DNA, 20 bp, Artificial Sequence
  Description of Artificial Sequence: Synthetic oligonucleotide
  Target: ATXN1; (-) strand; PAM type: NRG; PAM sequence: CAG
gatgcagtggtgtgctcatg

SEQ ID NO: 87352 - DNA, 20 bp, Artificial Sequence
  Description of Artificial Sequence: Synthetic oligonucleotide
  Target: ATXN1; (-) strand; PAM type: NRG; PAM sequence: TGG
actggatgagcctgatgcag

SEQ ID NO: 87353 - DNA, 20 bp, Artificial Sequence
  Description of Artificial Sequence: Synthetic oligonucleotide
  Target: ATXN1; (-) strand; PAM type: NRG; PAM sequence: CAG
tcaactggatgagcctgatg

SEQ ID NO: 87354 - DNA, 20 bp, Artificial Sequence
  Description of Artificial Sequence: Synthetic oligonucleotide
  Target: ATXN1; (-) strand; PAM type: NRG; PAM sequence: GAG
ttaaaaaacctcaactggat

SEQ ID NO: 87355 - DNA, 20 bp, Artificial Sequence
  Description of Artificial Sequence: Synthetic oligonucleotide
  Target: ATXN1; (-) strand; PAM type: NRG; PAM sequence: TGG
gtattttaaaaaacctcaac

SEQ ID NO: 87356 - DNA, 20 bp, Artificial Sequence
  Description of Artificial Sequence: Synthetic oligonucleotide
  Target: ATXN1; (-) strand; PAM type: NRG; PAM sequence: CAG
ctacccaatcagagcaaaaa

SEQ ID NO: 87357 - DNA, 20 bp, Artificial Sequence
  Description of Artificial Sequence: Synthetic oligonucleotide
  Target: ATXN1; (-) strand; PAM type: NRG; PAM sequence: GAG
tctttgaggctacccaatca

SEQ ID NO: 87358 - DNA, 20 bp, Artificial Sequence
  Description of Artificial Sequence: Synthetic oligonucleotide
  Target: ATXN1; (-) strand; PAM type: NRG; PAM sequence: CAG
cctctttgaggctacccaat

SEQ ID NO: 87359 - DNA, 20 bp, Artificial Sequence
  Description of Artificial Sequence: Synthetic oligonucleotide
  Target: ATXN1; (-) strand; PAM type: NRG; PAM sequence: AGG
gactctcttcctcctctttg

SEQ ID NO: 87360 - DNA, 20 bp, Artificial Sequence
  Description of Artificial Sequence: Synthetic oligonucleotide
  Target: ATXN1; (-) strand; PAM type: NRG; PAM sequence: GAG
tgactctcttcctcctcttt

SEQ ID NO: 87361 - DNA, 20 bp, Artificial Sequence
  Description of Artificial Sequence: Synthetic oligonucleotide
  Target: ATXN1; (-) strand; PAM type: NRG; PAM sequence: AAG
agagctgaagattctgaatc

SEQ ID NO: 87362 - DNA, 20 bp, Artificial Sequence
  Description of Artificial Sequence: Synthetic oligonucleotide
  Target: ATXN1; (-) strand; PAM type: NRG; PAM sequence: AAG
gctgatagagtggagagctg

SEQ ID NO: 87363 - DNA, 20 bp, Artificial Sequence
  Description of Artificial Sequence: Synthetic oligonucleotide
  Target: ATXN1; (-) strand; PAM type: NRG; PAM sequence: GAG
caggttgctgatagagtgga

SEQ ID NO: 87364 - DNA, 20 bp, Artificial Sequence
  Description of Artificial Sequence: Synthetic oligonucleotide
  Target: ATXN1; (-) strand; PAM type: NRG; PAM sequence: GAG
ggcaggttgctgatagagtg

SEQ ID NO: 87365 - DNA, 20 bp, Artificial Sequence
  Description of Artificial Sequence: Synthetic oligonucleotide
  Target: ATXN1; (-) strand; PAM type: NRG; PAM sequence: TGG
aaggcaggttgctgatagag

SEQ ID NO: 87366 - DNA, 20 bp, Artificial Sequence
  Description of Artificial Sequence: Synthetic oligonucleotide
  Target: ATXN1; (-) strand; PAM type: NRG; PAM sequence: GAG
aggaaggcaggttgctgata

SEQ ID NO: 87367 - DNA, 20 bp, Artificial Sequence
  Description of Artificial Sequence: Synthetic oligonucleotide
  Target: ATXN1; (-) strand; PAM type: NRG; PAM sequence: TAG
gaaggaaggcaggttgctga

SEQ ID NO: 87368 - DNA, 20 bp, Artificial Sequence
  Description of Artificial Sequence: Synthetic oligonucleotide
  Target: ATXN1; (-) strand; PAM type: NRG; PAM sequence: AGG
aagtagacttgaaggaaggc

SEQ ID NO: 87369 - DNA, 20 bp, Artificial Sequence
  Description of Artificial Sequence: Synthetic oligonucleotide
  Target: ATXN1; (-) strand; PAM type: NRG; PAM sequence: CAG
caagtagacttgaaggaagg

SEQ ID NO: 87370 - DNA, 20 bp, Artificial Sequence
  Description of Artificial Sequence: Synthetic oligonucleotide
  Target: ATXN1; (-) strand; PAM type: NRG; PAM sequence: AGG
ggccaagtagacttgaagga

SEQ ID NO: 87371 - DNA, 20 bp, Artificial Sequence
  Description of Artificial Sequence: Synthetic oligonucleotide
  Target: ATXN1; (-) strand; PAM type: NRG; PAM sequence: AAG
gggccaagtagacttgaagg

SEQ ID NO: 87372 - DNA, 20 bp, Artificial Sequence
  Description of Artificial Sequence: Synthetic oligonucleotide
  Target: ATXN1; (-) strand; PAM type: NRG; PAM sequence: AGG
actgggccaagtagacttga

SEQ ID NO: 87373 - DNA, 20 bp, Artificial Sequence
  Description of Artificial Sequence: Synthetic oligonucleotide
  Target: ATXN1; (-) strand; PAM type: NRG; PAM sequence: AAG
cactgggccaagtagacttg

SEQ ID NO: 87374 - DNA, 20 bp, Artificial Sequence
  Description of Artificial Sequence: Synthetic oligonucleotide
  Target: ATXN1; (-) strand; PAM type: NRG; PAM sequence: TAG
aataacagcactgggccaag

SEQ ID NO: 87375 - DNA, 20 bp, Artificial Sequence
  Description of Artificial Sequence: Synthetic oligonucleotide
  Target: ATXN1; (-) strand; PAM type: NRG; PAM sequence: AAG
aggaataacagcactgggcc

SEQ ID NO: 87376 - DNA, 20 bp, Artificial Sequence
  Description of Artificial Sequence: Synthetic oligonucleotide
  Target: ATXN1; (-) strand; PAM type: NRG; PAM sequence: GGG
ggaggaggaataacagcact

SEQ ID NO: 87377 - DNA, 20 bp, Artificial Sequence
  Description of Artificial Sequence: Synthetic oligonucleotide
  Target: ATXN1; (-) strand; PAM type: NRG; PAM sequence: TGG
tggaggaggaataacagcac

SEQ ID NO: 87378 - DNA, 20 bp, Artificial Sequence
  Description of Artificial Sequence: Synthetic oligonucleotide
  Target: ATXN1; (-) strand; PAM type: NRG; PAM sequence: CAG
tgccagtggaggaggaataa

SEQ ID NO: 87379 - DNA, 20 bp, Artificial Sequence
  Description of Artificial Sequence: Synthetic oligonucleotide
  Target: ATXN1; (-) strand; PAM type: NRG; PAM sequence: AGG
catctagttgccagtggagg

SEQ ID NO: 87380 - DNA, 20 bp, Artificial Sequence
  Description of Artificial Sequence: Synthetic oligonucleotide
  Target: ATXN1; (-) strand; PAM type: NRG; PAM sequence: GAG
acatctagttgccagtggag

SEQ ID NO: 87381 - DNA, 20 bp, Artificial Sequence
  Description of Artificial Sequence: Synthetic oligonucleotide
  Target: ATXN1; (-) strand; PAM type: NRG; PAM sequence: AGG
acacatctagttgccagtgg

SEQ ID NO: 87382 - DNA, 20 bp, Artificial Sequence
  Description of Artificial Sequence: Synthetic oligonucleotide
  Target: ATXN1; (-) strand; PAM type: NRG; PAM sequence: GAG
cacacatctagttgccagtg

SEQ ID NO: 87383 - DNA, 20 bp, Artificial Sequence
  Description of Artificial Sequence: Synthetic oligonucleotide
  Target: ATXN1; (-) strand; PAM type: NRG; PAM sequence: TGG
ctcacacatctagttgccag

SEQ ID NO: 87384 - DNA, 20 bp, Artificial Sequence
  Description of Artificial Sequence: Synthetic oligonucleotide
  Target: ATXN1; (-) strand; PAM type: NRG; PAM sequence: CAG
tcactcacacatctagttgc

SEQ ID NO: 87385 - DNA, 20 bp, Artificial Sequence
  Description of Artificial Sequence: Synthetic oligonucleotide
  Target: ATXN1; (-) strand; PAM type: NRG; PAM sequence: TAG
atcaatgtcactcacacatc

SEQ ID NO: 87386 - DNA, 20 bp, Artificial Sequence
  Description of Artificial Sequence: Synthetic oligonucleotide
  Target: ATXN1; (-) strand; PAM type: NRG; PAM sequence: AGG
gagttaatccctctggtaat

SEQ ID NO: 87387 - DNA, 20 bp, Artificial Sequence
  Description of Artificial Sequence: Synthetic oligonucleotide
  Target: ATXN1; (-) strand; PAM type: NRG; PAM sequence: TAG
ggagttaatccctctggtaa

SEQ ID NO: 87388 - DNA, 20 bp, Artificial Sequence
  Description of Artificial Sequence: Synthetic oligonucleotide
  Target: ATXN1; (-) strand; PAM type: NRG; PAM sequence: TGG
aactttggagttaatccctc

SEQ ID NO: 87389 - DNA, 20 bp, Artificial Sequence
  Description of Artificial Sequence: Synthetic oligonucleotide
  Target: ATXN1; (-) strand; PAM type: NRG; PAM sequence: GAG
aaaccttcaagagaactttg

SEQ ID NO: 87390 - DNA, 20 bp, Artificial Sequence
  Description of Artificial Sequence: Synthetic oligonucleotide
  Target: ATXN1; (-) strand; PAM type: NRG; PAM sequence: TGG
taaaaccttcaagagaactt

SEQ ID NO: 87391 - DNA, 20 bp, Artificial Sequence
  Description of Artificial Sequence: Synthetic oligonucleotide
  Target: ATXN1; (-) strand; PAM type: NRG; PAM sequence: GAG
aagaactgtaaaaccttcaa

SEQ ID NO: 87392 - DNA, 20 bp, Artificial Sequence
  Description of Artificial Sequence: Synthetic oligonucleotide
  Target: ATXN1; (-) strand; PAM type: NRG; PAM sequence: AAG
aaaagaactgtaaaaccttc

SEQ ID NO: 87393 - DNA, 20 bp, Artificial Sequence
  Description of Artificial Sequence: Synthetic oligonucleotide
  Target: ATXN1; (-) strand; PAM type: NRG; PAM sequence: AAG
agaatgaggaactgctggaa

SEQ ID NO: 87394 - DNA, 20 bp, Artificial Sequence
  Description of Artificial Sequence: Synthetic oligonucleotide
  Target: ATXN1; (-) strand; PAM type: NRG; PAM sequence: TGG
tttgaagaatgaggaactgc

SEQ ID NO: 87395 - DNA, 20 bp, Artificial Sequence
  Description of Artificial Sequence: Synthetic oligonucleotide
  Target: ATXN1; (-) strand; PAM type: NRG; PAM sequence: AGG
ttaattacctttgaagaatg

SEQ ID NO: 87396 - DNA, 20 bp, Artificial Sequence
  Description of Artificial Sequence: Synthetic oligonucleotide
  Target: ATXN1; (-) strand; PAM type: NRG; PAM sequence: GAG
gttaattacctttgaagaat

SEQ ID NO: 87397 - DNA, 20 bp, Artificial Sequence
  Description of Artificial Sequence: Synthetic oligonucleotide
  Target: ATXN1; (-) strand; PAM type: NRG; PAM sequence: AAG
caagaggttaattacctttg

SEQ ID NO: 87398 - DNA, 20 bp, Artificial Sequence
  Description of Artificial Sequence: Synthetic oligonucleotide
  Target: ATXN1; (-) strand; PAM type: NRG; PAM sequence: AGG
tctgctgtaagcccatcaag

SEQ ID NO: 87399 - DNA, 20 bp, Artificial Sequence
  Description of Artificial Sequence: Synthetic oligonucleotide
  Target: ATXN1; (-) strand; PAM type: NRG; PAM sequence: GAG
ttctgctgtaagcccatcaa

SEQ ID NO: 87400 - DNA, 20 bp, Artificial Sequence
  Description of Artificial Sequence: Synthetic oligonucleotide
  Target: ATXN1; (-) strand; PAM type: NRG; PAM sequence: AAG
gcttctgctgtaagcccatc

SEQ ID NO: 87401 - DNA, 20 bp, Artificial Sequence
  Description of Artificial Sequence: Synthetic oligonucleotide
  Target: ATXN1; (-) strand; PAM type: NRG; PAM sequence: AAG
tctaacactgcttctgctgt

SEQ ID NO: 87402 - DNA, 20 bp, Artificial Sequence
  Description of Artificial Sequence: Synthetic oligonucleotide
  Target: ATXN1; (-) strand; PAM type: NRG; PAM sequence: GGG
taacatatcatcaatgtgtt

SEQ ID NO: 87403 - DNA, 20 bp, Artificial Sequence
  Description of Artificial Sequence: Synthetic oligonucleotide
  Target: ATXN1; (-) strand; PAM type: NRG; PAM sequence: TGG
ataacatatcatcaatgtgt

SEQ ID NO: 87404 - DNA, 20 bp, Artificial Sequence
  Description of Artificial Sequence: Synthetic oligonucleotide
  Target: ATXN1; (-) strand; PAM type: NRG; PAM sequence: TGG
tttccaattatcctctcccc

SEQ ID NO: 87405 - DNA, 20 bp, Artificial Sequence
  Description of Artificial Sequence: Synthetic oligonucleotide
  Target: ATXN1; (-) strand; PAM type: NRG; PAM sequence: TGG
aatatattttccaatgaggc

SEQ ID NO: 87406 - DNA, 20 bp, Artificial Sequence
  Description of Artificial Sequence: Synthetic oligonucleotide
  Target: ATXN1; (-) strand; PAM type: NRG; PAM sequence: AGG
tggaaatatattttccaatg

SEQ ID NO: 87407 - DNA, 20 bp, Artificial Sequence
  Description of Artificial Sequence: Synthetic oligonucleotide
  Target: ATXN1; (-) strand; PAM type: NRG; PAM sequence: GAG
atggaaatatattttccaat

SEQ ID NO: 87408 - DNA, 20 bp, Artificial Sequence
  Description of Artificial Sequence: Synthetic oligonucleotide
  Target: ATXN1; (-) strand; PAM type: NRG; PAM sequence: TGG
agttactttttctcaataaa

SEQ ID NO: 87409 - DNA, 20 bp, Artificial Sequence
  Description of Artificial Sequence: Synthetic oligonucleotide
  Target: ATXN1; (-) strand; PAM type: NRG; PAM sequence: GAG
tcatatgttcctaaacactt

SEQ ID NO: 87410 - DNA, 20 bp, Artificial Sequence
  Description of Artificial Sequence: Synthetic oligonucleotide
  Target: ATXN1; (-) strand; PAM type: NRG; PAM sequence: AGG
cgaaatagcatggttttcta

SEQ ID NO: 87411 - DNA, 20 bp, Artificial Sequence
  Description of Artificial Sequence: Synthetic oligonucleotide
  Target: ATXN1; (-) strand; PAM type: NRG; PAM sequence: AAG
tcgaaatagcatggttttct

SEQ ID NO: 87412 - DNA, 20 bp, Artificial Sequence
  Description of Artificial Sequence: Synthetic oligonucleotide
  Target: ATXN1; (-) strand; PAM type: NRG; PAM sequence: TGG
tagtagaagtcgaaatagca

SEQ ID NO: 87413 - DNA, 20 bp, Artificial Sequence
  Description of Artificial Sequence: Synthetic oligonucleotide
  Target: ATXN1; (-) strand; PAM type: NRG; PAM sequence: TAG
attattagtagaagtcgaaa

SEQ ID NO: 87414 - DNA, 20 bp, Artificial Sequence
  Description of Artificial Sequence: Synthetic oligonucleotide
  Target: ATXN1; (-) strand; PAM type: NRG; PAM sequence: AAG
cgttttctcattattagtag

SEQ ID NO: 87415 - DNA, 20 bp, Artificial Sequence
  Description of Artificial Sequence: Synthetic oligonucleotide
  Target: ATXN1; (-) strand; PAM type: NRG; PAM sequence: TAG
ctccgttttctcattattag

SEQ ID NO: 87416 - DNA, 20 bp, Artificial Sequence
  Description of Artificial Sequence: Synthetic oligonucleotide
  Target: ATXN1; (-) strand; PAM type: NRG; PAM sequence: TAG
cacctccgttttctcattat

SEQ ID NO: 87417 - DNA, 20 bp, Artificial Sequence
  Description of Artificial Sequence: Synthetic oligonucleotide
  Target: ATXN1; (-) strand; PAM type: NRG; PAM sequence: AGG
ttgggtaactgtggctcggc

SEQ ID NO: 87418 - DNA, 20 bp, Artificial Sequence
  Description of Artificial Sequence: Synthetic oligonucleotide
  Target: ATXN1; (-) strand; PAM type: NRG; PAM sequence: CAG
gttgggtaactgtggctcgg

SEQ ID NO: 87419 - DNA, 20 bp, Artificial Sequence
  Description of Artificial Sequence: Synthetic oligonucleotide
  Target: ATXN1; (-) strand; PAM type: NRG; PAM sequence: CGG
ctggttgggtaactgtggct

SEQ ID NO: 87420 - DNA, 20 bp, Artificial Sequence
  Description of Artificial Sequence: Synthetic oligonucleotide
  Target: ATXN1; (-) strand; PAM type: NRG; PAM sequence: TGG
tggtgctggttgggtaactg

SEQ ID NO: 87421 - DNA, 20 bp, Artificial Sequence
  Description of Artificial Sequence: Synthetic oligonucleotide
  Target: ATXN1; (-) strand; PAM type: NRG; PAM sequence: GGG
tgactacattggtgctggtt

SEQ ID NO: 87422 - DNA, 20 bp, Artificial Sequence
  Description of Artificial Sequence: Synthetic oligonucleotide
  Target: ATXN1; (-) strand; PAM type: NRG; PAM sequence: TGG
ctgactacattggtgctggt

SEQ ID NO: 87423 - DNA, 20 bp, Artificial Sequence
  Description of Artificial Sequence: Synthetic oligonucleotide
  Target: ATXN1; (-) strand; PAM type: NRG; PAM sequence: TGG
agcactgactacattggtgc

SEQ ID NO: 87424 - DNA, 20 bp, Artificial Sequence
  Description of Artificial Sequence: Synthetic oligonucleotide
  Target: ATXN1; (-) strand; PAM type: NRG; PAM sequence: TGG
ccaggcagcactgactacat

SEQ ID NO: 87425 - DNA, 20 bp, Artificial Sequence
  Description of Artificial Sequence: Synthetic oligonucleotide
  Target: ATXN1; (-) strand; PAM type: NRG; PAM sequence: CAG
tggtcaggtctcgctccagg

SEQ ID NO: 87426 - DNA, 20 bp, Artificial Sequence
  Description of Artificial Sequence: Synthetic oligonucleotide
  Target: ATXN1; (-) strand; PAM type: NRG; PAM sequence: AGG
gtatggtcaggtctcgctcc

SEQ ID NO: 87427 - DNA, 20 bp, Artificial Sequence
  Description of Artificial Sequence: Synthetic oligonucleotide
  Target: ATXN1; (-) strand; PAM type: NRG; PAM sequence: CAG
agtatggtcaggtctcgctc

SEQ ID NO: 87428 - DNA, 20 bp, Artificial Sequence
  Description of Artificial Sequence: Synthetic oligonucleotide
  Target: ATXN1; (-) strand; PAM type: NRG; PAM sequence: AGG
ttctgccccacagtatggtc

SEQ ID NO: 87429 - DNA, 20 bp, Artificial Sequence
  Description of Artificial Sequence: Synthetic oligonucleotide
  Target: ATXN1; (-) strand; PAM type: NRG; PAM sequence: CAG
attctgccccacagtatggt

SEQ ID NO: 87430 - DNA, 20 bp, Artificial Sequence
  Description of Artificial Sequence: Synthetic oligonucleotide
  Target: ATXN1; (-) strand; PAM type: NRG; PAM sequence: TGG
ggagattctgccccacagta

SEQ ID NO: 87431 - DNA, 20 bp, Artificial Sequence
  Description of Artificial Sequence: Synthetic oligonucleotide
  Target: ATXN1; (-) strand; PAM type: NRG; PAM sequence: CAG
ggaggggagattctgcccca

SEQ ID NO: 87432 - DNA, 20 bp, Artificial Sequence
  Description of Artificial Sequence: Synthetic oligonucleotide
  Target: ATXN1; (-) strand; PAM type: NRG; PAM sequence: GAG
ttatgaaggggattggaggg

SEQ ID NO: 87433 - DNA, 20 bp, Artificial Sequence
  Description of Artificial Sequence: Synthetic oligonucleotide
  Target: ATXN1; (-) strand; PAM type: NRG; PAM sequence: GGG
ctttatgaaggggattggag

SEQ ID NO: 87434 - DNA, 20 bp, Artificial Sequence
  Description of Artificial Sequence: Synthetic oligonucleotide
  Target: ATXN1; (-) strand; PAM type: NRG; PAM sequence: GGG
gctttatgaaggggattgga

SEQ ID NO: 87435 - DNA, 20 bp, Artificial Sequence
  Description of Artificial Sequence: Synthetic oligonucleotide
  Target: ATXN1; (-) strand; PAM type: NRG; PAM sequence: AGG
tgctttatgaaggggattgg

SEQ ID NO: 87436 - DNA, 20 bp, Artificial Sequence
  Description of Artificial Sequence: Synthetic oligonucleotide
  Target: ATXN1; (-) strand; PAM type: NRG; PAM sequence: GAG
gtgctttatgaaggggattg

SEQ ID NO: 87437 - DNA, 20 bp, Artificial Sequence
  Description of Artificial Sequence: Synthetic oligonucleotide
  Target: ATXN1; (-) strand; PAM type: NRG; PAM sequence: TGG
tcgtgctttatgaaggggat

SEQ ID NO: 87438 - DNA, 20 bp, Artificial Sequence
  Description of Artificial Sequence: Synthetic oligonucleotide
  Target: ATXN1; (-) strand; PAM type: NRG; PAM sequence: GGG
catcatcgtgctttatgaag

SEQ ID NO: 87439 - DNA, 20 bp, Artificial Sequence
  Description of Artificial Sequence: Synthetic oligonucleotide
  Target: ATXN1; (-) strand; PAM type: NRG; PAM sequence: GGG
gcatcatcgtgctttatgaa

SEQ ID NO: 87440 - DNA, 20 bp, Artificial Sequence
  Description of Artificial Sequence: Synthetic oligonucleotide
  Target: ATXN1; (-) strand; PAM type: NRG; PAM sequence: AGG
agcatcatcgtgctttatga

SEQ ID NO: 87441 - DNA, 20 bp, Artificial Sequence
  Description of Artificial Sequence: Synthetic oligonucleotide
  Target: ATXN1; (-) strand; PAM type: NRG; PAM sequence: AAG
cagcatcatcgtgctttatg

SEQ ID NO: 87442 - DNA, 20 bp, Artificial Sequence
  Description of Artificial Sequence: Synthetic oligonucleotide
  Target: ATXN1; (-) strand; PAM type: NRG; PAM sequence: CAG
aggcacaggttgtgtttgaa

SEQ ID NO: 87443 - DNA, 20 bp, Artificial Sequence
  Description of Artificial Sequence: Synthetic oligonucleotide
  Target: ATXN1; (-) strand; PAM type: NRG; PAM sequence: AGG
gctctaaggacaggaggcac

SEQ ID NO: 87444 - DNA, 20 bp, Artificial Sequence
  Description of Artificial Sequence: Synthetic oligonucleotide
  Target: ATXN1; (-) strand; PAM type: NRG; PAM sequence: CAG
ggctctaaggacaggaggca

SEQ ID NO: 87445 - DNA, 20 bp, Artificial Sequence
  Description of Artificial Sequence: Synthetic oligonucleotide
  Target: ATXN1; (-) strand; PAM type: NRG; PAM sequence: AGG
tctggggctctaaggacagg

SEQ ID NO: 87446 - DNA, 20 bp, Artificial Sequence
  Description of Artificial Sequence: Synthetic oligonucleotide
  Target: ATXN1; (-) strand; PAM type: NRG; PAM sequence: GAG
atctggggctctaaggacag

SEQ ID NO: 87447 - DNA, 20 bp, Artificial Sequence
  Description of Artificial Sequence: Synthetic oligonucleotide
  Target: ATXN1; (-) strand; PAM type: NRG; PAM sequence: AGG
aaatctggggctctaaggac

SEQ ID NO: 87448 - DNA, 20 bp, Artificial Sequence
  Description of Artificial Sequence: Synthetic oligonucleotide
  Target: ATXN1; (-) strand; PAM type: NRG; PAM sequence: CAG
gaaatctggggctctaagga

SEQ ID NO: 87449 - DNA, 20 bp, Artificial Sequence
  Description of Artificial Sequence: Synthetic oligonucleotide
  Target: ATXN1; (-) strand; PAM type: NRG; PAM sequence: AGG
aaatgaaatctggggctcta

SEQ ID NO: 87450 - DNA, 20 bp, Artificial Sequence
  Description of Artificial Sequence: Synthetic oligonucleotide
  Target: ATXN1; (-) strand; PAM type: NRG; PAM sequence: AAG
aaaatgaaatctggggctct

SEQ ID NO: 87451 - DNA, 20 bp, Artificial Sequence
  Description of Artificial Sequence: Synthetic oligonucleotide
  Target: ATXN1; (-) strand; PAM type: NRG; PAM sequence: GGG
ctctcctaaaatgaaatctg

SEQ ID NO: 87452 - DNA, 20 bp, Artificial Sequence
  Description of Artificial Sequence: Synthetic oligonucleotide
  Target: ATXN1; (-) strand; PAM type: NRG; PAM sequence: GGG
cctctcctaaaatgaaatct

SEQ ID NO: 87453 - DNA, 20 bp, Artificial Sequence
  Description of Artificial Sequence: Synthetic oligonucleotide
  Target: ATXN1; (-) strand; PAM type: NRG; PAM sequence: TGG
tcctctcctaaaatgaaatc

SEQ ID NO: 87454 - DNA, 20 bp, Artificial Sequence
  Description of Artificial Sequence: Synthetic oligonucleotide
  Target: ATXN1; (-) strand; PAM type: NRG; PAM sequence: TAG
cattctcagttttcagagct

SEQ ID NO: 87455 - DNA, 20 bp, Artificial Sequence
  Description of Artificial Sequence: Synthetic oligonucleotide
  Target: ATXN1; (-) strand; PAM type: NRG; PAM sequence: GAG
tgtctcattctcagttttca

SEQ ID NO: 87456 - DNA, 20 bp, Artificial Sequence
  Description of Artificial Sequence: Synthetic oligonucleotide
  Target: ATXN1; (-) strand; PAM type: NRG; PAM sequence: CAG
tttgtctcattctcagtttt

SEQ ID NO: 87457 - DNA, 20 bp, Artificial Sequence
  Description of Artificial Sequence: Synthetic oligonucleotide
  Target: ATXN1; (-) strand; PAM type: NRG; PAM sequence: CAG
ttcttcctttgtctcattct

SEQ ID NO: 87458 - DNA, 20 bp, Artificial Sequence
  Description of Artificial Sequence: Synthetic oligonucleotide
  Target: ATXN1; (-) strand; PAM type: NRG; PAM sequence: AAG
gtgattgcaaacactacaat

SEQ ID NO: 87459 - DNA, 20 bp, Artificial Sequence
  Description of Artificial Sequence: Synthetic oligonucleotide
  Target: ATXN1; (-) strand; PAM type: NRG; PAM sequence: TAG
aatgtaatgaaaggcacaag

SEQ ID NO: 87460 - DNA, 20 bp, Artificial Sequence
  Description of Artificial Sequence: Synthetic oligonucleotide
  Target: ATXN1; (-) strand; PAM type: NRG; PAM sequence: AAG
ttaaatgtaatgaaaggcac

SEQ ID NO: 87461 - DNA, 20 bp, Artificial Sequence
  Description of Artificial Sequence: Synthetic oligonucleotide
  Target: ATXN1; (-) strand; PAM type: NRG; PAM sequence: AGG
atgcatttaaatgtaatgaa

SEQ ID NO: 87462 - DNA, 20 bp, Artificial Sequence
  Description of Artificial Sequence: Synthetic oligonucleotide
  Target: ATXN1; (-) strand; PAM type: NRG; PAM sequence: AAG
catgcatttaaatgtaatga

SEQ ID NO: 87463 - DNA, 20 bp, Artificial Sequence
  Description of Artificial Sequence: Synthetic oligonucleotide
  Target: ATXN1; (-) strand; PAM type: NRG; PAM sequence: TGG
cactgcagaatgcatgaagg

SEQ ID NO: 87464 - DNA, 20 bp, Artificial Sequence
  Description of Artificial Sequence: Synthetic oligonucleotide
  Target: ATXN1; (-) strand; PAM type: NRG; PAM sequence: AGG
tttcactgcagaatgcatga

SEQ ID NO: 87465 - DNA, 20 bp, Artificial Sequence
  Description of Artificial Sequence: Synthetic oligonucleotide
  Target: ATXN1; (-) strand; PAM type: NRG; PAM sequence: AAG
ttttcactgcagaatgcatg

SEQ ID NO: 87466 - DNA, 20 bp, Artificial Sequence
  Description of Artificial Sequence: Synthetic oligonucleotide
  Target: ATXN1; (-) strand; PAM type: NRG; PAM sequence: CAG
tggcaccatctttttcactg

SEQ ID NO: 87467 - DNA, 20 bp, Artificial Sequence
  Description of Artificial Sequence: Synthetic oligonucleotide
  Target: ATXN1; (-) strand; PAM type: NRG; PAM sequence: TGG
cttacaatgaaattccaacc

SEQ ID NO: 87468 - DNA, 20 bp, Artificial Sequence
  Description of Artificial Sequence: Synthetic oligonucleotide
  Target: ATXN1; (-) strand; PAM type: NRG; PAM sequence: GGG
atttgggacctgattccaaa

SEQ ID NO: 87469 - DNA, 20 bp, Artificial Sequence
  Description of Artificial Sequence: Synthetic oligonucleotide
  Target: ATXN1; (-) strand; PAM type: NRG; PAM sequence: AGG
gatttgggacctgattccaa

SEQ ID NO: 87470 - DNA, 20 bp, Artificial Sequence
  Description of Artificial Sequence: Synthetic oligonucleotide
  Target: ATXN1; (-) strand; PAM type: NRG; PAM sequence: AAG
tgatttgggacctgattcca

SEQ ID NO: 87471 - DNA, 20 bp, Artificial Sequence
  Description of Artificial Sequence: Synthetic oligonucleotide
  Target: ATXN1; (-) strand; PAM type: NRG; PAM sequence: GGG
aaaggagcaaataatgattt

SEQ ID NO: 87472 - DNA, 20 bp, Artificial Sequence
  Description of Artificial Sequence: Synthetic oligonucleotide
  Target: ATXN1; (-) strand; PAM type: NRG; PAM sequence: TGG
aaaaggagcaaataatgatt

SEQ ID NO: 87473 - DNA, 20 bp, Artificial Sequence
  Description of Artificial Sequence: Synthetic oligonucleotide
  Target: ATXN1; (-) strand; PAM type: NRG; PAM sequence: GAG
gatgatgacaatgataaaag

SEQ ID NO: 87474 - DNA, 20 bp, Artificial Sequence
  Description of Artificial Sequence: Synthetic oligonucleotide
  Target: ATXN1; (-) strand; PAM type: NRG; PAM sequence: AGG
acgatgatgacaatgataaa

SEQ ID NO: 87475 - DNA, 20 bp, Artificial Sequence
  Description of Artificial Sequence: Synthetic oligonucleotide
  Target: ATXN1; (-) strand; PAM type: NRG; PAM sequence: AAG
cacgatgatgacaatgataa

SEQ ID NO: 87476 - DNA, 20 bp, Artificial Sequence
  Description of Artificial Sequence: Synthetic oligonucleotide
  Target: ATXN1; (-) strand; PAM type: NRG; PAM sequence: GAG
acagagctcctcccctcagg

SEQ ID NO: 87477 - DNA, 20 bp, Artificial Sequence
  Description of Artificial Sequence: Synthetic oligonucleotide
  Target: ATXN1; (-) strand; PAM type: NRG; PAM sequence: GGG
agacagagctcctcccctca

SEQ ID NO: 87478 - DNA, 20 bp, Artificial Sequence
  Description of Artificial Sequence: Synthetic oligonucleotide
  Target: ATXN1; (-) strand; PAM type: NRG; PAM sequence: AGG
cagacagagctcctcccctc

SEQ ID NO: 87479 - DNA, 20 bp, Artificial Sequence
  Description of Artificial Sequence: Synthetic oligonucleotide
  Target: ATXN1; (-) strand; PAM type: NRG; PAM sequence: CAG
acagacagagctcctcccct

SEQ ID NO: 87480 - DNA, 20 bp, Artificial Sequence
  Description of Artificial Sequence: Synthetic oligonucleotide
  Target: ATXN1; (-) strand; PAM type: NRG; PAM sequence: GAG
gatagtgaacaagacagaca

SEQ ID NO: 87481 - DNA, 20 bp, Artificial Sequence
  Description of Artificial Sequence: Synthetic oligonucleotide
  Target: ATXN1; (-) strand; PAM type: NRG; PAM sequence: CAG
atgatagtgaacaagacaga

SEQ ID NO: 87482 - DNA, 20 bp, Artificial Sequence
  Description of Artificial Sequence: Synthetic oligonucleotide
  Target: ATXN1; (-) strand; PAM type: NRG; PAM sequence: CAG
gaatatgatagtgaacaaga

SEQ ID NO: 87483 - DNA, 20 bp, Artificial Sequence
  Description of Artificial Sequence: Synthetic oligonucleotide
  Target: ATXN1; (-) strand; PAM type: NRG; PAM sequence: AAG
taaggaatatgatagtgaac

SEQ ID NO: 87484 - DNA, 20 bp, Artificial Sequence
  Description of Artificial Sequence: Synthetic oligonucleotide
  Target: ATXN1; (-) strand; PAM type: NRG; PAM sequence: TAG
cgtaggtgtaaggaatatga

SEQ ID NO: 87485 - DNA, 20 bp, Artificial Sequence
  Description of Artificial Sequence: Synthetic oligonucleotide
  Target: ATXN1; (-) strand; PAM type: NRG; PAM sequence: AGG
ccatggatgccgtaggtgta

SEQ ID NO: 87486 - DNA, 20 bp, Artificial Sequence
  Description of Artificial Sequence: Synthetic oligonucleotide
  Target: ATXN1; (-) strand; PAM type: NRG; PAM sequence: AAG
cccatggatgccgtaggtgt

SEQ ID NO: 87487 - DNA, 20 bp, Artificial Sequence
  Description of Artificial Sequence: Synthetic oligonucleotide
  Target: ATXN1; (-) strand; PAM type: NRG; PAM sequence: AGG
gcttgtcccatggatgccgt

SEQ ID NO: 87488 - DNA, 20 bp, Artificial Sequence
  Description of Artificial Sequence: Synthetic oligonucleotide
  Target: ATXN1; (-) strand; PAM type: NRG; PAM sequence: TAG
agcttgtcccatggatgccg

SEQ ID NO: 87489 - DNA, 20 bp, Artificial Sequence
  Description of Artificial Sequence: Synthetic oligonucleotide
  Target: ATXN1; (-) strand; PAM type: NRG; PAM sequence: TGG
attttacttagcttgtccca

SEQ ID NO: 87490 - DNA, 20 bp, Artificial Sequence
  Description of Artificial Sequence: Synthetic oligonucleotide
  Target: ATXN1; (-) strand; PAM type: NRG; PAM sequence: TAG
gcctttcagtaaattttact

SEQ ID NO: 87491 - DNA, 20 bp, Artificial Sequence
  Description of Artificial Sequence: Synthetic oligonucleotide
  Target: ATXN1; (-) strand; PAM type: NRG; PAM sequence: CAG
gaagtttttattcagccttt

SEQ ID NO: 87492 - DNA, 20 bp, Artificial Sequence
  Description of Artificial Sequence: Synthetic oligonucleotide
  Target: ATXN1; (-) strand; PAM type: NRG; PAM sequence: CAG
tccatgtggaagtttttatt

SEQ ID NO: 87493 - DNA, 20 bp, Artificial Sequence
  Description of Artificial Sequence: Synthetic oligonucleotide
  Target: ATXN1; (-) strand; PAM type: NRG; PAM sequence: AAG
ttcttcttcattccatgtgg

SEQ ID NO: 87494 - DNA, 20 bp, Artificial Sequence
  Description of Artificial Sequence: Synthetic oligonucleotide
  Target: ATXN1; (-) strand; PAM type: NRG; PAM sequence: TGG
tatttcttcttcattccatg

SEQ ID NO: 87495 - DNA, 20 bp, Artificial Sequence
  Description of Artificial Sequence: Synthetic oligonucleotide
  Target: ATXN1; (-) strand; PAM type: NRG; PAM sequence: CAG
tcttctttcattttccttta

SEQ ID NO: 87496 - DNA, 20 bp, Artificial Sequence
  Description of Artificial Sequence: Synthetic oligonucleotide
  Target: ATXN1; (-) strand; PAM type: NRG; PAM sequence: AGG
tgtggttttaaattttaaac

SEQ ID NO: 87497 - DNA, 20 bp, Artificial Sequence
  Description of Artificial Sequence: Synthetic oligonucleotide
  Target: ATXN1; (-) strand; PAM type: NRG; PAM sequence: CAG
atgtggttttaaattttaaa

SEQ ID NO: 87498 - DNA, 20 bp, Artificial Sequence
  Description of Artificial Sequence: Synthetic oligonucleotide
  Target: ATXN1; (-) strand; PAM type: NRG; PAM sequence: TGG
aaactctcaatcttttaatg

SEQ ID NO: 87499 - DNA, 20 bp, Artificial Sequence
  Description of Artificial Sequence: Synthetic oligonucleotide
  Target: ATXN1; (-) strand; PAM type: NRG; PAM sequence: CAG
tttccatttttaacatacct

SEQ ID NO: 87500 - DNA, 20 bp, Artificial Sequence
  Description of Artificial Sequence: Synthetic oligonucleotide
  Target: ATXN1; (-) strand; PAM type: NRG; PAM sequence: AGG
actgacagtaacagcttaat

SEQ ID NO: 87501 - DNA, 20 bp, Artificial Sequence
  Description of Artificial Sequence: Synthetic oligonucleotide
  Target: ATXN1; (-) strand; PAM type: NRG; PAM sequence: TAG
aactgacagtaacagcttaa

SEQ ID NO: 87502 - DNA, 20 bp, Artificial Sequence
  Description of Artificial Sequence: Synthetic oligonucleotide
  Target: ATXN1; (-) strand; PAM type: NRG; PAM sequence: CAG
acaggtgaaactgacagtaa

SEQ ID NO: 87503 - DNA, 20 bp, Artificial Sequence
  Description of Artificial Sequence: Synthetic oligonucleotide
  Target: ATXN1; (-) strand; PAM type: NRG; PAM sequence: CAG
tacttaacaggtgaaactga

SEQ ID NO: 87504 - DNA, 20 bp, Artificial Sequence
  Description of Artificial Sequence: Synthetic oligonucleotide
  Target: ATXN1; (-) strand; PAM type: NRG; PAM sequence: AGG
actaatagtacctacttaac

SEQ ID NO: 87505 - DNA, 20 bp, Artificial Sequence
  Description of Artificial Sequence: Synthetic oligonucleotide
  Target: ATXN1; (-) strand; PAM type: NRG; PAM sequence: CAG
aactaatagtacctacttaa

SEQ ID NO: 87506 - DNA, 20 bp, Artificial Sequence
  Description of Artificial Sequence: Synthetic oligonucleotide
  Target: ATXN1; (-) strand; PAM type: NRG; PAM sequence: TAG
aactatgctggcttaactaa

SEQ ID NO: 87507 - DNA, 20 bp, Artificial Sequence
  Description of Artificial Sequence: Synthetic oligonucleotide
  Target: ATXN1; (-) strand; PAM type: NRG; PAM sequence: TGG
ttgcaactcaggaactatgc

SEQ ID NO: 87508 - DNA, 20 bp, Artificial Sequence
  Description of Artificial Sequence: Synthetic oligonucleotide
  Target: ATXN1; (-) strand; PAM type: NRG; PAM sequence: AGG
ctgtatatgctttgcaactc

SEQ ID NO: 87509 - DNA, 20 bp, Artificial Sequence
  Description of Artificial Sequence: Synthetic oligonucleotide
  Target: ATXN1; (-) strand; PAM type: NRG; PAM sequence: CAG
cctgtatatgctttgcaact

SEQ ID NO: 87510 - DNA, 20 bp, Artificial Sequence
  Description of Artificial Sequence: Synthetic oligonucleotide
  Target: ATXN1; (-) strand; PAM type: NRG; PAM sequence: CAG
gttttcttgacattgtactt

SEQ ID NO: 87511 - DNA, 20 bp, Artificial Sequence
  Description of Artificial Sequence: Synthetic oligonucleotide
  Target: ATXN1; (-) strand; PAM type: NRG; PAM sequence: TGG
tgttcagagtatcttctcag

SEQ ID NO: 87512 - DNA, 20 bp, Artificial Sequence
  Description of Artificial Sequence: Synthetic oligonucleotide
  Target: ATXN1; (-) strand; PAM type: NRG; PAM sequence: CAG
atctgttcagagtatcttct

SEQ ID NO: 87513 - DNA, 20 bp, Artificial Sequence
  Description of Artificial Sequence: Synthetic oligonucleotide
  Target: ATXN1; (-) strand; PAM type: NRG; PAM sequence: GAG
ttttcttatttatctgttca

SEQ ID NO: 87514 - DNA, 20 bp, Artificial Sequence
  Description of Artificial Sequence: Synthetic oligonucleotide
  Target: ATXN1; (-) strand; PAM type: NRG; PAM sequence: CAG
ttttttcttatttatctgtt

SEQ ID NO: 87515 - DNA, 20 bp, Artificial Sequence
  Description of Artificial Sequence: Synthetic oligonucleotide
  Target: ATXN1; (-) strand; PAM type: NRG; PAM sequence: GAG
gtctgtccacacactgccta

SEQ ID NO: 87516 - DNA, 20 bp, Artificial Sequence
  Description of Artificial Sequence: Synthetic oligonucleotide
  Target: ATXN1; (-) strand; PAM type: NRG; PAM sequence: TAG
ctgtctgtccacacactgcc

SEQ ID NO: 87517 - DNA, 20 bp, Artificial Sequence
  Description of Artificial Sequence: Synthetic oligonucleotide
  Target: ATXN1; (-) strand; PAM type: NRG; PAM sequence: CAG
cattcaggccaaggcataaa

SEQ ID NO: 87518 - DNA, 20 bp, Artificial Sequence
  Description of Artificial Sequence: Synthetic oligonucleotide
  Target: ATXN1; (-) strand; PAM type: NRG; PAM sequence: AGG
gcacacagacattcaggcca

SEQ ID NO: 87519 - DNA, 20 bp, Artificial Sequence
  Description of Artificial Sequence: Synthetic oligonucleotide
  Target: ATXN1; (-) strand; PAM type: NRG; PAM sequence: AAG
ggcacacagacattcaggcc

SEQ ID NO: 87520 - DNA, 20 bp, Artificial Sequence
  Description of Artificial Sequence: Synthetic oligonucleotide
  Target: ATXN1; (-) strand; PAM type: NRG; PAM sequence: AGG
ttggaggcacacagacattc

SEQ ID NO: 87521 - DNA, 20 bp, Artificial Sequence
  Description of Artificial Sequence: Synthetic oligonucleotide
  Target: ATXN1; (-) strand; PAM type: NRG; PAM sequence: CAG
tttggaggcacacagacatt

SEQ ID NO: 87522 - DNA, 20 bp, Artificial Sequence
  Description of Artificial Sequence: Synthetic oligonucleotide
  Target: ATXN1; (-) strand; PAM type: NRG; PAM sequence: CAG
atgtgaattttggaggcaca

SEQ ID NO: 87523 - DNA, 20 bp, Artificial Sequence
  Description of Artificial Sequence: Synthetic oligonucleotide
  Target: ATXN1; (-) strand; PAM type: NRG; PAM sequence: AGG
attcgacatgtgaattttgg

SEQ ID NO: 87524 - DNA, 20 bp, Artificial Sequence
  Description of Artificial Sequence: Synthetic oligonucleotide
  Target: ATXN1; (-) strand; PAM type: NRG; PAM sequence: GAG
gattcgacatgtgaattttg

SEQ ID NO: 87525 - DNA, 20 bp, Artificial Sequence
  Description of Artificial Sequence: Synthetic oligonucleotide
  Target: ATXN1; (-) strand; PAM type: NRG; PAM sequence: TGG
aggattcgacatgtgaattt

SEQ ID NO: 87526 - DNA, 20 bp, Artificial Sequence
  Description of Artificial Sequence: Synthetic oligonucleotide
  Target: ATXN1; (-) strand; PAM type: NRG; PAM sequence: AGG
atactatcacgtggggagtt

SEQ ID NO: 87527 - DNA, 20 bp, Artificial Sequence
  Description of Artificial Sequence: Synthetic oligonucleotide
  Target: ATXN1; (-) strand; PAM type: NRG; PAM sequence: TAG
aatactatcacgtggggagt

SEQ ID NO: 87528 - DNA, 20 bp, Artificial Sequence
  Description of Artificial Sequence: Synthetic oligonucleotide
  Target: ATXN1; (-) strand; PAM type: NRG; PAM sequence: GAG
ccctaatactatcacgtggg

SEQ ID NO: 87529 - DNA, 20 bp, Artificial Sequence
  Description of Artificial Sequence: Synthetic oligonucleotide
  Target: ATXN1; (-) strand; PAM type: NRG; PAM sequence: GGG
ctccctaatactatcacgtg

SEQ ID NO: 87530 - DNA, 20 bp, Artificial Sequence
  Description of Artificial Sequence: Synthetic oligonucleotide
  Target: ATXN1; (-) strand; PAM type: NRG; PAM sequence: GGG
actccctaatactatcacgt

SEQ ID NO: 87531 - DNA, 20 bp, Artificial Sequence
  Description of Artificial Sequence: Synthetic oligonucleotide
  Target: ATXN1; (-) strand; PAM type: NRG; PAM sequence: TGG
cactccctaatactatcacg

SEQ ID NO: 87532 - DNA, 20 bp, Artificial Sequence
  Description of Artificial Sequence: Synthetic oligonucleotide
  Target: ATXN1; (-) strand; PAM type: NRG; PAM sequence: GGG
ttcaagagggcacctcccaa

SEQ ID NO: 87533 - DNA, 20 bp, Artificial Sequence
  Description of Artificial Sequence: Synthetic oligonucleotide
  Target: ATXN1; (-) strand; PAM type: NRG; PAM sequence: AGG
attcaagagggcacctccca

SEQ ID NO: 87534 - DNA, 20 bp, Artificial Sequence
  Description of Artificial Sequence: Synthetic oligonucleotide
  Target: ATXN1; (-) strand; PAM type: NRG; PAM sequence: AAG
cattcaagagggcacctccc

SEQ ID NO: 87535 - DNA, 20 bp, Artificial Sequence
  Description of Artificial Sequence: Synthetic oligonucleotide
  Target: ATXN1; (-) strand; PAM type: NRG; PAM sequence: GGG
ggtgctaattccattcaaga

SEQ ID NO: 87536 - DNA, 20 bp, Artificial Sequence
  Description of Artificial Sequence: Synthetic oligonucleotide
  Target: ATXN1; (-) strand; PAM type: NRG; PAM sequence: AGG
aggtgctaattccattcaag

SEQ ID NO: 87537 - DNA, 20 bp, Artificial Sequence
  Description of Artificial Sequence: Synthetic oligonucleotide
  Target: ATXN1; (-) strand; PAM type: NRG; PAM sequence: GAG
aaggtgctaattccattcaa

SEQ ID NO: 87538 - DNA, 20 bp, Artificial Sequence
  Description of Artificial Sequence: Synthetic oligonucleotide
  Target: ATXN1; (-) strand; PAM type: NRG; PAM sequence: AAG
taaaggtgctaattccattc

SEQ ID NO: 87539 - DNA, 20 bp, Artificial Sequence
  Description of Artificial Sequence: Synthetic oligonucleotide
  Target: ATXN1; (-) strand; PAM type: NRG; PAM sequence: AGG
ctgggggagttctttgataa

SEQ ID NO: 87540 - DNA, 20 bp, Artificial Sequence
  Description of Artificial Sequence: Synthetic oligonucleotide
  Target: ATXN1; (-) strand; PAM type: NRG; PAM sequence: AAG
cctgggggagttctttgata

SEQ ID NO: 87541 - DNA, 20 bp, Artificial Sequence
  Description of Artificial Sequence: Synthetic oligonucleotide
  Target: ATXN1; (-) strand; PAM type: NRG; PAM sequence: GAG
aggcaaagcagttcctgggg

SEQ ID NO: 87542 - DNA, 20 bp, Artificial Sequence
  Description of Artificial Sequence: Synthetic oligonucleotide
  Target: ATXN1; (-) strand; PAM type: NRG; PAM sequence: GGG
agaggcaaagcagttcctgg

SEQ ID NO: 87543 - DNA, 20 bp, Artificial Sequence
  Description of Artificial Sequence: Synthetic oligonucleotide
  Target: ATXN1; (-) strand; PAM type: NRG; PAM sequence: GGG
aagaggcaaagcagttcctg

SEQ ID NO: 87544 - DNA, 20 bp, Artificial Sequence
  Description of Artificial Sequence: Synthetic oligonucleotide
  Target: ATXN1; (-) strand; PAM type: NRG; PAM sequence: GGG
gaagaggcaaagcagttcct

SEQ ID NO: 87545 - DNA, 20 bp, Artificial Sequence
  Description of Artificial Sequence: Synthetic oligonucleotide
  Target: ATXN1; (-) strand; PAM type: NRG; PAM sequence: TGG
ggaagaggcaaagcagttcc

SEQ ID NO: 87546 - DNA, 20 bp, Artificial Sequence
  Description of Artificial Sequence: Synthetic oligonucleotide
  Target: ATXN1; (-) strand; PAM type: NRG; PAM sequence: CAG
acatggtggaagaggcaaag

SEQ ID NO: 87547 - DNA, 20 bp, Artificial Sequence
  Description of Artificial Sequence: Synthetic oligonucleotide
  Target: ATXN1; (-) strand; PAM type: NRG; PAM sequence: AAG
ctcacatggtggaagaggca

SEQ ID NO: 87548 - DNA, 20 bp, Artificial Sequence
  Description of Artificial Sequence: Synthetic oligonucleotide
  Target: ATXN1; (-) strand; PAM type: NRG; PAM sequence: AGG
gtatcctcacatggtggaag

SEQ ID NO: 87549 - DNA, 20 bp, Artificial Sequence
  Description of Artificial Sequence: Synthetic oligonucleotide
  Target: ATXN1; (-) strand; PAM type: NRG; PAM sequence: GAG
tgtatcctcacatggtggaa

SEQ ID NO: 87550 - DNA, 20 bp, Artificial Sequence
  Description of Artificial Sequence: Synthetic oligonucleotide
  Target: ATXN1; (-) strand; PAM type: NRG; PAM sequence: AAG
tgtgtatcctcacatggtgg

SEQ ID NO: 87551 - DNA, 20 bp, Artificial Sequence
  Description of Artificial Sequence: Synthetic oligonucleotide
  Target: ATXN1; (-) strand; PAM type: NRG; PAM sequence: TGG
ctctgtgtatcctcacatgg

SEQ ID NO: 87552 - DNA, 20 bp, Artificial Sequence
  Description of Artificial Sequence: Synthetic oligonucleotide
  Target: ATXN1; (-) strand; PAM type: NRG; PAM sequence: TGG
cttctctgtgtatcctcaca

SEQ ID NO: 87553 - DNA, 20 bp, Artificial Sequence
  Description of Artificial Sequence: Synthetic oligonucleotide
  Target: ATXN1; (-) strand; PAM type: NRG; PAM sequence: TGG
cttgttctaaggctcacaga

SEQ ID NO: 87554 - DNA, 20 bp, Artificial Sequence
  Description of Artificial Sequence: Synthetic oligonucleotide
  Target: ATXN1; (-) strand; PAM type: NRG; PAM sequence: CAG
aaggcttgttctaaggctca

SEQ ID NO: 87555 - DNA, 20 bp, Artificial Sequence
  Description of Artificial Sequence: Synthetic oligonucleotide
  Target: ATXN1; (-) strand; PAM type: NRG; PAM sequence: AGG
ctattctaaggcttgttcta

SEQ ID NO: 87556 - DNA, 20 bp, Artificial Sequence
  Description of Artificial Sequence: Synthetic oligonucleotide
  Target: ATXN1; (-) strand; PAM type: NRG; PAM sequence: AAG
cctattctaaggcttgttct

SEQ ID NO: 87557 - DNA, 20 bp, Artificial Sequence
  Description of Artificial Sequence: Synthetic oligonucleotide
  Target: ATXN1; (-) strand; PAM type: NRG; PAM sequence: AGG
accacacccggcctattcta

SEQ ID NO: 87558 - DNA, 20 bp, Artificial Sequence
  Description of Artificial Sequence: Synthetic oligonucleotide
  Target: ATXN1; (-) strand; PAM type: NRG; PAM sequence: AAG
caccacacccggcctattct

SEQ ID NO: 87559 - DNA, 20 bp, Artificial Sequence
  Description of Artificial Sequence: Synthetic oligonucleotide
  Target: ATXN1; (-) strand; PAM type: NRG; PAM sequence: CGG
caggcttgagccaccacacc

SEQ ID NO: 87560 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggctt

SEQ ID NO: 87561 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 87562 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 87563 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 87564 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 87565 - DNA, 20 bp, Artificial Sequence
  Description of Artificial Sequence: Synthetic oligonucleotide
  Target: ATXN1; (-) strand; PAM type: NRG; PAM sequence: AAG
ctgcccgcctcggcctccca

SEQ ID NO: 87566 - DNA, 20 bp, Artificial Sequence
  Description of Artificial Sequence: Synthetic oligonucleotide
  Target: ATXN1; (-) strand; PAM type: NRG; PAM sequence: CGG
gtcaggtgatctgcccgcct

SEQ ID NO: 87567 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgatgtc

SEQ ID NO: 87568 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgatgt

SEQ ID NO: 87569 - DNA, 20 bp, Artificial Sequence
  Description of Artificial Sequence: Synthetic oligonucleotide
  Target: ATXN1; (-) strand; PAM type: NRG; PAM sequence: TGG
tttcaccatattggccaggc

SEQ ID NO: 87570 - DNA, 20 bp, Artificial Sequence
  Description of Artificial Sequence: Synthetic oligonucleotide
  Target: ATXN1; (-) strand; PAM type: NRG; PAM sequence: AGG
gaggtttcaccatattggcc

SEQ ID NO: 87571 - DNA, 20 bp, Artificial Sequence
  Description of Artificial Sequence: Synthetic oligonucleotide
  Target: ATXN1; (-) strand; PAM type: NRG; PAM sequence: CAG
tgaggtttcaccatattggc

SEQ ID NO: 87572 - DNA, 20 bp, Artificial Sequence
  Description of Artificial Sequence: Synthetic oligonucleotide
  Target: ATXN1; (-) strand; PAM type: NRG; PAM sequence: TGG
gagatgaggtttcaccatat

SEQ ID NO: 87573 - DNA, 20 bp, Artificial Sequence
  Description of Artificial Sequence: Synthetic oligonucleotide
  Target: ATXN1; (-) strand; PAM type: NRG; PAM sequence: AGG
gtgtatttttagtagagatg

SEQ ID NO: 87574 - DNA, 20 bp, Artificial Sequence
  Description of Artificial Sequence: Synthetic oligonucleotide
  Target: ATXN1; (-) strand; PAM type: NRG; PAM sequence: GAG
ggtgtatttttagtagagat

SEQ ID NO: 87575 - DNA, 20 bp, Artificial Sequence
  Description of Artificial Sequence: Synthetic oligonucleotide
  Target: ATXN1; (-) strand; PAM type: NRG; PAM sequence: GAG
cgcccggtgtatttttagta

SEQ ID NO: 87576 - DNA, 20 bp, Artificial Sequence
  Description of Artificial Sequence: Synthetic oligonucleotide
  Target: ATXN1; (-) strand; PAM type: NRG; PAM sequence: TAG
cacgcccggtgtatttttag

SEQ ID NO: 87577 - DNA, 20 bp, Artificial Sequence
  Description of Artificial Sequence: Synthetic oligonucleotide
  Target: ATXN1; (-) strand; PAM type: NRG; PAM sequence: TAG
caccacgcccggtgtatttt

SEQ ID NO: 87578 - DNA, 20 bp, Artificial Sequence
  Description of Artificial Sequence: Synthetic oligonucleotide
  Target: ATXN1; (-) strand; PAM type: NRG; PAM sequence: CGG
caggtgcgtgccaccacgcc

SEQ ID NO: 87579 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggactac

SEQ ID NO: 87580 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggacta

SEQ ID NO: 87581 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcctgagtagct

SEQ ID NO: 87582 - DNA, 20 bp, Artificial Sequence
  Description of Artificial Sequence: Synthetic oligonucleotide
  Target: ATXN1; (-) strand; PAM type: NRG; PAM sequence: TGG
gtctcagcctcctgagtagc

SEQ ID NO: 87583 - DNA, 20 bp, Artificial Sequence
  Description of Artificial Sequence: Synthetic oligonucleotide
  Target: ATXN1; (-) strand; PAM type: NRG; PAM sequence: TAG
tactgtctcagcctcctgag

SEQ ID NO: 87584 - DNA, 20 bp, Artificial Sequence
  Description of Artificial Sequence: Synthetic oligonucleotide
  Target: ATXN1; (-) strand; PAM type: NRG; PAM sequence: GAG
ttctactgtctcagcctcct

SEQ ID NO: 87585 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctactgtct

SEQ ID NO: 87586 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccaggttc

SEQ ID NO: 87587 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccgcctccc

SEQ ID NO: 87588 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccgcctcc

SEQ ID NO: 87589 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggcatgatct

SEQ ID NO: 87590 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 87591 - DNA, 20 bp, Artificial Sequence
  Description of Artificial Sequence: Synthetic oligonucleotide
  Target: ATXN1; (-) strand; PAM type: NRG; PAM sequence: CAG
cagtcgcccaggctggagtg

SEQ ID NO: 87592 - DNA, 20 bp, Artificial Sequence
  Description of Artificial Sequence: Synthetic oligonucleotide
  Target: ATXN1; (-) strand; PAM type: NRG; PAM sequence: GAG
tcgctcagtcgcccaggctg

SEQ ID NO: 87593 - DNA, 20 bp, Artificial Sequence
  Description of Artificial Sequence: Synthetic oligonucleotide
  Target: ATXN1; (-) strand; PAM type: NRG; PAM sequence: TGG
tctcgctcagtcgcccaggc

SEQ ID NO: 87594 - DNA, 20 bp, Artificial Sequence
  Description of Artificial Sequence: Synthetic oligonucleotide
  Target: ATXN1; (-) strand; PAM type: NRG; PAM sequence: AGG
agagtctcgctcagtcgccc

SEQ ID NO: 87595 - DNA, 20 bp, Artificial Sequence
  Description of Artificial Sequence: Synthetic oligonucleotide
  Target: ATXN1; (-) strand; PAM type: NRG; PAM sequence: CAG
cagagtctcgctcagtcgcc

SEQ ID NO: 87596 - DNA, 20 bp, Artificial Sequence
  Description of Artificial Sequence: Synthetic oligonucleotide
  Target: ATXN1; (-) strand; PAM type: NRG; PAM sequence: CAG
catatttgcagagtctcgct

SEQ ID NO: 87597 - DNA, 20 bp, Artificial Sequence
  Description of Artificial Sequence: Synthetic oligonucleotide
  Target: ATXN1; (-) strand; PAM type: NRG; PAM sequence: GAG
atataaagtacatatttgca

SEQ ID NO: 87598 - DNA, 20 bp, Artificial Sequence
  Description of Artificial Sequence: Synthetic oligonucleotide
  Target: ATXN1; (-) strand; PAM type: NRG; PAM sequence: CAG
tcatataaagtacatatttg

SEQ ID NO: 87599 - DNA, 20 bp, Artificial Sequence
  Description of Artificial Sequence: Synthetic oligonucleotide
  Target: ATXN1; (-) strand; PAM type: NRG; PAM sequence: AAG
acaaatagattaatcatata

SEQ ID NO: 87600 - DNA, 20 bp, Artificial Sequence
  Description of Artificial Sequence: Synthetic oligonucleotide
  Target: ATXN1; (-) strand; PAM type: NRG; PAM sequence: TAG
tttacttcaatggttacaaa

SEQ ID NO: 87601 - DNA, 20 bp, Artificial Sequence
  Description of Artificial Sequence: Synthetic oligonucleotide
  Target: ATXN1; (-) strand; PAM type: NRG; PAM sequence: TGG
aagaaaaatgtttacttcaa

SEQ ID NO: 87602 - DNA, 20 bp, Artificial Sequence
  Description of Artificial Sequence: Synthetic oligonucleotide
  Target: ATXN1; (-) strand; PAM type: NRG; PAM sequence: AAG
ggtttgaatttaaaagcaca

SEQ ID NO: 87603 - DNA, 20 bp, Artificial Sequence
  Description of Artificial Sequence: Synthetic oligonucleotide
  Target: ATXN1; (-) strand; PAM type: NRG; PAM sequence: AAG
aggtagaggtttgaatttaa

SEQ ID NO: 87604 - DNA, 20 bp, Artificial Sequence
  Description of Artificial Sequence: Synthetic oligonucleotide
  Target: ATXN1; (-) strand; PAM type: NRG; PAM sequence: AGG
tgatatggctgctaaggtag

SEQ ID NO: 87605 - DNA, 20 bp, Artificial Sequence
  Description of Artificial Sequence: Synthetic oligonucleotide
  Target: ATXN1; (-) strand; PAM type: NRG; PAM sequence: GAG
gtgatatggctgctaaggta

SEQ ID NO: 87606 - DNA, 20 bp, Artificial Sequence
  Description of Artificial Sequence: Synthetic oligonucleotide
  Target: ATXN1; (-) strand; PAM type: NRG; PAM sequence: TAG
ctgtgatatggctgctaagg

SEQ ID NO: 87607 - DNA, 20 bp, Artificial Sequence
  Description of Artificial Sequence: Synthetic oligonucleotide
  Target: ATXN1; (-) strand; PAM type: NRG; PAM sequence: AGG
tgactgtgatatggctgcta

SEQ ID NO: 87608 - DNA, 20 bp, Artificial Sequence
  Description of Artificial Sequence: Synthetic oligonucleotide
  Target: ATXN1; (-) strand; PAM type: NRG; PAM sequence: AAG
gtgactgtgatatggctgct

SEQ ID NO: 87609 - DNA, 20 bp, Artificial Sequence
  Description of Artificial Sequence: Synthetic oligonucleotide
  Target: ATXN1; (-) strand; PAM type: NRG; PAM sequence: TGG
gttaatttgtgactgtgata

SEQ ID NO: 87610 - DNA, 20 bp, Artificial Sequence
  Description of Artificial Sequence: Synthetic oligonucleotide
  Target: ATXN1; (-) strand; PAM type: NRG; PAM sequence: TAG
catacagattacttgccata

SEQ ID NO: 87611 - DNA, 20 bp, Artificial Sequence
  Description of Artificial Sequence: Synthetic oligonucleotide
  Target: ATXN1; (-) strand; PAM type: NRG; PAM sequence: CAG
gagaacccaaagtaatcata

SEQ ID NO: 87612 - DNA, 20 bp, Artificial Sequence
  Description of Artificial Sequence: Synthetic oligonucleotide
  Target: ATXN1; (-) strand; PAM type: NRG; PAM sequence: AAG
gcaagtcatctgagaaccca

SEQ ID NO: 87613 - DNA, 20 bp, Artificial Sequence
  Description of Artificial Sequence: Synthetic oligonucleotide
  Target: ATXN1; (-) strand; PAM type: NRG; PAM sequence: GAG
aaatacatagcaagtcatct

SEQ ID NO: 87614 - DNA, 20 bp, Artificial Sequence
  Description of Artificial Sequence: Synthetic oligonucleotide
  Target: ATXN1; (-) strand; PAM type: NRG; PAM sequence: AAG
tacttcattaaatacatagc

SEQ ID NO: 87615 - DNA, 20 bp, Artificial Sequence
  Description of Artificial Sequence: Synthetic oligonucleotide
  Target: ATXN1; (-) strand; PAM type: NRG; PAM sequence: TAG
attttacttcattaaataca

SEQ ID NO: 87616 - DNA, 20 bp, Artificial Sequence
  Description of Artificial Sequence: Synthetic oligonucleotide
  Target: ATXN1; (-) strand; PAM type: NRG; PAM sequence: TAG
tctttcttgagtctttaaaa

SEQ ID NO: 87617 - DNA, 20 bp, Artificial Sequence
  Description of Artificial Sequence: Synthetic oligonucleotide
  Target: ATXN1; (-) strand; PAM type: NRG; PAM sequence: GAG
tgggtataattgtctttctt

SEQ ID NO: 87618 - DNA, 20 bp, Artificial Sequence
  Description of Artificial Sequence: Synthetic oligonucleotide
  Target: ATXN1; (-) strand; PAM type: NRG; PAM sequence: GGG
tatgaatgtgtgtgttaatt

SEQ ID NO: 87619 - DNA, 20 bp, Artificial Sequence
  Description of Artificial Sequence: Synthetic oligonucleotide
  Target: ATXN1; (-) strand; PAM type: NRG; PAM sequence: TGG
atatgaatgtgtgtgttaat

SEQ ID NO: 87620 - DNA, 20 bp, Artificial Sequence
  Description of Artificial Sequence: Synthetic oligonucleotide
  Target: ATXN1; (-) strand; PAM type: NRG; PAM sequence: AGG
tgaaatgttttccaaaaatt

SEQ ID NO: 87621 - DNA, 20 bp, Artificial Sequence
  Description of Artificial Sequence: Synthetic oligonucleotide
  Target: ATXN1; (-) strand; PAM type: NRG; PAM sequence: TAG
atgaaatgttttccaaaaat

SEQ ID NO: 87622 - DNA, 20 bp, Artificial Sequence
  Description of Artificial Sequence: Synthetic oligonucleotide
  Target: ATXN1; (-) strand; PAM type: NRG; PAM sequence: TGG
tattatttatatatttacaa

SEQ ID NO: 87623 - DNA, 20 bp, Artificial Sequence
  Description of Artificial Sequence: Synthetic oligonucleotide
  Target: ATXN1; (-) strand; PAM type: NRG; PAM sequence: TGG
gttgttggtggtggcggtag

SEQ ID NO: 87624 - DNA, 20 bp, Artificial Sequence
  Description of Artificial Sequence: Synthetic oligonucleotide
  Target: ATXN1; (-) strand; PAM type: NRG; PAM sequence: TAG
tttgttgttggtggtggcgg

SEQ ID NO: 87625 - DNA, 20 bp, Artificial Sequence
  Description of Artificial Sequence: Synthetic oligonucleotide
  Target: ATXN1; (-) strand; PAM type: NRG; PAM sequence: CGG
gtttttgttgttggtggtgg

SEQ ID NO: 87626 - DNA, 20 bp, Artificial Sequence
  Description of Artificial Sequence: Synthetic oligonucleotide
  Target: ATXN1; (-) strand; PAM type: NRG; PAM sequence: TGG
attgtttttgttgttggtgg

SEQ ID NO: 87627 - DNA, 20 bp, Artificial Sequence
  Description of Artificial Sequence: Synthetic oligonucleotide
  Target: ATXN1; (-) strand; PAM type: NRG; PAM sequence: TGG
gctattgtttttgttgttgg

SEQ ID NO: 87628 - DNA, 20 bp, Artificial Sequence
  Description of Artificial Sequence: Synthetic oligonucleotide
  Target: ATXN1; (-) strand; PAM type: NRG; PAM sequence: TGG
gttgctattgtttttgttgt

SEQ ID NO: 87629 - DNA, 20 bp, Artificial Sequence
  Description of Artificial Sequence: Synthetic oligonucleotide
  Target: ATXN1; (-) strand; PAM type: NRG; PAM sequence: TGG
agccttcatgttttagaaag

SEQ ID NO: 87630 - DNA, 20 bp, Artificial Sequence
  Description of Artificial Sequence: Synthetic oligonucleotide
  Target: ATXN1; (-) strand; PAM type: NRG; PAM sequence: AAG
cttagccttcatgttttaga

SEQ ID NO: 87631 - DNA, 20 bp, Artificial Sequence
  Description of Artificial Sequence: Synthetic oligonucleotide
  Target: ATXN1; (-) strand; PAM type: NRG; PAM sequence: TAG
attccttagccttcatgttt

SEQ ID NO: 87632 - DNA, 20 bp, Artificial Sequence
  Description of Artificial Sequence: Synthetic oligonucleotide
  Target: ATXN1; (-) strand; PAM type: NRG; PAM sequence: TAG
ccagcacactgcttattcct

SEQ ID NO: 87633 - DNA, 20 bp, Artificial Sequence
  Description of Artificial Sequence: Synthetic oligonucleotide
  Target: ATXN1; (-) strand; PAM type: NRG; PAM sequence: CAG
tggaatacaggtaaagtgcc

SEQ ID NO: 87634 - DNA, 20 bp, Artificial Sequence
  Description of Artificial Sequence: Synthetic oligonucleotide
  Target: ATXN1; (-) strand; PAM type: NRG; PAM sequence: AAG
aacacaatggaatacaggta

SEQ ID NO: 87635 - DNA, 20 bp, Artificial Sequence
  Description of Artificial Sequence: Synthetic oligonucleotide
  Target: ATXN1; (-) strand; PAM type: NRG; PAM sequence: AGG
gtaagaacacaatggaatac

SEQ ID NO: 87636 - DNA, 20 bp, Artificial Sequence
  Description of Artificial Sequence: Synthetic oligonucleotide
  Target: ATXN1; (-) strand; PAM type: NRG; PAM sequence: CAG
tgtaagaacacaatggaata

SEQ ID NO: 87637 - DNA, 20 bp, Artificial Sequence
  Description of Artificial Sequence: Synthetic oligonucleotide
  Target: ATXN1; (-) strand; PAM type: NRG; PAM sequence: TGG
atgtacctgtaagaacacaa

SEQ ID NO: 87638 - DNA, 20 bp, Artificial Sequence
  Description of Artificial Sequence: Synthetic oligonucleotide
  Target: ATXN1; (-) strand; PAM type: NRG; PAM sequence: AAG
agaacatggaatgtacctgt

SEQ ID NO: 87639 - DNA, 20 bp, Artificial Sequence
  Description of Artificial Sequence: Synthetic oligonucleotide
  Target: ATXN1; (-) strand; PAM type: NRG; PAM sequence: TGG
taaagtgaaaatatagaaca

SEQ ID NO: 87640 - DNA, 20 bp, Artificial Sequence
  Description of Artificial Sequence: Synthetic oligonucleotide
  Target: ATXN1; (-) strand; PAM type: NRG; PAM sequence: TAG
acatctctaaagtgaaaata

SEQ ID NO: 87641 - DNA, 20 bp, Artificial Sequence
  Description of Artificial Sequence: Synthetic oligonucleotide
  Target: ATXN1; (-) strand; PAM type: NRG; PAM sequence: AAG
cttcagtttccacatctcta

SEQ ID NO: 87642 - DNA, 20 bp, Artificial Sequence
  Description of Artificial Sequence: Synthetic oligonucleotide
  Target: ATXN1; (-) strand; PAM type: NRG; PAM sequence: CAG
ccattacttagcctgagctt

SEQ ID NO: 87643 - DNA, 20 bp, Artificial Sequence
  Description of Artificial Sequence: Synthetic oligonucleotide
  Target: ATXN1; (-) strand; PAM type: NRG; PAM sequence: GAG
ttgggcccattacttagcct

SEQ ID NO: 87644 - DNA, 20 bp, Artificial Sequence
  Description of Artificial Sequence: Synthetic oligonucleotide
  Target: ATXN1; (-) strand; PAM type: NRG; PAM sequence: TAG
gagatcttgggcccattact

SEQ ID NO: 87645 - DNA, 20 bp, Artificial Sequence
  Description of Artificial Sequence: Synthetic oligonucleotide
  Target: ATXN1; (-) strand; PAM type: NRG; PAM sequence: GGG
atctgccaatttgagatctt

SEQ ID NO: 87646 - DNA, 20 bp, Artificial Sequence
  Description of Artificial Sequence: Synthetic oligonucleotide
  Target: ATXN1; (-) strand; PAM type: NRG; PAM sequence: TGG
gatctgccaatttgagatct

SEQ ID NO: 87647 - DNA, 20 bp, Artificial Sequence
  Description of Artificial Sequence: Synthetic oligonucleotide
  Target: ATXN1; (-) strand; PAM type: NRG; PAM sequence: GAG
gaacccagatctgccaattt

SEQ ID NO: 87648 - DNA, 20 bp, Artificial Sequence
  Description of Artificial Sequence: Synthetic oligonucleotide
  Target: ATXN1; (-) strand; PAM type: NRG; PAM sequence: CAG
tctgactaaggttttgaacc

SEQ ID NO: 87649 - DNA, 20 bp, Artificial Sequence
  Description of Artificial Sequence: Synthetic oligonucleotide
  Target: ATXN1; (-) strand; PAM type: NRG; PAM sequence: AGG
gtctgggctcgttctgacta

SEQ ID NO: 87650 - DNA, 20 bp, Artificial Sequence
  Description of Artificial Sequence: Synthetic oligonucleotide
  Target: ATXN1; (-) strand; PAM type: NRG; PAM sequence: AAG
ggtctgggctcgttctgact

SEQ ID NO: 87651 - DNA, 20 bp, Artificial Sequence
  Description of Artificial Sequence: Synthetic oligonucleotide
  Target: ATXN1; (-) strand; PAM type: NRG; PAM sequence: GGG
tctgcctgtatgggaggtct

SEQ ID NO: 87652 - DNA, 20 bp, Artificial Sequence
  Description of Artificial Sequence: Synthetic oligonucleotide
  Target: ATXN1; (-) strand; PAM type: NRG; PAM sequence: TGG
ctctgcctgtatgggaggtc

SEQ ID NO: 87653 - DNA, 20 bp, Artificial Sequence
  Description of Artificial Sequence: Synthetic oligonucleotide
  Target: ATXN1; (-) strand; PAM type: NRG; PAM sequence: AGG
aagacctctgcctgtatggg

SEQ ID NO: 87654 - DNA, 20 bp, Artificial Sequence
  Description of Artificial Sequence: Synthetic oligonucleotide
  Target: ATXN1; (-) strand; PAM type: NRG; PAM sequence: GAG
aaagacctctgcctgtatgg

SEQ ID NO: 87655 - DNA, 20 bp, Artificial Sequence
  Description of Artificial Sequence: Synthetic oligonucleotide
  Target: ATXN1; (-) strand; PAM type: NRG; PAM sequence: GGG
gcaaagacctctgcctgtat

SEQ ID NO: 87656 - DNA, 20 bp, Artificial Sequence
  Description of Artificial Sequence: Synthetic oligonucleotide
  Target: ATXN1; (-) strand; PAM type: NRG; PAM sequence: TGG
tgcaaagacctctgcctgta

SEQ ID NO: 87657 - DNA, 20 bp, Artificial Sequence
  Description of Artificial Sequence: Synthetic oligonucleotide
  Target: ATXN1; (-) strand; PAM type: NRG; PAM sequence: AAG
tccatatcttcccatctgca

SEQ ID NO: 87658 - DNA, 20 bp, Artificial Sequence
  Description of Artificial Sequence: Synthetic oligonucleotide
  Target: ATXN1; (-) strand; PAM type: NRG; PAM sequence: AAG
ctgagcttaagtagaggaga

SEQ ID NO: 87659 - DNA, 20 bp, Artificial Sequence
  Description of Artificial Sequence: Synthetic oligonucleotide
  Target: ATXN1; (-) strand; PAM type: NRG; PAM sequence: GAG
tacactgagcttaagtagag

SEQ ID NO: 87660 - DNA, 20 bp, Artificial Sequence
  Description of Artificial Sequence: Synthetic oligonucleotide
  Target: ATXN1; (-) strand; PAM type: NRG; PAM sequence: AGG
gatacactgagcttaagtag

SEQ ID NO: 87661 - DNA, 20 bp, Artificial Sequence
  Description of Artificial Sequence: Synthetic oligonucleotide
  Target: ATXN1; (-) strand; PAM type: NRG; PAM sequence: GAG
agatacactgagcttaagta

SEQ ID NO: 87662 - DNA, 20 bp, Artificial Sequence
  Description of Artificial Sequence: Synthetic oligonucleotide
  Target: ATXN1; (-) strand; PAM type: NRG; PAM sequence: TAG
acagatacactgagcttaag

SEQ ID NO: 87663 - DNA, 20 bp, Artificial Sequence
  Description of Artificial Sequence: Synthetic oligonucleotide
  Target: ATXN1; (-) strand; PAM type: NRG; PAM sequence: AAG
tgtacagatacactgagctt

SEQ ID NO: 87664 - DNA, 20 bp, Artificial Sequence
  Description of Artificial Sequence: Synthetic oligonucleotide
  Target: ATXN1; (-) strand; PAM type: NRG; PAM sequence: GAG
actcagtgtacagatacact

SEQ ID NO: 87665 - DNA, 20 bp, Artificial Sequence
  Description of Artificial Sequence: Synthetic oligonucleotide
  Target: ATXN1; (-) strand; PAM type: NRG; PAM sequence: CAG
ctacatggctactcagtgta

SEQ ID NO: 87666 - DNA, 20 bp, Artificial Sequence
  Description of Artificial Sequence: Synthetic oligonucleotide
  Target: ATXN1; (-) strand; PAM type: NRG; PAM sequence: CAG
cattatgctacatggctact

SEQ ID NO: 87667 - DNA, 20 bp, Artificial Sequence
  Description of Artificial Sequence: Synthetic oligonucleotide
  Target: ATXN1; (-) strand; PAM type: NRG; PAM sequence: TGG
cactccaccattatgctaca

SEQ ID NO: 87668 - DNA, 20 bp, Artificial Sequence
  Description of Artificial Sequence: Synthetic oligonucleotide
  Target: ATXN1; (-) strand; PAM type: NRG; PAM sequence: GAG
aacttagagctttggctcca

SEQ ID NO: 87669 - DNA, 20 bp, Artificial Sequence
  Description of Artificial Sequence: Synthetic oligonucleotide
  Target: ATXN1; (-) strand; PAM type: NRG; PAM sequence: CAG
tgaacttagagctttggctc

SEQ ID NO: 87670 - DNA, 20 bp, Artificial Sequence
  Description of Artificial Sequence: Synthetic oligonucleotide
  Target: ATXN1; (-) strand; PAM type: NRG; PAM sequence: TGG
gaaatctgaacttagagctt

SEQ ID NO: 87671 - DNA, 20 bp, Artificial Sequence
  Description of Artificial Sequence: Synthetic oligonucleotide
  Target: ATXN1; (-) strand; PAM type: NRG; PAM sequence: GAG
ggagctgaaatctgaactta

SEQ ID NO: 87672 - DNA, 20 bp, Artificial Sequence
  Description of Artificial Sequence: Synthetic oligonucleotide
  Target: ATXN1; (-) strand; PAM type: NRG; PAM sequence: TAG
gcggagctgaaatctgaact

SEQ ID NO: 87673 - DNA, 20 bp, Artificial Sequence
  Description of Artificial Sequence: Synthetic oligonucleotide
  Target: ATXN1; (-) strand; PAM type: NRG; PAM sequence: GAG
gcatgcactagtgagtggcg

SEQ ID NO: 87674 - DNA, 20 bp, Artificial Sequence
  Description of Artificial Sequence: Synthetic oligonucleotide
  Target: ATXN1; (-) strand; PAM type: NRG; PAM sequence: CGG
gggcatgcactagtgagtgg

SEQ ID NO: 87675 - DNA, 20 bp, Artificial Sequence
  Description of Artificial Sequence: Synthetic oligonucleotide
  Target: ATXN1; (-) strand; PAM type: NRG; PAM sequence: TGG
ttagggcatgcactagtgag

SEQ ID NO: 87676 - DNA, 20 bp, Artificial Sequence
  Description of Artificial Sequence: Synthetic oligonucleotide
  Target: ATXN1; (-) strand; PAM type: NRG; PAM sequence: GAG
aagttagggcatgcactagt

SEQ ID NO: 87677 - DNA, 20 bp, Artificial Sequence
  Description of Artificial Sequence: Synthetic oligonucleotide
  Target: ATXN1; (-) strand; PAM type: NRG; PAM sequence: TAG
agagaagttagggcatgcac

SEQ ID NO: 87678 - DNA, 20 bp, Artificial Sequence
  Description of Artificial Sequence: Synthetic oligonucleotide
  Target: ATXN1; (-) strand; PAM type: NRG; PAM sequence: GGG
tgagaggcacagagaagtta

SEQ ID NO: 87679 - DNA, 20 bp, Artificial Sequence
  Description of Artificial Sequence: Synthetic oligonucleotide
  Target: ATXN1; (-) strand; PAM type: NRG; PAM sequence: AGG
ctgagaggcacagagaagtt

SEQ ID NO: 87680 - DNA, 20 bp, Artificial Sequence
  Description of Artificial Sequence: Synthetic oligonucleotide
  Target: ATXN1; (-) strand; PAM type: NRG; PAM sequence: TAG
actgagaggcacagagaagt

SEQ ID NO: 87681 - DNA, 20 bp, Artificial Sequence
  Description of Artificial Sequence: Synthetic oligonucleotide
  Target: ATXN1; (-) strand; PAM type: NRG; PAM sequence: AAG
ggccactgagaggcacagag

SEQ ID NO: 87682 - DNA, 20 bp, Artificial Sequence
  Description of Artificial Sequence: Synthetic oligonucleotide
  Target: ATXN1; (-) strand; PAM type: NRG; PAM sequence: GAG
tgaggccactgagaggcaca

SEQ ID NO: 87683 - DNA, 20 bp, Artificial Sequence
  Description of Artificial Sequence: Synthetic oligonucleotide
  Target: ATXN1; (-) strand; PAM type: NRG; PAM sequence: CAG
gctgaggccactgagaggca

SEQ ID NO: 87684 - DNA, 20 bp, Artificial Sequence
  Description of Artificial Sequence: Synthetic oligonucleotide
  Target: ATXN1; (-) strand; PAM type: NRG; PAM sequence: AGG
tcagagctgaggccactgag

SEQ ID NO: 87685 - DNA, 20 bp, Artificial Sequence
  Description of Artificial Sequence: Synthetic oligonucleotide
  Target: ATXN1; (-) strand; PAM type: NRG; PAM sequence: GAG
ttcagagctgaggccactga

SEQ ID NO: 87686 - DNA, 20 bp, Artificial Sequence
  Description of Artificial Sequence: Synthetic oligonucleotide
  Target: ATXN1; (-) strand; PAM type: NRG; PAM sequence: GAG
tcttcagagctgaggccact

SEQ ID NO: 87687 - DNA, 20 bp, Artificial Sequence
  Description of Artificial Sequence: Synthetic oligonucleotide
  Target: ATXN1; (-) strand; PAM type: NRG; PAM sequence: AGG
gattctcatcttcagagctg

SEQ ID NO: 87688 - DNA, 20 bp, Artificial Sequence
  Description of Artificial Sequence: Synthetic oligonucleotide
  Target: ATXN1; (-) strand; PAM type: NRG; PAM sequence: GAG
cgattctcatcttcagagct

SEQ ID NO: 87689 - DNA, 20 bp, Artificial Sequence
  Description of Artificial Sequence: Synthetic oligonucleotide
  Target: ATXN1; (-) strand; PAM type: NRG; PAM sequence: GAG
tattacgattctcatcttca

SEQ ID NO: 87690 - DNA, 20 bp, Artificial Sequence
  Description of Artificial Sequence: Synthetic oligonucleotide
  Target: ATXN1; (-) strand; PAM type: NRG; PAM sequence: CAG
actattacgattctcatctt

SEQ ID NO: 87691 - DNA, 20 bp, Artificial Sequence
  Description of Artificial Sequence: Synthetic oligonucleotide
  Target: ATXN1; (-) strand; PAM type: NRG; PAM sequence: TGG
taggtagatatcagttcttc

SEQ ID NO: 87692 - DNA, 20 bp, Artificial Sequence
  Description of Artificial Sequence: Synthetic oligonucleotide
  Target: ATXN1; (-) strand; PAM type: NRG; PAM sequence: CAG
ccctgttagtaggtagatat

SEQ ID NO: 87693 - DNA, 20 bp, Artificial Sequence
  Description of Artificial Sequence: Synthetic oligonucleotide
  Target: ATXN1; (-) strand; PAM type: NRG; PAM sequence: TAG
acagtggccctgttagtagg

SEQ ID NO: 87694 - DNA, 20 bp, Artificial Sequence
  Description of Artificial Sequence: Synthetic oligonucleotide
  Target: ATXN1; (-) strand; PAM type: NRG; PAM sequence: AGG
ctcacagtggccctgttagt

SEQ ID NO: 87695 - DNA, 20 bp, Artificial Sequence
  Description of Artificial Sequence: Synthetic oligonucleotide
  Target: ATXN1; (-) strand; PAM type: NRG; PAM sequence: TAG
cctcacagtggccctgttag

SEQ ID NO: 87696 - DNA, 20 bp, Artificial Sequence
  Description of Artificial Sequence: Synthetic oligonucleotide
  Target: ATXN1; (-) strand; PAM type: NRG; PAM sequence: TAG
aatcctcacagtggccctgt

SEQ ID NO: 87697 - DNA, 20 bp, Artificial Sequence
  Description of Artificial Sequence: Synthetic oligonucleotide
  Target: ATXN1; (-) strand; PAM type: NRG; PAM sequence: TGG
aactcatttaatcctcacag

SEQ ID NO: 87698 - DNA, 20 bp, Artificial Sequence
  Description of Artificial Sequence: Synthetic oligonucleotide
  Target: ATXN1; (-) strand; PAM type: NRG; PAM sequence: CAG
agtaactcatttaatcctca

SEQ ID NO: 87699 - DNA, 20 bp, Artificial Sequence
  Description of Artificial Sequence: Synthetic oligonucleotide
  Target: ATXN1; (-) strand; PAM type: NRG; PAM sequence: TAG
tgttctttgtgctgtatgtg

SEQ ID NO: 87700 - DNA, 20 bp, Artificial Sequence
  Description of Artificial Sequence: Synthetic oligonucleotide
  Target: ATXN1; (-) strand; PAM type: NRG; PAM sequence: AGG
tgctctttttagtatttcaa

SEQ ID NO: 87701 - DNA, 20 bp, Artificial Sequence
  Description of Artificial Sequence: Synthetic oligonucleotide
  Target: ATXN1; (-) strand; PAM type: NRG; PAM sequence: AAG
gtgctctttttagtatttca

SEQ ID NO: 87702 - DNA, 20 bp, Artificial Sequence
  Description of Artificial Sequence: Synthetic oligonucleotide
  Target: ATXN1; (-) strand; PAM type: NRG; PAM sequence: TAG
ttcaaattcagtgctctttt

SEQ ID NO: 87703 - DNA, 20 bp, Artificial Sequence
  Description of Artificial Sequence: Synthetic oligonucleotide
  Target: ATXN1; (-) strand; PAM type: NRG; PAM sequence: CAG
agaccactggacttcaaatt

SEQ ID NO: 87704 - DNA, 20 bp, Artificial Sequence
  Description of Artificial Sequence: Synthetic oligonucleotide
  Target: ATXN1; (-) strand; PAM type: NRG; PAM sequence: TGG
agatcaatggcggagaccac

SEQ ID NO: 87705 - DNA, 20 bp, Artificial Sequence
  Description of Artificial Sequence: Synthetic oligonucleotide
  Target: ATXN1; (-) strand; PAM type: NRG; PAM sequence: GAG
catacagtagatcaatggcg

SEQ ID NO: 87706 - DNA, 20 bp, Artificial Sequence
  Description of Artificial Sequence: Synthetic oligonucleotide
  Target: ATXN1; (-) strand; PAM type: NRG; PAM sequence: CGG
ctcatacagtagatcaatgg

SEQ ID NO: 87707 - DNA, 20 bp, Artificial Sequence
  Description of Artificial Sequence: Synthetic oligonucleotide
  Target: ATXN1; (-) strand; PAM type: NRG; PAM sequence: TGG
aagctcatacagtagatcaa

SEQ ID NO: 87708 - DNA, 20 bp, Artificial Sequence
  Description of Artificial Sequence: Synthetic oligonucleotide
  Target: ATXN1; (-) strand; PAM type: NRG; PAM sequence: TAG
acttgcctaagctcatacag

SEQ ID NO: 87709 - DNA, 20 bp, Artificial Sequence
  Description of Artificial Sequence: Synthetic oligonucleotide
  Target: ATXN1; (-) strand; PAM type: NRG; PAM sequence: CAG
gggacttgcctaagctcata

SEQ ID NO: 87710 - DNA, 20 bp, Artificial Sequence
  Description of Artificial Sequence: Synthetic oligonucleotide
  Target: ATXN1; (-) strand; PAM type: NRG; PAM sequence: AAG
gaagcttgagggacttgcct

SEQ ID NO: 87711 - DNA, 20 bp, Artificial Sequence
  Description of Artificial Sequence: Synthetic oligonucleotide
  Target: ATXN1; (-) strand; PAM type: NRG; PAM sequence: GGG
gtggagctcaggaagcttga

SEQ ID NO: 87712 - DNA, 20 bp, Artificial Sequence
  Description of Artificial Sequence: Synthetic oligonucleotide
  Target: ATXN1; (-) strand; PAM type: NRG; PAM sequence: AGG
agtggagctcaggaagcttg

SEQ ID NO: 87713 - DNA, 20 bp, Artificial Sequence
  Description of Artificial Sequence: Synthetic oligonucleotide
  Target: ATXN1; (-) strand; PAM type: NRG; PAM sequence: GAG
cagtggagctcaggaagctt

SEQ ID NO: 87714 - DNA, 20 bp, Artificial Sequence
  Description of Artificial Sequence: Synthetic oligonucleotide
  Target: ATXN1; (-) strand; PAM type: NRG; PAM sequence: AAG
tgaggacagtggagctcagg

SEQ ID NO: 87715 - DNA, 20 bp, Artificial Sequence
  Description of Artificial Sequence: Synthetic oligonucleotide
  Target: ATXN1; (-) strand; PAM type: NRG; PAM sequence: AGG
agatgaggacagtggagctc

SEQ ID NO: 87716 - DNA, 20 bp, Artificial Sequence
  Description of Artificial Sequence: Synthetic oligonucleotide
  Target: ATXN1; (-) strand; PAM type: NRG; PAM sequence: CAG
cagatgaggacagtggagct

SEQ ID NO: 87717 - DNA, 20 bp, Artificial Sequence
  Description of Artificial Sequence: Synthetic oligonucleotide
  Target: ATXN1; (-) strand; PAM type: NRG; PAM sequence: GAG
ttttacagatgaggacagtg

SEQ ID NO: 87718 - DNA, 20 bp, Artificial Sequence
  Description of Artificial Sequence: Synthetic oligonucleotide
  Target: ATXN1; (-) strand; PAM type: NRG; PAM sequence: TGG
atttttacagatgaggacag

SEQ ID NO: 87719 - DNA, 20 bp, Artificial Sequence
  Description of Artificial Sequence: Synthetic oligonucleotide
  Target: ATXN1; (-) strand; PAM type: NRG; PAM sequence: CAG
cccatttttacagatgagga

SEQ ID NO: 87720 - DNA, 20 bp, Artificial Sequence
  Description of Artificial Sequence: Synthetic oligonucleotide
  Target: ATXN1; (-) strand; PAM type: NRG; PAM sequence: AGG
gtatcccatttttacagatg

SEQ ID NO: 87721 - DNA, 20 bp, Artificial Sequence
  Description of Artificial Sequence: Synthetic oligonucleotide
  Target: ATXN1; (-) strand; PAM type: NRG; PAM sequence: GAG
ggtatcccatttttacagat

SEQ ID NO: 87722 - DNA, 20 bp, Artificial Sequence
  Description of Artificial Sequence: Synthetic oligonucleotide
  Target: ATXN1; (-) strand; PAM type: NRG; PAM sequence: CAG
ccgctggtatcccattttta

SEQ ID NO: 87723 - DNA, 20 bp, Artificial Sequence
  Description of Artificial Sequence: Synthetic oligonucleotide
  Target: ATXN1; (-) strand; PAM type: NRG; PAM sequence: TGG
tggaaaggaagcaaggccgc

SEQ ID NO: 87724 - DNA, 20 bp, Artificial Sequence
  Description of Artificial Sequence: Synthetic oligonucleotide
  Target: ATXN1; (-) strand; PAM type: NRG; PAM sequence: AGG
gatgttctggaaaggaagca

SEQ ID NO: 87725 - DNA, 20 bp, Artificial Sequence
  Description of Artificial Sequence: Synthetic oligonucleotide
  Target: ATXN1; (-) strand; PAM type: NRG; PAM sequence: AAG
tgatgttctggaaaggaagc

SEQ ID NO: 87726 - DNA, 20 bp, Artificial Sequence
  Description of Artificial Sequence: Synthetic oligonucleotide
  Target: ATXN1; (-) strand; PAM type: NRG; PAM sequence: AAG
cttgtgatgttctggaaagg

SEQ ID NO: 87727 - DNA, 20 bp, Artificial Sequence
  Description of Artificial Sequence: Synthetic oligonucleotide
  Target: ATXN1; (-) strand; PAM type: NRG; PAM sequence: AGG
tttcttgtgatgttctggaa

SEQ ID NO: 87728 - DNA, 20 bp, Artificial Sequence
  Description of Artificial Sequence: Synthetic oligonucleotide
  Target: ATXN1; (-) strand; PAM type: NRG; PAM sequence: AAG
gtttcttgtgatgttctgga

SEQ ID NO: 87729 - DNA, 20 bp, Artificial Sequence
  Description of Artificial Sequence: Synthetic oligonucleotide
  Target: ATXN1; (-) strand; PAM type: NRG; PAM sequence: TGG
gcttgtttcttgtgatgttc

SEQ ID NO: 87730 - DNA, 20 bp, Artificial Sequence
  Description of Artificial Sequence: Synthetic oligonucleotide
  Target: ATXN1; (-) strand; PAM type: NRG; PAM sequence: AAG
atagcactttttagcttcca

SEQ ID NO: 87731 - DNA, 20 bp, Artificial Sequence
  Description of Artificial Sequence: Synthetic oligonucleotide
  Target: ATXN1; (-) strand; PAM type: NRG; PAM sequence: TAG
atggtatatatagcactttt

SEQ ID NO: 87732 - DNA, 20 bp, Artificial Sequence
  Description of Artificial Sequence: Synthetic oligonucleotide
  Target: ATXN1; (-) strand; PAM type: NRG; PAM sequence: TAG
tcacatgtacatggtatata

SEQ ID NO: 87733 - DNA, 20 bp, Artificial Sequence
  Description of Artificial Sequence: Synthetic oligonucleotide
  Target: ATXN1; (-) strand; PAM type: NRG; PAM sequence: TGG
gacgataattcacatgtaca

SEQ ID NO: 87734 - DNA, 20 bp, Artificial Sequence
  Description of Artificial Sequence: Synthetic oligonucleotide
  Target: ATXN1; (-) strand; PAM type: NRG; PAM sequence: AAG
ctttggctttgagaggctga

SEQ ID NO: 87735 - DNA, 20 bp, Artificial Sequence
  Description of Artificial Sequence: Synthetic oligonucleotide
  Target: ATXN1; (-) strand; PAM type: NRG; PAM sequence: AGG
ttgacctctttggctttgag

SEQ ID NO: 87736 - DNA, 20 bp, Artificial Sequence
  Description of Artificial Sequence: Synthetic oligonucleotide
  Target: ATXN1; (-) strand; PAM type: NRG; PAM sequence: GAG
attgacctctttggctttga

SEQ ID NO: 87737 - DNA, 20 bp, Artificial Sequence
  Description of Artificial Sequence: Synthetic oligonucleotide
  Target: ATXN1; (-) strand; PAM type: NRG; PAM sequence: GAG
agattgacctctttggcttt

SEQ ID NO: 87738 - DNA, 20 bp, Artificial Sequence
  Description of Artificial Sequence: Synthetic oligonucleotide
  Target: ATXN1; (-) strand; PAM type: NRG; PAM sequence: TGG
ggaatagagattgacctctt

SEQ ID NO: 87739 - DNA, 20 bp, Artificial Sequence
  Description of Artificial Sequence: Synthetic oligonucleotide
  Target: ATXN1; (-) strand; PAM type: NRG; PAM sequence: GAG
aggcaggagagaatggaata

SEQ ID NO: 87740 - DNA, 20 bp, Artificial Sequence
  Description of Artificial Sequence: Synthetic oligonucleotide
  Target: ATXN1; (-) strand; PAM type: NRG; PAM sequence: TAG
tcaggcaggagagaatggaa

SEQ ID NO: 87741 - DNA, 20 bp, Artificial Sequence
  Description of Artificial Sequence: Synthetic oligonucleotide
  Target: ATXN1; (-) strand; PAM type: NRG; PAM sequence: TGG
aattctcaggcaggagagaa

SEQ ID NO: 87742 - DNA, 20 bp, Artificial Sequence
  Description of Artificial Sequence: Synthetic oligonucleotide
  Target: ATXN1; (-) strand; PAM type: NRG; PAM sequence: GAG
tattaaattctcaggcagga

SEQ ID NO: 87743 - DNA, 20 bp, Artificial Sequence
  Description of Artificial Sequence: Synthetic oligonucleotide
  Target: ATXN1; (-) strand; PAM type: NRG; PAM sequence: GAG
agtattaaattctcaggcag

SEQ ID NO: 87744 - DNA, 20 bp, Artificial Sequence
  Description of Artificial Sequence: Synthetic oligonucleotide
  Target: ATXN1; (-) strand; PAM type: NRG; PAM sequence: AGG
ttagtattaaattctcaggc

SEQ ID NO: 87745 - DNA, 20 bp, Artificial Sequence
  Description of Artificial Sequence: Synthetic oligonucleotide
  Target: ATXN1; (-) strand; PAM type: NRG; PAM sequence: CAG
cttagtattaaattctcagg

SEQ ID NO: 87746 - DNA, 20 bp, Artificial Sequence
  Description of Artificial Sequence: Synthetic oligonucleotide
  Target: ATXN1; (-) strand; PAM type: NRG; PAM sequence: AGG
atgcttagtattaaattctc

SEQ ID NO: 87747 - DNA, 20 bp, Artificial Sequence
  Description of Artificial Sequence: Synthetic oligonucleotide
  Target: ATXN1; (-) strand; PAM type: NRG; PAM sequence: CAG
gatgcttagtattaaattct

SEQ ID NO: 87748 - DNA, 20 bp, Artificial Sequence
  Description of Artificial Sequence: Synthetic oligonucleotide
  Target: ATXN1; (-) strand; PAM type: NRG; PAM sequence: TAG
caggttttggaactgatgct

SEQ ID NO: 87749 - DNA, 20 bp, Artificial Sequence
  Description of Artificial Sequence: Synthetic oligonucleotide
  Target: ATXN1; (-) strand; PAM type: NRG; PAM sequence: TGG
gcagttcagtgtccaggttt

SEQ ID NO: 87750 - DNA, 20 bp, Artificial Sequence
  Description of Artificial Sequence: Synthetic oligonucleotide
  Target: ATXN1; (-) strand; PAM type: NRG; PAM sequence: AGG
tgattagcagttcagtgtcc

SEQ ID NO: 87751 - DNA, 20 bp, Artificial Sequence
  Description of Artificial Sequence: Synthetic oligonucleotide
  Target: ATXN1; (-) strand; PAM type: NRG; PAM sequence: CAG
atgattagcagttcagtgtc

SEQ ID NO: 87752 - DNA, 20 bp, Artificial Sequence
  Description of Artificial Sequence: Synthetic oligonucleotide
  Target: ATXN1; (-) strand; PAM type: NRG; PAM sequence: CAG
ttctgttatgattagcagtt

SEQ ID NO: 87753 - DNA, 20 bp, Artificial Sequence
  Description of Artificial Sequence: Synthetic oligonucleotide
  Target: ATXN1; (-) strand; PAM type: NRG; PAM sequence: CAG
atgtgttctgttatgattag

SEQ ID NO: 87754 - DNA, 20 bp, Artificial Sequence
  Description of Artificial Sequence: Synthetic oligonucleotide
  Target: ATXN1; (-) strand; PAM type: NRG; PAM sequence: TAG
gacatgtgttctgttatgat

SEQ ID NO: 87755 - DNA, 20 bp, Artificial Sequence
  Description of Artificial Sequence: Synthetic oligonucleotide
  Target: ATXN1; (-) strand; PAM type: NRG; PAM sequence: TGG
ttgatcaagtcctgggtgac

SEQ ID NO: 87756 - DNA, 20 bp, Artificial Sequence
  Description of Artificial Sequence: Synthetic oligonucleotide
  Target: ATXN1; (-) strand; PAM type: NRG; PAM sequence: GGG
gttctgtttgatcaagtcct

SEQ ID NO: 87757 - DNA, 20 bp, Artificial Sequence
  Description of Artificial Sequence: Synthetic oligonucleotide
  Target: ATXN1; (-) strand; PAM type: NRG; PAM sequence: TGG
agttctgtttgatcaagtcc

SEQ ID NO: 87758 - DNA, 20 bp, Artificial Sequence
  Description of Artificial Sequence: Synthetic oligonucleotide
  Target: ATXN1; (-) strand; PAM type: NRG; PAM sequence: AAG
taatagagttctgtttgatc

SEQ ID NO: 87759 - DNA, 20 bp, Artificial Sequence
  Description of Artificial Sequence: Synthetic oligonucleotide
  Target: ATXN1; (-) strand; PAM type: NRG; PAM sequence: GAG
gcagaaggaggtagttaata

SEQ ID NO: 87760 - DNA, 20 bp, Artificial Sequence
  Description of Artificial Sequence: Synthetic oligonucleotide
  Target: ATXN1; (-) strand; PAM type: NRG; PAM sequence: TAG
gtgcagaaggaggtagttaa

SEQ ID NO: 87761 - DNA, 20 bp, Artificial Sequence
  Description of Artificial Sequence: Synthetic oligonucleotide
  Target: ATXN1; (-) strand; PAM type: NRG; PAM sequence: TAG
ggtgggtgtgcagaaggagg

SEQ ID NO: 87762 - DNA, 20 bp, Artificial Sequence
  Description of Artificial Sequence: Synthetic oligonucleotide
  Target: ATXN1; (-) strand; PAM type: NRG; PAM sequence: AGG
cacggtgggtgtgcagaagg

SEQ ID NO: 87763 - DNA, 20 bp, Artificial Sequence
  Description of Artificial Sequence: Synthetic oligonucleotide
  Target: ATXN1; (-) strand; PAM type: NRG; PAM sequence: GAG
tcacggtgggtgtgcagaag

SEQ ID NO: 87764 - DNA, 20 bp, Artificial Sequence
  Description of Artificial Sequence: Synthetic oligonucleotide
  Target: ATXN1; (-) strand; PAM type: NRG; PAM sequence: AGG
tctcacggtgggtgtgcaga

SEQ ID NO: 87765 - DNA, 20 bp, Artificial Sequence
  Description of Artificial Sequence: Synthetic oligonucleotide
  Target: ATXN1; (-) strand; PAM type: NRG; PAM sequence: AAG
ttctcacggtgggtgtgcag

SEQ ID NO: 87766 - DNA, 20 bp, Artificial Sequence
  Description of Artificial Sequence: Synthetic oligonucleotide
  Target: ATXN1; (-) strand; PAM type: NRG; PAM sequence: CAG
atgttctcacggtgggtgtg

SEQ ID NO: 87767 - DNA, 20 bp, Artificial Sequence
  Description of Artificial Sequence: Synthetic oligonucleotide
  Target: ATXN1; (-) strand; PAM type: NRG; PAM sequence: GGG
atcaattatgttctcacggt

SEQ ID NO: 87768 - DNA, 20 bp, Artificial Sequence
  Description of Artificial Sequence: Synthetic oligonucleotide
  Target: ATXN1; (-) strand; PAM type: NRG; PAM sequence: TGG
catcaattatgttctcacgg

SEQ ID NO: 87769 - DNA, 20 bp, Artificial Sequence
  Description of Artificial Sequence: Synthetic oligonucleotide
  Target: ATXN1; (-) strand; PAM type: NRG; PAM sequence: CGG
gagcatcaattatgttctca

SEQ ID NO: 87770 - DNA, 20 bp, Artificial Sequence
  Description of Artificial Sequence: Synthetic oligonucleotide
  Target: ATXN1; (-) strand; PAM type: NRG; PAM sequence: GAG
gagtgctttagggccatgat

SEQ ID NO: 87771 - DNA, 20 bp, Artificial Sequence
  Description of Artificial Sequence: Synthetic oligonucleotide
  Target: ATXN1; (-) strand; PAM type: NRG; PAM sequence: GGG
cagagtcttggagtgcttta

SEQ ID NO: 87772 - DNA, 20 bp, Artificial Sequence
  Description of Artificial Sequence: Synthetic oligonucleotide
  Target: ATXN1; (-) strand; PAM type: NRG; PAM sequence: AGG
tcagagtcttggagtgcttt

SEQ ID NO: 87773 - DNA, 20 bp, Artificial Sequence
  Description of Artificial Sequence: Synthetic oligonucleotide
  Target: ATXN1; (-) strand; PAM type: NRG; PAM sequence: TAG
ttcagagtcttggagtgctt

SEQ ID NO: 87774 - DNA, 20 bp, Artificial Sequence
  Description of Artificial Sequence: Synthetic oligonucleotide
  Target: ATXN1; (-) strand; PAM type: NRG; PAM sequence: GAG
gaaggtacttcagagtcttg

SEQ ID NO: 87775 - DNA, 20 bp, Artificial Sequence
  Description of Artificial Sequence: Synthetic oligonucleotide
  Target: ATXN1; (-) strand; PAM type: NRG; PAM sequence: TGG
ctgaaggtacttcagagtct

SEQ ID NO: 87776 - DNA, 20 bp, Artificial Sequence
  Description of Artificial Sequence: Synthetic oligonucleotide
  Target: ATXN1; (-) strand; PAM type: NRG; PAM sequence: GAG
ctttccctgaaggtacttca

SEQ ID NO: 87777 - DNA, 20 bp, Artificial Sequence
  Description of Artificial Sequence: Synthetic oligonucleotide
  Target: ATXN1; (-) strand; PAM type: NRG; PAM sequence: CAG
atctttccctgaaggtactt

SEQ ID NO: 87778 - DNA, 20 bp, Artificial Sequence
  Description of Artificial Sequence: Synthetic oligonucleotide
  Target: ATXN1; (-) strand; PAM type: NRG; PAM sequence: AGG
ataatttaatctttccctga

SEQ ID NO: 87779 - DNA, 20 bp, Artificial Sequence
  Description of Artificial Sequence: Synthetic oligonucleotide
  Target: ATXN1; (-) strand; PAM type: NRG; PAM sequence: AAG
cataatttaatctttccctg

SEQ ID NO: 87780 - DNA, 20 bp, Artificial Sequence
  Description of Artificial Sequence: Synthetic oligonucleotide
  Target: ATXN1; (-) strand; PAM type: NRG; PAM sequence: AGG
aatacacttcataataaact

SEQ ID NO: 87781 - DNA, 20 bp, Artificial Sequence
  Description of Artificial Sequence: Synthetic oligonucleotide
  Target: ATXN1; (-) strand; PAM type: NRG; PAM sequence: TAG
aaatacacttcataataaac

SEQ ID NO: 87782 - DNA, 20 bp, Artificial Sequence
  Description of Artificial Sequence: Synthetic oligonucleotide
  Target: ATXN1; (-) strand; PAM type: NRG; PAM sequence: GAG
caccaattttcaaagaattt

SEQ ID NO: 87783 - DNA, 20 bp, Artificial Sequence
  Description of Artificial Sequence: Synthetic oligonucleotide
  Target: ATXN1; (-) strand; PAM type: NRG; PAM sequence: AAG
tcctaggtcaccaattttca

SEQ ID NO: 87784 - DNA, 20 bp, Artificial Sequence
  Description of Artificial Sequence: Synthetic oligonucleotide
  Target: ATXN1; (-) strand; PAM type: NRG; PAM sequence: AGG
ttactctctgtgcttttcct

SEQ ID NO: 87785 - DNA, 20 bp, Artificial Sequence
  Description of Artificial Sequence: Synthetic oligonucleotide
  Target: ATXN1; (-) strand; PAM type: NRG; PAM sequence: TAG
cttactctctgtgcttttcc

SEQ ID NO: 87786 - DNA, 20 bp, Artificial Sequence
  Description of Artificial Sequence: Synthetic oligonucleotide
  Target: ATXN1; (-) strand; PAM type: NRG; PAM sequence: GAG
agaggcttccagttaccaga

SEQ ID NO: 87787 - DNA, 20 bp, Artificial Sequence
  Description of Artificial Sequence: Synthetic oligonucleotide
  Target: ATXN1; (-) strand; PAM type: NRG; PAM sequence: GAG
ggagaggcttccagttacca

SEQ ID NO: 87788 - DNA, 20 bp, Artificial Sequence
  Description of Artificial Sequence: Synthetic oligonucleotide
  Target: ATXN1; (-) strand; PAM type: NRG; PAM sequence: CAG
gaggagaggcttccagttac

SEQ ID NO: 87789 - DNA, 20 bp, Artificial Sequence
  Description of Artificial Sequence: Synthetic oligonucleotide
  Target: ATXN1; (-) strand; PAM type: NRG; PAM sequence: CAG
gactggtgaggagaggcttc

SEQ ID NO: 87790 - DNA, 20 bp, Artificial Sequence
  Description of Artificial Sequence: Synthetic oligonucleotide
  Target: ATXN1; (-) strand; PAM type: NRG; PAM sequence: AGG
gggggtggactggtgaggag

SEQ ID NO: 87791 - DNA, 20 bp, Artificial Sequence
  Description of Artificial Sequence: Synthetic oligonucleotide
  Target: ATXN1; (-) strand; PAM type: NRG; PAM sequence: GAG
tgggggtggactggtgagga

SEQ ID NO: 87792 - DNA, 20 bp, Artificial Sequence
  Description of Artificial Sequence: Synthetic oligonucleotide
  Target: ATXN1; (-) strand; PAM type: NRG; PAM sequence: GAG
actgggggtggactggtgag

SEQ ID NO: 87793 - DNA, 20 bp, Artificial Sequence
  Description of Artificial Sequence: Synthetic oligonucleotide
  Target: ATXN1; (-) strand; PAM type: NRG; PAM sequence: AGG
tgactgggggtggactggtg

SEQ ID NO: 87794 - DNA, 20 bp, Artificial Sequence
  Description of Artificial Sequence: Synthetic oligonucleotide
  Target: ATXN1; (-) strand; PAM type: NRG; PAM sequence: GAG
gtgactgggggtggactggt

SEQ ID NO: 87795 - DNA, 20 bp, Artificial Sequence
  Description of Artificial Sequence: Synthetic oligonucleotide
  Target: ATXN1; (-) strand; PAM type: NRG; PAM sequence: TGG
aagggtgactgggggtggac

SEQ ID NO: 87796 - DNA, 20 bp, Artificial Sequence
  Description of Artificial Sequence: Synthetic oligonucleotide
  Target: ATXN1; (-) strand; PAM type: NRG; PAM sequence: TGG
ctgtgaagggtgactggggg

SEQ ID NO: 87797 - DNA, 20 bp, Artificial Sequence
  Description of Artificial Sequence: Synthetic oligonucleotide
  Target: ATXN1; (-) strand; PAM type: NRG; PAM sequence: GGG
actctgtgaagggtgactgg

SEQ ID NO: 87798 - DNA, 20 bp, Artificial Sequence
  Description of Artificial Sequence: Synthetic oligonucleotide
  Target: ATXN1; (-) strand; PAM type: NRG; PAM sequence: GGG
aactctgtgaagggtgactg

SEQ ID NO: 87799 - DNA, 20 bp, Artificial Sequence
  Description of Artificial Sequence: Synthetic oligonucleotide
  Target: ATXN1; (-) strand; PAM type: NRG; PAM sequence: GGG
taactctgtgaagggtgact

SEQ ID NO: 87800 - DNA, 20 bp, Artificial Sequence
  Description of Artificial Sequence: Synthetic oligonucleotide
  Target: ATXN1; (-) strand; PAM type: NRG; PAM sequence: TGG
ttaactctgtgaagggtgac

SEQ ID NO: 87801 - DNA, 20 bp, Artificial Sequence
  Description of Artificial Sequence: Synthetic oligonucleotide
  Target: ATXN1; (-) strand; PAM type: NRG; PAM sequence: GGG
tttacaattaactctgtgaa

SEQ ID NO: 87802 - DNA, 20 bp, Artificial Sequence
  Description of Artificial Sequence: Synthetic oligonucleotide
  Target: ATXN1; (-) strand; PAM type: NRG; PAM sequence: AGG
ttttacaattaactctgtga

SEQ ID NO: 87803 - DNA, 20 bp, Artificial Sequence
  Description of Artificial Sequence: Synthetic oligonucleotide
  Target: ATXN1; (-) strand; PAM type: NRG; PAM sequence: AAG
tttttacaattaactctgtg

SEQ ID NO: 87804 - DNA, 20 bp, Artificial Sequence
  Description of Artificial Sequence: Synthetic oligonucleotide
  Target: ATXN1; (-) strand; PAM type: NRG; PAM sequence: TGG
cagtttttcctaccctaggg

SEQ ID NO: 87805 - DNA, 20 bp, Artificial Sequence
  Description of Artificial Sequence: Synthetic oligonucleotide
  Target: ATXN1; (-) strand; PAM type: NRG; PAM sequence: GGG
tcccagtttttcctacccta

SEQ ID NO: 87806 - DNA, 20 bp, Artificial Sequence
  Description of Artificial Sequence: Synthetic oligonucleotide
  Target: ATXN1; (-) strand; PAM type: NRG; PAM sequence: AGG
atcccagtttttcctaccct

SEQ ID NO: 87807 - DNA, 20 bp, Artificial Sequence
  Description of Artificial Sequence: Synthetic oligonucleotide
  Target: ATXN1; (-) strand; PAM type: NRG; PAM sequence: TAG
aatcccagtttttcctaccc

SEQ ID NO: 87808 - DNA, 20 bp, Artificial Sequence
  Description of Artificial Sequence: Synthetic oligonucleotide
  Target: ATXN1; (-) strand; PAM type: NRG; PAM sequence: CAG
taattagtgtgtcggaatcc

SEQ ID NO: 87809 - DNA, 20 bp, Artificial Sequence
  Description of Artificial Sequence: Synthetic oligonucleotide
  Target: ATXN1; (-) strand; PAM type: NRG; PAM sequence: CGG
gacttttataattagtgtgt

SEQ ID NO: 87810 - DNA, 20 bp, Artificial Sequence
  Description of Artificial Sequence: Synthetic oligonucleotide
  Target: ATXN1; (-) strand; PAM type: NRG; PAM sequence: TAG
gttcttttgacttttataat

SEQ ID NO: 87811 - DNA, 20 bp, Artificial Sequence
  Description of Artificial Sequence: Synthetic oligonucleotide
  Target: ATXN1; (-) strand; PAM type: NRG; PAM sequence: AAG
cttgaagattaggcaaggcc

SEQ ID NO: 87812 - DNA, 20 bp, Artificial Sequence
  Description of Artificial Sequence: Synthetic oligonucleotide
  Target: ATXN1; (-) strand; PAM type: NRG; PAM sequence: AGG
tgatccttgaagattaggca

SEQ ID NO: 87813 - DNA, 20 bp, Artificial Sequence
  Description of Artificial Sequence: Synthetic oligonucleotide
  Target: ATXN1; (-) strand; PAM type: NRG; PAM sequence: AAG
gtgatccttgaagattaggc

SEQ ID NO: 87814 - DNA, 20 bp, Artificial Sequence
  Description of Artificial Sequence: Synthetic oligonucleotide
  Target: ATXN1; (-) strand; PAM type: NRG; PAM sequence: AGG
attagtgatccttgaagatt

SEQ ID NO: 87815 - DNA, 20 bp, Artificial Sequence
  Description of Artificial Sequence: Synthetic oligonucleotide
  Target: ATXN1; (-) strand; PAM type: NRG; PAM sequence: TAG
cattagtgatccttgaagat

SEQ ID NO: 87816 - DNA, 20 bp, Artificial Sequence
  Description of Artificial Sequence: Synthetic oligonucleotide
  Target: ATXN1; (-) strand; PAM type: NRG; PAM sequence: AAG
ctgcacattagtgatccttg

SEQ ID NO: 87817 - DNA, 20 bp, Artificial Sequence
  Description of Artificial Sequence: Synthetic oligonucleotide
  Target: ATXN1; (-) strand; PAM type: NRG; PAM sequence: TAG
acttttgtatttctgcacat

SEQ ID NO: 87818 - DNA, 20 bp, Artificial Sequence
  Description of Artificial Sequence: Synthetic oligonucleotide
  Target: ATXN1; (-) strand; PAM type: NRG; PAM sequence: AAG
attaaatttttcattgtttc

SEQ ID NO: 87819 - DNA, 20 bp, Artificial Sequence
  Description of Artificial Sequence: Synthetic oligonucleotide
  Target: ATXN1; (-) strand; PAM type: NRG; PAM sequence: TAG
aaacatgtaggcatcttagg

SEQ ID NO: 87820 - DNA, 20 bp, Artificial Sequence
  Description of Artificial Sequence: Synthetic oligonucleotide
  Target: ATXN1; (-) strand; PAM type: NRG; PAM sequence: AGG
ttgaaacatgtaggcatctt

SEQ ID NO: 87821 - DNA, 20 bp, Artificial Sequence
  Description of Artificial Sequence: Synthetic oligonucleotide
  Target: ATXN1; (-) strand; PAM type: NRG; PAM sequence: TAG
tttgaaacatgtaggcatct

SEQ ID NO: 87822 - DNA, 20 bp, Artificial Sequence
  Description of Artificial Sequence: Synthetic oligonucleotide
  Target: ATXN1; (-) strand; PAM type: NRG; PAM sequence: AGG
aaagtctatttgaaacatgt

SEQ ID NO: 87823 - DNA, 20 bp, Artificial Sequence
  Description of Artificial Sequence: Synthetic oligonucleotide
  Target: ATXN1; (-) strand; PAM type: NRG; PAM sequence: TAG
aaaagtctatttgaaacatg

SEQ ID NO: 87824 - DNA, 20 bp, Artificial Sequence
  Description of Artificial Sequence: Synthetic oligonucleotide
  Target: ATXN1; (-) strand; PAM type: NRG; PAM sequence: AAG
ttcattcttagcaagaacaa

SEQ ID NO: 87825 - DNA, 20 bp, Artificial Sequence
  Description of Artificial Sequence: Synthetic oligonucleotide
  Target: ATXN1; (-) strand; PAM type: NRG; PAM sequence: AAG
caattgaattcattcttagc

SEQ ID NO: 87826 - DNA, 20 bp, Artificial Sequence
  Description of Artificial Sequence: Synthetic oligonucleotide
  Target: ATXN1; (-) strand; PAM type: NRG; PAM sequence: TAG
caaacaattgaattcattct

SEQ ID NO: 87827 - DNA, 20 bp, Artificial Sequence
  Description of Artificial Sequence: Synthetic oligonucleotide
  Target: ATXN1; (-) strand; PAM type: NRG; PAM sequence: TAG
tttgagtactgataatcgga

SEQ ID NO: 87828 - DNA, 20 bp, Artificial Sequence
  Description of Artificial Sequence: Synthetic oligonucleotide
  Target: ATXN1; (-) strand; PAM type: NRG; PAM sequence: CGG
tatttttgagtactgataat

SEQ ID NO: 87829 - DNA, 20 bp, Artificial Sequence
  Description of Artificial Sequence: Synthetic oligonucleotide
  Target: ATXN1; (-) strand; PAM type: NRG; PAM sequence: GAG
tcctctgtttttatattttt

SEQ ID NO: 87830 - DNA, 20 bp, Artificial Sequence
  Description of Artificial Sequence: Synthetic oligonucleotide
  Target: ATXN1; (-) strand; PAM type: NRG; PAM sequence: GAG
tgttaatttcctcttctcag

SEQ ID NO: 87831 - DNA, 20 bp, Artificial Sequence
  Description of Artificial Sequence: Synthetic oligonucleotide
  Target: ATXN1; (-) strand; PAM type: NRG; PAM sequence: AGG
aatgttaatttcctcttctc

SEQ ID NO: 87832 - DNA, 20 bp, Artificial Sequence
  Description of Artificial Sequence: Synthetic oligonucleotide
  Target: ATXN1; (-) strand; PAM type: NRG; PAM sequence: CAG
aaatgttaatttcctcttct

SEQ ID NO: 87833 - DNA, 20 bp, Artificial Sequence
  Description of Artificial Sequence: Synthetic oligonucleotide
  Target: ATXN1; (-) strand; PAM type: NRG; PAM sequence: CAG
aagaagtgacaaaacttacc

SEQ ID NO: 87834 - DNA, 20 bp, Artificial Sequence
  Description of Artificial Sequence: Synthetic oligonucleotide
  Target: ATXN1; (-) strand; PAM type: NRG; PAM sequence: AAG
aaaaaagaaaaaaaaaaaag

SEQ ID NO: 87835 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaagaaaaaaaaaa

SEQ ID NO: 87836 - DNA, 20 bp, Artificial Sequence
  Description of Artificial Sequence: Synthetic oligonucleotide
  Target: ATXN1; (-) strand; PAM type: NRG; PAM sequence: AAG
tctcttaaaaaaaaaaaaaa

SEQ ID NO: 87837 - DNA, 20 bp, Artificial Sequence
  Description of Artificial Sequence: Synthetic oligonucleotide
  Target: ATXN1; (-) strand; PAM type: NRG; PAM sequence: GAG
ctccagcctggcgacagagc

SEQ ID NO: 87838 - DNA, 20 bp, Artificial Sequence
  Description of Artificial Sequence: Synthetic oligonucleotide
  Target: ATXN1; (-) strand; PAM type: NRG; PAM sequence: GAG
tgcactccagcctggcgaca

SEQ ID NO: 87839 - DNA, 20 bp, Artificial Sequence
  Description of Artificial Sequence: Synthetic oligonucleotide
  Target: ATXN1; (-) strand; PAM type: NRG; PAM sequence: CAG
actgcactccagcctggcga

SEQ ID NO: 87840 - DNA, 20 bp, Artificial Sequence
  Description of Artificial Sequence: Synthetic oligonucleotide
  Target: ATXN1; (-) strand; PAM type: NRG; PAM sequence: TGG
cacaccactgcactccagcc

SEQ ID NO: 87841 - DNA, 20 bp, Artificial Sequence
  Description of Artificial Sequence: Synthetic oligonucleotide
  Target: ATXN1; (-) strand; PAM type: NRG; PAM sequence: CAG
aagatcacaccactgcactc

SEQ ID NO: 87842 - DNA, 20 bp, Artificial Sequence
  Description of Artificial Sequence: Synthetic oligonucleotide
  Target: ATXN1; (-) strand; PAM type: NRG; PAM sequence: AAG
ggcggagcttgcagtgagcc

SEQ ID NO: 87843 - DNA, 20 bp, Artificial Sequence
  Description of Artificial Sequence: Synthetic oligonucleotide
  Target: ATXN1; (-) strand; PAM type: NRG; PAM sequence: GAG
gaggcggcggagcttgcagt

SEQ ID NO: 87844 - DNA, 20 bp, Artificial Sequence
  Description of Artificial Sequence: Synthetic oligonucleotide
  Target: ATXN1; (-) strand; PAM type: NRG; PAM sequence: CAG
ccaggaggcggcggagcttg

SEQ ID NO: 87845 - DNA, 20 bp, Artificial Sequence
  Description of Artificial Sequence: Synthetic oligonucleotide
  Target: ATXN1; (-) strand; PAM type: NRG; PAM sequence: GAG
gctagaaccaggaggcggcg

SEQ ID NO: 87846 - DNA, 20 bp, Artificial Sequence
  Description of Artificial Sequence: Synthetic oligonucleotide
  Target: ATXN1; (-) strand; PAM type: NRG; PAM sequence: CGG
ttgctagaaccaggaggcgg

SEQ ID NO: 87847 - DNA, 20 bp, Artificial Sequence
  Description of Artificial Sequence: Synthetic oligonucleotide
  Target: ATXN1; (-) strand; PAM type: NRG; PAM sequence: CGG
gagttgctagaaccaggagg

SEQ ID NO: 87848 - DNA, 20 bp, Artificial Sequence
  Description of Artificial Sequence: Synthetic oligonucleotide
  Target: ATXN1; (-) strand; PAM type: NRG; PAM sequence: AGG
ggagagttgctagaaccagg

SEQ ID NO: 87849 - DNA, 20 bp, Artificial Sequence
  Description of Artificial Sequence: Synthetic oligonucleotide
  Target: ATXN1; (-) strand; PAM type: NRG; PAM sequence: GAG
aggagagttgctagaaccag

SEQ ID NO: 87850 - DNA, 20 bp, Artificial Sequence
  Description of Artificial Sequence: Synthetic oligonucleotide
  Target: ATXN1; (-) strand; PAM type: NRG; PAM sequence: AGG
gcaggagagttgctagaacc

SEQ ID NO: 87851 - DNA, 20 bp, Artificial Sequence
  Description of Artificial Sequence: Synthetic oligonucleotide
  Target: ATXN1; (-) strand; PAM type: NRG; PAM sequence: CAG
ggcaggagagttgctagaac

SEQ ID NO: 87852 - DNA, 20 bp, Artificial Sequence
  Description of Artificial Sequence: Synthetic oligonucleotide
  Target: ATXN1; (-) strand; PAM type: NRG; PAM sequence: TAG
ggctgaggcaggagagttgc

SEQ ID NO: 87853 - DNA, 20 bp, Artificial Sequence
  Description of Artificial Sequence: Synthetic oligonucleotide
  Target: ATXN1; (-) strand; PAM type: NRG; PAM sequence: GAG
cttgggaggctgaggcagga

SEQ ID NO: 87854 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 87855 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 87856 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 87857 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 87858 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 87859 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 87860 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 87861 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagctactt

SEQ ID NO: 87862 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagctact

SEQ ID NO: 87863 - DNA, 20 bp, Artificial Sequence
  Description of Artificial Sequence: Synthetic oligonucleotide
  Target: ATXN1; (-) strand; PAM type: NRG; PAM sequence: CAG
gtggcacacacctgtaatcc

SEQ ID NO: 87864 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagctgggcgtgg

SEQ ID NO: 87865 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagctgggcg

SEQ ID NO: 87866 - DNA, 20 bp, Artificial Sequence
  Description of Artificial Sequence: Synthetic oligonucleotide
  Target: ATXN1; (-) strand; PAM type: NRG; PAM sequence: GGG
taaaatacaaaaaattagct

SEQ ID NO: 87867 - DNA, 20 bp, Artificial Sequence
  Description of Artificial Sequence: Synthetic oligonucleotide
  Target: ATXN1; (-) strand; PAM type: NRG; PAM sequence: TGG
ctaaaatacaaaaaattagc

SEQ ID NO: 87868 - DNA, 20 bp, Artificial Sequence
  Description of Artificial Sequence: Synthetic oligonucleotide
  Target: ATXN1; (-) strand; PAM type: NRG; PAM sequence: TAG
tccactaaaatacaaaaaat

SEQ ID NO: 87869 - DNA, 20 bp, Artificial Sequence
  Description of Artificial Sequence: Synthetic oligonucleotide
  Target: ATXN1; (-) strand; PAM type: NRG; PAM sequence: TGG
tgtgacgagcctgggcaaca

SEQ ID NO: 87870 - DNA, 20 bp, Artificial Sequence
  Description of Artificial Sequence: Synthetic oligonucleotide
  Target: ATXN1; (-) strand; PAM type: NRG; PAM sequence: GGG
gggacaattgtgacgagcct

SEQ ID NO: 87871 - DNA, 20 bp, Artificial Sequence
  Description of Artificial Sequence: Synthetic oligonucleotide
  Target: ATXN1; (-) strand; PAM type: NRG; PAM sequence: TGG
agggacaattgtgacgagcc

SEQ ID NO: 87872 - DNA, 20 bp, Artificial Sequence
  Description of Artificial Sequence: Synthetic oligonucleotide
  Target: ATXN1; (-) strand; PAM type: NRG; PAM sequence: GAG
aaagaagggacaattgtgac

SEQ ID NO: 87873 - DNA, 20 bp, Artificial Sequence
  Description of Artificial Sequence: Synthetic oligonucleotide
  Target: ATXN1; (-) strand; PAM type: NRG; PAM sequence: GGG
acataatttcttttaaagaa

SEQ ID NO: 87874 - DNA, 20 bp, Artificial Sequence
  Description of Artificial Sequence: Synthetic oligonucleotide
  Target: ATXN1; (-) strand; PAM type: NRG; PAM sequence: AGG
gacataatttcttttaaaga

SEQ ID NO: 87875 - DNA, 20 bp, Artificial Sequence
  Description of Artificial Sequence: Synthetic oligonucleotide
  Target: ATXN1; (-) strand; PAM type: NRG; PAM sequence: AAG
agacataatttcttttaaag

SEQ ID NO: 87876 - DNA, 20 bp, Artificial Sequence
  Description of Artificial Sequence: Synthetic oligonucleotide
  Target: ATXN1; (-) strand; PAM type: NRG; PAM sequence: AAG
catagacataatttctttta

SEQ ID NO: 87877 - DNA, 20 bp, Artificial Sequence
  Description of Artificial Sequence: Synthetic oligonucleotide
  Target: ATXN1; (-) strand; PAM type: NRG; PAM sequence: TAG
tgttacgttcctcattaaca

SEQ ID NO: 87878 - DNA, 20 bp, Artificial Sequence
  Description of Artificial Sequence: Synthetic oligonucleotide
  Target: ATXN1; (-) strand; PAM type: NRG; PAM sequence: TAG
tttacaaccataatacggtt

SEQ ID NO: 87879 - DNA, 20 bp, Artificial Sequence
  Description of Artificial Sequence: Synthetic oligonucleotide
  Target: ATXN1; (-) strand; PAM type: NRG; PAM sequence: CGG
gtgcttttacaaccataata

SEQ ID NO: 87880 - DNA, 20 bp, Artificial Sequence
  Description of Artificial Sequence: Synthetic oligonucleotide
  Target: ATXN1; (-) strand; PAM type: NRG; PAM sequence: AAG
gtgttgaaataatttaaaca

SEQ ID NO: 87881 - DNA, 20 bp, Artificial Sequence
  Description of Artificial Sequence: Synthetic oligonucleotide
  Target: ATXN1; (-) strand; PAM type: NRG; PAM sequence: CAG
ggaaaagataacataatcta

SEQ ID NO: 87882 - DNA, 20 bp, Artificial Sequence
  Description of Artificial Sequence: Synthetic oligonucleotide
  Target: ATXN1; (-) strand; PAM type: NRG; PAM sequence: AAG
ttcccagtttctaatcggaa

SEQ ID NO: 87883 - DNA, 20 bp, Artificial Sequence
  Description of Artificial Sequence: Synthetic oligonucleotide
  Target: ATXN1; (-) strand; PAM type: NRG; PAM sequence: CGG
tgtgtttcccagtttctaat

SEQ ID NO: 87884 - DNA, 20 bp, Artificial Sequence
  Description of Artificial Sequence: Synthetic oligonucleotide
  Target: ATXN1; (-) strand; PAM type: NRG; PAM sequence: CAG
taaggctgacgtgtgtttcc

SEQ ID NO: 87885 - DNA, 20 bp, Artificial Sequence
  Description of Artificial Sequence: Synthetic oligonucleotide
  Target: ATXN1; (-) strand; PAM type: NRG; PAM sequence: AGG
gctctgaaatgtagtcctta

SEQ ID NO: 87886 - DNA, 20 bp, Artificial Sequence
  Description of Artificial Sequence: Synthetic oligonucleotide
  Target: ATXN1; (-) strand; PAM type: NRG; PAM sequence: AAG
agctctgaaatgtagtcctt

SEQ ID NO: 87887 - DNA, 20 bp, Artificial Sequence
  Description of Artificial Sequence: Synthetic oligonucleotide
  Target: ATXN1; (-) strand; PAM type: NRG; PAM sequence: TAG
tctctctcagctctgaaatg

SEQ ID NO: 87888 - DNA, 20 bp, Artificial Sequence
  Description of Artificial Sequence: Synthetic oligonucleotide
  Target: ATXN1; (-) strand; PAM type: NRG; PAM sequence: CAG
acgaccacttgtttctctct

SEQ ID NO: 87889 - DNA, 20 bp, Artificial Sequence
  Description of Artificial Sequence: Synthetic oligonucleotide
  Target: ATXN1; (-) strand; PAM type: NRG; PAM sequence: TAG
agttggatagaaggttattg

SEQ ID NO: 87890 - DNA, 20 bp, Artificial Sequence
  Description of Artificial Sequence: Synthetic oligonucleotide
  Target: ATXN1; (-) strand; PAM type: NRG; PAM sequence: AGG
ggagatgtgagttggataga

SEQ ID NO: 87891 - DNA, 20 bp, Artificial Sequence
  Description of Artificial Sequence: Synthetic oligonucleotide
  Target: ATXN1; (-) strand; PAM type: NRG; PAM sequence: AAG
aggagatgtgagttggatag

SEQ ID NO: 87892 - DNA, 20 bp, Artificial Sequence
  Description of Artificial Sequence: Synthetic oligonucleotide
  Target: ATXN1; (-) strand; PAM type: NRG; PAM sequence: TAG
gagaggagatgtgagttgga

SEQ ID NO: 87893 - DNA, 20 bp, Artificial Sequence
  Description of Artificial Sequence: Synthetic oligonucleotide
  Target: ATXN1; (-) strand; PAM type: NRG; PAM sequence: TGG
tccagagaggagatgtgagt

SEQ ID NO: 87894 - DNA, 20 bp, Artificial Sequence
  Description of Artificial Sequence: Synthetic oligonucleotide
  Target: ATXN1; (-) strand; PAM type: NRG; PAM sequence: GAG
attctccagagaggagatgt

SEQ ID NO: 87895 - DNA, 20 bp, Artificial Sequence
  Description of Artificial Sequence: Synthetic oligonucleotide
  Target: ATXN1; (-) strand; PAM type: NRG; PAM sequence: GAG
atcaggaattctccagagag

SEQ ID NO: 87896 - DNA, 20 bp, Artificial Sequence
  Description of Artificial Sequence: Synthetic oligonucleotide
  Target: ATXN1; (-) strand; PAM type: NRG; PAM sequence: AGG
ttatcaggaattctccagag

SEQ ID NO: 87897 - DNA, 20 bp, Artificial Sequence
  Description of Artificial Sequence: Synthetic oligonucleotide
  Target: ATXN1; (-) strand; PAM type: NRG; PAM sequence: GAG
cttatcaggaattctccaga

SEQ ID NO: 87898 - DNA, 20 bp, Artificial Sequence
  Description of Artificial Sequence: Synthetic oligonucleotide
  Target: ATXN1; (-) strand; PAM type: NRG; PAM sequence: GAG
ctcttatcaggaattctcca

SEQ ID NO: 87899 - DNA, 20 bp, Artificial Sequence
  Description of Artificial Sequence: Synthetic oligonucleotide
  Target: ATXN1; (-) strand; PAM type: NRG; PAM sequence: CAG
ccctcttatcaggaattctc

SEQ ID NO: 87900 - DNA, 20 bp, Artificial Sequence
  Description of Artificial Sequence: Synthetic oligonucleotide
  Target: ATXN1; (-) strand; PAM type: NRG; PAM sequence: AGG
ggtagtaggaccctcttatc

SEQ ID NO: 87901 - DNA, 20 bp, Artificial Sequence
  Description of Artificial Sequence: Synthetic oligonucleotide
  Target: ATXN1; (-) strand; PAM type: NRG; PAM sequence: CAG
aggtagtaggaccctcttat

SEQ ID NO: 87902 - DNA, 20 bp, Artificial Sequence
  Description of Artificial Sequence: Synthetic oligonucleotide
  Target: ATXN1; (-) strand; PAM type: NRG; PAM sequence: AGG
gatgttcaaacagaggtagt

SEQ ID NO: 87903 - DNA, 20 bp, Artificial Sequence
  Description of Artificial Sequence: Synthetic oligonucleotide
  Target: ATXN1; (-) strand; PAM type: NRG; PAM sequence: TAG
agatgttcaaacagaggtag

SEQ ID NO: 87904 - DNA, 20 bp, Artificial Sequence
  Description of Artificial Sequence: Synthetic oligonucleotide
  Target: ATXN1; (-) strand; PAM type: NRG; PAM sequence: TAG
tggagatgttcaaacagagg

SEQ ID NO: 87905 - DNA, 20 bp, Artificial Sequence
  Description of Artificial Sequence: Synthetic oligonucleotide
  Target: ATXN1; (-) strand; PAM type: NRG; PAM sequence: AGG
cactggagatgttcaaacag

SEQ ID NO: 87906 - DNA, 20 bp, Artificial Sequence
  Description of Artificial Sequence: Synthetic oligonucleotide
  Target: ATXN1; (-) strand; PAM type: NRG; PAM sequence: GAG
tcactggagatgttcaaaca

SEQ ID NO: 87907 - DNA, 20 bp, Artificial Sequence
  Description of Artificial Sequence: Synthetic oligonucleotide
  Target: ATXN1; (-) strand; PAM type: NRG; PAM sequence: CAG
tgtcactggagatgttcaaa

SEQ ID NO: 87908 - DNA, 20 bp, Artificial Sequence
  Description of Artificial Sequence: Synthetic oligonucleotide
  Target: ATXN1; (-) strand; PAM type: NRG; PAM sequence: GAG
cagtgaaacctctgtcactg

SEQ ID NO: 87909 - DNA, 20 bp, Artificial Sequence
  Description of Artificial Sequence: Synthetic oligonucleotide
  Target: ATXN1; (-) strand; PAM type: NRG; PAM sequence: TGG
agcagtgaaacctctgtcac

SEQ ID NO: 87910 - DNA, 20 bp, Artificial Sequence
  Description of Artificial Sequence: Synthetic oligonucleotide
  Target: ATXN1; (-) strand; PAM type: NRG; PAM sequence: CAG
gaacaagctgattgatttag

SEQ ID NO: 87911 - DNA, 20 bp, Artificial Sequence
  Description of Artificial Sequence: Synthetic oligonucleotide
  Target: ATXN1; (-) strand; PAM type: NRG; PAM sequence: TAG
atggaacaagctgattgatt

SEQ ID NO: 87912 - DNA, 20 bp, Artificial Sequence
  Description of Artificial Sequence: Synthetic oligonucleotide
  Target: ATXN1; (-) strand; PAM type: NRG; PAM sequence: AAG
ggactgtctaaaaatggaac

SEQ ID NO: 87913 - DNA, 20 bp, Artificial Sequence
  Description of Artificial Sequence: Synthetic oligonucleotide
  Target: ATXN1; (-) strand; PAM type: NRG; PAM sequence: TGG
caatcaggactgtctaaaaa

SEQ ID NO: 87914 - DNA, 20 bp, Artificial Sequence
  Description of Artificial Sequence: Synthetic oligonucleotide
  Target: ATXN1; (-) strand; PAM type: NRG; PAM sequence: AGG
ggaggaacattctggcaatc

SEQ ID NO: 87915 - DNA, 20 bp, Artificial Sequence
  Description of Artificial Sequence: Synthetic oligonucleotide
  Target: ATXN1; (-) strand; PAM type: NRG; PAM sequence: CAG
aggaggaacattctggcaat

SEQ ID NO: 87916 - DNA, 20 bp, Artificial Sequence
  Description of Artificial Sequence: Synthetic oligonucleotide
  Target: ATXN1; (-) strand; PAM type: NRG; PAM sequence: TGG
ccacttgaggaggaacattc

SEQ ID NO: 87917 - DNA, 20 bp, Artificial Sequence
  Description of Artificial Sequence: Synthetic oligonucleotide
  Target: ATXN1; (-) strand; PAM type: NRG; PAM sequence: AGG
gagttcgactccacttgagg

SEQ ID NO: 87918 - DNA, 20 bp, Artificial Sequence
  Description of Artificial Sequence: Synthetic oligonucleotide
  Target: ATXN1; (-) strand; PAM type: NRG; PAM sequence: GAG
agagttcgactccacttgag

SEQ ID NO: 87919 - DNA, 20 bp, Artificial Sequence
  Description of Artificial Sequence: Synthetic oligonucleotide
  Target: ATXN1; (-) strand; PAM type: NRG; PAM sequence: AGG
ggagagttcgactccacttg

SEQ ID NO: 87920 - DNA, 20 bp, Artificial Sequence
  Description of Artificial Sequence: Synthetic oligonucleotide
  Target: ATXN1; (-) strand; PAM type: NRG; PAM sequence: GAG
gggagagttcgactccactt

SEQ ID NO: 87921 - DNA, 20 bp, Artificial Sequence
  Description of Artificial Sequence: Synthetic oligonucleotide
  Target: ATXN1; (-) strand; PAM type: NRG; PAM sequence: GAG
agggaagttaaccctaggga

SEQ ID NO: 87922 - DNA, 20 bp, Artificial Sequence
  Description of Artificial Sequence: Synthetic oligonucleotide
  Target: ATXN1; (-) strand; PAM type: NRG; PAM sequence: GAG
ggagggaagttaaccctagg

SEQ ID NO: 87923 - DNA, 20 bp, Artificial Sequence
  Description of Artificial Sequence: Synthetic oligonucleotide
  Target: ATXN1; (-) strand; PAM type: NRG; PAM sequence: GGG
caggagggaagttaacccta

SEQ ID NO: 87924 - DNA, 20 bp, Artificial Sequence
  Description of Artificial Sequence: Synthetic oligonucleotide
  Target: ATXN1; (-) strand; PAM type: NRG; PAM sequence: AGG
acaggagggaagttaaccct

SEQ ID NO: 87925 - DNA, 20 bp, Artificial Sequence
  Description of Artificial Sequence: Synthetic oligonucleotide
  Target: ATXN1; (-) strand; PAM type: NRG; PAM sequence: TAG
aacaggagggaagttaaccc

SEQ ID NO: 87926 - DNA, 20 bp, Artificial Sequence
  Description of Artificial Sequence: Synthetic oligonucleotide
  Target: ATXN1; (-) strand; PAM type: NRG; PAM sequence: AAG
aagaactaagaacaggaggg

SEQ ID NO: 87927 - DNA, 20 bp, Artificial Sequence
  Description of Artificial Sequence: Synthetic oligonucleotide
  Target: ATXN1; (-) strand; PAM type: NRG; PAM sequence: GGG
accaagaactaagaacagga

SEQ ID NO: 87928 - DNA, 20 bp, Artificial Sequence
  Description of Artificial Sequence: Synthetic oligonucleotide
  Target: ATXN1; (-) strand; PAM type: NRG; PAM sequence: AGG
aaccaagaactaagaacagg

SEQ ID NO: 87929 - DNA, 20 bp, Artificial Sequence
  Description of Artificial Sequence: Synthetic oligonucleotide
  Target: ATXN1; (-) strand; PAM type: NRG; PAM sequence: GAG
caaccaagaactaagaacag

SEQ ID NO: 87930 - DNA, 20 bp, Artificial Sequence
  Description of Artificial Sequence: Synthetic oligonucleotide
  Target: ATXN1; (-) strand; PAM type: NRG; PAM sequence: AGG
cgcaaccaagaactaagaac

SEQ ID NO: 87931 - DNA, 20 bp, Artificial Sequence
  Description of Artificial Sequence: Synthetic oligonucleotide
  Target: ATXN1; (-) strand; PAM type: NRG; PAM sequence: CAG
acgcaaccaagaactaagaa

SEQ ID NO: 87932 - DNA, 20 bp, Artificial Sequence
  Description of Artificial Sequence: Synthetic oligonucleotide
  Target: ATXN1; (-) strand; PAM type: NRG; PAM sequence: AAG
agagtacgcaaccaagaact

SEQ ID NO: 87933 - DNA, 20 bp, Artificial Sequence
  Description of Artificial Sequence: Synthetic oligonucleotide
  Target: ATXN1; (-) strand; PAM type: NRG; PAM sequence: AAG
tggtggtagagtacgcaacc

SEQ ID NO: 87934 - DNA, 20 bp, Artificial Sequence
  Description of Artificial Sequence: Synthetic oligonucleotide
  Target: ATXN1; (-) strand; PAM type: NRG; PAM sequence: GAG
cacttactgaagtggtggta

SEQ ID NO: 87935 - DNA, 20 bp, Artificial Sequence
  Description of Artificial Sequence: Synthetic oligonucleotide
  Target: ATXN1; (-) strand; PAM type: NRG; PAM sequence: TAG
atcacttactgaagtggtgg

SEQ ID NO: 87936 - DNA, 20 bp, Artificial Sequence
  Description of Artificial Sequence: Synthetic oligonucleotide
  Target: ATXN1; (-) strand; PAM type: NRG; PAM sequence: TGG
gaaatcacttactgaagtgg

SEQ ID NO: 87937 - DNA, 20 bp, Artificial Sequence
  Description of Artificial Sequence: Synthetic oligonucleotide
  Target: ATXN1; (-) strand; PAM type: NRG; PAM sequence: TGG
agtgaaatcacttactgaag

SEQ ID NO: 87938 - DNA, 20 bp, Artificial Sequence
  Description of Artificial Sequence: Synthetic oligonucleotide
  Target: ATXN1; (-) strand; PAM type: NRG; PAM sequence: AAG
ggaagtgaaatcacttactg

SEQ ID NO: 87939 - DNA, 20 bp, Artificial Sequence
  Description of Artificial Sequence: Synthetic oligonucleotide
  Target: ATXN1; (-) strand; PAM type: NRG; PAM sequence: AAG
ctagcaaagggcctgacagg

SEQ ID NO: 87940 - DNA, 20 bp, Artificial Sequence
  Description of Artificial Sequence: Synthetic oligonucleotide
  Target: ATXN1; (-) strand; PAM type: NRG; PAM sequence: AGG
aggctagcaaagggcctgac

SEQ ID NO: 87941 - DNA, 20 bp, Artificial Sequence
  Description of Artificial Sequence: Synthetic oligonucleotide
  Target: ATXN1; (-) strand; PAM type: NRG; PAM sequence: CAG
gaggctagcaaagggcctga

SEQ ID NO: 87942 - DNA, 20 bp, Artificial Sequence
  Description of Artificial Sequence: Synthetic oligonucleotide
  Target: ATXN1; (-) strand; PAM type: NRG; PAM sequence: GGG
aaatgagtgaggctagcaaa

SEQ ID NO: 87943 - DNA, 20 bp, Artificial Sequence
  Description of Artificial Sequence: Synthetic oligonucleotide
  Target: ATXN1; (-) strand; PAM type: NRG; PAM sequence: AGG
aaaatgagtgaggctagcaa

SEQ ID NO: 87944 - DNA, 20 bp, Artificial Sequence
  Description of Artificial Sequence: Synthetic oligonucleotide
  Target: ATXN1; (-) strand; PAM type: NRG; PAM sequence: AAG
taaaatgagtgaggctagca

SEQ ID NO: 87945 - DNA, 20 bp, Artificial Sequence
  Description of Artificial Sequence: Synthetic oligonucleotide
  Target: ATXN1; (-) strand; PAM type: NRG; PAM sequence: TAG
actgataaaatgagtgaggc

SEQ ID NO: 87946 - DNA, 20 bp, Artificial Sequence
  Description of Artificial Sequence: Synthetic oligonucleotide
  Target: ATXN1; (-) strand; PAM type: NRG; PAM sequence: AGG
cctaactgataaaatgagtg

SEQ ID NO: 87947 - DNA, 20 bp, Artificial Sequence
  Description of Artificial Sequence: Synthetic oligonucleotide
  Target: ATXN1; (-) strand; PAM type: NRG; PAM sequence: GAG
acctaactgataaaatgagt

SEQ ID NO: 87948 - DNA, 20 bp, Artificial Sequence
  Description of Artificial Sequence: Synthetic oligonucleotide
  Target: ATXN1; (-) strand; PAM type: NRG; PAM sequence: GAG
cattacctaactgataaaat

SEQ ID NO: 87949 - DNA, 20 bp, Artificial Sequence
  Description of Artificial Sequence: Synthetic oligonucleotide
  Target: ATXN1; (-) strand; PAM type: NRG; PAM sequence: CAG
tgacaattgtgaatagaagc

SEQ ID NO: 87950 - DNA, 20 bp, Artificial Sequence
  Description of Artificial Sequence: Synthetic oligonucleotide
  Target: ATXN1; (-) strand; PAM type: NRG; PAM sequence: AAG
acagtgacaattgtgaatag

SEQ ID NO: 87951 - DNA, 20 bp, Artificial Sequence
  Description of Artificial Sequence: Synthetic oligonucleotide
  Target: ATXN1; (-) strand; PAM type: NRG; PAM sequence: TAG
ataacagtgacaattgtgaa

SEQ ID NO: 87952 - DNA, 20 bp, Artificial Sequence
  Description of Artificial Sequence: Synthetic oligonucleotide
  Target: ATXN1; (-) strand; PAM type: NRG; PAM sequence: CAG
cactgtggttcacagaataa

SEQ ID NO: 87953 - DNA, 20 bp, Artificial Sequence
  Description of Artificial Sequence: Synthetic oligonucleotide
  Target: ATXN1; (-) strand; PAM type: NRG; PAM sequence: CAG
agaatggtcactgtggttca

SEQ ID NO: 87954 - DNA, 20 bp, Artificial Sequence
  Description of Artificial Sequence: Synthetic oligonucleotide
  Target: ATXN1; (-) strand; PAM type: NRG; PAM sequence: TGG
gttgtgaagaatggtcactg

SEQ ID NO: 87955 - DNA, 20 bp, Artificial Sequence
  Description of Artificial Sequence: Synthetic oligonucleotide
  Target: ATXN1; (-) strand; PAM type: NRG; PAM sequence: TGG
tggtaggtggttgtgaagaa

SEQ ID NO: 87956 - DNA, 20 bp, Artificial Sequence
  Description of Artificial Sequence: Synthetic oligonucleotide
  Target: ATXN1; (-) strand; PAM type: NRG; PAM sequence: AAG
gtgggtggtaggtggttgtg

SEQ ID NO: 87957 - DNA, 20 bp, Artificial Sequence
  Description of Artificial Sequence: Synthetic oligonucleotide
  Target: ATXN1; (-) strand; PAM type: NRG; PAM sequence: TGG
ccacttcagtgggtggtagg

SEQ ID NO: 87958 - DNA, 20 bp, Artificial Sequence
  Description of Artificial Sequence: Synthetic oligonucleotide
  Target: ATXN1; (-) strand; PAM type: NRG; PAM sequence: AGG
ccaccacttcagtgggtggt

SEQ ID NO: 87959 - DNA, 20 bp, Artificial Sequence
  Description of Artificial Sequence: Synthetic oligonucleotide
  Target: ATXN1; (-) strand; PAM type: NRG; PAM sequence: TAG
gccaccacttcagtgggtgg

SEQ ID NO: 87960 - DNA, 20 bp, Artificial Sequence
  Description of Artificial Sequence: Synthetic oligonucleotide
  Target: ATXN1; (-) strand; PAM type: NRG; PAM sequence: TGG
agagccaccacttcagtggg

SEQ ID NO: 87961 - DNA, 20 bp, Artificial Sequence
  Description of Artificial Sequence: Synthetic oligonucleotide
  Target: ATXN1; (-) strand; PAM type: NRG; PAM sequence: GGG
ccaagagccaccacttcagt

SEQ ID NO: 87962 - DNA, 20 bp, Artificial Sequence
  Description of Artificial Sequence: Synthetic oligonucleotide
  Target: ATXN1; (-) strand; PAM type: NRG; PAM sequence: TGG
cccaagagccaccacttcag

SEQ ID NO: 87963 - DNA, 20 bp, Artificial Sequence
  Description of Artificial Sequence: Synthetic oligonucleotide
  Target: ATXN1; (-) strand; PAM type: NRG; PAM sequence: CAG
gtgcccaagagccaccactt

SEQ ID NO: 87964 - DNA, 20 bp, Artificial Sequence
  Description of Artificial Sequence: Synthetic oligonucleotide
  Target: ATXN1; (-) strand; PAM type: NRG; PAM sequence: GAG
ccaagagccatggtgcccaa

SEQ ID NO: 87965 - DNA, 20 bp, Artificial Sequence
  Description of Artificial Sequence: Synthetic oligonucleotide
  Target: ATXN1; (-) strand; PAM type: NRG; PAM sequence: AAG
ccccaagagccatggtgccc

SEQ ID NO: 87966 - DNA, 20 bp, Artificial Sequence
  Description of Artificial Sequence: Synthetic oligonucleotide
  Target: ATXN1; (-) strand; PAM type: NRG; PAM sequence: TGG
gccatggtccccaagagcca

SEQ ID NO: 87967 - DNA, 20 bp, Artificial Sequence
  Description of Artificial Sequence: Synthetic oligonucleotide
  Target: ATXN1; (-) strand; PAM type: NRG; PAM sequence: GAG
catagagccatggtccccaa

SEQ ID NO: 87968 - DNA, 20 bp, Artificial Sequence
  Description of Artificial Sequence: Synthetic oligonucleotide
  Target: ATXN1; (-) strand; PAM type: NRG; PAM sequence: AAG
tccatagagccatggtcccc

SEQ ID NO: 87969 - DNA, 20 bp, Artificial Sequence
  Description of Artificial Sequence: Synthetic oligonucleotide
  Target: ATXN1; (-) strand; PAM type: NRG; PAM sequence: TGG
tcatagtctccatagagcca

SEQ ID NO: 87970 - DNA, 20 bp, Artificial Sequence
  Description of Artificial Sequence: Synthetic oligonucleotide
  Target: ATXN1; (-) strand; PAM type: NRG; PAM sequence: GAG
tgcccatcatagtctccata

SEQ ID NO: 87971 - DNA, 20 bp, Artificial Sequence
  Description of Artificial Sequence: Synthetic oligonucleotide
  Target: ATXN1; (-) strand; PAM type: NRG; PAM sequence: TAG
catgcccatcatagtctcca

SEQ ID NO: 87972 - DNA, 20 bp, Artificial Sequence
  Description of Artificial Sequence: Synthetic oligonucleotide
  Target: ATXN1; (-) strand; PAM type: NRG; PAM sequence: TAG
ccttaggaccatgcccatca

SEQ ID NO: 87973 - DNA, 20 bp, Artificial Sequence
  Description of Artificial Sequence: Synthetic oligonucleotide
  Target: ATXN1; (-) strand; PAM type: NRG; PAM sequence: AGG
aaatatcccataatggcctt

SEQ ID NO: 87974 - DNA, 20 bp, Artificial Sequence
  Description of Artificial Sequence: Synthetic oligonucleotide
  Target: ATXN1; (-) strand; PAM type: NRG; PAM sequence: TAG
aaaatatcccataatggcct

SEQ ID NO: 87975 - DNA, 20 bp, Artificial Sequence
  Description of Artificial Sequence: Synthetic oligonucleotide
  Target: ATXN1; (-) strand; PAM type: NRG; PAM sequence: TGG
aagtccaaaatatcccataa

SEQ ID NO: 87976 - DNA, 20 bp, Artificial Sequence
  Description of Artificial Sequence: Synthetic oligonucleotide
  Target: ATXN1; (-) strand; PAM type: NRG; PAM sequence: AAG
gtgatggcaggaccccagta

SEQ ID NO: 87977 - DNA, 20 bp, Artificial Sequence
  Description of Artificial Sequence: Synthetic oligonucleotide
  Target: ATXN1; (-) strand; PAM type: NRG; PAM sequence: CAG
tgtatgtgatggcaggaccc

SEQ ID NO: 87978 - DNA, 20 bp, Artificial Sequence
  Description of Artificial Sequence: Synthetic oligonucleotide
  Target: ATXN1; (-) strand; PAM type: NRG; PAM sequence: AGG
gaaacagtgtatgtgatggc

SEQ ID NO: 87979 - DNA, 20 bp, Artificial Sequence
  Description of Artificial Sequence: Synthetic oligonucleotide
  Target: ATXN1; (-) strand; PAM type: NRG; PAM sequence: CAG
agaaacagtgtatgtgatgg

SEQ ID NO: 87980 - DNA, 20 bp, Artificial Sequence
  Description of Artificial Sequence: Synthetic oligonucleotide
  Target: ATXN1; (-) strand; PAM type: NRG; PAM sequence: TGG
cagagaaacagtgtatgtga

SEQ ID NO: 87981 - DNA, 20 bp, Artificial Sequence
  Description of Artificial Sequence: Synthetic oligonucleotide
  Target: ATXN1; (-) strand; PAM type: NRG; PAM sequence: CAG
gtctaagtttctcagagaaa

SEQ ID NO: 87982 - DNA, 20 bp, Artificial Sequence
  Description of Artificial Sequence: Synthetic oligonucleotide
  Target: ATXN1; (-) strand; PAM type: NRG; PAM sequence: GAG
ttgtaagtctaagtttctca

SEQ ID NO: 87983 - DNA, 20 bp, Artificial Sequence
  Description of Artificial Sequence: Synthetic oligonucleotide
  Target: ATXN1; (-) strand; PAM type: NRG; PAM sequence: CAG
gattgtaagtctaagtttct

SEQ ID NO: 87984 - DNA, 20 bp, Artificial Sequence
  Description of Artificial Sequence: Synthetic oligonucleotide
  Target: ATXN1; (-) strand; PAM type: NRG; PAM sequence: AAG
ttcagaaagattgtaagtct

SEQ ID NO: 87985 - DNA, 20 bp, Artificial Sequence
  Description of Artificial Sequence: Synthetic oligonucleotide
  Target: ATXN1; (-) strand; PAM type: NRG; PAM sequence: AAG
atccttttcagaaagattgt

SEQ ID NO: 87986 - DNA, 20 bp, Artificial Sequence
  Description of Artificial Sequence: Synthetic oligonucleotide
  Target: ATXN1; (-) strand; PAM type: NRG; PAM sequence: AAG
tataatgtatccttttcaga

SEQ ID NO: 87987 - DNA, 20 bp, Artificial Sequence
  Description of Artificial Sequence: Synthetic oligonucleotide
  Target: ATXN1; (-) strand; PAM type: NRG; PAM sequence: CAG
aatttataatgtatcctttt

SEQ ID NO: 87988 - DNA, 20 bp, Artificial Sequence
  Description of Artificial Sequence: Synthetic oligonucleotide
  Target: ATXN1; (-) strand; PAM type: NRG; PAM sequence: TAG
aaacagatttttcccaaaag

SEQ ID NO: 87989 - DNA, 20 bp, Artificial Sequence
  Description of Artificial Sequence: Synthetic oligonucleotide
  Target: ATXN1; (-) strand; PAM type: NRG; PAM sequence: AAG
atgaaacagatttttcccaa

SEQ ID NO: 87990 - DNA, 20 bp, Artificial Sequence
  Description of Artificial Sequence: Synthetic oligonucleotide
  Target: ATXN1; (-) strand; PAM type: NRG; PAM sequence: CAG
acgccttgtttctcatgaaa

SEQ ID NO: 87991 - DNA, 20 bp, Artificial Sequence
  Description of Artificial Sequence: Synthetic oligonucleotide
  Target: ATXN1; (-) strand; PAM type: NRG; PAM sequence: GAG
ataagactgcttaaaagaca

SEQ ID NO: 87992 - DNA, 20 bp, Artificial Sequence
  Description of Artificial Sequence: Synthetic oligonucleotide
  Target: ATXN1; (-) strand; PAM type: NRG; PAM sequence: CAG
tcataagactgcttaaaaga

SEQ ID NO: 87993 - DNA, 20 bp, Artificial Sequence
  Description of Artificial Sequence: Synthetic oligonucleotide
  Target: ATXN1; (-) strand; PAM type: NRG; PAM sequence: AAG
tggctcataagactgcttaa

SEQ ID NO: 87994 - DNA, 20 bp, Artificial Sequence
  Description of Artificial Sequence: Synthetic oligonucleotide
  Target: ATXN1; (-) strand; PAM type: NRG; PAM sequence: AAG
aaaacactgacttggctcat

SEQ ID NO: 87995 - DNA, 20 bp, Artificial Sequence
  Description of Artificial Sequence: Synthetic oligonucleotide
  Target: ATXN1; (-) strand; PAM type: NRG; PAM sequence: TGG
catgcatcaaaacactgact

SEQ ID NO: 87996 - DNA, 20 bp, Artificial Sequence
  Description of Artificial Sequence: Synthetic oligonucleotide
  Target: ATXN1; (-) strand; PAM type: NRG; PAM sequence: TGG
tactgcaggaggaggagcta

SEQ ID NO: 87997 - DNA, 20 bp, Artificial Sequence
  Description of Artificial Sequence: Synthetic oligonucleotide
  Target: ATXN1; (-) strand; PAM type: NRG; PAM sequence: GAG
tgcttctactgcaggaggag

SEQ ID NO: 87998 - DNA, 20 bp, Artificial Sequence
  Description of Artificial Sequence: Synthetic oligonucleotide
  Target: ATXN1; (-) strand; PAM type: NRG; PAM sequence: AGG
tctgcttctactgcaggagg

SEQ ID NO: 87999 - DNA, 20 bp, Artificial Sequence
  Description of Artificial Sequence: Synthetic oligonucleotide
  Target: ATXN1; (-) strand; PAM type: NRG; PAM sequence: GAG
ttctgcttctactgcaggag

SEQ ID NO: 88000 - DNA, 20 bp, Artificial Sequence
  Description of Artificial Sequence: Synthetic oligonucleotide
  Target: ATXN1; (-) strand; PAM type: NRG; PAM sequence: AGG
acttctgcttctactgcagg

SEQ ID NO: 88001 - DNA, 20 bp, Artificial Sequence
  Description of Artificial Sequence: Synthetic oligonucleotide
  Target: ATXN1; (-) strand; PAM type: NRG; PAM sequence: GAG
tacttctgcttctactgcag

SEQ ID NO: 88002 - DNA, 20 bp, Artificial Sequence
  Description of Artificial Sequence: Synthetic oligonucleotide
  Target: ATXN1; (-) strand; PAM type: NRG; PAM sequence: AGG
gctacttctgcttctactgc

SEQ ID NO: 88003 - DNA, 20 bp, Artificial Sequence
  Description of Artificial Sequence: Synthetic oligonucleotide
  Target: ATXN1; (-) strand; PAM type: NRG; PAM sequence: CAG
tgctacttctgcttctactg

SEQ ID NO: 88004 - DNA, 20 bp, Artificial Sequence
  Description of Artificial Sequence: Synthetic oligonucleotide
  Target: ATXN1; (-) strand; PAM type: NRG; PAM sequence: CAG
tctggatactacaggtttgc

SEQ ID NO: 88005 - DNA, 20 bp, Artificial Sequence
  Description of Artificial Sequence: Synthetic oligonucleotide
  Target: ATXN1; (-) strand; PAM type: NRG; PAM sequence: AGG
ggtagtcatctggatactac

SEQ ID NO: 88006 - DNA, 20 bp, Artificial Sequence
  Description of Artificial Sequence: Synthetic oligonucleotide
  Target: ATXN1; (-) strand; PAM type: NRG; PAM sequence: CAG
aggtagtcatctggatacta

SEQ ID NO: 88007 - DNA, 20 bp, Artificial Sequence
  Description of Artificial Sequence: Synthetic oligonucleotide
  Target: ATXN1; (-) strand; PAM type: NRG; PAM sequence: TGG
aggaaacagaggtagtcatc

SEQ ID NO: 88008 - DNA, 20 bp, Artificial Sequence
  Description of Artificial Sequence: Synthetic oligonucleotide
  Target: ATXN1; (-) strand; PAM type: NRG; PAM sequence: TAG
gttattccaggaaacagagg

SEQ ID NO: 88009 - DNA, 20 bp, Artificial Sequence
  Description of Artificial Sequence: Synthetic oligonucleotide
  Target: ATXN1; (-) strand; PAM type: NRG; PAM sequence: AGG
tctgttattccaggaaacag

SEQ ID NO: 88010 - DNA, 20 bp, Artificial Sequence
  Description of Artificial Sequence: Synthetic oligonucleotide
  Target: ATXN1; (-) strand; PAM type: NRG; PAM sequence: GAG
ttctgttattccaggaaaca

SEQ ID NO: 88011 - DNA, 20 bp, Artificial Sequence
  Description of Artificial Sequence: Synthetic oligonucleotide
  Target: ATXN1; (-) strand; PAM type: NRG; PAM sequence: CAG
gcttctgttattccaggaaa

SEQ ID NO: 88012 - DNA, 20 bp, Artificial Sequence
  Description of Artificial Sequence: Synthetic oligonucleotide
  Target: ATXN1; (-) strand; PAM type: NRG; PAM sequence: AGG
tcttcagcttctgttattcc

SEQ ID NO: 88013 - DNA, 20 bp, Artificial Sequence
  Description of Artificial Sequence: Synthetic oligonucleotide
  Target: ATXN1; (-) strand; PAM type: NRG; PAM sequence: CAG
atcttcagcttctgttattc

SEQ ID NO: 88014 - DNA, 20 bp, Artificial Sequence
  Description of Artificial Sequence: Synthetic oligonucleotide
  Target: ATXN1; (-) strand; PAM type: NRG; PAM sequence: CAG
gatgatgacctgttcatctt

SEQ ID NO: 88015 - DNA, 20 bp, Artificial Sequence
  Description of Artificial Sequence: Synthetic oligonucleotide
  Target: ATXN1; (-) strand; PAM type: NRG; PAM sequence: GAG
ggtacttgggtggtacctgg

SEQ ID NO: 88016 - DNA, 20 bp, Artificial Sequence
  Description of Artificial Sequence: Synthetic oligonucleotide
  Target: ATXN1; (-) strand; PAM type: NRG; PAM sequence: GGG
tgggtacttgggtggtacct

SEQ ID NO: 88017 - DNA, 20 bp, Artificial Sequence
  Description of Artificial Sequence: Synthetic oligonucleotide
  Target: ATXN1; (-) strand; PAM type: NRG; PAM sequence: TGG
ttgggtacttgggtggtacc

SEQ ID NO: 88018 - DNA, 20 bp, Artificial Sequence
  Description of Artificial Sequence: Synthetic oligonucleotide
  Target: ATXN1; (-) strand; PAM type: NRG; PAM sequence: TGG
ggcttgcttgggtacttggg

SEQ ID NO: 88019 - DNA, 20 bp, Artificial Sequence
  Description of Artificial Sequence: Synthetic oligonucleotide
  Target: ATXN1; (-) strand; PAM type: NRG; PAM sequence: GGG
gtgggcttgcttgggtactt

SEQ ID NO: 88020 - DNA, 20 bp, Artificial Sequence
  Description of Artificial Sequence: Synthetic oligonucleotide
  Target: ATXN1; (-) strand; PAM type: NRG; PAM sequence: TGG
ggtgggcttgcttgggtact

SEQ ID NO: 88021 - DNA, 20 bp, Artificial Sequence
  Description of Artificial Sequence: Synthetic oligonucleotide
  Target: ATXN1; (-) strand; PAM type: NRG; PAM sequence: GGG
cacacctggtgggcttgctt

SEQ ID NO: 88022 - DNA, 20 bp, Artificial Sequence
  Description of Artificial Sequence: Synthetic oligonucleotide
  Target: ATXN1; (-) strand; PAM type: NRG; PAM sequence: TGG
acacacctggtgggcttgct

SEQ ID NO: 88023 - DNA, 20 bp, Artificial Sequence
  Description of Artificial Sequence: Synthetic oligonucleotide
  Target: ATXN1; (-) strand; PAM type: NRG; PAM sequence: GGG
aattgtcccacacacctggt

SEQ ID NO: 88024 - DNA, 20 bp, Artificial Sequence
  Description of Artificial Sequence: Synthetic oligonucleotide
  Target: ATXN1; (-) strand; PAM type: NRG; PAM sequence: TGG
gaattgtcccacacacctgg

SEQ ID NO: 88025 - DNA, 20 bp, Artificial Sequence
  Description of Artificial Sequence: Synthetic oligonucleotide
  Target: ATXN1; (-) strand; PAM type: NRG; PAM sequence: TGG
ctagaattgtcccacacacc

SEQ ID NO: 88026 - DNA, 20 bp, Artificial Sequence
  Description of Artificial Sequence: Synthetic oligonucleotide
  Target: ATXN1; (-) strand; PAM type: NRG; PAM sequence: TAG
ctaggctgggcccagggctc

SEQ ID NO: 88027 - DNA, 20 bp, Artificial Sequence
  Description of Artificial Sequence: Synthetic oligonucleotide
  Target: ATXN1; (-) strand; PAM type: NRG; PAM sequence: GGG
tccgtcctaggctgggccca

SEQ ID NO: 88028 - DNA, 20 bp, Artificial Sequence
  Description of Artificial Sequence: Synthetic oligonucleotide
  Target: ATXN1; (-) strand; PAM type: NRG; PAM sequence: AGG
ctccgtcctaggctgggccc

SEQ ID NO: 88029 - DNA, 20 bp, Artificial Sequence
  Description of Artificial Sequence: Synthetic oligonucleotide
  Target: ATXN1; (-) strand; PAM type: NRG; PAM sequence: CAG
tctccgtcctaggctgggcc

SEQ ID NO: 88030 - DNA, 20 bp, Artificial Sequence
  Description of Artificial Sequence: Synthetic oligonucleotide
  Target: ATXN1; (-) strand; PAM type: NRG; PAM sequence: GGG
agctgtctccgtcctaggct

SEQ ID NO: 88031 - DNA, 20 bp, Artificial Sequence
  Description of Artificial Sequence: Synthetic oligonucleotide
  Target: ATXN1; (-) strand; PAM type: NRG; PAM sequence: TGG
aagctgtctccgtcctaggc

SEQ ID NO: 88032 - DNA, 20 bp, Artificial Sequence
  Description of Artificial Sequence: Synthetic oligonucleotide
  Target: ATXN1; (-) strand; PAM type: NRG; PAM sequence: AGG
tcagaagctgtctccgtcct

SEQ ID NO: 88033 - DNA, 20 bp, Artificial Sequence
  Description of Artificial Sequence: Synthetic oligonucleotide
  Target: ATXN1; (-) strand; PAM type: NRG; PAM sequence: TAG
ttcagaagctgtctccgtcc

SEQ ID NO: 88034 - DNA, 20 bp, Artificial Sequence
  Description of Artificial Sequence: Synthetic oligonucleotide
  Target: ATXN1; (-) strand; PAM type: NRG; PAM sequence: AAG
atgtagactaagaacttcag

SEQ ID NO: 88035 - DNA, 20 bp, Artificial Sequence
  Description of Artificial Sequence: Synthetic oligonucleotide
  Target: ATXN1; (-) strand; PAM type: NRG; PAM sequence: CAG
tagatgtagactaagaactt

SEQ ID NO: 88036 - DNA, 20 bp, Artificial Sequence
  Description of Artificial Sequence: Synthetic oligonucleotide
  Target: ATXN1; (-) strand; PAM type: NRG; PAM sequence: AAG
aggcctgttagatgtagact

SEQ ID NO: 88037 - DNA, 20 bp, Artificial Sequence
  Description of Artificial Sequence: Synthetic oligonucleotide
  Target: ATXN1; (-) strand; PAM type: NRG; PAM sequence: TAG
aaagacaggcctgttagatg

SEQ ID NO: 88038 - DNA, 20 bp, Artificial Sequence
  Description of Artificial Sequence: Synthetic oligonucleotide
  Target: ATXN1; (-) strand; PAM type: NRG; PAM sequence: TAG
aggaggaaagacaggcctgt

SEQ ID NO: 88039 - DNA, 20 bp, Artificial Sequence
  Description of Artificial Sequence: Synthetic oligonucleotide
  Target: ATXN1; (-) strand; PAM type: NRG; PAM sequence: AGG
ccacagcaaggaggaaagac

SEQ ID NO: 88040 - DNA, 20 bp, Artificial Sequence
  Description of Artificial Sequence: Synthetic oligonucleotide
  Target: ATXN1; (-) strand; PAM type: NRG; PAM sequence: CAG
accacagcaaggaggaaaga

SEQ ID NO: 88041 - DNA, 20 bp, Artificial Sequence
  Description of Artificial Sequence: Synthetic oligonucleotide
  Target: ATXN1; (-) strand; PAM type: NRG; PAM sequence: AAG
gttaaccacagcaaggagga

SEQ ID NO: 88042 - DNA, 20 bp, Artificial Sequence
  Description of Artificial Sequence: Synthetic oligonucleotide
  Target: ATXN1; (-) strand; PAM type: NRG; PAM sequence: AGG
cagtgttaaccacagcaagg

SEQ ID NO: 88043 - DNA, 20 bp, Artificial Sequence
  Description of Artificial Sequence: Synthetic oligonucleotide
  Target: ATXN1; (-) strand; PAM type: NRG; PAM sequence: GAG
tcagtgttaaccacagcaag

SEQ ID NO: 88044 - DNA, 20 bp, Artificial Sequence
  Description of Artificial Sequence: Synthetic oligonucleotide
  Target: ATXN1; (-) strand; PAM type: NRG; PAM sequence: AGG
cttcagtgttaaccacagca

SEQ ID NO: 88045 - DNA, 20 bp, Artificial Sequence
  Description of Artificial Sequence: Synthetic oligonucleotide
  Target: ATXN1; (-) strand; PAM type: NRG; PAM sequence: AAG
acttcagtgttaaccacagc

SEQ ID NO: 88046 - DNA, 20 bp, Artificial Sequence
  Description of Artificial Sequence: Synthetic oligonucleotide
  Target: ATXN1; (-) strand; PAM type: NRG; PAM sequence: CAG
tagaacttcagtgttaacca

SEQ ID NO: 88047 - DNA, 20 bp, Artificial Sequence
  Description of Artificial Sequence: Synthetic oligonucleotide
  Target: ATXN1; (-) strand; PAM type: NRG; PAM sequence: CAG
taggacattttctagaactt

SEQ ID NO: 88048 - DNA, 20 bp, Artificial Sequence
  Description of Artificial Sequence: Synthetic oligonucleotide
  Target: ATXN1; (-) strand; PAM type: NRG; PAM sequence: TAG
ggtactaataggacattttc

SEQ ID NO: 88049 - DNA, 20 bp, Artificial Sequence
  Description of Artificial Sequence: Synthetic oligonucleotide
  Target: ATXN1; (-) strand; PAM type: NRG; PAM sequence: AGG
ctcaagatgaaggtactaat

SEQ ID NO: 88050 - DNA, 20 bp, Artificial Sequence
  Description of Artificial Sequence: Synthetic oligonucleotide
  Target: ATXN1; (-) strand; PAM type: NRG; PAM sequence: TAG
tctcaagatgaaggtactaa

SEQ ID NO: 88051 - DNA, 20 bp, Artificial Sequence
  Description of Artificial Sequence: Synthetic oligonucleotide
  Target: ATXN1; (-) strand; PAM type: NRG; PAM sequence: AGG
tcattcacctctcaagatga

SEQ ID NO: 88052 - DNA, 20 bp, Artificial Sequence
  Description of Artificial Sequence: Synthetic oligonucleotide
  Target: ATXN1; (-) strand; PAM type: NRG; PAM sequence: AAG
atcattcacctctcaagatg

SEQ ID NO: 88053 - DNA, 20 bp, Artificial Sequence
  Description of Artificial Sequence: Synthetic oligonucleotide
  Target: ATXN1; (-) strand; PAM type: NRG; PAM sequence: AAG
tcttaaatcattcacctctc

SEQ ID NO: 88054 - DNA, 20 bp, Artificial Sequence
  Description of Artificial Sequence: Synthetic oligonucleotide
  Target: ATXN1; (-) strand; PAM type: NRG; PAM sequence: CAG
gggtaaaataaaaataaata

SEQ ID NO: 88055 - DNA, 20 bp, Artificial Sequence
  Description of Artificial Sequence: Synthetic oligonucleotide
  Target: ATXN1; (-) strand; PAM type: NRG; PAM sequence: GGG
taactgcccaaatggacatt

SEQ ID NO: 88056 - DNA, 20 bp, Artificial Sequence
  Description of Artificial Sequence: Synthetic oligonucleotide
  Target: ATXN1; (-) strand; PAM type: NRG; PAM sequence: TGG
gtaactgcccaaatggacat

SEQ ID NO: 88057 - DNA, 20 bp, Artificial Sequence
  Description of Artificial Sequence: Synthetic oligonucleotide
  Target: ATXN1; (-) strand; PAM type: NRG; PAM sequence: TGG
aagtttagtaactgcccaaa

SEQ ID NO: 88058 - DNA, 20 bp, Artificial Sequence
  Description of Artificial Sequence: Synthetic oligonucleotide
  Target: ATXN1; (-) strand; PAM type: NRG; PAM sequence: TAG
ccaggctgcatttttaagtt

SEQ ID NO: 88059 - DNA, 20 bp, Artificial Sequence
  Description of Artificial Sequence: Synthetic oligonucleotide
  Target: ATXN1; (-) strand; PAM type: NRG; PAM sequence: AAG
attgcccaggctgcattttt

SEQ ID NO: 88060 - DNA, 20 bp, Artificial Sequence
  Description of Artificial Sequence: Synthetic oligonucleotide
  Target: ATXN1; (-) strand; PAM type: NRG; PAM sequence: AGG
agggtctcattccattgccc

SEQ ID NO: 88061 - DNA, 20 bp, Artificial Sequence
  Description of Artificial Sequence: Synthetic oligonucleotide
  Target: ATXN1; (-) strand; PAM type: NRG; PAM sequence: CAG
cagggtctcattccattgcc

SEQ ID NO: 88062 - DNA, 20 bp, Artificial Sequence
  Description of Artificial Sequence: Synthetic oligonucleotide
  Target: ATXN1; (-) strand; PAM type: NRG; PAM sequence: GGG
atttattttttgtaaagaca

SEQ ID NO: 88063 - DNA, 20 bp, Artificial Sequence
  Description of Artificial Sequence: Synthetic oligonucleotide
  Target: ATXN1; (-) strand; PAM type: NRG; PAM sequence: AGG
aatttattttttgtaaagac

SEQ ID NO: 88064 - DNA, 20 bp, Artificial Sequence
  Description of Artificial Sequence: Synthetic oligonucleotide
  Target: ATXN1; (-) strand; PAM type: NRG; PAM sequence: CAG
taatttattttttgtaaaga

SEQ ID NO: 88065 - DNA, 20 bp, Artificial Sequence
  Description of Artificial Sequence: Synthetic oligonucleotide
  Target: ATXN1; (-) strand; PAM type: NRG; PAM sequence: AAG
tttttaatttattttttgta

SEQ ID NO: 88066 - DNA, 20 bp, Artificial Sequence
  Description of Artificial Sequence: Synthetic oligonucleotide
  Target: ATXN1; (-) strand; PAM type: NRG; PAM sequence: CAG
ctgctgagtagctaggacta

SEQ ID NO: 88067 - DNA, 20 bp, Artificial Sequence
  Description of Artificial Sequence: Synthetic oligonucleotide
  Target: ATXN1; (-) strand; PAM type: NRG; PAM sequence: AGG
cctcagcctgctgagtagct

SEQ ID NO: 88068 - DNA, 20 bp, Artificial Sequence
  Description of Artificial Sequence: Synthetic oligonucleotide
  Target: ATXN1; (-) strand; PAM type: NRG; PAM sequence: TAG
gcctcagcctgctgagtagc

SEQ ID NO: 88069 - DNA, 20 bp, Artificial Sequence
  Description of Artificial Sequence: Synthetic oligonucleotide
  Target: ATXN1; (-) strand; PAM type: NRG; PAM sequence: TAG
tcccgcctcagcctgctgag

SEQ ID NO: 88070 - DNA, 20 bp, Artificial Sequence
  Description of Artificial Sequence: Synthetic oligonucleotide
  Target: ATXN1; (-) strand; PAM type: NRG; PAM sequence: GAG
tcctcccgcctcagcctgct

SEQ ID NO: 88071 - DNA, 20 bp, Artificial Sequence
  Description of Artificial Sequence: Synthetic oligonucleotide
  Target: ATXN1; (-) strand; PAM type: NRG; PAM sequence: CAG
ctccagtgatcctcccgcct

SEQ ID NO: 88072 - DNA, 20 bp, Artificial Sequence
  Description of Artificial Sequence: Synthetic oligonucleotide
  Target: ATXN1; (-) strand; PAM type: NRG; PAM sequence: CAG
agtgtcgaactcctgggctc

SEQ ID NO: 88073 - DNA, 20 bp, Artificial Sequence
  Description of Artificial Sequence: Synthetic oligonucleotide
  Target: ATXN1; (-) strand; PAM type: NRG; PAM sequence: GGG
cactgtagtgtcgaactcct

SEQ ID NO: 88074 - DNA, 20 bp, Artificial Sequence
  Description of Artificial Sequence: Synthetic oligonucleotide
  Target: ATXN1; (-) strand; PAM type: NRG; PAM sequence: TGG
tcactgtagtgtcgaactcc

SEQ ID NO: 88075 - DNA, 20 bp, Artificial Sequence
  Description of Artificial Sequence: Synthetic oligonucleotide
  Target: ATXN1; (-) strand; PAM type: NRG; PAM sequence: TAG
ggtgccatcatagctcactg

SEQ ID NO: 88076 - DNA, 20 bp, Artificial Sequence
  Description of Artificial Sequence: Synthetic oligonucleotide
  Target: ATXN1; (-) strand; PAM type: NRG; PAM sequence: TAG
agagggtagtggtgccatca

SEQ ID NO: 88077 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggccagagggtag

SEQ ID NO: 88078 - DNA, 20 bp, Artificial Sequence
  Description of Artificial Sequence: Synthetic oligonucleotide
  Target: ATXN1; (-) strand; PAM type: NRG; PAM sequence: TAG
ctgttgcccaggccagaggg

SEQ ID NO: 88079 - DNA, 20 bp, Artificial Sequence
  Description of Artificial Sequence: Synthetic oligonucleotide
  Target: ATXN1; (-) strand; PAM type: NRG; PAM sequence: GGG
actctgttgcccaggccaga

SEQ ID NO: 88080 - DNA, 20 bp, Artificial Sequence
  Description of Artificial Sequence: Synthetic oligonucleotide
  Target: ATXN1; (-) strand; PAM type: NRG; PAM sequence: AGG
cactctgttgcccaggccag

SEQ ID NO: 88081 - DNA, 20 bp, Artificial Sequence
  Description of Artificial Sequence: Synthetic oligonucleotide
  Target: ATXN1; (-) strand; PAM type: NRG; PAM sequence: GAG
tcactctgttgcccaggcca

SEQ ID NO: 88082 - DNA, 20 bp, Artificial Sequence
  Description of Artificial Sequence: Synthetic oligonucleotide
  Target: ATXN1; (-) strand; PAM type: NRG; PAM sequence: CAG
tctcactctgttgcccaggc

SEQ ID NO: 88083 - DNA, 20 bp, Artificial Sequence
  Description of Artificial Sequence: Synthetic oligonucleotide
  Target: ATXN1; (-) strand; PAM type: NRG; PAM sequence: AGG
agagtctcactctgttgccc

SEQ ID NO: 88084 - DNA, 20 bp, Artificial Sequence
  Description of Artificial Sequence: Synthetic oligonucleotide
  Target: ATXN1; (-) strand; PAM type: NRG; PAM sequence: CAG
cagagtctcactctgttgcc

SEQ ID NO: 88085 - DNA, 20 bp, Artificial Sequence
  Description of Artificial Sequence: Synthetic oligonucleotide
  Target: ATXN1; (-) strand; PAM type: NRG; PAM sequence: GAG
tatatatagagagagaaaca

SEQ ID NO: 88086 - DNA, 20 bp, Artificial Sequence
  Description of Artificial Sequence: Synthetic oligonucleotide
  Target: ATXN1; (-) strand; PAM type: NRG; PAM sequence: CAG
tgtatatatagagagagaaa

SEQ ID NO: 88087 - DNA, 20 bp, Artificial Sequence
  Description of Artificial Sequence: Synthetic oligonucleotide
  Target: ATXN1; (-) strand; PAM type: NRG; PAM sequence: GAG
tttatttgtatatatagaga

SEQ ID NO: 88088 - DNA, 20 bp, Artificial Sequence
  Description of Artificial Sequence: Synthetic oligonucleotide
  Target: ATXN1; (-) strand; PAM type: NRG; PAM sequence: GAG
tatttatttgtatatataga

SEQ ID NO: 88089 - DNA, 20 bp, Artificial Sequence
  Description of Artificial Sequence: Synthetic oligonucleotide
  Target: ATXN1; (-) strand; PAM type: NRG; PAM sequence: GAG
tttatttatttgtatatata

SEQ ID NO: 88090 - DNA, 20 bp, Artificial Sequence
  Description of Artificial Sequence: Synthetic oligonucleotide
  Target: ATXN1; (-) strand; PAM type: NRG; PAM sequence: TAG
catttatttatttgtatata

SEQ ID NO: 88091 - DNA, 20 bp, Artificial Sequence
  Description of Artificial Sequence: Synthetic oligonucleotide
  Target: ATXN1; (-) strand; PAM type: NRG; PAM sequence: CGG
atatataaagtaaggactgt

SEQ ID NO: 88092 - DNA, 20 bp, Artificial Sequence
  Description of Artificial Sequence: Synthetic oligonucleotide
  Target: ATXN1; (-) strand; PAM type: NRG; PAM sequence: AGG
agacattaatatataaagta

SEQ ID NO: 88093 - DNA, 20 bp, Artificial Sequence
  Description of Artificial Sequence: Synthetic oligonucleotide
  Target: ATXN1; (-) strand; PAM type: NRG; PAM sequence: AAG
aagacattaatatataaagt

SEQ ID NO: 88094 - DNA, 20 bp, Artificial Sequence
  Description of Artificial Sequence: Synthetic oligonucleotide
  Target: ATXN1; (-) strand; PAM type: NRG; PAM sequence: AAG
aaataagacattaatatata

SEQ ID NO: 88095 - DNA, 20 bp, Artificial Sequence
  Description of Artificial Sequence: Synthetic oligonucleotide
  Target: ATXN1; (-) strand; PAM type: NRG; PAM sequence: AAG
agagctgtccagggttaaat

SEQ ID NO: 88096 - DNA, 20 bp, Artificial Sequence
  Description of Artificial Sequence: Synthetic oligonucleotide
  Target: ATXN1; (-) strand; PAM type: NRG; PAM sequence: GGG
gagcccaggagagctgtcca

SEQ ID NO: 88097 - DNA, 20 bp, Artificial Sequence
  Description of Artificial Sequence: Synthetic oligonucleotide
  Target: ATXN1; (-) strand; PAM type: NRG; PAM sequence: AGG
agagcccaggagagctgtcc

SEQ ID NO: 88098 - DNA, 20 bp, Artificial Sequence
  Description of Artificial Sequence: Synthetic oligonucleotide
  Target: ATXN1; (-) strand; PAM type: NRG; PAM sequence: CAG
gagagcccaggagagctgtc

SEQ ID NO: 88099 - DNA, 20 bp, Artificial Sequence
  Description of Artificial Sequence: Synthetic oligonucleotide
  Target: ATXN1; (-) strand; PAM type: NRG; PAM sequence: GAG
aaggctaagagagcccagga

SEQ ID NO: 88100 - DNA, 20 bp, Artificial Sequence
  Description of Artificial Sequence: Synthetic oligonucleotide
  Target: ATXN1; (-) strand; PAM type: NRG; PAM sequence: GAG
tgaaggctaagagagcccag

SEQ ID NO: 88101 - DNA, 20 bp, Artificial Sequence
  Description of Artificial Sequence: Synthetic oligonucleotide
  Target: ATXN1; (-) strand; PAM type: NRG; PAM sequence: AGG
ggtgaaggctaagagagccc

SEQ ID NO: 88102 - DNA, 20 bp, Artificial Sequence
  Description of Artificial Sequence: Synthetic oligonucleotide
  Target: ATXN1; (-) strand; PAM type: NRG; PAM sequence: CAG
tggtgaaggctaagagagcc

SEQ ID NO: 88103 - DNA, 20 bp, Artificial Sequence
  Description of Artificial Sequence: Synthetic oligonucleotide
  Target: ATXN1; (-) strand; PAM type: NRG; PAM sequence: GAG
ctgagtggtgaaggctaaga

SEQ ID NO: 88104 - DNA, 20 bp, Artificial Sequence
  Description of Artificial Sequence: Synthetic oligonucleotide
  Target: ATXN1; (-) strand; PAM type: NRG; PAM sequence: GAG
ttctgagtggtgaaggctaa

SEQ ID NO: 88105 - DNA, 20 bp, Artificial Sequence
  Description of Artificial Sequence: Synthetic oligonucleotide
  Target: ATXN1; (-) strand; PAM type: NRG; PAM sequence: AAG
tgttctgagtggtgaaggct

SEQ ID NO: 88106 - DNA, 20 bp, Artificial Sequence
  Description of Artificial Sequence: Synthetic oligonucleotide
  Target: ATXN1; (-) strand; PAM type: NRG; PAM sequence: AGG
agccatgttctgagtggtga

SEQ ID NO: 88107 - DNA, 20 bp, Artificial Sequence
  Description of Artificial Sequence: Synthetic oligonucleotide
  Target: ATXN1; (-) strand; PAM type: NRG; PAM sequence: AAG
tagccatgttctgagtggtg

SEQ ID NO: 88108 - DNA, 20 bp, Artificial Sequence
  Description of Artificial Sequence: Synthetic oligonucleotide
  Target: ATXN1; (-) strand; PAM type: NRG; PAM sequence: TGG
attcatagccatgttctgag

SEQ ID NO: 88109 - DNA, 20 bp, Artificial Sequence
  Description of Artificial Sequence: Synthetic oligonucleotide
  Target: ATXN1; (-) strand; PAM type: NRG; PAM sequence: GAG
ggcattcatagccatgttct

SEQ ID NO: 88110 - DNA, 20 bp, Artificial Sequence
  Description of Artificial Sequence: Synthetic oligonucleotide
  Target: ATXN1; (-) strand; PAM type: NRG; PAM sequence: TAG
agtgtggcctgaggcattca

SEQ ID NO: 88111 - DNA, 20 bp, Artificial Sequence
  Description of Artificial Sequence: Synthetic oligonucleotide
  Target: ATXN1; (-) strand; PAM type: NRG; PAM sequence: AGG
cacctagccagtgtggcctg

SEQ ID NO: 88112 - DNA, 20 bp, Artificial Sequence
  Description of Artificial Sequence: Synthetic oligonucleotide
  Target: ATXN1; (-) strand; PAM type: NRG; PAM sequence: GAG
ccacctagccagtgtggcct

SEQ ID NO: 88113 - DNA, 20 bp, Artificial Sequence
  Description of Artificial Sequence: Synthetic oligonucleotide
  Target: ATXN1; (-) strand; PAM type: NRG; PAM sequence: TGG
ctctctccacctagccagtg

SEQ ID NO: 88114 - DNA, 20 bp, Artificial Sequence
  Description of Artificial Sequence: Synthetic oligonucleotide
  Target: ATXN1; (-) strand; PAM type: NRG; PAM sequence: CAG
cctagctctctccacctagc

SEQ ID NO: 88115 - DNA, 20 bp, Artificial Sequence
  Description of Artificial Sequence: Synthetic oligonucleotide
  Target: ATXN1; (-) strand; PAM type: NRG; PAM sequence: TAG
cattcctagctctctccacc

SEQ ID NO: 88116 - DNA, 20 bp, Artificial Sequence
  Description of Artificial Sequence: Synthetic oligonucleotide
  Target: ATXN1; (-) strand; PAM type: NRG; PAM sequence: TAG
tatacattaattctcattcc

SEQ ID NO: 88117 - DNA, 20 bp, Artificial Sequence
  Description of Artificial Sequence: Synthetic oligonucleotide
  Target: ATXN1; (-) strand; PAM type: NRG; PAM sequence: AAG
atcaatctgataaaatcact

SEQ ID NO: 88118 - DNA, 20 bp, Artificial Sequence
  Description of Artificial Sequence: Synthetic oligonucleotide
  Target: ATXN1; (-) strand; PAM type: NRG; PAM sequence: CAG
tctgtaaacttaagagaaac

SEQ ID NO: 88119 - DNA, 20 bp, Artificial Sequence
  Description of Artificial Sequence: Synthetic oligonucleotide
  Target: ATXN1; (-) strand; PAM type: NRG; PAM sequence: GAG
gcctatatctgtaaacttaa

SEQ ID NO: 88120 - DNA, 20 bp, Artificial Sequence
  Description of Artificial Sequence: Synthetic oligonucleotide
  Target: ATXN1; (-) strand; PAM type: NRG; PAM sequence: AAG
ttgcctatatctgtaaactt

SEQ ID NO: 88121 - DNA, 20 bp, Artificial Sequence
  Description of Artificial Sequence: Synthetic oligonucleotide
  Target: ATXN1; (-) strand; PAM type: NRG; PAM sequence: TGG
tctgtcctatctacttgtct

SEQ ID NO: 88122 - DNA, 20 bp, Artificial Sequence
  Description of Artificial Sequence: Synthetic oligonucleotide
  Target: ATXN1; (-) strand; PAM type: NRG; PAM sequence: CAG
cataattcttctcgatgcca

SEQ ID NO: 88123 - DNA, 20 bp, Artificial Sequence
  Description of Artificial Sequence: Synthetic oligonucleotide
  Target: ATXN1; (-) strand; PAM type: NRG; PAM sequence: AAG
gtagcgtcctgatgcctcaa

SEQ ID NO: 88124 - DNA, 20 bp, Artificial Sequence
  Description of Artificial Sequence: Synthetic oligonucleotide
  Target: ATXN1; (-) strand; PAM type: NRG; PAM sequence: TAG
aagttattacctcgacatag

SEQ ID NO: 88125 - DNA, 20 bp, Artificial Sequence
  Description of Artificial Sequence: Synthetic oligonucleotide
  Target: ATXN1; (-) strand; PAM type: NRG; PAM sequence: TAG
gtgaagttattacctcgaca

SEQ ID NO: 88126 - DNA, 20 bp, Artificial Sequence
  Description of Artificial Sequence: Synthetic oligonucleotide
  Target: ATXN1; (-) strand; PAM type: NRG; PAM sequence: AAG
gacttattgtcatttctgtg

SEQ ID NO: 88127 - DNA, 20 bp, Artificial Sequence
  Description of Artificial Sequence: Synthetic oligonucleotide
  Target: ATXN1; (-) strand; PAM type: NRG; PAM sequence: GAG
taatttaactttttttcttg

SEQ ID NO: 88128 - DNA, 20 bp, Artificial Sequence
  Description of Artificial Sequence: Synthetic oligonucleotide
  Target: ATXN1; (-) strand; PAM type: NRG; PAM sequence: TGG
tataatttaactttttttct

SEQ ID NO: 88129 - DNA, 20 bp, Artificial Sequence
  Description of Artificial Sequence: Synthetic oligonucleotide
  Target: ATXN1; (-) strand; PAM type: NRG; PAM sequence: TAG
ctaagtagagtgctactata

SEQ ID NO: 88130 - DNA, 20 bp, Artificial Sequence
  Description of Artificial Sequence: Synthetic oligonucleotide
  Target: ATXN1; (-) strand; PAM type: NRG; PAM sequence: GAG
atttcctcccttcctaagta

SEQ ID NO: 88131 - DNA, 20 bp, Artificial Sequence
  Description of Artificial Sequence: Synthetic oligonucleotide
  Target: ATXN1; (-) strand; PAM type: NRG; PAM sequence: TAG
aaatttcctcccttcctaag

SEQ ID NO: 88132 - DNA, 20 bp, Artificial Sequence
  Description of Artificial Sequence: Synthetic oligonucleotide
  Target: ATXN1; (-) strand; PAM type: NRG; PAM sequence: AAG
ataaaatttcctcccttcct

SEQ ID NO: 88133 - DNA, 20 bp, Artificial Sequence
  Description of Artificial Sequence: Synthetic oligonucleotide
  Target: ATXN1; (-) strand; PAM type: NRG; PAM sequence: CAG
gaaaactcaacattttccgg

SEQ ID NO: 88134 - DNA, 20 bp, Artificial Sequence
  Description of Artificial Sequence: Synthetic oligonucleotide
  Target: ATXN1; (-) strand; PAM type: NRG; PAM sequence: CGG
ggagaaaactcaacattttc

SEQ ID NO: 88135 - DNA, 20 bp, Artificial Sequence
  Description of Artificial Sequence: Synthetic oligonucleotide
  Target: ATXN1; (-) strand; PAM type: NRG; PAM sequence: GAG
gctgacattgttagaaaggg

SEQ ID NO: 88136 - DNA, 20 bp, Artificial Sequence
  Description of Artificial Sequence: Synthetic oligonucleotide
  Target: ATXN1; (-) strand; PAM type: NRG; PAM sequence: GGG
atgctgacattgttagaaag

SEQ ID NO: 88137 - DNA, 20 bp, Artificial Sequence
  Description of Artificial Sequence: Synthetic oligonucleotide
  Target: ATXN1; (-) strand; PAM type: NRG; PAM sequence: GGG
aatgctgacattgttagaaa

SEQ ID NO: 88138 - DNA, 20 bp, Artificial Sequence
  Description of Artificial Sequence: Synthetic oligonucleotide
  Target: ATXN1; (-) strand; PAM type: NRG; PAM sequence: AGG
taatgctgacattgttagaa

SEQ ID NO: 88139 - DNA, 20 bp, Artificial Sequence
  Description of Artificial Sequence: Synthetic oligonucleotide
  Target: ATXN1; (-) strand; PAM type: NRG; PAM sequence: AAG
ttaatgctgacattgttaga

SEQ ID NO: 88140 - DNA, 20 bp, Artificial Sequence
  Description of Artificial Sequence: Synthetic oligonucleotide
  Target: ATXN1; (-) strand; PAM type: NRG; PAM sequence: TAG
tgcattaatgctgacattgt

SEQ ID NO: 88141 - DNA, 20 bp, Artificial Sequence
  Description of Artificial Sequence: Synthetic oligonucleotide
  Target: ATXN1; (-) strand; PAM type: NRG; PAM sequence: CAG
ttccagatagtatatttact

SEQ ID NO: 88142 - DNA, 20 bp, Artificial Sequence
  Description of Artificial Sequence: Synthetic oligonucleotide
  Target: ATXN1; (-) strand; PAM type: NRG; PAM sequence: TAG
ctgaaataactgcttccaga

SEQ ID NO: 88143 - DNA, 20 bp, Artificial Sequence
  Description of Artificial Sequence: Synthetic oligonucleotide
  Target: ATXN1; (-) strand; PAM type: NRG; PAM sequence: CAG
actcctgaaataactgcttc

SEQ ID NO: 88144 - DNA, 20 bp, Artificial Sequence
  Description of Artificial Sequence: Synthetic oligonucleotide
  Target: ATXN1; (-) strand; PAM type: NRG; PAM sequence: TAG
gatttaaatatttaattttg

SEQ ID NO: 88145 - DNA, 20 bp, Artificial Sequence
  Description of Artificial Sequence: Synthetic oligonucleotide
  Target: ATXN1; (-) strand; PAM type: NRG; PAM sequence: AAG
acttccatatttctctagta

SEQ ID NO: 88146 - DNA, 20 bp, Artificial Sequence
  Description of Artificial Sequence: Synthetic oligonucleotide
  Target: ATXN1; (-) strand; PAM type: NRG; PAM sequence: TAG
ttcttacttccatatttctc

SEQ ID NO: 88147 - DNA, 20 bp, Artificial Sequence
  Description of Artificial Sequence: Synthetic oligonucleotide
  Target: ATXN1; (-) strand; PAM type: NRG; PAM sequence: GAG
tgcaaaaccgtaattcttaa

SEQ ID NO: 88148 - DNA, 20 bp, Artificial Sequence
  Description of Artificial Sequence: Synthetic oligonucleotide
  Target: ATXN1; (-) strand; PAM type: NRG; PAM sequence: AAG
aatgcaaaaccgtaattctt

SEQ ID NO: 88149 - DNA, 20 bp, Artificial Sequence
  Description of Artificial Sequence: Synthetic oligonucleotide
  Target: ATXN1; (-) strand; PAM type: NRG; PAM sequence: GAG
cataggttcctctctacaca

SEQ ID NO: 88150 - DNA, 20 bp, Artificial Sequence
  Description of Artificial Sequence: Synthetic oligonucleotide
  Target: ATXN1; (-) strand; PAM type: NRG; PAM sequence: CAG
atcataggttcctctctaca

SEQ ID NO: 88151 - DNA, 20 bp, Artificial Sequence
  Description of Artificial Sequence: Synthetic oligonucleotide
  Target: ATXN1; (-) strand; PAM type: NRG; PAM sequence: AGG
aatttattttttcccatcat

SEQ ID NO: 88152 - DNA, 20 bp, Artificial Sequence
  Description of Artificial Sequence: Synthetic oligonucleotide
  Target: ATXN1; (-) strand; PAM type: NRG; PAM sequence: TAG
aaatttattttttcccatca

SEQ ID NO: 88153 - DNA, 20 bp, Artificial Sequence
  Description of Artificial Sequence: Synthetic oligonucleotide
  Target: ATXN1; (-) strand; PAM type: NRG; PAM sequence: AGG
cactaaccagtaggtcaaaa

SEQ ID NO: 88154 - DNA, 20 bp, Artificial Sequence
  Description of Artificial Sequence: Synthetic oligonucleotide
  Target: ATXN1; (-) strand; PAM type: NRG; PAM sequence: AAG
gcactaaccagtaggtcaaa

SEQ ID NO: 88155 - DNA, 20 bp, Artificial Sequence
  Description of Artificial Sequence: Synthetic oligonucleotide
  Target: ATXN1; (-) strand; PAM type: NRG; PAM sequence: AGG
ttatgacagcactaaccagt

SEQ ID NO: 88156 - DNA, 20 bp, Artificial Sequence
  Description of Artificial Sequence: Synthetic oligonucleotide
  Target: ATXN1; (-) strand; PAM type: NRG; PAM sequence: TAG
tttatgacagcactaaccag

SEQ ID NO: 88157 - DNA, 20 bp, Artificial Sequence
  Description of Artificial Sequence: Synthetic oligonucleotide
  Target: ATXN1; (-) strand; PAM type: NRG; PAM sequence: CAG
ggctttatgacagcactaac

SEQ ID NO: 88158 - DNA, 20 bp, Artificial Sequence
  Description of Artificial Sequence: Synthetic oligonucleotide
  Target: ATXN1; (-) strand; PAM type: NRG; PAM sequence: CAG
aagctggaggggctttatga

SEQ ID NO: 88159 - DNA, 20 bp, Artificial Sequence
  Description of Artificial Sequence: Synthetic oligonucleotide
  Target: ATXN1; (-) strand; PAM type: NRG; PAM sequence: GGG
tcaggtcgcctaagctggag

SEQ ID NO: 88160 - DNA, 20 bp, Artificial Sequence
  Description of Artificial Sequence: Synthetic oligonucleotide
  Target: ATXN1; (-) strand; PAM type: NRG; PAM sequence: GGG
ctcaggtcgcctaagctgga

SEQ ID NO: 88161 - DNA, 20 bp, Artificial Sequence
  Description of Artificial Sequence: Synthetic oligonucleotide
  Target: ATXN1; (-) strand; PAM type: NRG; PAM sequence: AGG
tctcaggtcgcctaagctgg

SEQ ID NO: 88162 - DNA, 20 bp, Artificial Sequence
  Description of Artificial Sequence: Synthetic oligonucleotide
  Target: ATXN1; (-) strand; PAM type: NRG; PAM sequence: GAG
ctctcaggtcgcctaagctg

SEQ ID NO: 88163 - DNA, 20 bp, Artificial Sequence
  Description of Artificial Sequence: Synthetic oligonucleotide
  Target: ATXN1; (-) strand; PAM type: NRG; PAM sequence: TGG
ttctctcaggtcgcctaagc

SEQ ID NO: 88164 - DNA, 20 bp, Artificial Sequence
  Description of Artificial Sequence: Synthetic oligonucleotide
  Target: ATXN1; (-) strand; PAM type: NRG; PAM sequence: AAG
aaaattctctcaggtcgcct

SEQ ID NO: 88165 - DNA, 20 bp, Artificial Sequence
  Description of Artificial Sequence: Synthetic oligonucleotide
  Target: ATXN1; (-) strand; PAM type: NRG; PAM sequence: AGG
agggttttaaaaattctctc

SEQ ID NO: 88166 - DNA, 20 bp, Artificial Sequence
  Description of Artificial Sequence: Synthetic oligonucleotide
  Target: ATXN1; (-) strand; PAM type: NRG; PAM sequence: CAG
gagggttttaaaaattctct

SEQ ID NO: 88167 - DNA, 20 bp, Artificial Sequence
  Description of Artificial Sequence: Synthetic oligonucleotide
  Target: ATXN1; (-) strand; PAM type: NRG; PAM sequence: GGG
tttccactattctgaaaaga

SEQ ID NO: 88168 - DNA, 20 bp, Artificial Sequence
  Description of Artificial Sequence: Synthetic oligonucleotide
  Target: ATXN1; (-) strand; PAM type: NRG; PAM sequence: AGG
ttttccactattctgaaaag

SEQ ID NO: 88169 - DNA, 20 bp, Artificial Sequence
  Description of Artificial Sequence: Synthetic oligonucleotide
  Target: ATXN1; (-) strand; PAM type: NRG; PAM sequence: GAG
cttttccactattctgaaaa

SEQ ID NO: 88170 - DNA, 20 bp, Artificial Sequence
  Description of Artificial Sequence: Synthetic oligonucleotide
  Target: ATXN1; (-) strand; PAM type: NRG; PAM sequence: AAG
accttttccactattctgaa

SEQ ID NO: 88171 - DNA, 20 bp, Artificial Sequence
  Description of Artificial Sequence: Synthetic oligonucleotide
  Target: ATXN1; (-) strand; PAM type: NRG; PAM sequence: GAG
tctcttggaaatgagaaggg

SEQ ID NO: 88172 - DNA, 20 bp, Artificial Sequence
  Description of Artificial Sequence: Synthetic oligonucleotide
  Target: ATXN1; (-) strand; PAM type: NRG; PAM sequence: GGG
tttctcttggaaatgagaag

SEQ ID NO: 88173 - DNA, 20 bp, Artificial Sequence
  Description of Artificial Sequence: Synthetic oligonucleotide
  Target: ATXN1; (-) strand; PAM type: NRG; PAM sequence: GGG
ctttctcttggaaatgagaa

SEQ ID NO: 88174 - DNA, 20 bp, Artificial Sequence
  Description of Artificial Sequence: Synthetic oligonucleotide
  Target: ATXN1; (-) strand; PAM type: NRG; PAM sequence: AGG
cctttctcttggaaatgaga

SEQ ID NO: 88175 - DNA, 20 bp, Artificial Sequence
  Description of Artificial Sequence: Synthetic oligonucleotide
  Target: ATXN1; (-) strand; PAM type: NRG; PAM sequence: AAG
acctttctcttggaaatgag

SEQ ID NO: 88176 - DNA, 20 bp, Artificial Sequence
  Description of Artificial Sequence: Synthetic oligonucleotide
  Target: ATXN1; (-) strand; PAM type: NRG; PAM sequence: GAG
actacctttctcttggaaat

SEQ ID NO: 88177 - DNA, 20 bp, Artificial Sequence
  Description of Artificial Sequence: Synthetic oligonucleotide
  Target: ATXN1; (-) strand; PAM type: NRG; PAM sequence: TGG
ggtcaacactacctttctct

SEQ ID NO: 88178 - DNA, 20 bp, Artificial Sequence
  Description of Artificial Sequence: Synthetic oligonucleotide
  Target: ATXN1; (-) strand; PAM type: NRG; PAM sequence: GGG
ttttcctctcttagctttta

SEQ ID NO: 88179 - DNA, 20 bp, Artificial Sequence
  Description of Artificial Sequence: Synthetic oligonucleotide
  Target: ATXN1; (-) strand; PAM type: NRG; PAM sequence: AGG
cttttcctctcttagctttt

SEQ ID NO: 88180 - DNA, 20 bp, Artificial Sequence
  Description of Artificial Sequence: Synthetic oligonucleotide
  Target: ATXN1; (-) strand; PAM type: NRG; PAM sequence: TAG
tcttttcctctcttagcttt

SEQ ID NO: 88181 - DNA, 20 bp, Artificial Sequence
  Description of Artificial Sequence: Synthetic oligonucleotide
  Target: ATXN1; (-) strand; PAM type: NRG; PAM sequence: TAG
catctagtcttttcctctct

SEQ ID NO: 88182 - DNA, 20 bp, Artificial Sequence
  Description of Artificial Sequence: Synthetic oligonucleotide
  Target: ATXN1; (-) strand; PAM type: NRG; PAM sequence: TAG
aggattccacaacacacatc

SEQ ID NO: 88183 - DNA, 20 bp, Artificial Sequence
  Description of Artificial Sequence: Synthetic oligonucleotide
  Target: ATXN1; (-) strand; PAM type: NRG; PAM sequence: AGG
agagaaagaagagtcgagaa

SEQ ID NO: 88184 - DNA, 20 bp, Artificial Sequence
  Description of Artificial Sequence: Synthetic oligonucleotide
  Target: ATXN1; (-) strand; PAM type: NRG; PAM sequence: AAG
tagagaaagaagagtcgaga

SEQ ID NO: 88185 - DNA, 20 bp, Artificial Sequence
  Description of Artificial Sequence: Synthetic oligonucleotide
  Target: ATXN1; (-) strand; PAM type: NRG; PAM sequence: GAG
atattagagaaagaagagtc

SEQ ID NO: 88186 - DNA, 20 bp, Artificial Sequence
  Description of Artificial Sequence: Synthetic oligonucleotide
  Target: ATXN1; (-) strand; PAM type: NRG; PAM sequence: GAG
caagaatattagagaaagaa

SEQ ID NO: 88187 - DNA, 20 bp, Artificial Sequence
  Description of Artificial Sequence: Synthetic oligonucleotide
  Target: ATXN1; (-) strand; PAM type: NRG; PAM sequence: AAG
agcaagaatattagagaaag

SEQ ID NO: 88188 - DNA, 20 bp, Artificial Sequence
  Description of Artificial Sequence: Synthetic oligonucleotide
  Target: ATXN1; (-) strand; PAM type: NRG; PAM sequence: AAG
tatagcaagaatattagaga

SEQ ID NO: 88189 - DNA, 20 bp, Artificial Sequence
  Description of Artificial Sequence: Synthetic oligonucleotide
  Target: ATXN1; (-) strand; PAM type: NRG; PAM sequence: GAG
tttatatagcaagaatatta

SEQ ID NO: 88190 - DNA, 20 bp, Artificial Sequence
  Description of Artificial Sequence: Synthetic oligonucleotide
  Target: ATXN1; (-) strand; PAM type: NRG; PAM sequence: TAG
tgtttatatagcaagaatat

SEQ ID NO: 88191 - DNA, 20 bp, Artificial Sequence
  Description of Artificial Sequence: Synthetic oligonucleotide
  Target: ATXN1; (-) strand; PAM type: NRG; PAM sequence: AAG
aactaccatgtttatatagc

SEQ ID NO: 88192 - DNA, 20 bp, Artificial Sequence
  Description of Artificial Sequence: Synthetic oligonucleotide
  Target: ATXN1; (-) strand; PAM type: NRG; PAM sequence: TAG
atggaactaccatgtttata

SEQ ID NO: 88193 - DNA, 20 bp, Artificial Sequence
  Description of Artificial Sequence: Synthetic oligonucleotide
  Target: ATXN1; (-) strand; PAM type: NRG; PAM sequence: TGG
ttccttaaaactcttactga

SEQ ID NO: 88194 - DNA, 20 bp, Artificial Sequence
  Description of Artificial Sequence: Synthetic oligonucleotide
  Target: ATXN1; (-) strand; PAM type: NRG; PAM sequence: AAG
tggtgtcccaaagagtgagc

SEQ ID NO: 88195 - DNA, 20 bp, Artificial Sequence
  Description of Artificial Sequence: Synthetic oligonucleotide
  Target: ATXN1; (-) strand; PAM type: NRG; PAM sequence: GAG
agtgtggtgtcccaaagagt

SEQ ID NO: 88196 - DNA, 20 bp, Artificial Sequence
  Description of Artificial Sequence: Synthetic oligonucleotide
  Target: ATXN1; (-) strand; PAM type: NRG; PAM sequence: GAG
tgacagtgtggtgtcccaaa

SEQ ID NO: 88197 - DNA, 20 bp, Artificial Sequence
  Description of Artificial Sequence: Synthetic oligonucleotide
  Target: ATXN1; (-) strand; PAM type: NRG; PAM sequence: AAG
tgtgacagtgtggtgtccca

SEQ ID NO: 88198 - DNA, 20 bp, Artificial Sequence
  Description of Artificial Sequence: Synthetic oligonucleotide
  Target: ATXN1; (-) strand; PAM type: NRG; PAM sequence: TGG
tgctactcattgtgacagtg

SEQ ID NO: 88199 - DNA, 20 bp, Artificial Sequence
  Description of Artificial Sequence: Synthetic oligonucleotide
  Target: ATXN1; (-) strand; PAM type: NRG; PAM sequence: CAG
gttggtgctactcattgtga

SEQ ID NO: 88200 - DNA, 20 bp, Artificial Sequence
  Description of Artificial Sequence: Synthetic oligonucleotide
  Target: ATXN1; (-) strand; PAM type: NRG; PAM sequence: TGG
ccactgtaacgtggtggtgt

SEQ ID NO: 88201 - DNA, 20 bp, Artificial Sequence
  Description of Artificial Sequence: Synthetic oligonucleotide
  Target: ATXN1; (-) strand; PAM type: NRG; PAM sequence: TGG
gcgtttccactgtaacgtgg

SEQ ID NO: 88202 - DNA, 20 bp, Artificial Sequence
  Description of Artificial Sequence: Synthetic oligonucleotide
  Target: ATXN1; (-) strand; PAM type: NRG; PAM sequence: TGG
gtggcgtttccactgtaacg

SEQ ID NO: 88203 - DNA, 20 bp, Artificial Sequence
  Description of Artificial Sequence: Synthetic oligonucleotide
  Target: ATXN1; (-) strand; PAM type: NRG; PAM sequence: TGG
ctctgttactagctccactg

SEQ ID NO: 88204 - DNA, 20 bp, Artificial Sequence
  Description of Artificial Sequence: Synthetic oligonucleotide
  Target: ATXN1; (-) strand; PAM type: NRG; PAM sequence: TAG
taatactaacactctgttac

SEQ ID NO: 88205 - DNA, 20 bp, Artificial Sequence
  Description of Artificial Sequence: Synthetic oligonucleotide
  Target: ATXN1; (-) strand; PAM type: NRG; PAM sequence: AGG
ttcacctaaattgcaccagc

SEQ ID NO: 88206 - DNA, 20 bp, Artificial Sequence
  Description of Artificial Sequence: Synthetic oligonucleotide
  Target: ATXN1; (-) strand; PAM type: NRG; PAM sequence: CAG
attcacctaaattgcaccag

SEQ ID NO: 88207 - DNA, 20 bp, Artificial Sequence
  Description of Artificial Sequence: Synthetic oligonucleotide
  Target: ATXN1; (-) strand; PAM type: NRG; PAM sequence: CAG
gaaattcacctaaattgcac

SEQ ID NO: 88208 - DNA, 20 bp, Artificial Sequence
  Description of Artificial Sequence: Synthetic oligonucleotide
  Target: ATXN1; (-) strand; PAM type: NRG; PAM sequence: TGG
aactaatatatgttctgtta

SEQ ID NO: 88209 - DNA, 20 bp, Artificial Sequence
  Description of Artificial Sequence: Synthetic oligonucleotide
  Target: ATXN1; (-) strand; PAM type: NRG; PAM sequence: AAG
ttttcccaattcataatcta

SEQ ID NO: 88210 - DNA, 20 bp, Artificial Sequence
  Description of Artificial Sequence: Synthetic oligonucleotide
  Target: ATXN1; (-) strand; PAM type: NRG; PAM sequence: AGG
aatatgctaataatatgcta

SEQ ID NO: 88211 - DNA, 20 bp, Artificial Sequence
  Description of Artificial Sequence: Synthetic oligonucleotide
  Target: ATXN1; (-) strand; PAM type: NRG; PAM sequence: AAG
taatatgctaataatatgct

SEQ ID NO: 88212 - DNA, 20 bp, Artificial Sequence
  Description of Artificial Sequence: Synthetic oligonucleotide
  Target: ATXN1; (-) strand; PAM type: NRG; PAM sequence: TAG
ggcaaaaacttacttgtaat

SEQ ID NO: 88213 - DNA, 20 bp, Artificial Sequence
  Description of Artificial Sequence: Synthetic oligonucleotide
  Target: ATXN1; (-) strand; PAM type: NRG; PAM sequence: TGG
agtggaaattataagtttgg

SEQ ID NO: 88214 - DNA, 20 bp, Artificial Sequence
  Description of Artificial Sequence: Synthetic oligonucleotide
  Target: ATXN1; (-) strand; PAM type: NRG; PAM sequence: TGG
agaagtggaaattataagtt

SEQ ID NO: 88215 - DNA, 20 bp, Artificial Sequence
  Description of Artificial Sequence: Synthetic oligonucleotide
  Target: ATXN1; (-) strand; PAM type: NRG; PAM sequence: AAG
gttgaagaagtggaaattat

SEQ ID NO: 88216 - DNA, 20 bp, Artificial Sequence
  Description of Artificial Sequence: Synthetic oligonucleotide
  Target: ATXN1; (-) strand; PAM type: NRG; PAM sequence: TGG
caaacagatagttgaagaag

SEQ ID NO: 88217 - DNA, 20 bp, Artificial Sequence
  Description of Artificial Sequence: Synthetic oligonucleotide
  Target: ATXN1; (-) strand; PAM type: NRG; PAM sequence: AAG
aagcaaacagatagttgaag

SEQ ID NO: 88218 - DNA, 20 bp, Artificial Sequence
  Description of Artificial Sequence: Synthetic oligonucleotide
  Target: ATXN1; (-) strand; PAM type: NRG; PAM sequence: AAG
aaaaagcaaacagatagttg

SEQ ID NO: 88219 - DNA, 20 bp, Artificial Sequence
  Description of Artificial Sequence: Synthetic oligonucleotide
  Target: ATXN1; (-) strand; PAM type: NRG; PAM sequence: TAG
agggtaaaaaagcaaacaga

SEQ ID NO: 88220 - DNA, 20 bp, Artificial Sequence
  Description of Artificial Sequence: Synthetic oligonucleotide
  Target: ATXN1; (-) strand; PAM type: NRG; PAM sequence: CAG
tccaagggtaaaaaagcaaa

SEQ ID NO: 88221 - DNA, 20 bp, Artificial Sequence
  Description of Artificial Sequence: Synthetic oligonucleotide
  Target: ATXN1; (-) strand; PAM type: NRG; PAM sequence: AAG
agacaagtccaagggtaaaa

SEQ ID NO: 88222 - DNA, 20 bp, Artificial Sequence
  Description of Artificial Sequence: Synthetic oligonucleotide
  Target: ATXN1; (-) strand; PAM type: NRG; PAM sequence: GGG
agagtcttagacaagtccaa

SEQ ID NO: 88223 - DNA, 20 bp, Artificial Sequence
  Description of Artificial Sequence: Synthetic oligonucleotide
  Target: ATXN1; (-) strand; PAM type: NRG; PAM sequence: AGG
tagagtcttagacaagtcca

SEQ ID NO: 88224 - DNA, 20 bp, Artificial Sequence
  Description of Artificial Sequence: Synthetic oligonucleotide
  Target: ATXN1; (-) strand; PAM type: NRG; PAM sequence: AAG
gtagagtcttagacaagtcc

SEQ ID NO: 88225 - DNA, 20 bp, Artificial Sequence
  Description of Artificial Sequence: Synthetic oligonucleotide
  Target: ATXN1; (-) strand; PAM type: NRG; PAM sequence: AAG
gcctgagtagagtcttagac

SEQ ID NO: 88226 - DNA, 20 bp, Artificial Sequence
  Description of Artificial Sequence: Synthetic oligonucleotide
  Target: ATXN1; (-) strand; PAM type: NRG; PAM sequence: TAG
agaaggcctgagtagagtct

SEQ ID NO: 88227 - DNA, 20 bp, Artificial Sequence
  Description of Artificial Sequence: Synthetic oligonucleotide
  Target: ATXN1; (-) strand; PAM type: NRG; PAM sequence: GAG
gggaagagaaggcctgagta

SEQ ID NO: 88228 - DNA, 20 bp, Artificial Sequence
  Description of Artificial Sequence: Synthetic oligonucleotide
  Target: ATXN1; (-) strand; PAM type: NRG; PAM sequence: TAG
aagggaagagaaggcctgag

SEQ ID NO: 88229 - DNA, 20 bp, Artificial Sequence
  Description of Artificial Sequence: Synthetic oligonucleotide
  Target: ATXN1; (-) strand; PAM type: NRG; PAM sequence: GAG
ttgaagggaagagaaggcct

SEQ ID NO: 88230 - DNA, 20 bp, Artificial Sequence
  Description of Artificial Sequence: Synthetic oligonucleotide
  Target: ATXN1; (-) strand; PAM type: NRG; PAM sequence: AGG
tgggatttgaagggaagaga

SEQ ID NO: 88231 - DNA, 20 bp, Artificial Sequence
  Description of Artificial Sequence: Synthetic oligonucleotide
  Target: ATXN1; (-) strand; PAM type: NRG; PAM sequence: AAG
ctgggatttgaagggaagag

SEQ ID NO: 88232 - DNA, 20 bp, Artificial Sequence
  Description of Artificial Sequence: Synthetic oligonucleotide
  Target: ATXN1; (-) strand; PAM type: NRG; PAM sequence: GAG
taactgggatttgaagggaa

SEQ ID NO: 88233 - DNA, 20 bp, Artificial Sequence
  Description of Artificial Sequence: Synthetic oligonucleotide
  Target: ATXN1; (-) strand; PAM type: NRG; PAM sequence: AAG
cttaactgggatttgaaggg

SEQ ID NO: 88234 - DNA, 20 bp, Artificial Sequence
  Description of Artificial Sequence: Synthetic oligonucleotide
  Target: ATXN1; (-) strand; PAM type: NRG; PAM sequence: GGG
ctccttaactgggatttgaa

SEQ ID NO: 88235 - DNA, 20 bp, Artificial Sequence
  Description of Artificial Sequence: Synthetic oligonucleotide
  Target: ATXN1; (-) strand; PAM type: NRG; PAM sequence: AGG
tctccttaactgggatttga

SEQ ID NO: 88236 - DNA, 20 bp, Artificial Sequence
  Description of Artificial Sequence: Synthetic oligonucleotide
  Target: ATXN1; (-) strand; PAM type: NRG; PAM sequence: AAG
gtctccttaactgggatttg

SEQ ID NO: 88237 - DNA, 20 bp, Artificial Sequence
  Description of Artificial Sequence: Synthetic oligonucleotide
  Target: ATXN1; (-) strand; PAM type: NRG; PAM sequence: GGG
taaatggcgtctccttaact

SEQ ID NO: 88238 - DNA, 20 bp, Artificial Sequence
  Description of Artificial Sequence: Synthetic oligonucleotide
  Target: ATXN1; (-) strand; PAM type: NRG; PAM sequence: TGG
ctaaatggcgtctccttaac

SEQ ID NO: 88239 - DNA, 20 bp, Artificial Sequence
  Description of Artificial Sequence: Synthetic oligonucleotide
  Target: ATXN1; (-) strand; PAM type: NRG; PAM sequence: TGG
atcaacagctatattctaaa

SEQ ID NO: 88240 - DNA, 20 bp, Artificial Sequence
  Description of Artificial Sequence: Synthetic oligonucleotide
  Target: ATXN1; (-) strand; PAM type: NRG; PAM sequence: CAG
ctgttaaaaagatgaatcaa

SEQ ID NO: 88241 - DNA, 20 bp, Artificial Sequence
  Description of Artificial Sequence: Synthetic oligonucleotide
  Target: ATXN1; (-) strand; PAM type: NRG; PAM sequence: AAG
aaaaaaagagtgctgttaaa

SEQ ID NO: 88242 - DNA, 20 bp, Artificial Sequence
  Description of Artificial Sequence: Synthetic oligonucleotide
  Target: ATXN1; (-) strand; PAM type: NRG; PAM sequence: GAG
tttttgtaccaaaaaaaaaa

SEQ ID NO: 88243 - DNA, 20 bp, Artificial Sequence
  Description of Artificial Sequence: Synthetic oligonucleotide
  Target: ATXN1; (-) strand; PAM type: NRG; PAM sequence: AAG
gatttttgtaccaaaaaaaa

SEQ ID NO: 88244 - DNA, 20 bp, Artificial Sequence
  Description of Artificial Sequence: Synthetic oligonucleotide
  Target: ATXN1; (-) strand; PAM type: NRG; PAM sequence: GAG
tggaaagaagaaaagcccta

SEQ ID NO: 88245 - DNA, 20 bp, Artificial Sequence
  Description of Artificial Sequence: Synthetic oligonucleotide
  Target: ATXN1; (-) strand; PAM type: NRG; PAM sequence: TAG
agtggaaagaagaaaagccc

SEQ ID NO: 88246 - DNA, 20 bp, Artificial Sequence
  Description of Artificial Sequence: Synthetic oligonucleotide
  Target: ATXN1; (-) strand; PAM type: NRG; PAM sequence: AAG
gatttaagtggaaagaagaa

SEQ ID NO: 88247 - DNA, 20 bp, Artificial Sequence
  Description of Artificial Sequence: Synthetic oligonucleotide
  Target: ATXN1; (-) strand; PAM type: NRG; PAM sequence: AAG
aaaaggatttaagtggaaag

SEQ ID NO: 88248 - DNA, 20 bp, Artificial Sequence
  Description of Artificial Sequence: Synthetic oligonucleotide
  Target: ATXN1; (-) strand; PAM type: NRG; PAM sequence: AAG
ggaaaaaggatttaagtgga

SEQ ID NO: 88249 - DNA, 20 bp, Artificial Sequence
  Description of Artificial Sequence: Synthetic oligonucleotide
  Target: ATXN1; (-) strand; PAM type: NRG; PAM sequence: TGG
ggtgggaaaaaggatttaag

SEQ ID NO: 88250 - DNA, 20 bp, Artificial Sequence
  Description of Artificial Sequence: Synthetic oligonucleotide
  Target: ATXN1; (-) strand; PAM type: NRG; PAM sequence: AAG
ctgggtgggaaaaaggattt

SEQ ID NO: 88251 - DNA, 20 bp, Artificial Sequence
  Description of Artificial Sequence: Synthetic oligonucleotide
  Target: ATXN1; (-) strand; PAM type: NRG; PAM sequence: AGG
gagagcactgggtgggaaaa

SEQ ID NO: 88252 - DNA, 20 bp, Artificial Sequence
  Description of Artificial Sequence: Synthetic oligonucleotide
  Target: ATXN1; (-) strand; PAM type: NRG; PAM sequence: AAG
agagagcactgggtgggaaa

SEQ ID NO: 88253 - DNA, 20 bp, Artificial Sequence
  Description of Artificial Sequence: Synthetic oligonucleotide
  Target: ATXN1; (-) strand; PAM type: NRG; PAM sequence: GGG
ctcttcagagagcactgggt

SEQ ID NO: 88254 - DNA, 20 bp, Artificial Sequence
  Description of Artificial Sequence: Synthetic oligonucleotide
  Target: ATXN1; (-) strand; PAM type: NRG; PAM sequence: TGG
gctcttcagagagcactggg

SEQ ID NO: 88255 - DNA, 20 bp, Artificial Sequence
  Description of Artificial Sequence: Synthetic oligonucleotide
  Target: ATXN1; (-) strand; PAM type: NRG; PAM sequence: GGG
ttagctcttcagagagcact

SEQ ID NO: 88256 - DNA, 20 bp, Artificial Sequence
  Description of Artificial Sequence: Synthetic oligonucleotide
  Target: ATXN1; (-) strand; PAM type: NRG; PAM sequence: TGG
cttagctcttcagagagcac

SEQ ID NO: 88257 - DNA, 20 bp, Artificial Sequence
  Description of Artificial Sequence: Synthetic oligonucleotide
  Target: ATXN1; (-) strand; PAM type: NRG; PAM sequence: GAG
gttagccttagctcttcaga

SEQ ID NO: 88258 - DNA, 20 bp, Artificial Sequence
  Description of Artificial Sequence: Synthetic oligonucleotide
  Target: ATXN1; (-) strand; PAM type: NRG; PAM sequence: GAG
aagttagccttagctcttca

SEQ ID NO: 88259 - DNA, 20 bp, Artificial Sequence
  Description of Artificial Sequence: Synthetic oligonucleotide
  Target: ATXN1; (-) strand; PAM type: NRG; PAM sequence: CAG
aaaagttagccttagctctt

SEQ ID NO: 88260 - DNA, 20 bp, Artificial Sequence
  Description of Artificial Sequence: Synthetic oligonucleotide
  Target: ATXN1; (-) strand; PAM type: NRG; PAM sequence: TAG
gaaaaggaaaaagttagcct

SEQ ID NO: 88261 - DNA, 20 bp, Artificial Sequence
  Description of Artificial Sequence: Synthetic oligonucleotide
  Target: ATXN1; (-) strand; PAM type: NRG; PAM sequence: TAG
tctttagaaaaggaaaaagt

SEQ ID NO: 88262 - DNA, 20 bp, Artificial Sequence
  Description of Artificial Sequence: Synthetic oligonucleotide
  Target: ATXN1; (-) strand; PAM type: NRG; PAM sequence: AAG
aagatctttagaaaaggaaa

SEQ ID NO: 88263 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaagatctttagaaa

SEQ ID NO: 88264 - DNA, 20 bp, Artificial Sequence
  Description of Artificial Sequence: Synthetic oligonucleotide
  Target: ATXN1; (-) strand; PAM type: NRG; PAM sequence: AAG
gaaaaaaaagatctttagaa

SEQ ID NO: 88265 - DNA, 20 bp, Artificial Sequence
  Description of Artificial Sequence: Synthetic oligonucleotide
  Target: ATXN1; (-) strand; PAM type: NRG; PAM sequence: TAG
cataggaaaaaaaagatctt

SEQ ID NO: 88266 - DNA, 20 bp, Artificial Sequence
  Description of Artificial Sequence: Synthetic oligonucleotide
  Target: ATXN1; (-) strand; PAM type: NRG; PAM sequence: AAG
ggaaacagcataggaaaaaa

SEQ ID NO: 88267 - DNA, 20 bp, Artificial Sequence
  Description of Artificial Sequence: Synthetic oligonucleotide
  Target: ATXN1; (-) strand; PAM type: NRG; PAM sequence: AGG
gaactatggggaaacagcat

SEQ ID NO: 88268 - DNA, 20 bp, Artificial Sequence
  Description of Artificial Sequence: Synthetic oligonucleotide
  Target: ATXN1; (-) strand; PAM type: NRG; PAM sequence: TAG
ggaactatggggaaacagca

SEQ ID NO: 88269 - DNA, 20 bp, Artificial Sequence
  Description of Artificial Sequence: Synthetic oligonucleotide
  Target: ATXN1; (-) strand; PAM type: NRG; PAM sequence: CAG
cgggtggaactatggggaaa

SEQ ID NO: 88270 - DNA, 20 bp, Artificial Sequence
  Description of Artificial Sequence: Synthetic oligonucleotide
  Target: ATXN1; (-) strand; PAM type: NRG; PAM sequence: GGG
gaggggcgggtggaactatg

SEQ ID NO: 88271 - DNA, 20 bp, Artificial Sequence
  Description of Artificial Sequence: Synthetic oligonucleotide
  Target: ATXN1; (-) strand; PAM type: NRG; PAM sequence: GGG
ggaggggcgggtggaactat

SEQ ID NO: 88272 - DNA, 20 bp, Artificial Sequence
  Description of Artificial Sequence: Synthetic oligonucleotide
  Target: ATXN1; (-) strand; PAM type: NRG; PAM sequence: TGG
gggaggggcgggtggaacta

SEQ ID NO: 88273 - DNA, 20 bp, Artificial Sequence
  Description of Artificial Sequence: Synthetic oligonucleotide
  Target: ATXN1; (-) strand; PAM type: NRG; PAM sequence: TGG
gagggtgggggaggggcggg

SEQ ID NO: 88274 - DNA, 20 bp, Artificial Sequence
  Description of Artificial Sequence: Synthetic oligonucleotide
  Target: ATXN1; (-) strand; PAM type: NRG; PAM sequence: GGG
gaagagggtgggggaggggc

SEQ ID NO: 88275 - DNA, 20 bp, Artificial Sequence
  Description of Artificial Sequence: Synthetic oligonucleotide
  Target: ATXN1; (-) strand; PAM type: NRG; PAM sequence: CGG
tgaagagggtgggggagggg

SEQ ID NO: 88276 - DNA, 20 bp, Artificial Sequence
  Description of Artificial Sequence: Synthetic oligonucleotide
  Target: ATXN1; (-) strand; PAM type: NRG; PAM sequence: GGG
acatgaagagggtgggggag

SEQ ID NO: 88277 - DNA, 20 bp, Artificial Sequence
  Description of Artificial Sequence: Synthetic oligonucleotide
  Target: ATXN1; (-) strand; PAM type: NRG; PAM sequence: GGG
gacatgaagagggtggggga

SEQ ID NO: 88278 - DNA, 20 bp, Artificial Sequence
  Description of Artificial Sequence: Synthetic oligonucleotide
  Target: ATXN1; (-) strand; PAM type: NRG; PAM sequence: AGG
agacatgaagagggtggggg

SEQ ID NO: 88279 - DNA, 20 bp, Artificial Sequence
  Description of Artificial Sequence: Synthetic oligonucleotide
  Target: ATXN1; (-) strand; PAM type: NRG; PAM sequence: GAG
gagacatgaagagggtgggg

SEQ ID NO: 88280 - DNA, 20 bp, Artificial Sequence
  Description of Artificial Sequence: Synthetic oligonucleotide
  Target: ATXN1; (-) strand; PAM type: NRG; PAM sequence: GGG
atgagacatgaagagggtgg

SEQ ID NO: 88281 - DNA, 20 bp, Artificial Sequence
  Description of Artificial Sequence: Synthetic oligonucleotide
  Target: ATXN1; (-) strand; PAM type: NRG; PAM sequence: GGG
tatgagacatgaagagggtg

SEQ ID NO: 88282 - DNA, 20 bp, Artificial Sequence
  Description of Artificial Sequence: Synthetic oligonucleotide
  Target: ATXN1; (-) strand; PAM type: NRG; PAM sequence: GGG
atatgagacatgaagagggt

SEQ ID NO: 88283 - DNA, 20 bp, Artificial Sequence
  Description of Artificial Sequence: Synthetic oligonucleotide
  Target: ATXN1; (-) strand; PAM type: NRG; PAM sequence: TGG
tatatgagacatgaagaggg

SEQ ID NO: 88284 - DNA, 20 bp, Artificial Sequence
  Description of Artificial Sequence: Synthetic oligonucleotide
  Target: ATXN1; (-) strand; PAM type: NRG; PAM sequence: GGG
ttttatatgagacatgaaga

SEQ ID NO: 88285 - DNA, 20 bp, Artificial Sequence
  Description of Artificial Sequence: Synthetic oligonucleotide
  Target: ATXN1; (-) strand; PAM type: NRG; PAM sequence: AGG
tttttatatgagacatgaag

SEQ ID NO: 88286 - DNA, 20 bp, Artificial Sequence
  Description of Artificial Sequence: Synthetic oligonucleotide
  Target: ATXN1; (-) strand; PAM type: NRG; PAM sequence: GAG
gtttttatatgagacatgaa

SEQ ID NO: 88287 - DNA, 20 bp, Artificial Sequence
  Description of Artificial Sequence: Synthetic oligonucleotide
  Target: ATXN1; (-) strand; PAM type: NRG; PAM sequence: AAG
ctgtttttatatgagacatg

SEQ ID NO: 88288 - DNA, 20 bp, Artificial Sequence
  Description of Artificial Sequence: Synthetic oligonucleotide
  Target: ATXN1; (-) strand; PAM type: NRG; PAM sequence: GAG
tgagagtgctgtttttatat

SEQ ID NO: 88289 - DNA, 20 bp, Artificial Sequence
  Description of Artificial Sequence: Synthetic oligonucleotide
  Target: ATXN1; (-) strand; PAM type: NRG; PAM sequence: GAG
ttggggattaagcccagtga

SEQ ID NO: 88290 - DNA, 20 bp, Artificial Sequence
  Description of Artificial Sequence: Synthetic oligonucleotide
  Target: ATXN1; (-) strand; PAM type: NRG; PAM sequence: GAG
atttggggattaagcccagt

SEQ ID NO: 88291 - DNA, 20 bp, Artificial Sequence
  Description of Artificial Sequence: Synthetic oligonucleotide
  Target: ATXN1; (-) strand; PAM type: NRG; PAM sequence: CAG
aaacatttggggattaagcc

SEQ ID NO: 88292 - DNA, 20 bp, Artificial Sequence
  Description of Artificial Sequence: Synthetic oligonucleotide
  Target: ATXN1; (-) strand; PAM type: NRG; PAM sequence: AAG
attaaaaacatttggggatt

SEQ ID NO: 88293 - DNA, 20 bp, Artificial Sequence
  Description of Artificial Sequence: Synthetic oligonucleotide
  Target: ATXN1; (-) strand; PAM type: NRG; PAM sequence: GGG
gagtcaattaaaaacatttg

SEQ ID NO: 88294 - DNA, 20 bp, Artificial Sequence
  Description of Artificial Sequence: Synthetic oligonucleotide
  Target: ATXN1; (-) strand; PAM type: NRG; PAM sequence: GGG
tgagtcaattaaaaacattt

SEQ ID NO: 88295 - DNA, 20 bp, Artificial Sequence
  Description of Artificial Sequence: Synthetic oligonucleotide
  Target: ATXN1; (-) strand; PAM type: NRG; PAM sequence: TGG
atgagtcaattaaaaacatt

SEQ ID NO: 88296 - DNA, 20 bp, Artificial Sequence
  Description of Artificial Sequence: Synthetic oligonucleotide
  Target: ATXN1; (-) strand; PAM type: NRG; PAM sequence: GAG
tagggagagcctcaccaaat

SEQ ID NO: 88297 - DNA, 20 bp, Artificial Sequence
  Description of Artificial Sequence: Synthetic oligonucleotide
  Target: ATXN1; (-) strand; PAM type: NRG; PAM sequence: GAG
actgttcatttagctaggga

SEQ ID NO: 88298 - DNA, 20 bp, Artificial Sequence
  Description of Artificial Sequence: Synthetic oligonucleotide
  Target: ATXN1; (-) strand; PAM type: NRG; PAM sequence: GAG
agactgttcatttagctagg

SEQ ID NO: 88299 - DNA, 20 bp, Artificial Sequence
  Description of Artificial Sequence: Synthetic oligonucleotide
  Target: ATXN1; (-) strand; PAM type: NRG; PAM sequence: GGG
gcagactgttcatttagcta

SEQ ID NO: 88300 - DNA, 20 bp, Artificial Sequence
  Description of Artificial Sequence: Synthetic oligonucleotide
  Target: ATXN1; (-) strand; PAM type: NRG; PAM sequence: AGG
ggcagactgttcatttagct

SEQ ID NO: 88301 - DNA, 20 bp, Artificial Sequence
  Description of Artificial Sequence: Synthetic oligonucleotide
  Target: ATXN1; (-) strand; PAM type: NRG; PAM sequence: TAG
aggcagactgttcatttagc

SEQ ID NO: 88302 - DNA, 20 bp, Artificial Sequence
  Description of Artificial Sequence: Synthetic oligonucleotide
  Target: ATXN1; (-) strand; PAM type: NRG; PAM sequence: TAG
gaaaaggcagactgttcatt

SEQ ID NO: 88303 - DNA, 20 bp, Artificial Sequence
  Description of Artificial Sequence: Synthetic oligonucleotide
  Target: ATXN1; (-) strand; PAM type: NRG; PAM sequence: CAG
gtttggttcctttgaaaagg

SEQ ID NO: 88304 - DNA, 20 bp, Artificial Sequence
  Description of Artificial Sequence: Synthetic oligonucleotide
  Target: ATXN1; (-) strand; PAM type: NRG; PAM sequence: AGG
aatgtttggttcctttgaaa

SEQ ID NO: 88305 - DNA, 20 bp, Artificial Sequence
  Description of Artificial Sequence: Synthetic oligonucleotide
  Target: ATXN1; (-) strand; PAM type: NRG; PAM sequence: AAG
aaatgtttggttcctttgaa

SEQ ID NO: 88306 - DNA, 20 bp, Artificial Sequence
  Description of Artificial Sequence: Synthetic oligonucleotide
  Target: ATXN1; (-) strand; PAM type: NRG; PAM sequence: TGG
actcagaaggaagaaatgtt

SEQ ID NO: 88307 - DNA, 20 bp, Artificial Sequence
  Description of Artificial Sequence: Synthetic oligonucleotide
  Target: ATXN1; (-) strand; PAM type: NRG; PAM sequence: AAG
agtttaaaatactcagaagg

SEQ ID NO: 88308 - DNA, 20 bp, Artificial Sequence
  Description of Artificial Sequence: Synthetic oligonucleotide
  Target: ATXN1; (-) strand; PAM type: NRG; PAM sequence: AGG
aagagtttaaaatactcaga

SEQ ID NO: 88309 - DNA, 20 bp, Artificial Sequence
  Description of Artificial Sequence: Synthetic oligonucleotide
  Target: ATXN1; (-) strand; PAM type: NRG; PAM sequence: AAG
gaagagtttaaaatactcag

SEQ ID NO: 88310 - DNA, 20 bp, Artificial Sequence
  Description of Artificial Sequence: Synthetic oligonucleotide
  Target: ATXN1; (-) strand; PAM type: NRG; PAM sequence: CAG
ttagaagagtttaaaatact

SEQ ID NO: 88311 - DNA, 20 bp, Artificial Sequence
  Description of Artificial Sequence: Synthetic oligonucleotide
  Target: ATXN1; (-) strand; PAM type: NRG; PAM sequence: GAG
catgtttggctttgttagaa

SEQ ID NO: 88312 - DNA, 20 bp, Artificial Sequence
  Description of Artificial Sequence: Synthetic oligonucleotide
  Target: ATXN1; (-) strand; PAM type: NRG; PAM sequence: AAG
tccatgtttggctttgttag

SEQ ID NO: 88313 - DNA, 20 bp, Artificial Sequence
  Description of Artificial Sequence: Synthetic oligonucleotide
  Target: ATXN1; (-) strand; PAM type: NRG; PAM sequence: TAG
taatccatgtttggctttgt

SEQ ID NO: 88314 - DNA, 20 bp, Artificial Sequence
  Description of Artificial Sequence: Synthetic oligonucleotide
  Target: ATXN1; (-) strand; PAM type: NRG; PAM sequence: TGG
aacgctgtttaatccatgtt

SEQ ID NO: 88315 - DNA, 20 bp, Artificial Sequence
  Description of Artificial Sequence: Synthetic oligonucleotide
  Target: ATXN1; (-) strand; PAM type: NRG; PAM sequence: GAG
ttgaacttaggtgctgtgaa

SEQ ID NO: 88316 - DNA, 20 bp, Artificial Sequence
  Description of Artificial Sequence: Synthetic oligonucleotide
  Target: ATXN1; (-) strand; PAM type: NRG; PAM sequence: AAG
atttgaacttaggtgctgtg

SEQ ID NO: 88317 - DNA, 20 bp, Artificial Sequence
  Description of Artificial Sequence: Synthetic oligonucleotide
  Target: ATXN1; (-) strand; PAM type: NRG; PAM sequence: AGG
ttgattcctaatttgaactt

SEQ ID NO: 88318 - DNA, 20 bp, Artificial Sequence
  Description of Artificial Sequence: Synthetic oligonucleotide
  Target: ATXN1; (-) strand; PAM type: NRG; PAM sequence: TAG
cttgattcctaatttgaact

SEQ ID NO: 88319 - DNA, 20 bp, Artificial Sequence
  Description of Artificial Sequence: Synthetic oligonucleotide
  Target: ATXN1; (-) strand; PAM type: NRG; PAM sequence: GGG
tccatgtcccattggttatt

SEQ ID NO: 88320 - DNA, 20 bp, Artificial Sequence
  Description of Artificial Sequence: Synthetic oligonucleotide
  Target: ATXN1; (-) strand; PAM type: NRG; PAM sequence: TGG
atccatgtcccattggttat

SEQ ID NO: 88321 - DNA, 20 bp, Artificial Sequence
  Description of Artificial Sequence: Synthetic oligonucleotide
  Target: ATXN1; (-) strand; PAM type: NRG; PAM sequence: TGG
aaacagtatccatgtcccat

SEQ ID NO: 88322 - DNA, 20 bp, Artificial Sequence
  Description of Artificial Sequence: Synthetic oligonucleotide
  Target: ATXN1; (-) strand; PAM type: NRG; PAM sequence: CAG
tggctatttattggtgaaaa

SEQ ID NO: 88323 - DNA, 20 bp, Artificial Sequence
  Description of Artificial Sequence: Synthetic oligonucleotide
  Target: ATXN1; (-) strand; PAM type: NRG; PAM sequence: TGG
ttgatggggtggctatttat

SEQ ID NO: 88324 - DNA, 20 bp, Artificial Sequence
  Description of Artificial Sequence: Synthetic oligonucleotide
  Target: ATXN1; (-) strand; PAM type: NRG; PAM sequence: TGG
gatggggcagcttgatgggg

SEQ ID NO: 88325 - DNA, 20 bp, Artificial Sequence
  Description of Artificial Sequence: Synthetic oligonucleotide
  Target: ATXN1; (-) strand; PAM type: NRG; PAM sequence: GGG
gtcgatggggcagcttgatg

SEQ ID NO: 88326 - DNA, 20 bp, Artificial Sequence
  Description of Artificial Sequence: Synthetic oligonucleotide
  Target: ATXN1; (-) strand; PAM type: NRG; PAM sequence: GGG
agtcgatggggcagcttgat

SEQ ID NO: 88327 - DNA, 20 bp, Artificial Sequence
  Description of Artificial Sequence: Synthetic oligonucleotide
  Target: ATXN1; (-) strand; PAM type: NRG; PAM sequence: TGG
tagtcgatggggcagcttga

SEQ ID NO: 88328 - DNA, 20 bp, Artificial Sequence
  Description of Artificial Sequence: Synthetic oligonucleotide
  Target: ATXN1; (-) strand; PAM type: NRG; PAM sequence: CAG
cctcttcctagtcgatgggg

SEQ ID NO: 88329 - DNA, 20 bp, Artificial Sequence
  Description of Artificial Sequence: Synthetic oligonucleotide
  Target: ATXN1; (-) strand; PAM type: NRG; PAM sequence: GGG
gggcctcttcctagtcgatg

SEQ ID NO: 88330 - DNA, 20 bp, Artificial Sequence
  Description of Artificial Sequence: Synthetic oligonucleotide
  Target: ATXN1; (-) strand; PAM type: NRG; PAM sequence: GGG
tgggcctcttcctagtcgat

SEQ ID NO: 88331 - DNA, 20 bp, Artificial Sequence
  Description of Artificial Sequence: Synthetic oligonucleotide
  Target: ATXN1; (-) strand; PAM type: NRG; PAM sequence: TGG
gtgggcctcttcctagtcga

SEQ ID NO: 88332 - DNA, 20 bp, Artificial Sequence
  Description of Artificial Sequence: Synthetic oligonucleotide
  Target: ATXN1; (-) strand; PAM type: NRG; PAM sequence: TAG
tgcctgagtgggcctcttcc

SEQ ID NO: 88333 - DNA, 20 bp, Artificial Sequence
  Description of Artificial Sequence: Synthetic oligonucleotide
  Target: ATXN1; (-) strand; PAM type: NRG; PAM sequence: GGG
aagcttccgggtgcctgagt

SEQ ID NO: 88334 - DNA, 20 bp, Artificial Sequence
  Description of Artificial Sequence: Synthetic oligonucleotide
  Target: ATXN1; (-) strand; PAM type: NRG; PAM sequence: TGG
aaagcttccgggtgcctgag

SEQ ID NO: 88335 - DNA, 20 bp, Artificial Sequence
  Description of Artificial Sequence: Synthetic oligonucleotide
  Target: ATXN1; (-) strand; PAM type: NRG; PAM sequence: GAG
ggcaaagcttccgggtgcct

SEQ ID NO: 88336 - DNA, 20 bp, Artificial Sequence
  Description of Artificial Sequence: Synthetic oligonucleotide
  Target: ATXN1; (-) strand; PAM type: NRG; PAM sequence: GGG
ctctctggggcaaagcttcc

SEQ ID NO: 88337 - DNA, 20 bp, Artificial Sequence
  Description of Artificial Sequence: Synthetic oligonucleotide
  Target: ATXN1; (-) strand; PAM type: NRG; PAM sequence: CGG
gctctctggggcaaagcttc

SEQ ID NO: 88338 - DNA, 20 bp, Artificial Sequence
  Description of Artificial Sequence: Synthetic oligonucleotide
  Target: ATXN1; (-) strand; PAM type: NRG; PAM sequence: AAG
tcattctgctctctggggca

SEQ ID NO: 88339 - DNA, 20 bp, Artificial Sequence
  Description of Artificial Sequence: Synthetic oligonucleotide
  Target: ATXN1; (-) strand; PAM type: NRG; PAM sequence: GGG
ggacctcattctgctctctg

SEQ ID NO: 88340 - DNA, 20 bp, Artificial Sequence
  Description of Artificial Sequence: Synthetic oligonucleotide
  Target: ATXN1; (-) strand; PAM type: NRG; PAM sequence: GGG
gggacctcattctgctctct

SEQ ID NO: 88341 - DNA, 20 bp, Artificial Sequence
  Description of Artificial Sequence: Synthetic oligonucleotide
  Target: ATXN1; (-) strand; PAM type: NRG; PAM sequence: TGG
agggacctcattctgctctc

SEQ ID NO: 88342 - DNA, 20 bp, Artificial Sequence
  Description of Artificial Sequence: Synthetic oligonucleotide
  Target: ATXN1; (-) strand; PAM type: NRG; PAM sequence: GGG
cagtggtatagtttcaggaa

SEQ ID NO: 88343 - DNA, 20 bp, Artificial Sequence
  Description of Artificial Sequence: Synthetic oligonucleotide
  Target: ATXN1; (-) strand; PAM type: NRG; PAM sequence: AGG
gcagtggtatagtttcagga

SEQ ID NO: 88344 - DNA, 20 bp, Artificial Sequence
  Description of Artificial Sequence: Synthetic oligonucleotide
  Target: ATXN1; (-) strand; PAM type: NRG; PAM sequence: AAG
agcagtggtatagtttcagg

SEQ ID NO: 88345 - DNA, 20 bp, Artificial Sequence
  Description of Artificial Sequence: Synthetic oligonucleotide
  Target: ATXN1; (-) strand; PAM type: NRG; PAM sequence: AGG
cagagcagtggtatagtttc

SEQ ID NO: 88346 - DNA, 20 bp, Artificial Sequence
  Description of Artificial Sequence: Synthetic oligonucleotide
  Target: ATXN1; (-) strand; PAM type: NRG; PAM sequence: CAG
gcagagcagtggtatagttt

SEQ ID NO: 88347 - DNA, 20 bp, Artificial Sequence
  Description of Artificial Sequence: Synthetic oligonucleotide
  Target: ATXN1; (-) strand; PAM type: NRG; PAM sequence: TAG
atgtctgcagagcagtggta

SEQ ID NO: 88348 - DNA, 20 bp, Artificial Sequence
  Description of Artificial Sequence: Synthetic oligonucleotide
  Target: ATXN1; (-) strand; PAM type: NRG; PAM sequence: TGG
gagatatgtctgcagagcag

SEQ ID NO: 88349 - DNA, 20 bp, Artificial Sequence
  Description of Artificial Sequence: Synthetic oligonucleotide
  Target: ATXN1; (-) strand; PAM type: NRG; PAM sequence: CAG
ggtgagatatgtctgcagag

SEQ ID NO: 88350 - DNA, 20 bp, Artificial Sequence
  Description of Artificial Sequence: Synthetic oligonucleotide
  Target: ATXN1; (-) strand; PAM type: NRG; PAM sequence: GAG
gtgggtgagatatgtctgca

SEQ ID NO: 88351 - DNA, 20 bp, Artificial Sequence
  Description of Artificial Sequence: Synthetic oligonucleotide
  Target: ATXN1; (-) strand; PAM type: NRG; PAM sequence: CAG
ctgtgggtgagatatgtctg

SEQ ID NO: 88352 - DNA, 20 bp, Artificial Sequence
  Description of Artificial Sequence: Synthetic oligonucleotide
  Target: ATXN1; (-) strand; PAM type: NRG; PAM sequence: GAG
aataggaaagcactgtgggt

SEQ ID NO: 88353 - DNA, 20 bp, Artificial Sequence
  Description of Artificial Sequence: Synthetic oligonucleotide
  Target: ATXN1; (-) strand; PAM type: NRG; PAM sequence: GGG
tggcaataggaaagcactgt

SEQ ID NO: 88354 - DNA, 20 bp, Artificial Sequence
  Description of Artificial Sequence: Synthetic oligonucleotide
  Target: ATXN1; (-) strand; PAM type: NRG; PAM sequence: TGG
ctggcaataggaaagcactg

SEQ ID NO: 88355 - DNA, 20 bp, Artificial Sequence
  Description of Artificial Sequence: Synthetic oligonucleotide
  Target: ATXN1; (-) strand; PAM type: NRG; PAM sequence: AAG
cggtgctcctggcaatagga

SEQ ID NO: 88356 - DNA, 20 bp, Artificial Sequence
  Description of Artificial Sequence: Synthetic oligonucleotide
  Target: ATXN1; (-) strand; PAM type: NRG; PAM sequence: AGG
ctcccggtgctcctggcaat

SEQ ID NO: 88357 - DNA, 20 bp, Artificial Sequence
  Description of Artificial Sequence: Synthetic oligonucleotide
  Target: ATXN1; (-) strand; PAM type: NRG; PAM sequence: TAG
cctcccggtgctcctggcaa

SEQ ID NO: 88358 - DNA, 20 bp, Artificial Sequence
  Description of Artificial Sequence: Synthetic oligonucleotide
  Target: ATXN1; (-) strand; PAM type: NRG; PAM sequence: TGG
atattccctcccggtgctcc

SEQ ID NO: 88359 - DNA, 20 bp, Artificial Sequence
  Description of Artificial Sequence: Synthetic oligonucleotide
  Target: ATXN1; (-) strand; PAM type: NRG; PAM sequence: CGG
aatgggcaaatattccctcc

SEQ ID NO: 88360 - DNA, 20 bp, Artificial Sequence
  Description of Artificial Sequence: Synthetic oligonucleotide
  Target: ATXN1; (-) strand; PAM type: NRG; PAM sequence: GGG
ttagaagggatgattagaat

SEQ ID NO: 88361 - DNA, 20 bp, Artificial Sequence
  Description of Artificial Sequence: Synthetic oligonucleotide
  Target: ATXN1; (-) strand; PAM type: NRG; PAM sequence: TGG
attagaagggatgattagaa

SEQ ID NO: 88362 - DNA, 20 bp, Artificial Sequence
  Description of Artificial Sequence: Synthetic oligonucleotide
  Target: ATXN1; (-) strand; PAM type: NRG; PAM sequence: TAG
gcgccattagaagggatgat

SEQ ID NO: 88363 - DNA, 20 bp, Artificial Sequence
  Description of Artificial Sequence: Synthetic oligonucleotide
  Target: ATXN1; (-) strand; PAM type: NRG; PAM sequence: GGG
ctcttgctgcgccattagaa

SEQ ID NO: 88364 - DNA, 20 bp, Artificial Sequence
  Description of Artificial Sequence: Synthetic oligonucleotide
  Target: ATXN1; (-) strand; PAM type: NRG; PAM sequence: AGG
tctcttgctgcgccattaga

SEQ ID NO: 88365 - DNA, 20 bp, Artificial Sequence
  Description of Artificial Sequence: Synthetic oligonucleotide
  Target: ATXN1; (-) strand; PAM type: NRG; PAM sequence: AAG
atctcttgctgcgccattag

SEQ ID NO: 88366 - DNA, 20 bp, Artificial Sequence
  Description of Artificial Sequence: Synthetic oligonucleotide
  Target: ATXN1; (-) strand; PAM type: NRG; PAM sequence: TAG
atgatctcttgctgcgccat

SEQ ID NO: 88367 - DNA, 20 bp, Artificial Sequence
  Description of Artificial Sequence: Synthetic oligonucleotide
  Target: ATXN1; (-) strand; PAM type: NRG; PAM sequence: TGG
aaaagttaaccacagagtag

SEQ ID NO: 88368 - DNA, 20 bp, Artificial Sequence
  Description of Artificial Sequence: Synthetic oligonucleotide
  Target: ATXN1; (-) strand; PAM type: NRG; PAM sequence: TAG
gtgaaaagttaaccacagag

SEQ ID NO: 88369 - DNA, 20 bp, Artificial Sequence
  Description of Artificial Sequence: Synthetic oligonucleotide
  Target: ATXN1; (-) strand; PAM type: NRG; PAM sequence: GAG
caggtgaaaagttaaccaca

SEQ ID NO: 88370 - DNA, 20 bp, Artificial Sequence
  Description of Artificial Sequence: Synthetic oligonucleotide
  Target: ATXN1; (-) strand; PAM type: NRG; PAM sequence: CAG
tacaggtgaaaagttaacca

SEQ ID NO: 88371 - DNA, 20 bp, Artificial Sequence
  Description of Artificial Sequence: Synthetic oligonucleotide
  Target: ATXN1; (-) strand; PAM type: NRG; PAM sequence: AAG
taattcacaatacaggtgaa

SEQ ID NO: 88372 - DNA, 20 bp, Artificial Sequence
  Description of Artificial Sequence: Synthetic oligonucleotide
  Target: ATXN1; (-) strand; PAM type: NRG; PAM sequence: AGG
gtgtagttaattcacaatac

SEQ ID NO: 88373 - DNA, 20 bp, Artificial Sequence
  Description of Artificial Sequence: Synthetic oligonucleotide
  Target: ATXN1; (-) strand; PAM type: NRG; PAM sequence: CAG
agtgtagttaattcacaata

SEQ ID NO: 88374 - DNA, 20 bp, Artificial Sequence
  Description of Artificial Sequence: Synthetic oligonucleotide
  Target: ATXN1; (-) strand; PAM type: NRG; PAM sequence: TAG
gtttaaatgaataatgagtg

SEQ ID NO: 88375 - DNA, 20 bp, Artificial Sequence
  Description of Artificial Sequence: Synthetic oligonucleotide
  Target: ATXN1; (-) strand; PAM type: NRG; PAM sequence: GAG
gtgctgtttaaatgaataat

SEQ ID NO: 88376 - DNA, 20 bp, Artificial Sequence
  Description of Artificial Sequence: Synthetic oligonucleotide
  Target: ATXN1; (-) strand; PAM type: NRG; PAM sequence: AGG
tttagacttgaaggttcttt

SEQ ID NO: 88377 - DNA, 20 bp, Artificial Sequence
  Description of Artificial Sequence: Synthetic oligonucleotide
  Target: ATXN1; (-) strand; PAM type: NRG; PAM sequence: TAG
gtttagacttgaaggttctt

SEQ ID NO: 88378 - DNA, 20 bp, Artificial Sequence
  Description of Artificial Sequence: Synthetic oligonucleotide
  Target: ATXN1; (-) strand; PAM type: NRG; PAM sequence: AGG
agtgatgtgtttagacttga

SEQ ID NO: 88379 - DNA, 20 bp, Artificial Sequence
  Description of Artificial Sequence: Synthetic oligonucleotide
  Target: ATXN1; (-) strand; PAM type: NRG; PAM sequence: AAG
gagtgatgtgtttagacttg

SEQ ID NO: 88380 - DNA, 20 bp, Artificial Sequence
  Description of Artificial Sequence: Synthetic oligonucleotide
  Target: ATXN1; (-) strand; PAM type: NRG; PAM sequence: TAG
taatgatagagtgatgtgtt

SEQ ID NO: 88381 - DNA, 20 bp, Artificial Sequence
  Description of Artificial Sequence: Synthetic oligonucleotide
  Target: ATXN1; (-) strand; PAM type: NRG; PAM sequence: GAG
agcaacagtcactaatgata

SEQ ID NO: 88382 - DNA, 20 bp, Artificial Sequence
  Description of Artificial Sequence: Synthetic oligonucleotide
  Target: ATXN1; (-) strand; PAM type: NRG; PAM sequence: TAG
tcagcaacagtcactaatga

SEQ ID NO: 88383 - DNA, 20 bp, Artificial Sequence
  Description of Artificial Sequence: Synthetic oligonucleotide
  Target: ATXN1; (-) strand; PAM type: NRG; PAM sequence: CAG
gtgaagcccttcttcagcaa

SEQ ID NO: 88384 - DNA, 20 bp, Artificial Sequence
  Description of Artificial Sequence: Synthetic oligonucleotide
  Target: ATXN1; (-) strand; PAM type: NRG; PAM sequence: CAG
atttcagtgaagcccttctt

SEQ ID NO: 88385 - DNA, 20 bp, Artificial Sequence
  Description of Artificial Sequence: Synthetic oligonucleotide
  Target: ATXN1; (-) strand; PAM type: NRG; PAM sequence: AAG
aatacaatcatatttcagtg

SEQ ID NO: 88386 - DNA, 20 bp, Artificial Sequence
  Description of Artificial Sequence: Synthetic oligonucleotide
  Target: ATXN1; (-) strand; PAM type: NRG; PAM sequence: CAG
atgttaatacaatcatattt

SEQ ID NO: 88387 - DNA, 20 bp, Artificial Sequence
  Description of Artificial Sequence: Synthetic oligonucleotide
  Target: ATXN1; (-) strand; PAM type: NRG; PAM sequence: CAG
gctctaaagaaaattcattt

SEQ ID NO: 88388 - DNA, 20 bp, Artificial Sequence
  Description of Artificial Sequence: Synthetic oligonucleotide
  Target: ATXN1; (-) strand; PAM type: NRG; PAM sequence: AAG
tggtactatgagctgctcta

SEQ ID NO: 88389 - DNA, 20 bp, Artificial Sequence
  Description of Artificial Sequence: Synthetic oligonucleotide
  Target: ATXN1; (-) strand; PAM type: NRG; PAM sequence: GAG
cagggagtggttggtactat

SEQ ID NO: 88390 - DNA, 20 bp, Artificial Sequence
  Description of Artificial Sequence: Synthetic oligonucleotide
  Target: ATXN1; (-) strand; PAM type: NRG; PAM sequence: TGG
tgggaggggcagggagtggt

SEQ ID NO: 88391 - DNA, 20 bp, Artificial Sequence
  Description of Artificial Sequence: Synthetic oligonucleotide
  Target: ATXN1; (-) strand; PAM type: NRG; PAM sequence: TGG
agaatgggaggggcagggag

SEQ ID NO: 88392 - DNA, 20 bp, Artificial Sequence
  Description of Artificial Sequence: Synthetic oligonucleotide
  Target: ATXN1; (-) strand; PAM type: NRG; PAM sequence: GAG
gtgagaatgggaggggcagg

SEQ ID NO: 88393 - DNA, 20 bp, Artificial Sequence
  Description of Artificial Sequence: Synthetic oligonucleotide
  Target: ATXN1; (-) strand; PAM type: NRG; PAM sequence: GGG
gagtgagaatgggaggggca

SEQ ID NO: 88394 - DNA, 20 bp, Artificial Sequence
  Description of Artificial Sequence: Synthetic oligonucleotide
  Target: ATXN1; (-) strand; PAM type: NRG; PAM sequence: AGG
ggagtgagaatgggaggggc

SEQ ID NO: 88395 - DNA, 20 bp, Artificial Sequence
  Description of Artificial Sequence: Synthetic oligonucleotide
  Target: ATXN1; (-) strand; PAM type: NRG; PAM sequence: CAG
gggagtgagaatgggagggg

SEQ ID NO: 88396 - DNA, 20 bp, Artificial Sequence
  Description of Artificial Sequence: Synthetic oligonucleotide
  Target: ATXN1; (-) strand; PAM type: NRG; PAM sequence: GGG
actgggagtgagaatgggag

SEQ ID NO: 88397 - DNA, 20 bp, Artificial Sequence
  Description of Artificial Sequence: Synthetic oligonucleotide
  Target: ATXN1; (-) strand; PAM type: NRG; PAM sequence: GGG
tactgggagtgagaatggga

SEQ ID NO: 88398 - DNA, 20 bp, Artificial Sequence
  Description of Artificial Sequence: Synthetic oligonucleotide
  Target: ATXN1; (-) strand; PAM type: NRG; PAM sequence: AGG
ctactgggagtgagaatggg

SEQ ID NO: 88399 - DNA, 20 bp, Artificial Sequence
  Description of Artificial Sequence: Synthetic oligonucleotide
  Target: ATXN1; (-) strand; PAM type: NRG; PAM sequence: GAG
gctactgggagtgagaatgg

SEQ ID NO: 88400 - DNA, 20 bp, Artificial Sequence
  Description of Artificial Sequence: Synthetic oligonucleotide
  Target: ATXN1; (-) strand; PAM type: NRG; PAM sequence: GGG
cagctactgggagtgagaat

SEQ ID NO: 88401 - DNA, 20 bp, Artificial Sequence
  Description of Artificial Sequence: Synthetic oligonucleotide
  Target: ATXN1; (-) strand; PAM type: NRG; PAM sequence: TGG
ccagctactgggagtgagaa

SEQ ID NO: 88402 - DNA, 20 bp, Artificial Sequence
  Description of Artificial Sequence: Synthetic oligonucleotide
  Target: ATXN1; (-) strand; PAM type: NRG; PAM sequence: GAG
atctcccagctactgggagt

SEQ ID NO: 88403 - DNA, 20 bp, Artificial Sequence
  Description of Artificial Sequence: Synthetic oligonucleotide
  Target: ATXN1; (-) strand; PAM type: NRG; PAM sequence: GAG
catcatctcccagctactgg

SEQ ID NO: 88404 - DNA, 20 bp, Artificial Sequence
  Description of Artificial Sequence: Synthetic oligonucleotide
  Target: ATXN1; (-) strand; PAM type: NRG; PAM sequence: GGG
agcatcatctcccagctact

SEQ ID NO: 88405 - DNA, 20 bp, Artificial Sequence
  Description of Artificial Sequence: Synthetic oligonucleotide
  Target: ATXN1; (-) strand; PAM type: NRG; PAM sequence: TGG
aagcatcatctcccagctac

SEQ ID NO: 88406 - DNA, 20 bp, Artificial Sequence
  Description of Artificial Sequence: Synthetic oligonucleotide
  Target: ATXN1; (-) strand; PAM type: NRG; PAM sequence: CAG
aacaatgaagcatcatctcc

SEQ ID NO: 88407 - DNA, 20 bp, Artificial Sequence
  Description of Artificial Sequence: Synthetic oligonucleotide
  Target: ATXN1; (-) strand; PAM type: NRG; PAM sequence: AAG
agtctaagcttagaacaatg

SEQ ID NO: 88408 - DNA, 20 bp, Artificial Sequence
  Description of Artificial Sequence: Synthetic oligonucleotide
  Target: ATXN1; (-) strand; PAM type: NRG; PAM sequence: TAG
tgttgtattaagtctaagct

SEQ ID NO: 88409 - DNA, 20 bp, Artificial Sequence
  Description of Artificial Sequence: Synthetic oligonucleotide
  Target: ATXN1; (-) strand; PAM type: NRG; PAM sequence: AAG
tgcagtgttgtattaagtct

SEQ ID NO: 88410 - DNA, 20 bp, Artificial Sequence
  Description of Artificial Sequence: Synthetic oligonucleotide
  Target: ATXN1; (-) strand; PAM type: NRG; PAM sequence: AAG
gaaaagtgcagtgttgtatt

SEQ ID NO: 88411 - DNA, 20 bp, Artificial Sequence
  Description of Artificial Sequence: Synthetic oligonucleotide
  Target: ATXN1; (-) strand; PAM type: NRG; PAM sequence: CAG
ttatttgtttaagaaaagtg

SEQ ID NO: 88412 - DNA, 20 bp, Artificial Sequence
  Description of Artificial Sequence: Synthetic oligonucleotide
  Target: ATXN1; (-) strand; PAM type: NRG; PAM sequence: AAG
aaggtttatttgtttaagaa

SEQ ID NO: 88413 - DNA, 20 bp, Artificial Sequence
  Description of Artificial Sequence: Synthetic oligonucleotide
  Target: ATXN1; (-) strand; PAM type: NRG; PAM sequence: AAG
agcaaaaggtttatttgttt

SEQ ID NO: 88414 - DNA, 20 bp, Artificial Sequence
  Description of Artificial Sequence: Synthetic oligonucleotide
  Target: ATXN1; (-) strand; PAM type: NRG; PAM sequence: AGG
ttttaatccactttagcaaa

SEQ ID NO: 88415 - DNA, 20 bp, Artificial Sequence
  Description of Artificial Sequence: Synthetic oligonucleotide
  Target: ATXN1; (-) strand; PAM type: NRG; PAM sequence: AAG
gttttaatccactttagcaa

SEQ ID NO: 88416 - DNA, 20 bp, Artificial Sequence
  Description of Artificial Sequence: Synthetic oligonucleotide
  Target: ATXN1; (-) strand; PAM type: NRG; PAM sequence: TAG
tgagatgttttaatccactt

SEQ ID NO: 88417 - DNA, 20 bp, Artificial Sequence
  Description of Artificial Sequence: Synthetic oligonucleotide
  Target: ATXN1; (-) strand; PAM type: NRG; PAM sequence: GAG
gcatgtgtgccgtagctgtt

SEQ ID NO: 88418 - DNA, 20 bp, Artificial Sequence
  Description of Artificial Sequence: Synthetic oligonucleotide
  Target: ATXN1; (-) strand; PAM type: NRG; PAM sequence: TAG
taatgactgcatgtgtgccg

SEQ ID NO: 88419 - DNA, 20 bp, Artificial Sequence
  Description of Artificial Sequence: Synthetic oligonucleotide
  Target: ATXN1; (-) strand; PAM type: NRG; PAM sequence: CAG
ttatctgtctatatgctgaa

SEQ ID NO: 88420 - DNA, 20 bp, Artificial Sequence
  Description of Artificial Sequence: Synthetic oligonucleotide
  Target: ATXN1; (-) strand; PAM type: NRG; PAM sequence: TGG
acttcttaaaccatacactg

SEQ ID NO: 88421 - DNA, 20 bp, Artificial Sequence
  Description of Artificial Sequence: Synthetic oligonucleotide
  Target: ATXN1; (-) strand; PAM type: NRG; PAM sequence: CAG
tcattctcatacttcaagaa

SEQ ID NO: 88422 - DNA, 20 bp, Artificial Sequence
  Description of Artificial Sequence: Synthetic oligonucleotide
  Target: ATXN1; (-) strand; PAM type: NRG; PAM sequence: AAG
cttaatcattctcatacttc

SEQ ID NO: 88423 - DNA, 20 bp, Artificial Sequence
  Description of Artificial Sequence: Synthetic oligonucleotide
  Target: ATXN1; (-) strand; PAM type: NRG; PAM sequence: AGG
ttttttttttttaatttttg

SEQ ID NO: 88424 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttaattttt

SEQ ID NO: 88425 - DNA, 20 bp, Artificial Sequence
  Description of Artificial Sequence: Synthetic oligonucleotide
  Target: ATXN1; (-) strand; PAM type: NRG; PAM sequence: AAG
atgtctttttagcttcagtg

SEQ ID NO: 88426 - DNA, 20 bp, Artificial Sequence
  Description of Artificial Sequence: Synthetic oligonucleotide
  Target: ATXN1; (-) strand; PAM type: NRG; PAM sequence: CAG
tggtcatgtctttttagctt

SEQ ID NO: 88427 - DNA, 20 bp, Artificial Sequence
  Description of Artificial Sequence: Synthetic oligonucleotide
  Target: ATXN1; (-) strand; PAM type: NRG; PAM sequence: TAG
cttcattggtcatgtctttt

SEQ ID NO: 88428 - DNA, 20 bp, Artificial Sequence
  Description of Artificial Sequence: Synthetic oligonucleotide
  Target: ATXN1; (-) strand; PAM type: NRG; PAM sequence: TGG
atttaatgcttttccttcat

SEQ ID NO: 88429 - DNA, 20 bp, Artificial Sequence
  Description of Artificial Sequence: Synthetic oligonucleotide
  Target: ATXN1; (-) strand; PAM type: NRG; PAM sequence: CAG
tgaggctgaaaaccagactc

SEQ ID NO: 88430 - DNA, 20 bp, Artificial Sequence
  Description of Artificial Sequence: Synthetic oligonucleotide
  Target: ATXN1; (-) strand; PAM type: NRG; PAM sequence: CAG
tgatggctgaggctgaaaac

SEQ ID NO: 88431 - DNA, 20 bp, Artificial Sequence
  Description of Artificial Sequence: Synthetic oligonucleotide
  Target: ATXN1; (-) strand; PAM type: NRG; PAM sequence: AGG
gcctgtttgtttgatggctg

SEQ ID NO: 88432 - DNA, 20 bp, Artificial Sequence
  Description of Artificial Sequence: Synthetic oligonucleotide
  Target: ATXN1; (-) strand; PAM type: NRG; PAM sequence: GAG
agcctgtttgtttgatggct

SEQ ID NO: 88433 - DNA, 20 bp, Artificial Sequence
  Description of Artificial Sequence: Synthetic oligonucleotide
  Target: ATXN1; (-) strand; PAM type: NRG; PAM sequence: TGG
cacacagcctgtttgtttga

SEQ ID NO: 88434 - DNA, 20 bp, Artificial Sequence
  Description of Artificial Sequence: Synthetic oligonucleotide
  Target: ATXN1; (-) strand; PAM type: NRG; PAM sequence: CAG
atgaccactcctacaacaca

SEQ ID NO: 88435 - DNA, 20 bp, Artificial Sequence
  Description of Artificial Sequence: Synthetic oligonucleotide
  Target: ATXN1; (-) strand; PAM type: NRG; PAM sequence: CGG
gaaacatttgaggcttagtg

SEQ ID NO: 88436 - DNA, 20 bp, Artificial Sequence
  Description of Artificial Sequence: Synthetic oligonucleotide
  Target: ATXN1; (-) strand; PAM type: NRG; PAM sequence: TAG
cagaggaaacatttgaggct

SEQ ID NO: 88437 - DNA, 20 bp, Artificial Sequence
  Description of Artificial Sequence: Synthetic oligonucleotide
  Target: ATXN1; (-) strand; PAM type: NRG; PAM sequence: AGG
ttttacagaggaaacatttg

SEQ ID NO: 88438 - DNA, 20 bp, Artificial Sequence
  Description of Artificial Sequence: Synthetic oligonucleotide
  Target: ATXN1; (-) strand; PAM type: NRG; PAM sequence: GAG
attttacagaggaaacattt

SEQ ID NO: 88439 - DNA, 20 bp, Artificial Sequence
  Description of Artificial Sequence: Synthetic oligonucleotide
  Target: ATXN1; (-) strand; PAM type: NRG; PAM sequence: AGG
ctaatgttctaattttacag

SEQ ID NO: 88440 - DNA, 20 bp, Artificial Sequence
  Description of Artificial Sequence: Synthetic oligonucleotide
  Target: ATXN1; (-) strand; PAM type: NRG; PAM sequence: GAG
cctaatgttctaattttaca

SEQ ID NO: 88441 - DNA, 20 bp, Artificial Sequence
  Description of Artificial Sequence: Synthetic oligonucleotide
  Target: ATXN1; (-) strand; PAM type: NRG; PAM sequence: CAG
aacctaatgttctaatttta

SEQ ID NO: 88442 - DNA, 20 bp, Artificial Sequence
  Description of Artificial Sequence: Synthetic oligonucleotide
  Target: ATXN1; (-) strand; PAM type: NRG; PAM sequence: TGG
gtagaattttaaagcttaaa

SEQ ID NO: 88443 - DNA, 20 bp, Artificial Sequence
  Description of Artificial Sequence: Synthetic oligonucleotide
  Target: ATXN1; (-) strand; PAM type: NRG; PAM sequence: AAG
cggacaatcgtagaatttta

SEQ ID NO: 88444 - DNA, 20 bp, Artificial Sequence
  Description of Artificial Sequence: Synthetic oligonucleotide
  Target: ATXN1; (-) strand; PAM type: NRG; PAM sequence: TAG
ttgaattggacggacaatcg

SEQ ID NO: 88445 - DNA, 20 bp, Artificial Sequence
  Description of Artificial Sequence: Synthetic oligonucleotide
  Target: ATXN1; (-) strand; PAM type: NRG; PAM sequence: CGG
gtttattttattgaattgga

SEQ ID NO: 88446 - DNA, 20 bp, Artificial Sequence
  Description of Artificial Sequence: Synthetic oligonucleotide
  Target: ATXN1; (-) strand; PAM type: NRG; PAM sequence: TGG
tacagtttattttattgaat

SEQ ID NO: 88447 - DNA, 20 bp, Artificial Sequence
  Description of Artificial Sequence: Synthetic oligonucleotide
  Target: ATXN1; (-) strand; PAM type: NRG; PAM sequence: CAG
aaagcaggtattattaaata

SEQ ID NO: 88448 - DNA, 20 bp, Artificial Sequence
  Description of Artificial Sequence: Synthetic oligonucleotide
  Target: ATXN1; (-) strand; PAM type: NRG; PAM sequence: AGG
attagcttagttgaaaaagc

SEQ ID NO: 88449 - DNA, 20 bp, Artificial Sequence
  Description of Artificial Sequence: Synthetic oligonucleotide
  Target: ATXN1; (-) strand; PAM type: NRG; PAM sequence: CAG
aattagcttagttgaaaaag

SEQ ID NO: 88450 - DNA, 20 bp, Artificial Sequence
  Description of Artificial Sequence: Synthetic oligonucleotide
  Target: ATXN1; (-) strand; PAM type: NRG; PAM sequence: AAG
aaaaattagcttagttgaaa

SEQ ID NO: 88451 - DNA, 20 bp, Artificial Sequence
  Description of Artificial Sequence: Synthetic oligonucleotide
  Target: ATXN1; (-) strand; PAM type: NRG; PAM sequence: TAG
tgccttttaaaaaattagct

SEQ ID NO: 88452 - DNA, 20 bp, Artificial Sequence
  Description of Artificial Sequence: Synthetic oligonucleotide
  Target: ATXN1; (-) strand; PAM type: NRG; PAM sequence: TAG
ttttctgccttttaaaaaat

SEQ ID NO: 88453 - DNA, 20 bp, Artificial Sequence
  Description of Artificial Sequence: Synthetic oligonucleotide
  Target: ATXN1; (-) strand; PAM type: NRG; PAM sequence: TAG
attttttattcttttctggt

SEQ ID NO: 88454 - DNA, 20 bp, Artificial Sequence
  Description of Artificial Sequence: Synthetic oligonucleotide
  Target: ATXN1; (-) strand; PAM type: NRG; PAM sequence: TGG
aaacattttttattcttttc

SEQ ID NO: 88455 - DNA, 20 bp, Artificial Sequence
  Description of Artificial Sequence: Synthetic oligonucleotide
  Target: ATXN1; (-) strand; PAM type: NRG; PAM sequence: AAG
ggacaaagtttatgttgtac

SEQ ID NO: 88456 - DNA, 20 bp, Artificial Sequence
  Description of Artificial Sequence: Synthetic oligonucleotide
  Target: ATXN1; (-) strand; PAM type: NRG; PAM sequence: AAG
cagatactgatttctggaca

SEQ ID NO: 88457 - DNA, 20 bp, Artificial Sequence
  Description of Artificial Sequence: Synthetic oligonucleotide
  Target: ATXN1; (-) strand; PAM type: NRG; PAM sequence: TGG
gaagagcagatactgatttc

SEQ ID NO: 88458 - DNA, 20 bp, Artificial Sequence
  Description of Artificial Sequence: Synthetic oligonucleotide
  Target: ATXN1; (-) strand; PAM type: NRG; PAM sequence: CAG
gctatttttctttggaagag

SEQ ID NO: 88459 - DNA, 20 bp, Artificial Sequence
  Description of Artificial Sequence: Synthetic oligonucleotide
  Target: ATXN1; (-) strand; PAM type: NRG; PAM sequence: GAG
aaggctatttttctttggaa

SEQ ID NO: 88460 - DNA, 20 bp, Artificial Sequence
  Description of Artificial Sequence: Synthetic oligonucleotide
  Target: ATXN1; (-) strand; PAM type: NRG; PAM sequence: AAG
aaaaggctatttttctttgg

SEQ ID NO: 88461 - DNA, 20 bp, Artificial Sequence
  Description of Artificial Sequence: Synthetic oligonucleotide
  Target: ATXN1; (-) strand; PAM type: NRG; PAM sequence: TGG
aacaaaaggctatttttctt

SEQ ID NO: 88462 - DNA, 20 bp, Artificial Sequence
  Description of Artificial Sequence: Synthetic oligonucleotide
  Target: ATXN1; (-) strand; PAM type: NRG; PAM sequence: AGG
actgaacaatagaaaacaaa

SEQ ID NO: 88463 - DNA, 20 bp, Artificial Sequence
  Description of Artificial Sequence: Synthetic oligonucleotide
  Target: ATXN1; (-) strand; PAM type: NRG; PAM sequence: AAG
cactgaacaatagaaaacaa

SEQ ID NO: 88464 - DNA, 20 bp, Artificial Sequence
  Description of Artificial Sequence: Synthetic oligonucleotide
  Target: ATXN1; (-) strand; PAM type: NRG; PAM sequence: TAG
gtaagctgtacactgaacaa

SEQ ID NO: 88465 - DNA, 20 bp, Artificial Sequence
  Description of Artificial Sequence: Synthetic oligonucleotide
  Target: ATXN1; (-) strand; PAM type: NRG; PAM sequence: AAG
tttattccttgcttagtggt

SEQ ID NO: 88466 - DNA, 20 bp, Artificial Sequence
  Description of Artificial Sequence: Synthetic oligonucleotide
  Target: ATXN1; (-) strand; PAM type: NRG; PAM sequence: TGG
cacatttattccttgcttag

SEQ ID NO: 88467 - DNA, 20 bp, Artificial Sequence
  Description of Artificial Sequence: Synthetic oligonucleotide
  Target: ATXN1; (-) strand; PAM type: NRG; PAM sequence: TAG
ccccacatttattccttgct

SEQ ID NO: 88468 - DNA, 20 bp, Artificial Sequence
  Description of Artificial Sequence: Synthetic oligonucleotide
  Target: ATXN1; (-) strand; PAM type: NRG; PAM sequence: TAG
tggcacatacagatgaactg

SEQ ID NO: 88469 - DNA, 20 bp, Artificial Sequence
  Description of Artificial Sequence: Synthetic oligonucleotide
  Target: ATXN1; (-) strand; PAM type: NRG; PAM sequence: CAG
aagtaacatgctggcacata

SEQ ID NO: 88470 - DNA, 20 bp, Artificial Sequence
  Description of Artificial Sequence: Synthetic oligonucleotide
  Target: ATXN1; (-) strand; PAM type: NRG; PAM sequence: TGG
aacccttgaaagtaacatgc

SEQ ID NO: 88471 - DNA, 20 bp, Artificial Sequence
  Description of Artificial Sequence: Synthetic oligonucleotide
  Target: ATXN1; (-) strand; PAM type: NRG; PAM sequence: AAG
tggagctactgaacccttga

SEQ ID NO: 88472 - DNA, 20 bp, Artificial Sequence
  Description of Artificial Sequence: Synthetic oligonucleotide
  Target: ATXN1; (-) strand; PAM type: NRG; PAM sequence: GAG
agaagtttctttctgccgtg

SEQ ID NO: 88473 - DNA, 20 bp, Artificial Sequence
  Description of Artificial Sequence: Synthetic oligonucleotide
  Target: ATXN1; (-) strand; PAM type: NRG; PAM sequence: TGG
agagaagtttctttctgccg

SEQ ID NO: 88474 - DNA, 20 bp, Artificial Sequence
  Description of Artificial Sequence: Synthetic oligonucleotide
  Target: ATXN1; (-) strand; PAM type: NRG; PAM sequence: AAG
tttaatagtgagtaatagag

SEQ ID NO: 88475 - DNA, 20 bp, Artificial Sequence
  Description of Artificial Sequence: Synthetic oligonucleotide
  Target: ATXN1; (-) strand; PAM type: NRG; PAM sequence: GAG
cagtttaatagtgagtaata

SEQ ID NO: 88476 - DNA, 20 bp, Artificial Sequence
  Description of Artificial Sequence: Synthetic oligonucleotide
  Target: ATXN1; (-) strand; PAM type: NRG; PAM sequence: TAG
tgcagtttaatagtgagtaa

SEQ ID NO: 88477 - DNA, 20 bp, Artificial Sequence
  Description of Artificial Sequence: Synthetic oligonucleotide
  Target: ATXN1; (-) strand; PAM type: NRG; PAM sequence: GAG
ttgaaatgcagtttaatagt

SEQ ID NO: 88478 - DNA, 20 bp, Artificial Sequence
  Description of Artificial Sequence: Synthetic oligonucleotide
  Target: ATXN1; (-) strand; PAM type: NRG; PAM sequence: TAG
ggttttgaaatgcagtttaa

SEQ ID NO: 88479 - DNA, 20 bp, Artificial Sequence
  Description of Artificial Sequence: Synthetic oligonucleotide
  Target: ATXN1; (-) strand; PAM type: NRG; PAM sequence: CAG
tttttgtaggttttgaaatg

SEQ ID NO: 88480 - DNA, 20 bp, Artificial Sequence
  Description of Artificial Sequence: Synthetic oligonucleotide
  Target: ATXN1; (-) strand; PAM type: NRG; PAM sequence: AGG
aattttggagctgtttttgt

SEQ ID NO: 88481 - DNA, 20 bp, Artificial Sequence
  Description of Artificial Sequence: Synthetic oligonucleotide
  Target: ATXN1; (-) strand; PAM type: NRG; PAM sequence: TAG
taattttggagctgtttttg

SEQ ID NO: 88482 - DNA, 20 bp, Artificial Sequence
  Description of Artificial Sequence: Synthetic oligonucleotide
  Target: ATXN1; (-) strand; PAM type: NRG; PAM sequence: GAG
attttgctggcttaattttg

SEQ ID NO: 88483 - DNA, 20 bp, Artificial Sequence
  Description of Artificial Sequence: Synthetic oligonucleotide
  Target: ATXN1; (-) strand; PAM type: NRG; PAM sequence: TGG
acattttgctggcttaattt

SEQ ID NO: 88484 - DNA, 20 bp, Artificial Sequence
  Description of Artificial Sequence: Synthetic oligonucleotide
  Target: ATXN1; (-) strand; PAM type: NRG; PAM sequence: TGG
ggatgacagcaacattttgc

SEQ ID NO: 88485 - DNA, 20 bp, Artificial Sequence
  Description of Artificial Sequence: Synthetic oligonucleotide
  Target: ATXN1; (-) strand; PAM type: NRG; PAM sequence: CAG
taacaggttcagatggatga

SEQ ID NO: 88486 - DNA, 20 bp, Artificial Sequence
  Description of Artificial Sequence: Synthetic oligonucleotide
  Target: ATXN1; (-) strand; PAM type: NRG; PAM sequence: TGG
agatttctaacaggttcaga

SEQ ID NO: 88487 - DNA, 20 bp, Artificial Sequence
  Description of Artificial Sequence: Synthetic oligonucleotide
  Target: ATXN1; (-) strand; PAM type: NRG; PAM sequence: CAG
cttgagatttctaacaggtt

SEQ ID NO: 88488 - DNA, 20 bp, Artificial Sequence
  Description of Artificial Sequence: Synthetic oligonucleotide
  Target: ATXN1; (-) strand; PAM type: NRG; PAM sequence: AGG
acgagcttgagatttctaac

SEQ ID NO: 88489 - DNA, 20 bp, Artificial Sequence
  Description of Artificial Sequence: Synthetic oligonucleotide
  Target: ATXN1; (-) strand; PAM type: NRG; PAM sequence: CAG
gacgagcttgagatttctaa

SEQ ID NO: 88490 - DNA, 20 bp, Artificial Sequence
  Description of Artificial Sequence: Synthetic oligonucleotide
  Target: ATXN1; (-) strand; PAM type: NRG; PAM sequence: GAG
aaagattctatgacgagctt

SEQ ID NO: 88491 - DNA, 20 bp, Artificial Sequence
  Description of Artificial Sequence: Synthetic oligonucleotide
  Target: ATXN1; (-) strand; PAM type: NRG; PAM sequence: GAG
gaggtcaaagattctatgac

SEQ ID NO: 88492 - DNA, 20 bp, Artificial Sequence
  Description of Artificial Sequence: Synthetic oligonucleotide
  Target: ATXN1; (-) strand; PAM type: NRG; PAM sequence: AAG
aacattgaatggtgaggtca

SEQ ID NO: 88493 - DNA, 20 bp, Artificial Sequence
  Description of Artificial Sequence: Synthetic oligonucleotide
  Target: ATXN1; (-) strand; PAM type: NRG; PAM sequence: AGG
ttgtaaaacattgaatggtg

SEQ ID NO: 88494 - DNA, 20 bp, Artificial Sequence
  Description of Artificial Sequence: Synthetic oligonucleotide
  Target: ATXN1; (-) strand; PAM type: NRG; PAM sequence: GAG
tttgtaaaacattgaatggt

SEQ ID NO: 88495 - DNA, 20 bp, Artificial Sequence
  Description of Artificial Sequence: Synthetic oligonucleotide
  Target: ATXN1; (-) strand; PAM type: NRG; PAM sequence: TGG
tcaatttgtaaaacattgaa

SEQ ID NO: 88496 - DNA, 20 bp, Artificial Sequence
  Description of Artificial Sequence: Synthetic oligonucleotide
  Target: ATXN1; (-) strand; PAM type: NRG; PAM sequence: TAG
agtagtaaatgacagggaca

SEQ ID NO: 88497 - DNA, 20 bp, Artificial Sequence
  Description of Artificial Sequence: Synthetic oligonucleotide
  Target: ATXN1; (-) strand; PAM type: NRG; PAM sequence: GGG
cattttagtagtaaatgaca

SEQ ID NO: 88498 - DNA, 20 bp, Artificial Sequence
  Description of Artificial Sequence: Synthetic oligonucleotide
  Target: ATXN1; (-) strand; PAM type: NRG; PAM sequence: AGG
tcattttagtagtaaatgac

SEQ ID NO: 88499 - DNA, 20 bp, Artificial Sequence
  Description of Artificial Sequence: Synthetic oligonucleotide
  Target: ATXN1; (-) strand; PAM type: NRG; PAM sequence: CAG
gtcattttagtagtaaatga

SEQ ID NO: 88500 - DNA, 20 bp, Artificial Sequence
  Description of Artificial Sequence: Synthetic oligonucleotide
  Target: ATXN1; (-) strand; PAM type: NRG; PAM sequence: TAG
ttttatttttgtcattttag

SEQ ID NO: 88501 - DNA, 20 bp, Artificial Sequence
  Description of Artificial Sequence: Synthetic oligonucleotide
  Target: ATXN1; (-) strand; PAM type: NRG; PAM sequence: TAG
tatttttatttttgtcattt

SEQ ID NO: 88502 - DNA, 20 bp, Artificial Sequence
  Description of Artificial Sequence: Synthetic oligonucleotide
  Target: ATXN1; (-) strand; PAM type: NRG; PAM sequence: CAG
cctcacctactcctaacctt

SEQ ID NO: 88503 - DNA, 20 bp, Artificial Sequence
  Description of Artificial Sequence: Synthetic oligonucleotide
  Target: ATXN1; (-) strand; PAM type: NRG; PAM sequence: CGG
aatctagctctgaattcagc

SEQ ID NO: 88504 - DNA, 20 bp, Artificial Sequence
  Description of Artificial Sequence: Synthetic oligonucleotide
  Target: ATXN1; (-) strand; PAM type: NRG; PAM sequence: CAG
ttggaatctagctctgaatt

SEQ ID NO: 88505 - DNA, 20 bp, Artificial Sequence
  Description of Artificial Sequence: Synthetic oligonucleotide
  Target: ATXN1; (-) strand; PAM type: NRG; PAM sequence: TAG
cctgaaacccacttggaatc

SEQ ID NO: 88506 - DNA, 20 bp, Artificial Sequence
  Description of Artificial Sequence: Synthetic oligonucleotide
  Target: ATXN1; (-) strand; PAM type: NRG; PAM sequence: TGG
agtcctccctgaaacccact

SEQ ID NO: 88507 - DNA, 20 bp, Artificial Sequence
  Description of Artificial Sequence: Synthetic oligonucleotide
  Target: ATXN1; (-) strand; PAM type: NRG; PAM sequence: CAG
catttgcagttctctgactt

SEQ ID NO: 88508 - DNA, 20 bp, Artificial Sequence
  Description of Artificial Sequence: Synthetic oligonucleotide
  Target: ATXN1; (-) strand; PAM type: NRG; PAM sequence: CAG
agatggtgaaacaacatttg

SEQ ID NO: 88509 - DNA, 20 bp, Artificial Sequence
  Description of Artificial Sequence: Synthetic oligonucleotide
  Target: ATXN1; (-) strand; PAM type: NRG; PAM sequence: TGG
taaagctgtgaataaacaga

SEQ ID NO: 88510 - DNA, 20 bp, Artificial Sequence
  Description of Artificial Sequence: Synthetic oligonucleotide
  Target: ATXN1; (-) strand; PAM type: NRG; PAM sequence: CAG
aaggtaaagctgtgaataaa

SEQ ID NO: 88511 - DNA, 20 bp, Artificial Sequence
  Description of Artificial Sequence: Synthetic oligonucleotide
  Target: ATXN1; (-) strand; PAM type: NRG; PAM sequence: AAG
actctgatgagtcaaaggta

SEQ ID NO: 88512 - DNA, 20 bp, Artificial Sequence
  Description of Artificial Sequence: Synthetic oligonucleotide
  Target: ATXN1; (-) strand; PAM type: NRG; PAM sequence: AGG
acctcactctgatgagtcaa

SEQ ID NO: 88513 - DNA, 20 bp, Artificial Sequence
  Description of Artificial Sequence: Synthetic oligonucleotide
  Target: ATXN1; (-) strand; PAM type: NRG; PAM sequence: AAG
gacctcactctgatgagtca

SEQ ID NO: 88514 - DNA, 20 bp, Artificial Sequence
  Description of Artificial Sequence: Synthetic oligonucleotide
  Target: ATXN1; (-) strand; PAM type: NRG; PAM sequence: GAG
ttttcagacctcactctgat

SEQ ID NO: 88515 - DNA, 20 bp, Artificial Sequence
  Description of Artificial Sequence: Synthetic oligonucleotide
  Target: ATXN1; (-) strand; PAM type: NRG; PAM sequence: CAG
tatgacccacaaacagtttt

SEQ ID NO: 88516 - DNA, 20 bp, Artificial Sequence
  Description of Artificial Sequence: Synthetic oligonucleotide
  Target: ATXN1; (-) strand; PAM type: NRG; PAM sequence: CAG
tttttactatgacccacaaa

SEQ ID NO: 88517 - DNA, 20 bp, Artificial Sequence
  Description of Artificial Sequence: Synthetic oligonucleotide
  Target: ATXN1; (-) strand; PAM type: NRG; PAM sequence: CAG
ctggaagtcacattgtcctt

SEQ ID NO: 88518 - DNA, 20 bp, Artificial Sequence
  Description of Artificial Sequence: Synthetic oligonucleotide
  Target: ATXN1; (-) strand; PAM type: NRG; PAM sequence: AAG
gttggcttacctctccctgg

SEQ ID NO: 88519 - DNA, 20 bp, Artificial Sequence
  Description of Artificial Sequence: Synthetic oligonucleotide
  Target: ATXN1; (-) strand; PAM type: NRG; PAM sequence: TGG
taggttggcttacctctccc

SEQ ID NO: 88520 - DNA, 20 bp, Artificial Sequence
  Description of Artificial Sequence: Synthetic oligonucleotide
  Target: ATXN1; (-) strand; PAM type: NRG; PAM sequence: TGG
ctggctcatgcagtgtaggt

SEQ ID NO: 88521 - DNA, 20 bp, Artificial Sequence
  Description of Artificial Sequence: Synthetic oligonucleotide
  Target: ATXN1; (-) strand; PAM type: NRG; PAM sequence: AGG
tctgctggctcatgcagtgt

SEQ ID NO: 88522 - DNA, 20 bp, Artificial Sequence
  Description of Artificial Sequence: Synthetic oligonucleotide
  Target: ATXN1; (-) strand; PAM type: NRG; PAM sequence: TAG
ctctgctggctcatgcagtg

SEQ ID NO: 88523 - DNA, 20 bp, Artificial Sequence
  Description of Artificial Sequence: Synthetic oligonucleotide
  Target: ATXN1; (-) strand; PAM type: NRG; PAM sequence: CAG
gtctgctctgctggctcatg

SEQ ID NO: 88524 - DNA, 20 bp, Artificial Sequence
  Description of Artificial Sequence: Synthetic oligonucleotide
  Target: ATXN1; (-) strand; PAM type: NRG; PAM sequence: TGG
cctttcagtgtctgctctgc

SEQ ID NO: 88525 - DNA, 20 bp, Artificial Sequence
  Description of Artificial Sequence: Synthetic oligonucleotide
  Target: ATXN1; (-) strand; PAM type: NRG; PAM sequence: CAG
tttttcttcttatcaccttt

SEQ ID NO: 88526 - DNA, 20 bp, Artificial Sequence
  Description of Artificial Sequence: Synthetic oligonucleotide
  Target: ATXN1; (-) strand; PAM type: NRG; PAM sequence: AAG
ggtcttacgttaataaaaac

SEQ ID NO: 88527 - DNA, 20 bp, Artificial Sequence
  Description of Artificial Sequence: Synthetic oligonucleotide
  Target: ATXN1; (-) strand; PAM type: NRG; PAM sequence: AGG
gaagtctgaggaagttggtg

SEQ ID NO: 88528 - DNA, 20 bp, Artificial Sequence
  Description of Artificial Sequence: Synthetic oligonucleotide
  Target: ATXN1; (-) strand; PAM type: NRG; PAM sequence: GAG
ggaagtctgaggaagttggt

SEQ ID NO: 88529 - DNA, 20 bp, Artificial Sequence
  Description of Artificial Sequence: Synthetic oligonucleotide
  Target: ATXN1; (-) strand; PAM type: NRG; PAM sequence: TGG
ttggggaagtctgaggaagt

SEQ ID NO: 88530 - DNA, 20 bp, Artificial Sequence
  Description of Artificial Sequence: Synthetic oligonucleotide
  Target: ATXN1; (-) strand; PAM type: NRG; PAM sequence: AAG
tcatttggggaagtctgagg

SEQ ID NO: 88531 - DNA, 20 bp, Artificial Sequence
  Description of Artificial Sequence: Synthetic oligonucleotide
  Target: ATXN1; (-) strand; PAM type: NRG; PAM sequence: AGG
atttcatttggggaagtctg

SEQ ID NO: 88532 - DNA, 20 bp, Artificial Sequence
  Description of Artificial Sequence: Synthetic oligonucleotide
  Target: ATXN1; (-) strand; PAM type: NRG; PAM sequence: GAG
catttcatttggggaagtct

SEQ ID NO: 88533 - DNA, 20 bp, Artificial Sequence
  Description of Artificial Sequence: Synthetic oligonucleotide
  Target: ATXN1; (-) strand; PAM type: NRG; PAM sequence: AAG
gtctgacatttcatttgggg

SEQ ID NO: 88534 - DNA, 20 bp, Artificial Sequence
  Description of Artificial Sequence: Synthetic oligonucleotide
  Target: ATXN1; (-) strand; PAM type: NRG; PAM sequence: GGG
cgagtctgacatttcatttg

SEQ ID NO: 88535 - DNA, 20 bp, Artificial Sequence
  Description of Artificial Sequence: Synthetic oligonucleotide
  Target: ATXN1; (-) strand; PAM type: NRG; PAM sequence: GGG
gcgagtctgacatttcattt

SEQ ID NO: 88536 - DNA, 20 bp, Artificial Sequence
  Description of Artificial Sequence: Synthetic oligonucleotide
  Target: ATXN1; (-) strand; PAM type: NRG; PAM sequence: TGG
tgcgagtctgacatttcatt

SEQ ID NO: 88537 - DNA, 20 bp, Artificial Sequence
  Description of Artificial Sequence: Synthetic oligonucleotide
  Target: ATXN1; (-) strand; PAM type: NRG; PAM sequence: GAG
attcttactcagaatcatgc

SEQ ID NO: 88538 - DNA, 20 bp, Artificial Sequence
  Description of Artificial Sequence: Synthetic oligonucleotide
  Target: ATXN1; (-) strand; PAM type: NRG; PAM sequence: CAG
ggacacagttgattcttact

SEQ ID NO: 88539 - DNA, 20 bp, Artificial Sequence
  Description of Artificial Sequence: Synthetic oligonucleotide
  Target: ATXN1; (-) strand; PAM type: NRG; PAM sequence: CAG
tgtttttcttctaagggaca

SEQ ID NO: 88540 - DNA, 20 bp, Artificial Sequence
  Description of Artificial Sequence: Synthetic oligonucleotide
  Target: ATXN1; (-) strand; PAM type: NRG; PAM sequence: GGG
ttgggatgtttttcttctaa

SEQ ID NO: 88541 - DNA, 20 bp, Artificial Sequence
  Description of Artificial Sequence: Synthetic oligonucleotide
  Target: ATXN1; (-) strand; PAM type: NRG; PAM sequence: AGG
tttgggatgtttttcttcta

SEQ ID NO: 88542 - DNA, 20 bp, Artificial Sequence
  Description of Artificial Sequence: Synthetic oligonucleotide
  Target: ATXN1; (-) strand; PAM type: NRG; PAM sequence: AAG
atttgggatgtttttcttct

SEQ ID NO: 88543 - DNA, 20 bp, Artificial Sequence
  Description of Artificial Sequence: Synthetic oligonucleotide
  Target: ATXN1; (-) strand; PAM type: NRG; PAM sequence: GGG
ccacgattatcactgaattt

SEQ ID NO: 88544 - DNA, 20 bp, Artificial Sequence
  Description of Artificial Sequence: Synthetic oligonucleotide
  Target: ATXN1; (-) strand; PAM type: NRG; PAM sequence: TGG
cccacgattatcactgaatt

SEQ ID NO: 88545 - DNA, 20 bp, Artificial Sequence
  Description of Artificial Sequence: Synthetic oligonucleotide
  Target: ATXN1; (-) strand; PAM type: NRG; PAM sequence: TGG
atctatttggtcaaaaagaa

SEQ ID NO: 88546 - DNA, 20 bp, Artificial Sequence
  Description of Artificial Sequence: Synthetic oligonucleotide
  Target: ATXN1; (-) strand; PAM type: NRG; PAM sequence: AAG
gcaaaatctatttggtcaaa

SEQ ID NO: 88547 - DNA, 20 bp, Artificial Sequence
  Description of Artificial Sequence: Synthetic oligonucleotide
  Target: ATXN1; (-) strand; PAM type: NRG; PAM sequence: TGG
gttcgtgagcaaaatctatt

SEQ ID NO: 88548 - DNA, 20 bp, Artificial Sequence
  Description of Artificial Sequence: Synthetic oligonucleotide
  Target: ATXN1; (-) strand; PAM type: NRG; PAM sequence: GAG
tacattaaaaaaatgttcgt

SEQ ID NO: 88549 - DNA, 20 bp, Artificial Sequence
  Description of Artificial Sequence: Synthetic oligonucleotide
  Target: ATXN1; (-) strand; PAM type: NRG; PAM sequence: GGG
gtactgtgttgcttcctact

SEQ ID NO: 88550 - DNA, 20 bp, Artificial Sequence
  Description of Artificial Sequence: Synthetic oligonucleotide
  Target: ATXN1; (-) strand; PAM type: NRG; PAM sequence: TGG
tgtactgtgttgcttcctac

SEQ ID NO: 88551 - DNA, 20 bp, Artificial Sequence
  Description of Artificial Sequence: Synthetic oligonucleotide
  Target: ATXN1; (-) strand; PAM type: NRG; PAM sequence: AAG
tgtttcatcctgagcggatt

SEQ ID NO: 88552 - DNA, 20 bp, Artificial Sequence
  Description of Artificial Sequence: Synthetic oligonucleotide
  Target: ATXN1; (-) strand; PAM type: NRG; PAM sequence: CGG
gtagtgtgtttcatcctgag

SEQ ID NO: 88553 - DNA, 20 bp, Artificial Sequence
  Description of Artificial Sequence: Synthetic oligonucleotide
  Target: ATXN1; (-) strand; PAM type: NRG; PAM sequence: GAG
taagtagtgtgtttcatcct

SEQ ID NO: 88554 - DNA, 20 bp, Artificial Sequence
  Description of Artificial Sequence: Synthetic oligonucleotide
  Target: ATXN1; (-) strand; PAM type: NRG; PAM sequence: TAG
gtcattcagtttattttaag

SEQ ID NO: 88555 - DNA, 20 bp, Artificial Sequence
  Description of Artificial Sequence: Synthetic oligonucleotide
  Target: ATXN1; (-) strand; PAM type: NRG; PAM sequence: AAG
ggtgtcattcagtttatttt

SEQ ID NO: 88556 - DNA, 20 bp, Artificial Sequence
  Description of Artificial Sequence: Synthetic oligonucleotide
  Target: ATXN1; (-) strand; PAM type: NRG; PAM sequence: CAG
ggatcattttaggtgtcatt

SEQ ID NO: 88557 - DNA, 20 bp, Artificial Sequence
  Description of Artificial Sequence: Synthetic oligonucleotide
  Target: ATXN1; (-) strand; PAM type: NRG; PAM sequence: AGG
ttcattcagcggatcatttt

SEQ ID NO: 88558 - DNA, 20 bp, Artificial Sequence
  Description of Artificial Sequence: Synthetic oligonucleotide
  Target: ATXN1; (-) strand; PAM type: NRG; PAM sequence: TAG
tttcattcagcggatcattt

SEQ ID NO: 88559 - DNA, 20 bp, Artificial Sequence
  Description of Artificial Sequence: Synthetic oligonucleotide
  Target: ATXN1; (-) strand; PAM type: NRG; PAM sequence: CGG
tagcttttcttttcattcag

SEQ ID NO: 88560 - DNA, 20 bp, Artificial Sequence
  Description of Artificial Sequence: Synthetic oligonucleotide
  Target: ATXN1; (-) strand; PAM type: NRG; PAM sequence: CAG
gaatagcttttcttttcatt

SEQ ID NO: 88561 - DNA, 20 bp, Artificial Sequence
  Description of Artificial Sequence: Synthetic oligonucleotide
  Target: ATXN1; (-) strand; PAM type: NRG; PAM sequence: TAG
gtttattttgtgacttggaa

SEQ ID NO: 88562 - DNA, 20 bp, Artificial Sequence
  Description of Artificial Sequence: Synthetic oligonucleotide
  Target: ATXN1; (-) strand; PAM type: NRG; PAM sequence: TGG
taatagtttattttgtgact

SEQ ID NO: 88563 - DNA, 20 bp, Artificial Sequence
  Description of Artificial Sequence: Synthetic oligonucleotide
  Target: ATXN1; (-) strand; PAM type: NRG; PAM sequence: TAG
aagcttccatggcttaataa

SEQ ID NO: 88564 - DNA, 20 bp, Artificial Sequence
  Description of Artificial Sequence: Synthetic oligonucleotide
  Target: ATXN1; (-) strand; PAM type: NRG; PAM sequence: TGG
gaatacagagtaagcttcca

SEQ ID NO: 88565 - DNA, 20 bp, Artificial Sequence
  Description of Artificial Sequence: Synthetic oligonucleotide
  Target: ATXN1; (-) strand; PAM type: NRG; PAM sequence: AAG
ggagagtgagaatacagagt

SEQ ID NO: 88566 - DNA, 20 bp, Artificial Sequence
  Description of Artificial Sequence: Synthetic oligonucleotide
  Target: ATXN1; (-) strand; PAM type: NRG; PAM sequence: GAG
aaaaggagagtgagaataca

SEQ ID NO: 88567 - DNA, 20 bp, Artificial Sequence
  Description of Artificial Sequence: Synthetic oligonucleotide
  Target: ATXN1; (-) strand; PAM type: NRG; PAM sequence: CAG
tgaaaaggagagtgagaata

SEQ ID NO: 88568 - DNA, 20 bp, Artificial Sequence
  Description of Artificial Sequence: Synthetic oligonucleotide
  Target: ATXN1; (-) strand; PAM type: NRG; PAM sequence: GAG
atgtcactgaaaaggagagt

SEQ ID NO: 88569 - DNA, 20 bp, Artificial Sequence
  Description of Artificial Sequence: Synthetic oligonucleotide
  Target: ATXN1; (-) strand; PAM type: NRG; PAM sequence: GAG
aaaaatgtcactgaaaagga

SEQ ID NO: 88570 - DNA, 20 bp, Artificial Sequence
  Description of Artificial Sequence: Synthetic oligonucleotide
  Target: ATXN1; (-) strand; PAM type: NRG; PAM sequence: GAG
ataaaaatgtcactgaaaag

SEQ ID NO: 88571 - DNA, 20 bp, Artificial Sequence
  Description of Artificial Sequence: Synthetic oligonucleotide
  Target: ATXN1; (-) strand; PAM type: NRG; PAM sequence: AGG
tcataaaaatgtcactgaaa

SEQ ID NO: 88572 - DNA, 20 bp, Artificial Sequence
  Description of Artificial Sequence: Synthetic oligonucleotide
  Target: ATXN1; (-) strand; PAM type: NRG; PAM sequence: AAG
ttcataaaaatgtcactgaa

SEQ ID NO: 88573 - DNA, 20 bp, Artificial Sequence
  Description of Artificial Sequence: Synthetic oligonucleotide
  Target: ATXN1; (-) strand; PAM type: NRG; PAM sequence: AAG
tttgagttttctctgctgca

SEQ ID NO: 88574 - DNA, 20 bp, Artificial Sequence
  Description of Artificial Sequence: Synthetic oligonucleotide
  Target: ATXN1; (-) strand; PAM type: NRG; PAM sequence: GAG
taattgggaaagcattattt

SEQ ID NO: 88575 - DNA, 20 bp, Artificial Sequence
  Description of Artificial Sequence: Synthetic oligonucleotide
  Target: ATXN1; (-) strand; PAM type: NRG; PAM sequence: AAG
caggatttttttaattggga

SEQ ID NO: 88576 - DNA, 20 bp, Artificial Sequence
  Description of Artificial Sequence: Synthetic oligonucleotide
  Target: ATXN1; (-) strand; PAM type: NRG; PAM sequence: GGG
accccaggatttttttaatt

SEQ ID NO: 88577 - DNA, 20 bp, Artificial Sequence
  Description of Artificial Sequence: Synthetic oligonucleotide
  Target: ATXN1; (-) strand; PAM type: NRG; PAM sequence: TGG
gaccccaggatttttttaat

SEQ ID NO: 88578 - DNA, 20 bp, Artificial Sequence
  Description of Artificial Sequence: Synthetic oligonucleotide
  Target: ATXN1; (-) strand; PAM type: NRG; PAM sequence: AGG
ggccggtcctggaagacccc

SEQ ID NO: 88579 - DNA, 20 bp, Artificial Sequence
  Description of Artificial Sequence: Synthetic oligonucleotide
  Target: ATXN1; (-) strand; PAM type: NRG; PAM sequence: CAG
gggccggtcctggaagaccc

SEQ ID NO: 88580 - DNA, 20 bp, Artificial Sequence
  Description of Artificial Sequence: Synthetic oligonucleotide
  Target: ATXN1; (-) strand; PAM type: NRG; PAM sequence: AAG
caaggaagggccggtcctgg

SEQ ID NO: 88581 - DNA, 20 bp, Artificial Sequence
  Description of Artificial Sequence: Synthetic oligonucleotide
  Target: ATXN1; (-) strand; PAM type: NRG; PAM sequence: TGG
gaacaaggaagggccggtcc

SEQ ID NO: 88582 - DNA, 20 bp, Artificial Sequence
  Description of Artificial Sequence: Synthetic oligonucleotide
  Target: ATXN1; (-) strand; PAM type: NRG; PAM sequence: CGG
ggaggagaacaaggaagggc

SEQ ID NO: 88583 - DNA, 20 bp, Artificial Sequence
  Description of Artificial Sequence: Synthetic oligonucleotide
  Target: ATXN1; (-) strand; PAM type: NRG; PAM sequence: GGG
gcatggaggagaacaaggaa

SEQ ID NO: 88584 - DNA, 20 bp, Artificial Sequence
  Description of Artificial Sequence: Synthetic oligonucleotide
  Target: ATXN1; (-) strand; PAM type: NRG; PAM sequence: AGG
agcatggaggagaacaagga

SEQ ID NO: 88585 - DNA, 20 bp, Artificial Sequence
  Description of Artificial Sequence: Synthetic oligonucleotide
  Target: ATXN1; (-) strand; PAM type: NRG; PAM sequence: AAG
cagcatggaggagaacaagg

SEQ ID NO: 88586 - DNA, 20 bp, Artificial Sequence
  Description of Artificial Sequence: Synthetic oligonucleotide
  Target: ATXN1; (-) strand; PAM type: NRG; PAM sequence: AGG
gaccagcatggaggagaaca

SEQ ID NO: 88587 - DNA, 20 bp, Artificial Sequence
  Description of Artificial Sequence: Synthetic oligonucleotide
  Target: ATXN1; (-) strand; PAM type: NRG; PAM sequence: AAG
tgaccagcatggaggagaac

SEQ ID NO: 88588 - DNA, 20 bp, Artificial Sequence
  Description of Artificial Sequence: Synthetic oligonucleotide
  Target: ATXN1; (-) strand; PAM type: NRG; PAM sequence: GAG
ccagtttgaccagcatggag

SEQ ID NO: 88589 - DNA, 20 bp, Artificial Sequence
  Description of Artificial Sequence: Synthetic oligonucleotide
  Target: ATXN1; (-) strand; PAM type: NRG; PAM sequence: AGG
cgccagtttgaccagcatgg

SEQ ID NO: 88590 - DNA, 20 bp, Artificial Sequence
  Description of Artificial Sequence: Synthetic oligonucleotide
  Target: ATXN1; (-) strand; PAM type: NRG; PAM sequence: GAG
tcgccagtttgaccagcatg

SEQ ID NO: 88591 - DNA, 20 bp, Artificial Sequence
  Description of Artificial Sequence: Synthetic oligonucleotide
  Target: ATXN1; (-) strand; PAM type: NRG; PAM sequence: TGG
gatcgccagtttgaccagca

SEQ ID NO: 88592 - DNA, 20 bp, Artificial Sequence
  Description of Artificial Sequence: Synthetic oligonucleotide
  Target: ATXN1; (-) strand; PAM type: NRG; PAM sequence: CAG
gtccagatcgccagtttgac

SEQ ID NO: 88593 - DNA, 20 bp, Artificial Sequence
  Description of Artificial Sequence: Synthetic oligonucleotide
  Target: ATXN1; (-) strand; PAM type: NRG; PAM sequence: CAG
aaagagcctgtccagatcgc

SEQ ID NO: 88594 - DNA, 20 bp, Artificial Sequence
  Description of Artificial Sequence: Synthetic oligonucleotide
  Target: ATXN1; (-) strand; PAM type: NRG; PAM sequence: CAG
cttgctccaaagagcctgtc

SEQ ID NO: 88595 - DNA, 20 bp, Artificial Sequence
  Description of Artificial Sequence: Synthetic oligonucleotide
  Target: ATXN1; (-) strand; PAM type: NRG; PAM sequence: GAG
gttgagcaccttgctccaaa

SEQ ID NO: 88596 - DNA, 20 bp, Artificial Sequence
  Description of Artificial Sequence: Synthetic oligonucleotide
  Target: ATXN1; (-) strand; PAM type: NRG; PAM sequence: AAG
gagttgagcaccttgctcca

SEQ ID NO: 88597 - DNA, 20 bp, Artificial Sequence
  Description of Artificial Sequence: Synthetic oligonucleotide
  Target: ATXN1; (-) strand; PAM type: NRG; PAM sequence: GAG
aatactattcttcaagagtt

SEQ ID NO: 88598 - DNA, 20 bp, Artificial Sequence
  Description of Artificial Sequence: Synthetic oligonucleotide
  Target: ATXN1; (-) strand; PAM type: NRG; PAM sequence: GAG
ttgccaatactattcttcaa

SEQ ID NO: 88599 - DNA, 20 bp, Artificial Sequence
  Description of Artificial Sequence: Synthetic oligonucleotide
  Target: ATXN1; (-) strand; PAM type: NRG; PAM sequence: AAG
ccttgccaatactattcttc

SEQ ID NO: 88600 - DNA, 20 bp, Artificial Sequence
  Description of Artificial Sequence: Synthetic oligonucleotide
  Target: ATXN1; (-) strand; PAM type: NRG; PAM sequence: AAG
atgcagagaagtacatcccc

SEQ ID NO: 88601 - DNA, 20 bp, Artificial Sequence
  Description of Artificial Sequence: Synthetic oligonucleotide
  Target: ATXN1; (-) strand; PAM type: NRG; PAM sequence: AAG
tctgcaccccagatgcagag

SEQ ID NO: 88602 - DNA, 20 bp, Artificial Sequence
  Description of Artificial Sequence: Synthetic oligonucleotide
  Target: ATXN1; (-) strand; PAM type: NRG; PAM sequence: GAG
ttttctgcaccccagatgca

SEQ ID NO: 88603 - DNA, 20 bp, Artificial Sequence
  Description of Artificial Sequence: Synthetic oligonucleotide
  Target: ATXN1; (-) strand; PAM type: NRG; PAM sequence: CAG
tcttttctgcaccccagatg

SEQ ID NO: 88604 - DNA, 20 bp, Artificial Sequence
  Description of Artificial Sequence: Synthetic oligonucleotide
  Target: ATXN1; (-) strand; PAM type: NRG; PAM sequence: CAG
ttcttatcttttctgcaccc

SEQ ID NO: 88605 - DNA, 20 bp, Artificial Sequence
  Description of Artificial Sequence: Synthetic oligonucleotide
  Target: ATXN1; (-) strand; PAM type: NRG; PAM sequence: GGG
acaggggcagaggcaaatca

SEQ ID NO: 88606 - DNA, 20 bp, Artificial Sequence
  Description of Artificial Sequence: Synthetic oligonucleotide
  Target: ATXN1; (-) strand; PAM type: NRG; PAM sequence: AGG
aacaggggcagaggcaaatc

SEQ ID NO: 88607 - DNA, 20 bp, Artificial Sequence
  Description of Artificial Sequence: Synthetic oligonucleotide
  Target: ATXN1; (-) strand; PAM type: NRG; PAM sequence: CAG
gaacaggggcagaggcaaat

SEQ ID NO: 88608 - DNA, 20 bp, Artificial Sequence
  Description of Artificial Sequence: Synthetic oligonucleotide
  Target: ATXN1; (-) strand; PAM type: NRG; PAM sequence: AGG
aaacataagaacaggggcag

SEQ ID NO: 88609 - DNA, 20 bp, Artificial Sequence
  Description of Artificial Sequence: Synthetic oligonucleotide
  Target: ATXN1; (-) strand; PAM type: NRG; PAM sequence: GAG
gaaacataagaacaggggca

SEQ ID NO: 88610 - DNA, 20 bp, Artificial Sequence
  Description of Artificial Sequence: Synthetic oligonucleotide
  Target: ATXN1; (-) strand; PAM type: NRG; PAM sequence: CAG
cagaaacataagaacagggg

SEQ ID NO: 88611 - DNA, 20 bp, Artificial Sequence
  Description of Artificial Sequence: Synthetic oligonucleotide
  Target: ATXN1; (-) strand; PAM type: NRG; PAM sequence: GGG
cagcagaaacataagaacag

SEQ ID NO: 88612 - DNA, 20 bp, Artificial Sequence
  Description of Artificial Sequence: Synthetic oligonucleotide
  Target: ATXN1; (-) strand; PAM type: NRG; PAM sequence: GGG
ccagcagaaacataagaaca

SEQ ID NO: 88613 - DNA, 20 bp, Artificial Sequence
  Description of Artificial Sequence: Synthetic oligonucleotide
  Target: ATXN1; (-) strand; PAM type: NRG; PAM sequence: AGG
accagcagaaacataagaac

SEQ ID NO: 88614 - DNA, 20 bp, Artificial Sequence
  Description of Artificial Sequence: Synthetic oligonucleotide
  Target: ATXN1; (-) strand; PAM type: NRG; PAM sequence: CAG
caccagcagaaacataagaa

SEQ ID NO: 88615 - DNA, 20 bp, Artificial Sequence
  Description of Artificial Sequence: Synthetic oligonucleotide
  Target: ATXN1; (-) strand; PAM type: NRG; PAM sequence: AAG
atatgcaccagcagaaacat

SEQ ID NO: 88616 - DNA, 20 bp, Artificial Sequence
  Description of Artificial Sequence: Synthetic oligonucleotide
  Target: ATXN1; (-) strand; PAM type: NRG; PAM sequence: CAG
cacagcaagatatgcaccag

SEQ ID NO: 88617 - DNA, 20 bp, Artificial Sequence
  Description of Artificial Sequence: Synthetic oligonucleotide
  Target: ATXN1; (-) strand; PAM type: NRG; PAM sequence: CAG
gagcacagcaagatatgcac

SEQ ID NO: 88618 - DNA, 20 bp, Artificial Sequence
  Description of Artificial Sequence: Synthetic oligonucleotide
  Target: ATXN1; (-) strand; PAM type: NRG; PAM sequence: AAG
tgggggttgcagagcacagc

SEQ ID NO: 88619 - DNA, 20 bp, Artificial Sequence
  Description of Artificial Sequence: Synthetic oligonucleotide
  Target: ATXN1; (-) strand; PAM type: NRG; PAM sequence: CAG
ctggtgggggttgcagagca

SEQ ID NO: 88620 - DNA, 20 bp, Artificial Sequence
  Description of Artificial Sequence: Synthetic oligonucleotide
  Target: ATXN1; (-) strand; PAM type: NRG; PAM sequence: GAG
gtcggctggtgggggttgca

SEQ ID NO: 88621 - DNA, 20 bp, Artificial Sequence
  Description of Artificial Sequence: Synthetic oligonucleotide
  Target: ATXN1; (-) strand; PAM type: NRG; PAM sequence: CAG
gggtcggctggtgggggttg

SEQ ID NO: 88622 - DNA, 20 bp, Artificial Sequence
  Description of Artificial Sequence: Synthetic oligonucleotide
  Target: ATXN1; (-) strand; PAM type: NRG; PAM sequence: GGG
cgtaaggggtcggctggtgg

SEQ ID NO: 88623 - DNA, 20 bp, Artificial Sequence
  Description of Artificial Sequence: Synthetic oligonucleotide
  Target: ATXN1; (-) strand; PAM type: NRG; PAM sequence: GGG
ccgtaaggggtcggctggtg

SEQ ID NO: 88624 - DNA, 20 bp, Artificial Sequence
  Description of Artificial Sequence: Synthetic oligonucleotide
  Target: ATXN1; (-) strand; PAM type: NRG; PAM sequence: GGG
gccgtaaggggtcggctggt

SEQ ID NO: 88625 - DNA, 20 bp, Artificial Sequence
  Description of Artificial Sequence: Synthetic oligonucleotide
  Target: ATXN1; (-) strand; PAM type: NRG; PAM sequence: TGG
ggccgtaaggggtcggctgg

SEQ ID NO: 88626 - DNA, 20 bp, Artificial Sequence
  Description of Artificial Sequence: Synthetic oligonucleotide
  Target: ATXN1; (-) strand; PAM type: NRG; PAM sequence: TGG
aatggccgtaaggggtcggc

SEQ ID NO: 88627 - DNA, 20 bp, Artificial Sequence
  Description of Artificial Sequence: Synthetic oligonucleotide
  Target: ATXN1; (-) strand; PAM type: NRG; PAM sequence: CGG
taggaatggccgtaaggggt

SEQ ID NO: 88628 - DNA, 20 bp, Artificial Sequence
  Description of Artificial Sequence: Synthetic oligonucleotide
  Target: ATXN1; (-) strand; PAM type: NRG; PAM sequence: GGG
cgagtaggaatggccgtaag

SEQ ID NO: 88629 - DNA, 20 bp, Artificial Sequence
  Description of Artificial Sequence: Synthetic oligonucleotide
  Target: ATXN1; (-) strand; PAM type: NRG; PAM sequence: GGG
gcgagtaggaatggccgtaa

SEQ ID NO: 88630 - DNA, 20 bp, Artificial Sequence
  Description of Artificial Sequence: Synthetic oligonucleotide
  Target: ATXN1; (-) strand; PAM type: NRG; PAM sequence: AGG
agcgagtaggaatggccgta

SEQ ID NO: 88631 - DNA, 20 bp, Artificial Sequence
  Description of Artificial Sequence: Synthetic oligonucleotide
  Target: ATXN1; (-) strand; PAM type: NRG; PAM sequence: AAG
cagcgagtaggaatggccgt

SEQ ID NO: 88632 - DNA, 20 bp, Artificial Sequence
  Description of Artificial Sequence: Synthetic oligonucleotide
  Target: ATXN1; (-) strand; PAM type: NRG; PAM sequence: TGG
tgtcaggcagcgagtaggaa

SEQ ID NO: 88633 - DNA, 20 bp, Artificial Sequence
  Description of Artificial Sequence: Synthetic oligonucleotide
  Target: ATXN1; (-) strand; PAM type: NRG; PAM sequence: AGG
catgttgtcaggcagcgagt

SEQ ID NO: 88634 - DNA, 20 bp, Artificial Sequence
  Description of Artificial Sequence: Synthetic oligonucleotide
  Target: ATXN1; (-) strand; PAM type: NRG; PAM sequence: TAG
tcatgttgtcaggcagcgag

SEQ ID NO: 88635 - DNA, 20 bp, Artificial Sequence
  Description of Artificial Sequence: Synthetic oligonucleotide
  Target: ATXN1; (-) strand; PAM type: NRG; PAM sequence: GAG
tgatcatgttgtcaggcagc

SEQ ID NO: 88636 - DNA, 20 bp, Artificial Sequence
  Description of Artificial Sequence: Synthetic oligonucleotide
  Target: ATXN1; (-) strand; PAM type: NRG; PAM sequence: CAG
cctttgatcatgttgtcagg

SEQ ID NO: 88637 - DNA, 20 bp, Artificial Sequence
  Description of Artificial Sequence: Synthetic oligonucleotide
  Target: ATXN1; (-) strand; PAM type: NRG; PAM sequence: AGG
cctcctttgatcatgttgtc

SEQ ID NO: 88638 - DNA, 20 bp, Artificial Sequence
  Description of Artificial Sequence: Synthetic oligonucleotide
  Target: ATXN1; (-) strand; PAM type: NRG; PAM sequence: CAG
ccctcctttgatcatgttgt

SEQ ID NO: 88639 - DNA, 20 bp, Artificial Sequence
  Description of Artificial Sequence: Synthetic oligonucleotide
  Target: ATXN1; (-) strand; PAM type: NRG; PAM sequence: TGG
cctggtaaggttattaaact

SEQ ID NO: 88640 - DNA, 20 bp, Artificial Sequence
  Description of Artificial Sequence: Synthetic oligonucleotide
  Target: ATXN1; (-) strand; PAM type: NRG; PAM sequence: AGG
gacaatctgatctcctggta

SEQ ID NO: 88641 - DNA, 20 bp, Artificial Sequence
  Description of Artificial Sequence: Synthetic oligonucleotide
  Target: ATXN1; (-) strand; PAM type: NRG; PAM sequence: AAG
agacaatctgatctcctggt

SEQ ID NO: 88642 - DNA, 20 bp, Artificial Sequence
  Description of Artificial Sequence: Synthetic oligonucleotide
  Target: ATXN1; (-) strand; PAM type: NRG; PAM sequence: TGG
ccccagacaatctgatctcc

SEQ ID NO: 88643 - DNA, 20 bp, Artificial Sequence
  Description of Artificial Sequence: Synthetic oligonucleotide
  Target: ATXN1; (-) strand; PAM type: NRG; PAM sequence: CAG
tcaggacttctgcttggccc

SEQ ID NO: 88644 - DNA, 20 bp, Artificial Sequence
  Description of Artificial Sequence: Synthetic oligonucleotide
  Target: ATXN1; (-) strand; PAM type: NRG; PAM sequence: TGG
gctatctcaggacttctgct

SEQ ID NO: 88645 - DNA, 20 bp, Artificial Sequence
  Description of Artificial Sequence: Synthetic oligonucleotide
  Target: ATXN1; (-) strand; PAM type: NRG; PAM sequence: AGG
caggattcagcagctatctc

SEQ ID NO: 88646 - DNA, 20 bp, Artificial Sequence
  Description of Artificial Sequence: Synthetic oligonucleotide
  Target: ATXN1; (-) strand; PAM type: NRG; PAM sequence: CAG
ccaggattcagcagctatct

SEQ ID NO: 88647 - DNA, 20 bp, Artificial Sequence
  Description of Artificial Sequence: Synthetic oligonucleotide
  Target: ATXN1; (-) strand; PAM type: NRG; PAM sequence: CAG
tgtaaatggccaggattcag

SEQ ID NO: 88648 - DNA, 20 bp, Artificial Sequence
  Description of Artificial Sequence: Synthetic oligonucleotide
  Target: ATXN1; (-) strand; PAM type: NRG; PAM sequence: CAG
ctctgtaaatggccaggatt

SEQ ID NO: 88649 - DNA, 20 bp, Artificial Sequence
  Description of Artificial Sequence: Synthetic oligonucleotide
  Target: ATXN1; (-) strand; PAM type: NRG; PAM sequence: AGG
gtgctgctctgtaaatggcc

SEQ ID NO: 88650 - DNA, 20 bp, Artificial Sequence
  Description of Artificial Sequence: Synthetic oligonucleotide
  Target: ATXN1; (-) strand; PAM type: NRG; PAM sequence: CAG
tgtgctgctctgtaaatggc

SEQ ID NO: 88651 - DNA, 20 bp, Artificial Sequence
  Description of Artificial Sequence: Synthetic oligonucleotide
  Target: ATXN1; (-) strand; PAM type: NRG; PAM sequence: TGG
gttttgtgctgctctgtaaa

SEQ ID NO: 88652 - DNA, 20 bp, Artificial Sequence
  Description of Artificial Sequence: Synthetic oligonucleotide
  Target: ATXN1; (-) strand; PAM type: NRG; PAM sequence: TAG
ggcaggaaaaggaacaggac

SEQ ID NO: 88653 - DNA, 20 bp, Artificial Sequence
  Description of Artificial Sequence: Synthetic oligonucleotide
  Target: ATXN1; (-) strand; PAM type: NRG; PAM sequence: AGG
accgcggcaggaaaaggaac

SEQ ID NO: 88654 - DNA, 20 bp, Artificial Sequence
  Description of Artificial Sequence: Synthetic oligonucleotide
  Target: ATXN1; (-) strand; PAM type: NRG; PAM sequence: CAG
aaccgcggcaggaaaaggaa

SEQ ID NO: 88655 - DNA, 20 bp, Artificial Sequence
  Description of Artificial Sequence: Synthetic oligonucleotide
  Target: ATXN1; (-) strand; PAM type: NRG; PAM sequence: AGG
atggcaaccgcggcaggaaa

SEQ ID NO: 88656 - DNA, 20 bp, Artificial Sequence
  Description of Artificial Sequence: Synthetic oligonucleotide
  Target: ATXN1; (-) strand; PAM type: NRG; PAM sequence: AAG
catggcaaccgcggcaggaa

SEQ ID NO: 88657 - DNA, 20 bp, Artificial Sequence
  Description of Artificial Sequence: Synthetic oligonucleotide
  Target: ATXN1; (-) strand; PAM type: NRG; PAM sequence: AGG
tcggccatggcaaccgcggc

SEQ ID NO: 88658 - DNA, 20 bp, Artificial Sequence
  Description of Artificial Sequence: Synthetic oligonucleotide
  Target: ATXN1; (-) strand; PAM type: NRG; PAM sequence: CAG
gtcggccatggcaaccgcgg

SEQ ID NO: 88659 - DNA, 20 bp, Artificial Sequence
  Description of Artificial Sequence: Synthetic oligonucleotide
  Target: ATXN1; (-) strand; PAM type: NRG; PAM sequence: CGG
tgggtcggccatggcaaccg

SEQ ID NO: 88660 - DNA, 20 bp, Artificial Sequence
  Description of Artificial Sequence: Synthetic oligonucleotide
  Target: ATXN1; (-) strand; PAM type: NRG; PAM sequence: TGG
tatattgtttgggtcggcca

SEQ ID NO: 88661 - DNA, 20 bp, Artificial Sequence
  Description of Artificial Sequence: Synthetic oligonucleotide
  Target: ATXN1; (-) strand; PAM type: NRG; PAM sequence: CGG
ctggggtatattgtttgggt

SEQ ID NO: 88662 - DNA, 20 bp, Artificial Sequence
  Description of Artificial Sequence: Synthetic oligonucleotide
  Target: ATXN1; (-) strand; PAM type: NRG; PAM sequence: GGG
gaagctggggtatattgttt

SEQ ID NO: 88663 - DNA, 20 bp, Artificial Sequence
  Description of Artificial Sequence: Synthetic oligonucleotide
  Target: ATXN1; (-) strand; PAM type: NRG; PAM sequence: TGG
tgaagctggggtatattgtt

SEQ ID NO: 88664 - DNA, 20 bp, Artificial Sequence
  Description of Artificial Sequence: Synthetic oligonucleotide
  Target: ATXN1; (-) strand; PAM type: NRG; PAM sequence: GGG
gccaaaggaggctgaagctg

SEQ ID NO: 88665 - DNA, 20 bp, Artificial Sequence
  Description of Artificial Sequence: Synthetic oligonucleotide
  Target: ATXN1; (-) strand; PAM type: NRG; PAM sequence: GGG
agccaaaggaggctgaagct

SEQ ID NO: 88666 - DNA, 20 bp, Artificial Sequence
  Description of Artificial Sequence: Synthetic oligonucleotide
  Target: ATXN1; (-) strand; PAM type: NRG; PAM sequence: TGG
aagccaaaggaggctgaagc

SEQ ID NO: 88667 - DNA, 20 bp, Artificial Sequence
  Description of Artificial Sequence: Synthetic oligonucleotide
  Target: ATXN1; (-) strand; PAM type: NRG; PAM sequence: AAG
taggaagccaaaggaggctg

SEQ ID NO: 88668 - DNA, 20 bp, Artificial Sequence
  Description of Artificial Sequence: Synthetic oligonucleotide
  Target: ATXN1; (-) strand; PAM type: NRG; PAM sequence: AGG
ggcggttaggaagccaaagg

SEQ ID NO: 88669 - DNA, 20 bp, Artificial Sequence
  Description of Artificial Sequence: Synthetic oligonucleotide
  Target: ATXN1; (-) strand; PAM type: NRG; PAM sequence: GAG
tggcggttaggaagccaaag

SEQ ID NO: 88670 - DNA, 20 bp, Artificial Sequence
  Description of Artificial Sequence: Synthetic oligonucleotide
  Target: ATXN1; (-) strand; PAM type: NRG; PAM sequence: AGG
ggtggcggttaggaagccaa

SEQ ID NO: 88671 - DNA, 20 bp, Artificial Sequence
  Description of Artificial Sequence: Synthetic oligonucleotide
  Target: ATXN1; (-) strand; PAM type: NRG; PAM sequence: AAG
gggtggcggttaggaagcca

SEQ ID NO: 88672 - DNA, 20 bp, Artificial Sequence
  Description of Artificial Sequence: Synthetic oligonucleotide
  Target: ATXN1; (-) strand; PAM type: NRG; PAM sequence: AAG
gtctgtgggtggcggttagg

SEQ ID NO: 88673 - DNA, 20 bp, Artificial Sequence
  Description of Artificial Sequence: Synthetic oligonucleotide
  Target: ATXN1; (-) strand; PAM type: NRG; PAM sequence: AGG
gaggtctgtgggtggcggtt

SEQ ID NO: 88674 - DNA, 20 bp, Artificial Sequence
  Description of Artificial Sequence: Synthetic oligonucleotide
  Target: ATXN1; (-) strand; PAM type: NRG; PAM sequence: TAG
ggaggtctgtgggtggcggt

SEQ ID NO: 88675 - DNA, 20 bp, Artificial Sequence
  Description of Artificial Sequence: Synthetic oligonucleotide
  Target: ATXN1; (-) strand; PAM type: NRG; PAM sequence: CGG
gtttggaggtctgtgggtgg

SEQ ID NO: 88676 - DNA, 20 bp, Artificial Sequence
  Description of Artificial Sequence: Synthetic oligonucleotide
  Target: ATXN1; (-) strand; PAM type: NRG; PAM sequence: TGG
cacgtttggaggtctgtggg

SEQ ID NO: 88677 - DNA, 20 bp, Artificial Sequence
  Description of Artificial Sequence: Synthetic oligonucleotide
  Target: ATXN1; (-) strand; PAM type: NRG; PAM sequence: GGG
gcccacgtttggaggtctgt

SEQ ID NO: 88678 - DNA, 20 bp, Artificial Sequence
  Description of Artificial Sequence: Synthetic oligonucleotide
  Target: ATXN1; (-) strand; PAM type: NRG; PAM sequence: TGG
tgcccacgtttggaggtctg

SEQ ID NO: 88679 - DNA, 20 bp, Artificial Sequence
  Description of Artificial Sequence: Synthetic oligonucleotide
  Target: ATXN1; (-) strand; PAM type: NRG; PAM sequence: AGG
ctcctcctgcccacgtttgg

SEQ ID NO: 88680 - DNA, 20 bp, Artificial Sequence
  Description of Artificial Sequence: Synthetic oligonucleotide
  Target: ATXN1; (-) strand; PAM type: NRG; PAM sequence: GAG
cctcctcctgcccacgtttg

SEQ ID NO: 88681 - DNA, 20 bp, Artificial Sequence
  Description of Artificial Sequence: Synthetic oligonucleotide
  Target: ATXN1; (-) strand; PAM type: NRG; PAM sequence: TGG
cacctcctcctgcccacgtt

SEQ ID NO: 88682 - DNA, 20 bp, Artificial Sequence
  Description of Artificial Sequence: Synthetic oligonucleotide
  Target: ATXN1; (-) strand; PAM type: NRG; PAM sequence: CAG
cctcaattcccatcggtgag

SEQ ID NO: 88683 - DNA, 20 bp, Artificial Sequence
  Description of Artificial Sequence: Synthetic oligonucleotide
  Target: ATXN1; (-) strand; PAM type: NRG; PAM sequence: GAG
gctcctcaattcccatcggt

SEQ ID NO: 88684 - DNA, 20 bp, Artificial Sequence
  Description of Artificial Sequence: Synthetic oligonucleotide
  Target: ATXN1; (-) strand; PAM type: NRG; PAM sequence: CGG
cctagctcctcaattcccat

SEQ ID NO: 88685 - DNA, 20 bp, Artificial Sequence
  Description of Artificial Sequence: Synthetic oligonucleotide
  Target: ATXN1; (-) strand; PAM type: NRG; PAM sequence: TAG
tcccctttccatcctctacc

SEQ ID NO: 88686 - DNA, 20 bp, Artificial Sequence
  Description of Artificial Sequence: Synthetic oligonucleotide
  Target: ATXN1; (-) strand; PAM type: NRG; PAM sequence: CAG
ctccgggctgatctgcagcc

SEQ ID NO: 88687 - DNA, 20 bp, Artificial Sequence
  Description of Artificial Sequence: Synthetic oligonucleotide
  Target: ATXN1; (-) strand; PAM type: NRG; PAM sequence: CAG
acaccctccgggctgatctg

SEQ ID NO: 88688 - DNA, 20 bp, Artificial Sequence
  Description of Artificial Sequence: Synthetic oligonucleotide
  Target: ATXN1; (-) strand; PAM type: NRG; PAM sequence: GGG
cttaccacgttacaccctcc

SEQ ID NO: 88689 - DNA, 20 bp, Artificial Sequence
  Description of Artificial Sequence: Synthetic oligonucleotide
  Target: ATXN1; (-) strand; PAM type: NRG; PAM sequence: CGG
gcttaccacgttacaccctc

SEQ ID NO: 88690 - DNA, 20 bp, Artificial Sequence
  Description of Artificial Sequence: Synthetic oligonucleotide
  Target: ATXN1; (-) strand; PAM type: NRG; PAM sequence: CAG
caaagcctagcagctaaaag

SEQ ID NO: 88691 - DNA, 20 bp, Artificial Sequence
  Description of Artificial Sequence: Synthetic oligonucleotide
  Target: ATXN1; (-) strand; PAM type: NRG; PAM sequence: AAG
aagcaaagcctagcagctaa

SEQ ID NO: 88692 - DNA, 20 bp, Artificial Sequence
  Description of Artificial Sequence: Synthetic oligonucleotide
  Target: ATXN1; (-) strand; PAM type: NRG; PAM sequence: CAG
ctcacagaagcaaagcctag

SEQ ID NO: 88693 - DNA, 20 bp, Artificial Sequence
  Description of Artificial Sequence: Synthetic oligonucleotide
  Target: ATXN1; (-) strand; PAM type: NRG; PAM sequence: TAG
aaactcacagaagcaaagcc

SEQ ID NO: 88694 - DNA, 20 bp, Artificial Sequence
  Description of Artificial Sequence: Synthetic oligonucleotide
  Target: ATXN1; (-) strand; PAM type: NRG; PAM sequence: AAG
ggtgaaaactcacagaagca

SEQ ID NO: 88695 - DNA, 20 bp, Artificial Sequence
  Description of Artificial Sequence: Synthetic oligonucleotide
  Target: ATXN1; (-) strand; PAM type: NRG; PAM sequence: AAG
aatgaggtgaaaactcacag

SEQ ID NO: 88696 - DNA, 20 bp, Artificial Sequence
  Description of Artificial Sequence: Synthetic oligonucleotide
  Target: ATXN1; (-) strand; PAM type: NRG; PAM sequence: CAG
agaaatgaggtgaaaactca

SEQ ID NO: 88697 - DNA, 20 bp, Artificial Sequence
  Description of Artificial Sequence: Synthetic oligonucleotide
  Target: ATXN1; (-) strand; PAM type: NRG; PAM sequence: AGG
ctgttttccacttagaaatg

SEQ ID NO: 88698 - DNA, 20 bp, Artificial Sequence
  Description of Artificial Sequence: Synthetic oligonucleotide
  Target: ATXN1; (-) strand; PAM type: NRG; PAM sequence: GAG
tctgttttccacttagaaat

SEQ ID NO: 88699 - DNA, 20 bp, Artificial Sequence
  Description of Artificial Sequence: Synthetic oligonucleotide
  Target: ATXN1; (-) strand; PAM type: NRG; PAM sequence: TAG
cttaagatctgttttccact

SEQ ID NO: 88700 - DNA, 20 bp, Artificial Sequence
  Description of Artificial Sequence: Synthetic oligonucleotide
  Target: ATXN1; (-) strand; PAM type: NRG; PAM sequence: AAG
gctggtttctttttcttctt

SEQ ID NO: 88701 - DNA, 20 bp, Artificial Sequence
  Description of Artificial Sequence: Synthetic oligonucleotide
  Target: ATXN1; (-) strand; PAM type: NRG; PAM sequence: TGG
tcccatgttgggtttttagc

SEQ ID NO: 88702 - DNA, 20 bp, Artificial Sequence
  Description of Artificial Sequence: Synthetic oligonucleotide
  Target: ATXN1; (-) strand; PAM type: NRG; PAM sequence: TAG
attgtcccatgttgggtttt

SEQ ID NO: 88703 - DNA, 20 bp, Artificial Sequence
  Description of Artificial Sequence: Synthetic oligonucleotide
  Target: ATXN1; (-) strand; PAM type: NRG; PAM sequence: GGG
gatagtaattgtcccatgtt

SEQ ID NO: 88704 - DNA, 20 bp, Artificial Sequence
  Description of Artificial Sequence: Synthetic oligonucleotide
  Target: ATXN1; (-) strand; PAM type: NRG; PAM sequence: TGG
tgatagtaattgtcccatgt

SEQ ID NO: 88705 - DNA, 20 bp, Artificial Sequence
  Description of Artificial Sequence: Synthetic oligonucleotide
  Target: ATXN1; (-) strand; PAM type: NRG; PAM sequence: TAG
aaaccaaagtttaaaggtga

SEQ ID NO: 88706 - DNA, 20 bp, Artificial Sequence
  Description of Artificial Sequence: Synthetic oligonucleotide
  Target: ATXN1; (-) strand; PAM type: NRG; PAM sequence: AGG
gtgctaaaaccaaagtttaa

SEQ ID NO: 88707 - DNA, 20 bp, Artificial Sequence
  Description of Artificial Sequence: Synthetic oligonucleotide
  Target: ATXN1; (-) strand; PAM type: NRG; PAM sequence: AAG
ggtgctaaaaccaaagttta

SEQ ID NO: 88708 - DNA, 20 bp, Artificial Sequence
  Description of Artificial Sequence: Synthetic oligonucleotide
  Target: ATXN1; (-) strand; PAM type: NRG; PAM sequence: AAG
gtttaaaggtgctaaaacca

SEQ ID NO: 88709 - DNA, 20 bp, Artificial Sequence
  Description of Artificial Sequence: Synthetic oligonucleotide
  Target: ATXN1; (-) strand; PAM type: NRG; PAM sequence: AGG
cggttcattccagagtttaa

SEQ ID NO: 88710 - DNA, 20 bp, Artificial Sequence
  Description of Artificial Sequence: Synthetic oligonucleotide
  Target: ATXN1; (-) strand; PAM type: NRG; PAM sequence: AAG
acggttcattccagagttta

SEQ ID NO: 88711 - DNA, 20 bp, Artificial Sequence
  Description of Artificial Sequence: Synthetic oligonucleotide
  Target: ATXN1; (-) strand; PAM type: NRG; PAM sequence: GAG
ctggttcacggttcattcca

SEQ ID NO: 88712 - DNA, 20 bp, Artificial Sequence
  Description of Artificial Sequence: Synthetic oligonucleotide
  Target: ATXN1; (-) strand; PAM type: NRG; PAM sequence: CAG
tgctggttcacggttcattc

SEQ ID NO: 88713 - DNA, 20 bp, Artificial Sequence
  Description of Artificial Sequence: Synthetic oligonucleotide
  Target: ATXN1; (-) strand; PAM type: NRG; PAM sequence: CGG
ccatttgttttgctggttca

SEQ ID NO: 88714 - DNA, 20 bp, Artificial Sequence
  Description of Artificial Sequence: Synthetic oligonucleotide
  Target: ATXN1; (-) strand; PAM type: NRG; PAM sequence: TGG
tttttttccatttgttttgc

SEQ ID NO: 88715 - DNA, 20 bp, Artificial Sequence
  Description of Artificial Sequence: Synthetic oligonucleotide
  Target: ATXN1; (-) strand; PAM type: NRG; PAM sequence: AGG
cagatattaccatacccagg

SEQ ID NO: 88716 - DNA, 20 bp, Artificial Sequence
  Description of Artificial Sequence: Synthetic oligonucleotide
  Target: ATXN1; (-) strand; PAM type: NRG; PAM sequence: GAG
tcagatattaccatacccag

SEQ ID NO: 88717 - DNA, 20 bp, Artificial Sequence
  Description of Artificial Sequence: Synthetic oligonucleotide
  Target: ATXN1; (-) strand; PAM type: NRG; PAM sequence: AGG
gttcagatattaccataccc

SEQ ID NO: 88718 - DNA, 20 bp, Artificial Sequence
  Description of Artificial Sequence: Synthetic oligonucleotide
  Target: ATXN1; (-) strand; PAM type: NRG; PAM sequence: CAG
tgttcagatattaccatacc

SEQ ID NO: 88719 - DNA, 20 bp, Artificial Sequence
  Description of Artificial Sequence: Synthetic oligonucleotide
  Target: ATXN1; (-) strand; PAM type: NRG; PAM sequence: CAG
tcccaaacctcgcttctgtt

SEQ ID NO: 88720 - DNA, 20 bp, Artificial Sequence
  Description of Artificial Sequence: Synthetic oligonucleotide
  Target: ATXN1; (-) strand; PAM type: NRG; PAM sequence: GGG
caacacgtatgccattccta

SEQ ID NO: 88721 - DNA, 20 bp, Artificial Sequence
  Description of Artificial Sequence: Synthetic oligonucleotide
  Target: ATXN1; (-) strand; PAM type: NRG; PAM sequence: AGG
acaacacgtatgccattcct

SEQ ID NO: 88722 - DNA, 20 bp, Artificial Sequence
  Description of Artificial Sequence: Synthetic oligonucleotide
  Target: ATXN1; (-) strand; PAM type: NRG; PAM sequence: TAG
cacaacacgtatgccattcc

SEQ ID NO: 88723 - DNA, 20 bp, Artificial Sequence
  Description of Artificial Sequence: Synthetic oligonucleotide
  Target: ATXN1; (-) strand; PAM type: NRG; PAM sequence: CAG
aataggaacttgttttaaac

SEQ ID NO: 88724 - DNA, 20 bp, Artificial Sequence
  Description of Artificial Sequence: Synthetic oligonucleotide
  Target: ATXN1; (-) strand; PAM type: NRG; PAM sequence: AGG
ttttaatggcatcttcaaat

SEQ ID NO: 88725 - DNA, 20 bp, Artificial Sequence
  Description of Artificial Sequence: Synthetic oligonucleotide
  Target: ATXN1; (-) strand; PAM type: NRG; PAM sequence: TAG
tttttaatggcatcttcaaa

SEQ ID NO: 88726 - DNA, 20 bp, Artificial Sequence
  Description of Artificial Sequence: Synthetic oligonucleotide
  Target: ATXN1; (-) strand; PAM type: NRG; PAM sequence: TGG
ctgtatctaaacttttttaa

SEQ ID NO: 88727 - DNA, 20 bp, Artificial Sequence
  Description of Artificial Sequence: Synthetic oligonucleotide
  Target: ATXN1; (-) strand; PAM type: NRG; PAM sequence: TAG
cctctgtctctttctttgtg

SEQ ID NO: 88728 - DNA, 20 bp, Artificial Sequence
  Description of Artificial Sequence: Synthetic oligonucleotide
  Target: ATXN1; (-) strand; PAM type: NRG; PAM sequence: GGG
tcattggtggtttattttta

SEQ ID NO: 88729 - DNA, 20 bp, Artificial Sequence
  Description of Artificial Sequence: Synthetic oligonucleotide
  Target: ATXN1; (-) strand; PAM type: NRG; PAM sequence: AGG
ttcattggtggtttattttt

SEQ ID NO: 88730 - DNA, 20 bp, Artificial Sequence
  Description of Artificial Sequence: Synthetic oligonucleotide
  Target: ATXN1; (-) strand; PAM type: NRG; PAM sequence: TAG
attcattggtggtttatttt

SEQ ID NO: 88731 - DNA, 20 bp, Artificial Sequence
  Description of Artificial Sequence: Synthetic oligonucleotide
  Target: ATXN1; (-) strand; PAM type: NRG; PAM sequence: TGG
tgtcataaaaaattcattgg

SEQ ID NO: 88732 - DNA, 20 bp, Artificial Sequence
  Description of Artificial Sequence: Synthetic oligonucleotide
  Target: ATXN1; (-) strand; PAM type: NRG; PAM sequence: TGG
atgtgtcataaaaaattcat

SEQ ID NO: 88733 - DNA, 20 bp, Artificial Sequence
  Description of Artificial Sequence: Synthetic oligonucleotide
  Target: ATXN1; (-) strand; PAM type: NRG; PAM sequence: TAG
tccctgggctagtctgttgt

SEQ ID NO: 88734 - DNA, 20 bp, Artificial Sequence
  Description of Artificial Sequence: Synthetic oligonucleotide
  Target: ATXN1; (-) strand; PAM type: NRG; PAM sequence: TAG
ctgagcgccattccctgggc

SEQ ID NO: 88735 - DNA, 20 bp, Artificial Sequence
  Description of Artificial Sequence: Synthetic oligonucleotide
  Target: ATXN1; (-) strand; PAM type: NRG; PAM sequence: GGG
tcgcctgagcgccattccct

SEQ ID NO: 88736 - DNA, 20 bp, Artificial Sequence
  Description of Artificial Sequence: Synthetic oligonucleotide
  Target: ATXN1; (-) strand; PAM type: NRG; PAM sequence: TGG
atcgcctgagcgccattccc

SEQ ID NO: 88737 - DNA, 20 bp, Artificial Sequence
  Description of Artificial Sequence: Synthetic oligonucleotide
  Target: ATXN1; (-) strand; PAM type: NRG; PAM sequence: GAG
gcataggtgctccatcgcct

SEQ ID NO: 88738 - DNA, 20 bp, Artificial Sequence
  Description of Artificial Sequence: Synthetic oligonucleotide
  Target: ATXN1; (-) strand; PAM type: NRG; PAM sequence: AGG
ccatgcttgtcccagagcat

SEQ ID NO: 88739 - DNA, 20 bp, Artificial Sequence
  Description of Artificial Sequence: Synthetic oligonucleotide
  Target: ATXN1; (-) strand; PAM type: NRG; PAM sequence: TAG
gccatgcttgtcccagagca

SEQ ID NO: 88740 - DNA, 20 bp, Artificial Sequence
  Description of Artificial Sequence: Synthetic oligonucleotide
  Target: ATXN1; (-) strand; PAM type: NRG; PAM sequence: GAG
cagtggccatgcttgtccca

SEQ ID NO: 88741 - DNA, 20 bp, Artificial Sequence
  Description of Artificial Sequence: Synthetic oligonucleotide
  Target: ATXN1; (-) strand; PAM type: NRG; PAM sequence: CAG
gacagtggccatgcttgtcc

SEQ ID NO: 88742 - DNA, 20 bp, Artificial Sequence
  Description of Artificial Sequence: Synthetic oligonucleotide
  Target: ATXN1; (-) strand; PAM type: NRG; PAM sequence: TGG
tggcttgcttagctggacag

SEQ ID NO: 88743 - DNA, 20 bp, Artificial Sequence
  Description of Artificial Sequence: Synthetic oligonucleotide
  Target: ATXN1; (-) strand; PAM type: NRG; PAM sequence: CAG
taatggcttgcttagctgga

SEQ ID NO: 88744 - DNA, 20 bp, Artificial Sequence
  Description of Artificial Sequence: Synthetic oligonucleotide
  Target: ATXN1; (-) strand; PAM type: NRG; PAM sequence: TGG
gggttaatggcttgcttagc

SEQ ID NO: 88745 - DNA, 20 bp, Artificial Sequence
  Description of Artificial Sequence: Synthetic oligonucleotide
  Target: ATXN1; (-) strand; PAM type: NRG; PAM sequence: TAG
aaaagggttaatggcttgct

SEQ ID NO: 88746 - DNA, 20 bp, Artificial Sequence
  Description of Artificial Sequence: Synthetic oligonucleotide
  Target: ATXN1; (-) strand; PAM type: NRG; PAM sequence: TGG
tgaatggccaaaagggttaa

SEQ ID NO: 88747 - DNA, 20 bp, Artificial Sequence
  Description of Artificial Sequence: Synthetic oligonucleotide
  Target: ATXN1; (-) strand; PAM type: NRG; PAM sequence: GGG
gaagaagtgaatggccaaaa

SEQ ID NO: 88748 - DNA, 20 bp, Artificial Sequence
  Description of Artificial Sequence: Synthetic oligonucleotide
  Target: ATXN1; (-) strand; PAM type: NRG; PAM sequence: AGG
tgaagaagtgaatggccaaa

SEQ ID NO: 88749 - DNA, 20 bp, Artificial Sequence
  Description of Artificial Sequence: Synthetic oligonucleotide
  Target: ATXN1; (-) strand; PAM type: NRG; PAM sequence: AAG
atgaagaagtgaatggccaa

SEQ ID NO: 88750 - DNA, 20 bp, Artificial Sequence
  Description of Artificial Sequence: Synthetic oligonucleotide
  Target: ATXN1; (-) strand; PAM type: NRG; PAM sequence: TGG
tttatagatgaagaagtgaa

SEQ ID NO: 88751 - DNA, 20 bp, Artificial Sequence
  Description of Artificial Sequence: Synthetic oligonucleotide
  Target: ATXN1; (-) strand; PAM type: NRG; PAM sequence: AAG
tgccccgtttatagatgaag

SEQ ID NO: 88752 - DNA, 20 bp, Artificial Sequence
  Description of Artificial Sequence: Synthetic oligonucleotide
  Target: ATXN1; (-) strand; PAM type: NRG; PAM sequence: AAG
ctctgccccgtttatagatg

SEQ ID NO: 88753 - DNA, 20 bp, Artificial Sequence
  Description of Artificial Sequence: Synthetic oligonucleotide
  Target: ATXN1; (-) strand; PAM type: NRG; PAM sequence: TAG
ccccttctctgccccgttta

SEQ ID NO: 88754 - DNA, 20 bp, Artificial Sequence
  Description of Artificial Sequence: Synthetic oligonucleotide
  Target: ATXN1; (-) strand; PAM type: NRG; PAM sequence: CAG
tgtgtaaaggaatttaaaga

SEQ ID NO: 88755 - DNA, 20 bp, Artificial Sequence
  Description of Artificial Sequence: Synthetic oligonucleotide
  Target: ATXN1; (-) strand; PAM type: NRG; PAM sequence: AAG
cttgtgtgtaaaggaattta

SEQ ID NO: 88756 - DNA, 20 bp, Artificial Sequence
  Description of Artificial Sequence: Synthetic oligonucleotide
  Target: ATXN1; (-) strand; PAM type: NRG; PAM sequence: AGG
catccctgtcttgtgtgtaa

SEQ ID NO: 88757 - DNA, 20 bp, Artificial Sequence
  Description of Artificial Sequence: Synthetic oligonucleotide
  Target: ATXN1; (-) strand; PAM type: NRG; PAM sequence: AAG
gcatccctgtcttgtgtgta

SEQ ID NO: 88758 - DNA, 20 bp, Artificial Sequence
  Description of Artificial Sequence: Synthetic oligonucleotide
  Target: ATXN1; (-) strand; PAM type: NRG; PAM sequence: GGG
tgaataggagtggtgagaga

SEQ ID NO: 88759 - DNA, 20 bp, Artificial Sequence
  Description of Artificial Sequence: Synthetic oligonucleotide
  Target: ATXN1; (-) strand; PAM type: NRG; PAM sequence: AGG
ttgaataggagtggtgagag

SEQ ID NO: 88760 - DNA, 20 bp, Artificial Sequence
  Description of Artificial Sequence: Synthetic oligonucleotide
  Target: ATXN1; (-) strand; PAM type: NRG; PAM sequence: GAG
gttgaataggagtggtgaga

SEQ ID NO: 88761 - DNA, 20 bp, Artificial Sequence
  Description of Artificial Sequence: Synthetic oligonucleotide
  Target: ATXN1; (-) strand; PAM type: NRG; PAM sequence: GAG
atgttgaataggagtggtga

SEQ ID NO: 88762 - DNA, 20 bp, Artificial Sequence
  Description of Artificial Sequence: Synthetic oligonucleotide
  Target: ATXN1; (-) strand; PAM type: NRG; PAM sequence: GAG
ctatgttgaataggagtggt

SEQ ID NO: 88763 - DNA, 20 bp, Artificial Sequence
  Description of Artificial Sequence: Synthetic oligonucleotide
  Target: ATXN1; (-) strand; PAM type: NRG; PAM sequence: TGG
aacactatgttgaataggag

SEQ ID NO: 88764 - DNA, 20 bp, Artificial Sequence
  Description of Artificial Sequence: Synthetic oligonucleotide
  Target: ATXN1; (-) strand; PAM type: NRG; PAM sequence: GAG
tccaacactatgttgaatag

SEQ ID NO: 88765 - DNA, 20 bp, Artificial Sequence
  Description of Artificial Sequence: Synthetic oligonucleotide
  Target: ATXN1; (-) strand; PAM type: NRG; PAM sequence: AGG
cttccaacactatgttgaat

SEQ ID NO: 88766 - DNA, 20 bp, Artificial Sequence
  Description of Artificial Sequence: Synthetic oligonucleotide
  Target: ATXN1; (-) strand; PAM type: NRG; PAM sequence: TAG
acttccaacactatgttgaa

SEQ ID NO: 88767 - DNA, 20 bp, Artificial Sequence
  Description of Artificial Sequence: Synthetic oligonucleotide
  Target: ATXN1; (-) strand; PAM type: NRG; PAM sequence: CAG
tcctgcctgattgccctggc

SEQ ID NO: 88768 - DNA, 20 bp, Artificial Sequence
  Description of Artificial Sequence: Synthetic oligonucleotide
  Target: ATXN1; (-) strand; PAM type: NRG; PAM sequence: TGG
cttctcctgcctgattgccc

SEQ ID NO: 88769 - DNA, 20 bp, Artificial Sequence
  Description of Artificial Sequence: Synthetic oligonucleotide
  Target: ATXN1; (-) strand; PAM type: NRG; PAM sequence: GGG
gatcatgtcatctgcaaaca

SEQ ID NO: 88770 - DNA, 20 bp, Artificial Sequence
  Description of Artificial Sequence: Synthetic oligonucleotide
  Target: ATXN1; (-) strand; PAM type: NRG; PAM sequence: AGG
tgatcatgtcatctgcaaac

SEQ ID NO: 88771 - DNA, 20 bp, Artificial Sequence
  Description of Artificial Sequence: Synthetic oligonucleotide
  Target: ATXN1; (-) strand; PAM type: NRG; PAM sequence: CAG
atgatcatgtcatctgcaaa

SEQ ID NO: 88772 - DNA, 20 bp, Artificial Sequence
  Description of Artificial Sequence: Synthetic oligonucleotide
  Target: ATXN1; (-) strand; PAM type: NRG; PAM sequence: TAG
gctgagacaatggggttttc

SEQ ID NO: 88773 - DNA, 20 bp, Artificial Sequence
  Description of Artificial Sequence: Synthetic oligonucleotide
  Target: ATXN1; (-) strand; PAM type: NRG; PAM sequence: GGG
agatttgggctgagacaatg

SEQ ID NO: 88774 - DNA, 20 bp, Artificial Sequence
  Description of Artificial Sequence: Synthetic oligonucleotide
  Target: ATXN1; (-) strand; PAM type: NRG; PAM sequence: GGG
gagatttgggctgagacaat

SEQ ID NO: 88775 - DNA, 20 bp, Artificial Sequence
  Description of Artificial Sequence: Synthetic oligonucleotide
  Target: ATXN1; (-) strand; PAM type: NRG; PAM sequence: TGG
ggagatttgggctgagacaa

SEQ ID NO: 88776 - DNA, 20 bp, Artificial Sequence
  Description of Artificial Sequence: Synthetic oligonucleotide
  Target: ATXN1; (-) strand; PAM type: NRG; PAM sequence: GAG
agcttaaggagatttgggct

SEQ ID NO: 88777 - DNA, 20 bp, Artificial Sequence
  Description of Artificial Sequence: Synthetic oligonucleotide
  Target: ATXN1; (-) strand; PAM type: NRG; PAM sequence: GGG
ttatcagcttaaggagattt

SEQ ID NO: 88778 - DNA, 20 bp, Artificial Sequence
  Description of Artificial Sequence: Synthetic oligonucleotide
  Target: ATXN1; (-) strand; PAM type: NRG; PAM sequence: TGG
cttatcagcttaaggagatt

SEQ ID NO: 88779 - DNA, 20 bp, Artificial Sequence
  Description of Artificial Sequence: Synthetic oligonucleotide
  Target: ATXN1; (-) strand; PAM type: NRG; PAM sequence: GAG
acgttgcttatcagcttaag

SEQ ID NO: 88780 - DNA, 20 bp, Artificial Sequence
  Description of Artificial Sequence: Synthetic oligonucleotide
  Target: ATXN1; (-) strand; PAM type: NRG; PAM sequence: AGG
tgacgttgcttatcagctta

SEQ ID NO: 88781 - DNA, 20 bp, Artificial Sequence
  Description of Artificial Sequence: Synthetic oligonucleotide
  Target: ATXN1; (-) strand; PAM type: NRG; PAM sequence: AAG
ctgacgttgcttatcagctt

SEQ ID NO: 88782 - DNA, 20 bp, Artificial Sequence
  Description of Artificial Sequence: Synthetic oligonucleotide
  Target: ATXN1; (-) strand; PAM type: NRG; PAM sequence: CAG
actttgctgacgttgcttat

SEQ ID NO: 88783 - DNA, 20 bp, Artificial Sequence
  Description of Artificial Sequence: Synthetic oligonucleotide
  Target: ATXN1; (-) strand; PAM type: NRG; PAM sequence: CAG
gcacattgattttgtatcct

SEQ ID NO: 88784 - DNA, 20 bp, Artificial Sequence
  Description of Artificial Sequence: Synthetic oligonucleotide
  Target: ATXN1; (-) strand; PAM type: NRG; PAM sequence: AAG
tttgtctgttagtggtgtat

SEQ ID NO: 88785 - DNA, 20 bp, Artificial Sequence
  Description of Artificial Sequence: Synthetic oligonucleotide
  Target: ATXN1; (-) strand; PAM type: NRG; PAM sequence: TGG
gctctctgtttgtctgttag

SEQ ID NO: 88786 - DNA, 20 bp, Artificial Sequence
  Description of Artificial Sequence: Synthetic oligonucleotide
  Target: ATXN1; (-) strand; PAM type: NRG; PAM sequence: TAG
ttggctctctgtttgtctgt

SEQ ID NO: 88787 - DNA, 20 bp, Artificial Sequence
  Description of Artificial Sequence: Synthetic oligonucleotide
  Target: ATXN1; (-) strand; PAM type: NRG; PAM sequence: TGG
ataggaggtcactcatgatt

SEQ ID NO: 88788 - DNA, 20 bp, Artificial Sequence
  Description of Artificial Sequence: Synthetic oligonucleotide
  Target: ATXN1; (-) strand; PAM type: NRG; PAM sequence: AGG
ttgaagcagttgtgaatagg

SEQ ID NO: 88789 - DNA, 20 bp, Artificial Sequence
  Description of Artificial Sequence: Synthetic oligonucleotide
  Target: ATXN1; (-) strand; PAM type: NRG; PAM sequence: GAG
tttgaagcagttgtgaatag

SEQ ID NO: 88790 - DNA, 20 bp, Artificial Sequence
  Description of Artificial Sequence: Synthetic oligonucleotide
  Target: ATXN1; (-) strand; PAM type: NRG; PAM sequence: AGG
tctttgaagcagttgtgaat

SEQ ID NO: 88791 - DNA, 20 bp, Artificial Sequence
  Description of Artificial Sequence: Synthetic oligonucleotide
  Target: ATXN1; (-) strand; PAM type: NRG; PAM sequence: TAG
ctctttgaagcagttgtgaa

SEQ ID NO: 88792 - DNA, 20 bp, Artificial Sequence
  Description of Artificial Sequence: Synthetic oligonucleotide
  Target: ATXN1; (-) strand; PAM type: NRG; PAM sequence: CAG
gtattttattctctttgaag

SEQ ID NO: 88793 - DNA, 20 bp, Artificial Sequence
  Description of Artificial Sequence: Synthetic oligonucleotide
  Target: ATXN1; (-) strand; PAM type: NRG; PAM sequence: AAG
taggtattttattctctttg

SEQ ID NO: 88794 - DNA, 20 bp, Artificial Sequence
  Description of Artificial Sequence: Synthetic oligonucleotide
  Target: ATXN1; (-) strand; PAM type: NRG; PAM sequence: AGG
cccttgtaagttggattcct

SEQ ID NO: 88795 - DNA, 20 bp, Artificial Sequence
  Description of Artificial Sequence: Synthetic oligonucleotide
  Target: ATXN1; (-) strand; PAM type: NRG; PAM sequence: TAG
tcccttgtaagttggattcc

SEQ ID NO: 88796 - DNA, 20 bp, Artificial Sequence
  Description of Artificial Sequence: Synthetic oligonucleotide
  Target: ATXN1; (-) strand; PAM type: NRG; PAM sequence: TGG
tcttcacatcccttgtaagt

SEQ ID NO: 88797 - DNA, 20 bp, Artificial Sequence
  Description of Artificial Sequence: Synthetic oligonucleotide
  Target: ATXN1; (-) strand; PAM type: NRG; PAM sequence: AAG
gggttcttcacatcccttgt

SEQ ID NO: 88798 - DNA, 20 bp, Artificial Sequence
  Description of Artificial Sequence: Synthetic oligonucleotide
  Target: ATXN1; (-) strand; PAM type: NRG; PAM sequence: GGG
gtttgtagttctccttgaag

SEQ ID NO: 88799 - DNA, 20 bp, Artificial Sequence
  Description of Artificial Sequence: Synthetic oligonucleotide
  Target: ATXN1; (-) strand; PAM type: NRG; PAM sequence: GGG
ggtttgtagttctccttgaa

SEQ ID NO: 88800 - DNA, 20 bp, Artificial Sequence
  Description of Artificial Sequence: Synthetic oligonucleotide
  Target: ATXN1; (-) strand; PAM type: NRG; PAM sequence: AGG
tggtttgtagttctccttga

SEQ ID NO: 88801 - DNA, 20 bp, Artificial Sequence
  Description of Artificial Sequence: Synthetic oligonucleotide
  Target: ATXN1; (-) strand; PAM type: NRG; PAM sequence: AAG
gtggtttgtagttctccttg

SEQ ID NO: 88802 - DNA, 20 bp, Artificial Sequence
  Description of Artificial Sequence: Synthetic oligonucleotide
  Target: ATXN1; (-) strand; PAM type: NRG; PAM sequence: TAG
tttcgttgagcagtggtttg

SEQ ID NO: 88803 - DNA, 20 bp, Artificial Sequence
  Description of Artificial Sequence: Synthetic oligonucleotide
  Target: ATXN1; (-) strand; PAM type: NRG; PAM sequence: TGG
tcttttatttcgttgagcag

SEQ ID NO: 88804 - DNA, 20 bp, Artificial Sequence
  Description of Artificial Sequence: Synthetic oligonucleotide
  Target: ATXN1; (-) strand; PAM type: NRG; PAM sequence: CAG
tcctcttttatttcgttgag

SEQ ID NO: 88805 - DNA, 20 bp, Artificial Sequence
  Description of Artificial Sequence: Synthetic oligonucleotide
  Target: ATXN1; (-) strand; PAM type: NRG; PAM sequence: GAG
gtatcctcttttatttcgtt

SEQ ID NO: 88806 - DNA, 20 bp, Artificial Sequence
  Description of Artificial Sequence: Synthetic oligonucleotide
  Target: ATXN1; (-) strand; PAM type: NRG; PAM sequence: TGG
cttcttcctttccatgagca

SEQ ID NO: 88807 - DNA, 20 bp, Artificial Sequence
  Description of Artificial Sequence: Synthetic oligonucleotide
  Target: ATXN1; (-) strand; PAM type: NRG; PAM sequence: GAG
tattgcttcttcctttccat

SEQ ID NO: 88808 - DNA, 20 bp, Artificial Sequence
  Description of Artificial Sequence: Synthetic oligonucleotide
  Target: ATXN1; (-) strand; PAM type: NRG; PAM sequence: TGG
ataaattaccttgggcagta

SEQ ID NO: 88809 - DNA, 20 bp, Artificial Sequence
  Description of Artificial Sequence: Synthetic oligonucleotide
  Target: ATXN1; (-) strand; PAM type: NRG; PAM sequence: CAG
aatctataaattaccttggg

SEQ ID NO: 88810 - DNA, 20 bp, Artificial Sequence
  Description of Artificial Sequence: Synthetic oligonucleotide
  Target: ATXN1; (-) strand; PAM type: NRG; PAM sequence: GGG
ttgaatctataaattacctt

SEQ ID NO: 88811 - DNA, 20 bp, Artificial Sequence
  Description of Artificial Sequence: Synthetic oligonucleotide
  Target: ATXN1; (-) strand; PAM type: NRG; PAM sequence: TGG
attgaatctataaattacct

SEQ ID NO: 88812 - DNA, 20 bp, Artificial Sequence
  Description of Artificial Sequence: Synthetic oligonucleotide
  Target: ATXN1; (-) strand; PAM type: NRG; PAM sequence: TGG
cattggtagcttgatgggga

SEQ ID NO: 88813 - DNA, 20 bp, Artificial Sequence
  Description of Artificial Sequence: Synthetic oligonucleotide
  Target: ATXN1; (-) strand; PAM type: NRG; PAM sequence: GGG
aagtcattggtagcttgatg

SEQ ID NO: 88814 - DNA, 20 bp, Artificial Sequence
  Description of Artificial Sequence: Synthetic oligonucleotide
  Target: ATXN1; (-) strand; PAM type: NRG; PAM sequence: GGG
aaagtcattggtagcttgat

SEQ ID NO: 88815 - DNA, 20 bp, Artificial Sequence
  Description of Artificial Sequence: Synthetic oligonucleotide
  Target: ATXN1; (-) strand; PAM type: NRG; PAM sequence: TGG
gaaagtcattggtagcttga

SEQ ID NO: 88816 - DNA, 20 bp, Artificial Sequence
  Description of Artificial Sequence: Synthetic oligonucleotide
  Target: ATXN1; (-) strand; PAM type: NRG; PAM sequence: TAG
tctgtgaagaaagtcattgg

SEQ ID NO: 88817 - DNA, 20 bp, Artificial Sequence
  Description of Artificial Sequence: Synthetic oligonucleotide
  Target: ATXN1; (-) strand; PAM type: NRG; PAM sequence: TGG
aattctgtgaagaaagtcat

SEQ ID NO: 88818 - DNA, 20 bp, Artificial Sequence
  Description of Artificial Sequence: Synthetic oligonucleotide
  Target: ATXN1; (-) strand; PAM type: NRG; PAM sequence: AAG
tttttccaattctgtgaaga

SEQ ID NO: 88819 - DNA, 20 bp, Artificial Sequence
  Description of Artificial Sequence: Synthetic oligonucleotide
  Target: ATXN1; (-) strand; PAM type: NRG; PAM sequence: AAG
tagttttttccaattctgtg

SEQ ID NO: 88820 - DNA, 20 bp, Artificial Sequence
  Description of Artificial Sequence: Synthetic oligonucleotide
  Target: ATXN1; (-) strand; PAM type: NRG; PAM sequence: TAG
gttccatatgaactttaaag

SEQ ID NO: 88821 - DNA, 20 bp, Artificial Sequence
  Description of Artificial Sequence: Synthetic oligonucleotide
  Target: ATXN1; (-) strand; PAM type: NRG; PAM sequence: AAG
ttggttccatatgaacttta

SEQ ID NO: 88822 - DNA, 20 bp, Artificial Sequence
  Description of Artificial Sequence: Synthetic oligonucleotide
  Target: ATXN1; (-) strand; PAM type: NRG; PAM sequence: TGG
tggcaatgtgggctcttttt

SEQ ID NO: 88823 - DNA, 20 bp, Artificial Sequence
  Description of Artificial Sequence: Synthetic oligonucleotide
  Target: ATXN1; (-) strand; PAM type: NRG; PAM sequence: GGG
taggattgacttggcaatgt

SEQ ID NO: 88824 - DNA, 20 bp, Artificial Sequence
  Description of Artificial Sequence: Synthetic oligonucleotide
  Target: ATXN1; (-) strand; PAM type: NRG; PAM sequence: TGG
ttaggattgacttggcaatg

SEQ ID NO: 88825 - DNA, 20 bp, Artificial Sequence
  Description of Artificial Sequence: Synthetic oligonucleotide
  Target: ATXN1; (-) strand; PAM type: NRG; PAM sequence: TGG
cttttggcttaggattgact

SEQ ID NO: 88826 - DNA, 20 bp, Artificial Sequence
  Description of Artificial Sequence: Synthetic oligonucleotide
  Target: ATXN1; (-) strand; PAM type: NRG; PAM sequence: AGG
cagctttgttcttttggctt

SEQ ID NO: 88827 - DNA, 20 bp, Artificial Sequence
  Description of Artificial Sequence: Synthetic oligonucleotide
  Target: ATXN1; (-) strand; PAM type: NRG; PAM sequence: TAG
ccagctttgttcttttggct

SEQ ID NO: 88828 - DNA, 20 bp, Artificial Sequence
  Description of Artificial Sequence: Synthetic oligonucleotide
  Target: ATXN1; (-) strand; PAM type: NRG; PAM sequence: TGG
tgcctccagctttgttcttt

SEQ ID NO: 88829 - DNA, 20 bp, Artificial Sequence
  Description of Artificial Sequence: Synthetic oligonucleotide
  Target: ATXN1; (-) strand; PAM type: NRG; PAM sequence: CAG
gtcaggtagtgtgatgcctc

SEQ ID NO: 88830 - DNA, 20 bp, Artificial Sequence
  Description of Artificial Sequence: Synthetic oligonucleotide
  Target: ATXN1; (-) strand; PAM type: NRG; PAM sequence: TAG
tagtatagtttgaagtcagg

SEQ ID NO: 88831 - DNA, 20 bp, Artificial Sequence
  Description of Artificial Sequence: Synthetic oligonucleotide
  Target: ATXN1; (-) strand; PAM type: NRG; PAM sequence: AGG
ttgtagtatagtttgaagtc

SEQ ID NO: 88832 - DNA, 20 bp, Artificial Sequence
  Description of Artificial Sequence: Synthetic oligonucleotide
  Target: ATXN1; (-) strand; PAM type: NRG; PAM sequence: CAG
cttgtagtatagtttgaagt

SEQ ID NO: 88833 - DNA, 20 bp, Artificial Sequence
  Description of Artificial Sequence: Synthetic oligonucleotide
  Target: ATXN1; (-) strand; PAM type: NRG; PAM sequence: AAG
tagccttgtagtatagtttg

SEQ ID NO: 88834 - DNA, 20 bp, Artificial Sequence
  Description of Artificial Sequence: Synthetic oligonucleotide
  Target: ATXN1; (-) strand; PAM type: NRG; PAM sequence: TAG
attactgtagccttgtagta

SEQ ID NO: 88835 - DNA, 20 bp, Artificial Sequence
  Description of Artificial Sequence: Synthetic oligonucleotide
  Target: ATXN1; (-) strand; PAM type: NRG; PAM sequence: TAG
ttttgattactgtagccttg

SEQ ID NO: 88836 - DNA, 20 bp, Artificial Sequence
  Description of Artificial Sequence: Synthetic oligonucleotide
  Target: ATXN1; (-) strand; PAM type: NRG; PAM sequence: TAG
ccatgctgttttgattactg

SEQ ID NO: 88837 - DNA, 20 bp, Artificial Sequence
  Description of Artificial Sequence: Synthetic oligonucleotide
  Target: ATXN1; (-) strand; PAM type: NRG; PAM sequence: CAG
ctatatctctgttttggtac

SEQ ID NO: 88838 - DNA, 20 bp, Artificial Sequence
  Description of Artificial Sequence: Synthetic oligonucleotide
  Target: ATXN1; (-) strand; PAM type: NRG; PAM sequence: TGG
attggtctatatctctgttt

SEQ ID NO: 88839 - DNA, 20 bp, Artificial Sequence
  Description of Artificial Sequence: Synthetic oligonucleotide
  Target: ATXN1; (-) strand; PAM type: NRG; PAM sequence: TGG
agggctctgttctgttccat

SEQ ID NO: 88840 - DNA, 20 bp, Artificial Sequence
  Description of Artificial Sequence: Synthetic oligonucleotide
  Target: ATXN1; (-) strand; PAM type: NRG; PAM sequence: GGG
atgtgtggcattatttctga

SEQ ID NO: 88841 - DNA, 20 bp, Artificial Sequence
  Description of Artificial Sequence: Synthetic oligonucleotide
  Target: ATXN1; (-) strand; PAM type: NRG; PAM sequence: AGG
gatgtgtggcattatttctg

SEQ ID NO: 88842 - DNA, 20 bp, Artificial Sequence
  Description of Artificial Sequence: Synthetic oligonucleotide
  Target: ATXN1; (-) strand; PAM type: NRG; PAM sequence: GAG
agatgtgtggcattatttct

SEQ ID NO: 88843 - DNA, 20 bp, Artificial Sequence
  Description of Artificial Sequence: Synthetic oligonucleotide
  Target: ATXN1; (-) strand; PAM type: NRG; PAM sequence: TGG
atcggatagttgtagatgtg

SEQ ID NO: 88844 - DNA, 20 bp, Artificial Sequence
  Description of Artificial Sequence: Synthetic oligonucleotide
  Target: ATXN1; (-) strand; PAM type: NRG; PAM sequence: TAG
tgtcaaagatcggatagttg

SEQ ID NO: 88845 - DNA, 20 bp, Artificial Sequence
  Description of Artificial Sequence: Synthetic oligonucleotide
  Target: ATXN1; (-) strand; PAM type: NRG; PAM sequence: TAG
caggtttgtcaaagatcgga

SEQ ID NO: 88846 - DNA, 20 bp, Artificial Sequence
  Description of Artificial Sequence: Synthetic oligonucleotide
  Target: ATXN1; (-) strand; PAM type: NRG; PAM sequence: CGG
ttgtcaggtttgtcaaagat

SEQ ID NO: 88847 - DNA, 20 bp, Artificial Sequence
  Description of Artificial Sequence: Synthetic oligonucleotide
  Target: ATXN1; (-) strand; PAM type: NRG; PAM sequence: AAG
tgtttttgtcaggtttgtca

SEQ ID NO: 88848 - DNA, 20 bp, Artificial Sequence
  Description of Artificial Sequence: Synthetic oligonucleotide
  Target: ATXN1; (-) strand; PAM type: NRG; PAM sequence: AGG
ccccatttcttgtttttgtc

SEQ ID NO: 88849 - DNA, 20 bp, Artificial Sequence
  Description of Artificial Sequence: Synthetic oligonucleotide
  Target: ATXN1; (-) strand; PAM type: NRG; PAM sequence: CAG
tccccatttcttgtttttgt

SEQ ID NO: 88850 - DNA, 20 bp, Artificial Sequence
  Description of Artificial Sequence: Synthetic oligonucleotide
  Target: ATXN1; (-) strand; PAM type: NRG; PAM sequence: GGG
ccagcaccatttattaaata

SEQ ID NO: 88851 - DNA, 20 bp, Artificial Sequence
  Description of Artificial Sequence: Synthetic oligonucleotide
  Target: ATXN1; (-) strand; PAM type: NRG; PAM sequence: AGG
cccagcaccatttattaaat

SEQ ID NO: 88852 - DNA, 20 bp, Artificial Sequence
  Description of Artificial Sequence: Synthetic oligonucleotide
  Target: ATXN1; (-) strand; PAM type: NRG; PAM sequence: TAG
tcccagcaccatttattaaa

SEQ ID NO: 88853 - DNA, 20 bp, Artificial Sequence
  Description of Artificial Sequence: Synthetic oligonucleotide
  Target: ATXN1; (-) strand; PAM type: NRG; PAM sequence: CAG
atatggctagccagttttcc

SEQ ID NO: 88854 - DNA, 20 bp, Artificial Sequence
  Description of Artificial Sequence: Synthetic oligonucleotide
  Target: ATXN1; (-) strand; PAM type: NRG; PAM sequence: CAG
gctttctacatatggctagc

SEQ ID NO: 88855 - DNA, 20 bp, Artificial Sequence
  Description of Artificial Sequence: Synthetic oligonucleotide
  Target: ATXN1; (-) strand; PAM type: NRG; PAM sequence: TAG
ttcggctttctacatatggc

SEQ ID NO: 88856 - DNA, 20 bp, Artificial Sequence
  Description of Artificial Sequence: Synthetic oligonucleotide
  Target: ATXN1; (-) strand; PAM type: NRG; PAM sequence: TGG
cagtttcggctttctacata

SEQ ID NO: 88857 - DNA, 20 bp, Artificial Sequence
  Description of Artificial Sequence: Synthetic oligonucleotide
  Target: ATXN1; (-) strand; PAM type: NRG; PAM sequence: CGG
gtaaggaaggggttcagttt

SEQ ID NO: 88858 - DNA, 20 bp, Artificial Sequence
  Description of Artificial Sequence: Synthetic oligonucleotide
  Target: ATXN1; (-) strand; PAM type: NRG; PAM sequence: CAG
taaggtgtaaggaaggggtt

SEQ ID NO: 88859 - DNA, 20 bp, Artificial Sequence
  Description of Artificial Sequence: Synthetic oligonucleotide
  Target: ATXN1; (-) strand; PAM type: NRG; PAM sequence: GGG
ttgtataaggtgtaaggaag

SEQ ID NO: 88860 - DNA, 20 bp, Artificial Sequence
  Description of Artificial Sequence: Synthetic oligonucleotide
  Target: ATXN1; (-) strand; PAM type: NRG; PAM sequence: GGG
tttgtataaggtgtaaggaa

SEQ ID NO: 88861 - DNA, 20 bp, Artificial Sequence
  Description of Artificial Sequence: Synthetic oligonucleotide
  Target: ATXN1; (-) strand; PAM type: NRG; PAM sequence: AGG
ttttgtataaggtgtaagga

SEQ ID NO: 88862 - DNA, 20 bp, Artificial Sequence
  Description of Artificial Sequence: Synthetic oligonucleotide
  Target: ATXN1; (-) strand; PAM type: NRG; PAM sequence: AAG
tttttgtataaggtgtaagg

SEQ ID NO: 88863 - DNA, 20 bp, Artificial Sequence
  Description of Artificial Sequence: Synthetic oligonucleotide
  Target: ATXN1; (-) strand; PAM type: NRG; PAM sequence: AGG
taatttttgtataaggtgta

SEQ ID NO: 88864 - DNA, 20 bp, Artificial Sequence
  Description of Artificial Sequence: Synthetic oligonucleotide
  Target: ATXN1; (-) strand; PAM type: NRG; PAM sequence: AAG
ttaatttttgtataaggtgt

SEQ ID NO: 88865 - DNA, 20 bp, Artificial Sequence
  Description of Artificial Sequence: Synthetic oligonucleotide
  Target: ATXN1; (-) strand; PAM type: NRG; PAM sequence: AGG
cttgaattaatttttgtata

SEQ ID NO: 88866 - DNA, 20 bp, Artificial Sequence
  Description of Artificial Sequence: Synthetic oligonucleotide
  Target: ATXN1; (-) strand; PAM type: NRG; PAM sequence: AAG
tcttgaattaatttttgtat

SEQ ID NO: 88867 - DNA, 20 bp, Artificial Sequence
  Description of Artificial Sequence: Synthetic oligonucleotide
  Target: ATXN1; (-) strand; PAM type: NRG; PAM sequence: AAG
tggttttaggtctaacattt

SEQ ID NO: 88868 - DNA, 20 bp, Artificial Sequence
  Description of Artificial Sequence: Synthetic oligonucleotide
  Target: ATXN1; (-) strand; PAM type: NRG; PAM sequence: AGG
tctagggtttttatggtttt

SEQ ID NO: 88869 - DNA, 20 bp, Artificial Sequence
  Description of Artificial Sequence: Synthetic oligonucleotide
  Target: ATXN1; (-) strand; PAM type: NRG; PAM sequence: TAG
ttctagggtttttatggttt

SEQ ID NO: 88870 - DNA, 20 bp, Artificial Sequence
  Description of Artificial Sequence: Synthetic oligonucleotide
  Target: ATXN1; (-) strand; PAM type: NRG; PAM sequence: TGG
gttttcttctagggttttta

SEQ ID NO: 88871 - DNA, 20 bp, Artificial Sequence
  Description of Artificial Sequence: Synthetic oligonucleotide
  Target: ATXN1; (-) strand; PAM type: NRG; PAM sequence: GGG
attgcctaggttttcttcta

SEQ ID NO: 88872 - DNA, 20 bp, Artificial Sequence
  Description of Artificial Sequence: Synthetic oligonucleotide
  Target: ATXN1; (-) strand; PAM type: NRG; PAM sequence: AGG
tattgcctaggttttcttct

SEQ ID NO: 88873 - DNA, 20 bp, Artificial Sequence
  Description of Artificial Sequence: Synthetic oligonucleotide
  Target: ATXN1; (-) strand; PAM type: NRG; PAM sequence: TAG
gtattgcctaggttttcttc

SEQ ID NO: 88874 - DNA, 20 bp, Artificial Sequence
  Description of Artificial Sequence: Synthetic oligonucleotide
  Target: ATXN1; (-) strand; PAM type: NRG; PAM sequence: AGG
tgtcctgaatggtattgcct

SEQ ID NO: 88875 - DNA, 20 bp, Artificial Sequence
  Description of Artificial Sequence: Synthetic oligonucleotide
  Target: ATXN1; (-) strand; PAM type: NRG; PAM sequence: TAG
atgtcctgaatggtattgcc

SEQ ID NO: 88876 - DNA, 20 bp, Artificial Sequence
  Description of Artificial Sequence: Synthetic oligonucleotide
  Target: ATXN1; (-) strand; PAM type: NRG; PAM sequence: TGG
gcccatgcctatgtcctgaa

SEQ ID NO: 88877 - DNA, 20 bp, Artificial Sequence
  Description of Artificial Sequence: Synthetic oligonucleotide
  Target: ATXN1; (-) strand; PAM type: NRG; PAM sequence: AAG
cttttggtgttttagacatg

SEQ ID NO: 88878 - DNA, 20 bp, Artificial Sequence
  Description of Artificial Sequence: Synthetic oligonucleotide
  Target: ATXN1; (-) strand; PAM type: NRG; PAM sequence: TAG
tgccattgcttttggtgttt

SEQ ID NO: 88879 - DNA, 20 bp, Artificial Sequence
  Description of Artificial Sequence: Synthetic oligonucleotide
  Target: ATXN1; (-) strand; PAM type: NRG; PAM sequence: TGG
gcttttgttgccattgcttt

SEQ ID NO: 88880 - DNA, 20 bp, Artificial Sequence
  Description of Artificial Sequence: Synthetic oligonucleotide
  Target: ATXN1; (-) strand; PAM type: NRG; PAM sequence: TGG
tagatcccatttgacaattt

SEQ ID NO: 88881 - DNA, 20 bp, Artificial Sequence
  Description of Artificial Sequence: Synthetic oligonucleotide
  Target: ATXN1; (-) strand; PAM type: NRG; PAM sequence: TAG
cagaagctctttagtttaat

SEQ ID NO: 88882 - DNA, 20 bp, Artificial Sequence
  Description of Artificial Sequence: Synthetic oligonucleotide
  Target: ATXN1; (-) strand; PAM type: NRG; PAM sequence: TAG
ttggctgtgcagaagctctt

SEQ ID NO: 88883 - DNA, 20 bp, Artificial Sequence
  Description of Artificial Sequence: Synthetic oligonucleotide
  Target: ATXN1; (-) strand; PAM type: NRG; PAM sequence: AAG
tagtttctttggctgtgcag

SEQ ID NO: 88884 - DNA, 20 bp, Artificial Sequence
  Description of Artificial Sequence: Synthetic oligonucleotide
  Target: ATXN1; (-) strand; PAM type: NRG; PAM sequence: CAG
tggtagtttctttggctgtg

SEQ ID NO: 88885 - DNA, 20 bp, Artificial Sequence
  Description of Artificial Sequence: Synthetic oligonucleotide
  Target: ATXN1; (-) strand; PAM type: NRG; PAM sequence: TGG
cactccgatggtagtttctt

SEQ ID NO: 88886 - DNA, 20 bp, Artificial Sequence
  Description of Artificial Sequence: Synthetic oligonucleotide
  Target: ATXN1; (-) strand; PAM type: NRG; PAM sequence: TAG
ttgcctgttcactccgatgg

SEQ ID NO: 88887 - DNA, 20 bp, Artificial Sequence
  Description of Artificial Sequence: Synthetic oligonucleotide
  Target: ATXN1; (-) strand; PAM type: NRG; PAM sequence: TGG
aggttgcctgttcactccga

SEQ ID NO: 88888 - DNA, 20 bp, Artificial Sequence
  Description of Artificial Sequence: Synthetic oligonucleotide
  Target: ATXN1; (-) strand; PAM type: NRG; PAM sequence: AGG
aaaattttctcccattctgt

SEQ ID NO: 88889 - DNA, 20 bp, Artificial Sequence
  Description of Artificial Sequence: Synthetic oligonucleotide
  Target: ATXN1; (-) strand; PAM type: NRG; PAM sequence: TAG
aaaaattttctcccattctg

SEQ ID NO: 88890 - DNA, 20 bp, Artificial Sequence
  Description of Artificial Sequence: Synthetic oligonucleotide
  Target: ATXN1; (-) strand; PAM type: NRG; PAM sequence: TAG
ttagccctttgtccgatgag

SEQ ID NO: 88891 - DNA, 20 bp, Artificial Sequence
  Description of Artificial Sequence: Synthetic oligonucleotide
  Target: ATXN1; (-) strand; PAM type: NRG; PAM sequence: GAG
atattagccctttgtccgat

SEQ ID NO: 88892 - DNA, 20 bp, Artificial Sequence
  Description of Artificial Sequence: Synthetic oligonucleotide
  Target: ATXN1; (-) strand; PAM type: NRG; PAM sequence: TAG
tctttgtagattctggatat

SEQ ID NO: 88893 - DNA, 20 bp, Artificial Sequence
  Description of Artificial Sequence: Synthetic oligonucleotide
  Target: ATXN1; (-) strand; PAM type: NRG; PAM sequence: TGG
tttgagttctttgtagattc

SEQ ID NO: 88894 - DNA, 20 bp, Artificial Sequence
  Description of Artificial Sequence: Synthetic oligonucleotide
  Target: ATXN1; (-) strand; PAM type: NRG; PAM sequence: TAG
aaatttgtttgagttctttg

SEQ ID NO: 88895 - DNA, 20 bp, Artificial Sequence
  Description of Artificial Sequence: Synthetic oligonucleotide
  Target: ATXN1; (-) strand; PAM type: NRG; PAM sequence: GAG
tttttcttgtaaatttgttt

SEQ ID NO: 88896 - DNA, 20 bp, Artificial Sequence
  Description of Artificial Sequence: Synthetic oligonucleotide
  Target: ATXN1; (-) strand; PAM type: NRG; PAM sequence: GGG
ccttcgcccactttttgatg

SEQ ID NO: 88897 - DNA, 20 bp, Artificial Sequence
  Description of Artificial Sequence: Synthetic oligonucleotide
  Target: ATXN1; (-) strand; PAM type: NRG; PAM sequence: GGG
tccttcgcccactttttgat

SEQ ID NO: 88898 - DNA, 20 bp, Artificial Sequence
  Description of Artificial Sequence: Synthetic oligonucleotide
  Target: ATXN1; (-) strand; PAM type: NRG; PAM sequence: TGG
atccttcgcccactttttga

SEQ ID NO: 88899 - DNA, 20 bp, Artificial Sequence
  Description of Artificial Sequence: Synthetic oligonucleotide
  Target: ATXN1; (-) strand; PAM type: NRG; PAM sequence: AAG
cataaatgtcttcttttgag

SEQ ID NO: 88900 - DNA, 20 bp, Artificial Sequence
  Description of Artificial Sequence: Synthetic oligonucleotide
  Target: ATXN1; (-) strand; PAM type: NRG; PAM sequence: GAG
ctgcataaatgtcttctttt

SEQ ID NO: 88901 - DNA, 20 bp, Artificial Sequence
  Description of Artificial Sequence: Synthetic oligonucleotide
  Target: ATXN1; (-) strand; PAM type: NRG; PAM sequence: TGG
gatgagcattttttgtcttt

SEQ ID NO: 88902 - DNA, 20 bp, Artificial Sequence
  Description of Artificial Sequence: Synthetic oligonucleotide
  Target: ATXN1; (-) strand; PAM type: NRG; PAM sequence: GAG
ctctgatggccagtgatgat

SEQ ID NO: 88903 - DNA, 20 bp, Artificial Sequence
  Description of Artificial Sequence: Synthetic oligonucleotide
  Target: ATXN1; (-) strand; PAM type: NRG; PAM sequence: CAG
atttgcatttctctgatggc

SEQ ID NO: 88904 - DNA, 20 bp, Artificial Sequence
  Description of Artificial Sequence: Synthetic oligonucleotide
  Target: ATXN1; (-) strand; PAM type: NRG; PAM sequence: TGG
tttgatttgcatttctctga

SEQ ID NO: 88905 - DNA, 20 bp, Artificial Sequence
  Description of Artificial Sequence: Synthetic oligonucleotide
  Target: ATXN1; (-) strand; PAM type: NRG; PAM sequence: TGG
tgtgagatggtatgtcattg

SEQ ID NO: 88906 - DNA, 20 bp, Artificial Sequence
  Description of Artificial Sequence: Synthetic oligonucleotide
  Target: ATXN1; (-) strand; PAM type: NRG; PAM sequence: TGG
ccattctaactggtgtgaga

SEQ ID NO: 88907 - DNA, 20 bp, Artificial Sequence
  Description of Artificial Sequence: Synthetic oligonucleotide
  Target: ATXN1; (-) strand; PAM type: NRG; PAM sequence: GAG
attgccattctaactggtgt

SEQ ID NO: 88908 - DNA, 20 bp, Artificial Sequence
  Description of Artificial Sequence: Synthetic oligonucleotide
  Target: ATXN1; (-) strand; PAM type: NRG; PAM sequence: TGG
ttaatgattgccattctaac

SEQ ID NO: 88909 - DNA, 20 bp, Artificial Sequence
  Description of Artificial Sequence: Synthetic oligonucleotide
  Target: ATXN1; (-) strand; PAM type: NRG; PAM sequence: CAG
ctatgtctccacatcctctc

SEQ ID NO: 88910 - DNA, 20 bp, Artificial Sequence
  Description of Artificial Sequence: Synthetic oligonucleotide
  Target: ATXN1; (-) strand; PAM type: NRG; PAM sequence: CAG
ctagtttacagtcccacaaa

SEQ ID NO: 88911 - DNA, 20 bp, Artificial Sequence
  Description of Artificial Sequence: Synthetic oligonucleotide
  Target: ATXN1; (-) strand; PAM type: NRG; PAM sequence: CAG
acaatggttgaactagttta

SEQ ID NO: 88912 - DNA, 20 bp, Artificial Sequence
  Description of Artificial Sequence: Synthetic oligonucleotide
  Target: ATXN1; (-) strand; PAM type: NRG; PAM sequence: TAG
gacttccacaatggttgaac

SEQ ID NO: 88913 - DNA, 20 bp, Artificial Sequence
  Description of Artificial Sequence: Synthetic oligonucleotide
  Target: ATXN1; (-) strand; PAM type: NRG; PAM sequence: TGG
cgccacactgacttccacaa

SEQ ID NO: 88914 - DNA, 20 bp, Artificial Sequence
  Description of Artificial Sequence: Synthetic oligonucleotide
  Target: ATXN1; (-) strand; PAM type: NRG; PAM sequence: AGG
tttctagttctagatccctg

SEQ ID NO: 88915 - DNA, 20 bp, Artificial Sequence
  Description of Artificial Sequence: Synthetic oligonucleotide
  Target: ATXN1; (-) strand; PAM type: NRG; PAM sequence: GAG
atttctagttctagatccct

SEQ ID NO: 88916 - DNA, 20 bp, Artificial Sequence
  Description of Artificial Sequence: Synthetic oligonucleotide
  Target: ATXN1; (-) strand; PAM type: NRG; PAM sequence: TAG
tcaaatggtatttctagttc

SEQ ID NO: 88917 - DNA, 20 bp, Artificial Sequence
  Description of Artificial Sequence: Synthetic oligonucleotide
  Target: ATXN1; (-) strand; PAM type: NRG; PAM sequence: TAG
gctgggtcaaatggtatttc

SEQ ID NO: 88918 - DNA, 20 bp, Artificial Sequence
  Description of Artificial Sequence: Synthetic oligonucleotide
  Target: ATXN1; (-) strand; PAM type: NRG; PAM sequence: TGG
aatgggatggctgggtcaaa

SEQ ID NO: 88919 - DNA, 20 bp, Artificial Sequence
  Description of Artificial Sequence: Synthetic oligonucleotide
  Target: ATXN1; (-) strand; PAM type: NRG; PAM sequence: GGG
tacccagtaatgggatggct

SEQ ID NO: 88920 - DNA, 20 bp, Artificial Sequence
  Description of Artificial Sequence: Synthetic oligonucleotide
  Target: ATXN1; (-) strand; PAM type: NRG; PAM sequence: TGG
atacccagtaatgggatggc

SEQ ID NO: 88921 - DNA, 20 bp, Artificial Sequence
  Description of Artificial Sequence: Synthetic oligonucleotide
  Target: ATXN1; (-) strand; PAM type: NRG; PAM sequence: TGG
gtatatacccagtaatggga

SEQ ID NO: 88922 - DNA, 20 bp, Artificial Sequence
  Description of Artificial Sequence: Synthetic oligonucleotide
  Target: ATXN1; (-) strand; PAM type: NRG; PAM sequence: GGG
tttggtatatacccagtaat

SEQ ID NO: 88923 - DNA, 20 bp, Artificial Sequence
  Description of Artificial Sequence: Synthetic oligonucleotide
  Target: ATXN1; (-) strand; PAM type: NRG; PAM sequence: TGG
ttttggtatatacccagtaa

SEQ ID NO: 88924 - DNA, 20 bp, Artificial Sequence
  Description of Artificial Sequence: Synthetic oligonucleotide
  Target: ATXN1; (-) strand; PAM type: NRG; PAM sequence: CAG
tactccttttggtatatacc

SEQ ID NO: 88925 - DNA, 20 bp, Artificial Sequence
  Description of Artificial Sequence: Synthetic oligonucleotide
  Target: ATXN1; (-) strand; PAM type: NRG; PAM sequence: TGG
agcatgatttatactccttt

SEQ ID NO: 88926 - DNA, 20 bp, Artificial Sequence
  Description of Artificial Sequence: Synthetic oligonucleotide
  Target: ATXN1; (-) strand; PAM type: NRG; PAM sequence: CAG
gtgtgcatgtgtctttatag

SEQ ID NO: 88927 - DNA, 20 bp, Artificial Sequence
  Description of Artificial Sequence: Synthetic oligonucleotide
  Target: ATXN1; (-) strand; PAM type: NRG; PAM sequence: TAG
tacgtgtgcatgtgtcttta

SEQ ID NO: 88928 - DNA, 20 bp, Artificial Sequence
  Description of Artificial Sequence: Synthetic oligonucleotide
  Target: ATXN1; (-) strand; PAM type: NRG; PAM sequence: TAG
caagtctttgctattgtgaa

SEQ ID NO: 88929 - DNA, 20 bp, Artificial Sequence
  Description of Artificial Sequence: Synthetic oligonucleotide
  Target: ATXN1; (-) strand; PAM type: NRG; PAM sequence: AAG
tggacatttgggttggttcc

SEQ ID NO: 88930 - DNA, 20 bp, Artificial Sequence
  Description of Artificial Sequence: Synthetic oligonucleotide
  Target: ATXN1; (-) strand; PAM type: NRG; PAM sequence: TGG
tcattgttggacatttgggt

SEQ ID NO: 88931 - DNA, 20 bp, Artificial Sequence
  Description of Artificial Sequence: Synthetic oligonucleotide
  Target: ATXN1; (-) strand; PAM type: NRG; PAM sequence: GGG
tttatcattgttggacattt

SEQ ID NO: 88932 - DNA, 20 bp, Artificial Sequence
  Description of Artificial Sequence: Synthetic oligonucleotide
  Target: ATXN1; (-) strand; PAM type: NRG; PAM sequence: TGG
gtttatcattgttggacatt

SEQ ID NO: 88933 - DNA, 20 bp, Artificial Sequence
  Description of Artificial Sequence: Synthetic oligonucleotide
  Target: ATXN1; (-) strand; PAM type: NRG; PAM sequence: TGG
ttaatgcagtttatcattgt

SEQ ID NO: 88934 - DNA, 20 bp, Artificial Sequence
  Description of Artificial Sequence: Synthetic oligonucleotide
  Target: ATXN1; (-) strand; PAM type: NRG; PAM sequence: CAG
tgtgccacattttcttaatg

SEQ ID NO: 88935 - DNA, 20 bp, Artificial Sequence
  Description of Artificial Sequence: Synthetic oligonucleotide
  Target: ATXN1; (-) strand; PAM type: NRG; PAM sequence: TGG
tatggctgcatagtattccc

SEQ ID NO: 88936 - DNA, 20 bp, Artificial Sequence
  Description of Artificial Sequence: Synthetic oligonucleotide
  Target: ATXN1; (-) strand; PAM type: NRG; PAM sequence: TAG
catcattttttatggctgca

SEQ ID NO: 88937 - DNA, 20 bp, Artificial Sequence
  Description of Artificial Sequence: Synthetic oligonucleotide
  Target: ATXN1; (-) strand; PAM type: NRG; PAM sequence: TGG
catgaactcatcatttttta

SEQ ID NO: 88938 - DNA, 20 bp, Artificial Sequence
  Description of Artificial Sequence: Synthetic oligonucleotide
  Target: ATXN1; (-) strand; PAM type: NRG; PAM sequence: AGG
cttcatccatgtccctacaa

SEQ ID NO: 88939 - DNA, 20 bp, Artificial Sequence
  Description of Artificial Sequence: Synthetic oligonucleotide
  Target: ATXN1; (-) strand; PAM type: NRG; PAM sequence: AAG
gcttcatccatgtccctaca

SEQ ID NO: 88940 - DNA, 20 bp, Artificial Sequence
  Description of Artificial Sequence: Synthetic oligonucleotide
  Target: ATXN1; (-) strand; PAM type: NRG; PAM sequence: CAG
ttgctgagaatgatggtttc

SEQ ID NO: 88941 - DNA, 20 bp, Artificial Sequence
  Description of Artificial Sequence: Synthetic oligonucleotide
  Target: ATXN1; (-) strand; PAM type: NRG; PAM sequence: TGG
cgatagtttgctgagaatga

SEQ ID NO: 88942 - DNA, 20 bp, Artificial Sequence
  Description of Artificial Sequence: Synthetic oligonucleotide
  Target: ATXN1; (-) strand; PAM type: NRG; PAM sequence: GAG
tgtccttgcgatagtttgct

SEQ ID NO: 88943 - DNA, 20 bp, Artificial Sequence
  Description of Artificial Sequence: Synthetic oligonucleotide
  Target: ATXN1; (-) strand; PAM type: NRG; PAM sequence: TAG
ttggttttttgtccttgcga

SEQ ID NO: 88944 - DNA, 20 bp, Artificial Sequence
  Description of Artificial Sequence: Synthetic oligonucleotide
  Target: ATXN1; (-) strand; PAM type: NRG; PAM sequence: TGG
gagtgagaacatgcggtgtt

SEQ ID NO: 88945 - DNA, 20 bp, Artificial Sequence
  Description of Artificial Sequence: Synthetic oligonucleotide
  Target: ATXN1; (-) strand; PAM type: NRG; PAM sequence: CGG
cacctatgagtgagaacatg

SEQ ID NO: 88946 - DNA, 20 bp, Artificial Sequence
  Description of Artificial Sequence: Synthetic oligonucleotide
  Target: ATXN1; (-) strand; PAM type: NRG; PAM sequence: GAG
ttcaattcccacctatgagt

SEQ ID NO: 88947 - DNA, 20 bp, Artificial Sequence
  Description of Artificial Sequence: Synthetic oligonucleotide
  Target: ATXN1; (-) strand; PAM type: NRG; PAM sequence: GAG
attgttcaattcccacctat

SEQ ID NO: 88948 - DNA, 20 bp, Artificial Sequence
  Description of Artificial Sequence: Synthetic oligonucleotide
  Target: ATXN1; (-) strand; PAM type: NRG; PAM sequence: AAG
gtgttccccttcctgtgccc

SEQ ID NO: 88949 - DNA, 20 bp, Artificial Sequence
  Description of Artificial Sequence: Synthetic oligonucleotide
  Target: ATXN1; (-) strand; PAM type: NRG; PAM sequence: TGG
ccacaacaggccctggggtg

SEQ ID NO: 88950 - DNA, 20 bp, Artificial Sequence
  Description of Artificial Sequence: Synthetic oligonucleotide
  Target: ATXN1; (-) strand; PAM type: NRG; PAM sequence: GGG
ccaccccacaacaggccctg

SEQ ID NO: 88951 - DNA, 20 bp, Artificial Sequence
  Description of Artificial Sequence: Synthetic oligonucleotide
  Target: ATXN1; (-) strand; PAM type: NRG; PAM sequence: GGG
cccaccccacaacaggccct

SEQ ID NO: 88952 - DNA, 20 bp, Artificial Sequence
  Description of Artificial Sequence: Synthetic oligonucleotide
  Target: ATXN1; (-) strand; PAM type: NRG; PAM sequence: TGG
ccccaccccacaacaggccc

SEQ ID NO: 88953 - DNA, 20 bp, Artificial Sequence
  Description of Artificial Sequence: Synthetic oligonucleotide
  Target: ATXN1; (-) strand; PAM type: NRG; PAM sequence: AGG
ccttccccccaccccacaac

SEQ ID NO: 88954 - DNA, 20 bp, Artificial Sequence
  Description of Artificial Sequence: Synthetic oligonucleotide
  Target: ATXN1; (-) strand; PAM type: NRG; PAM sequence: CAG
cccttccccccaccccacaa

SEQ ID NO: 88955 - DNA, 20 bp, Artificial Sequence
  Description of Artificial Sequence: Synthetic oligonucleotide
  Target: ATXN1; (-) strand; PAM type: NRG; PAM sequence: AGG
attaaatcgtcatttacatt

SEQ ID NO: 88956 - DNA, 20 bp, Artificial Sequence
  Description of Artificial Sequence: Synthetic oligonucleotide
  Target: ATXN1; (-) strand; PAM type: NRG; PAM sequence: TAG
cattaaatcgtcatttacat

SEQ ID NO: 88957 - DNA, 20 bp, Artificial Sequence
  Description of Artificial Sequence: Synthetic oligonucleotide
  Target: ATXN1; (-) strand; PAM type: NRG; PAM sequence: AGG
ggtagatgtgcacaacttgc

SEQ ID NO: 88958 - DNA, 20 bp, Artificial Sequence
  Description of Artificial Sequence: Synthetic oligonucleotide
  Target: ATXN1; (-) strand; PAM type: NRG; PAM sequence: CAG
gggtagatgtgcacaacttg

SEQ ID NO: 88959 - DNA, 20 bp, Artificial Sequence
  Description of Artificial Sequence: Synthetic oligonucleotide
  Target: ATXN1; (-) strand; PAM type: NRG; PAM sequence: TAG
ttatactttaagttttaggg

SEQ ID NO: 88960 - DNA, 20 bp, Artificial Sequence
  Description of Artificial Sequence: Synthetic oligonucleotide
  Target: ATXN1; (-) strand; PAM type: NRG; PAM sequence: GGG
aaattatactttaagtttta

SEQ ID NO: 88961 - DNA, 20 bp, Artificial Sequence
  Description of Artificial Sequence: Synthetic oligonucleotide
  Target: ATXN1; (-) strand; PAM type: NRG; PAM sequence: AGG
aaaattatactttaagtttt

SEQ ID NO: 88962 - DNA, 20 bp, Artificial Sequence
  Description of Artificial Sequence: Synthetic oligonucleotide
  Target: ATXN1; (-) strand; PAM type: NRG; PAM sequence: TAG
taaaattatactttaagttt

SEQ ID NO: 88963 - DNA, 20 bp, Artificial Sequence
  Description of Artificial Sequence: Synthetic oligonucleotide
  Target: ATXN1; (-) strand; PAM type: NRG; PAM sequence: AAG
tttttttaaaattatacttt

SEQ ID NO: 88964 - DNA, 20 bp, Artificial Sequence
  Description of Artificial Sequence: Synthetic oligonucleotide
  Target: ATXN1; (-) strand; PAM type: NRG; PAM sequence: AGG
agagaaatatagagttataa

SEQ ID NO: 88965 - DNA, 20 bp, Artificial Sequence
  Description of Artificial Sequence: Synthetic oligonucleotide
  Target: ATXN1; (-) strand; PAM type: NRG; PAM sequence: AAG
aagagaaatatagagttata

SEQ ID NO: 88966 - DNA, 20 bp, Artificial Sequence
  Description of Artificial Sequence: Synthetic oligonucleotide
  Target: ATXN1; (-) strand; PAM type: NRG; PAM sequence: GAG
aggttataaagagaaatata

SEQ ID NO: 88967 - DNA, 20 bp, Artificial Sequence
  Description of Artificial Sequence: Synthetic oligonucleotide
  Target: ATXN1; (-) strand; PAM type: NRG; PAM sequence: TAG
agaggttataaagagaaata

SEQ ID NO: 88968 - DNA, 20 bp, Artificial Sequence
  Description of Artificial Sequence: Synthetic oligonucleotide
  Target: ATXN1; (-) strand; PAM type: NRG; PAM sequence: GAG
cttttcatagaggttataaa

SEQ ID NO: 88969 - DNA, 20 bp, Artificial Sequence
  Description of Artificial Sequence: Synthetic oligonucleotide
  Target: ATXN1; (-) strand; PAM type: NRG; PAM sequence: AAG
tacttttcatagaggttata

SEQ ID NO: 88970 - DNA, 20 bp, Artificial Sequence
  Description of Artificial Sequence: Synthetic oligonucleotide
  Target: ATXN1; (-) strand; PAM type: NRG; PAM sequence: AGG
agttgcaatacttttcatag

SEQ ID NO: 88971 - DNA, 20 bp, Artificial Sequence
  Description of Artificial Sequence: Synthetic oligonucleotide
  Target: ATXN1; (-) strand; PAM type: NRG; PAM sequence: GAG
tagttgcaatacttttcata

SEQ ID NO: 88972 - DNA, 20 bp, Artificial Sequence
  Description of Artificial Sequence: Synthetic oligonucleotide
  Target: ATXN1; (-) strand; PAM type: NRG; PAM sequence: TAG
cctagttgcaatacttttca

SEQ ID NO: 88973 - DNA, 20 bp, Artificial Sequence
  Description of Artificial Sequence: Synthetic oligonucleotide
  Target: ATXN1; (-) strand; PAM type: NRG; PAM sequence: TAG
tacatgattttgttcaaacc

SEQ ID NO: 88974 - DNA, 20 bp, Artificial Sequence
  Description of Artificial Sequence: Synthetic oligonucleotide
  Target: ATXN1; (-) strand; PAM type: NRG; PAM sequence: AAG
aaattaagatgttagtctcc

SEQ ID NO: 88975 - DNA, 20 bp, Artificial Sequence
  Description of Artificial Sequence: Synthetic oligonucleotide
  Target: ATXN1; (-) strand; PAM type: NRG; PAM sequence: TAG
cattgttaaaattaagatgt

SEQ ID NO: 88976 - DNA, 20 bp, Artificial Sequence
  Description of Artificial Sequence: Synthetic oligonucleotide
  Target: ATXN1; (-) strand; PAM type: NRG; PAM sequence: AAG
gtatagtcattgttaaaatt

SEQ ID NO: 88977 - DNA, 20 bp, Artificial Sequence
  Description of Artificial Sequence: Synthetic oligonucleotide
  Target: ATXN1; (-) strand; PAM type: NRG; PAM sequence: TAG
tttacccccacagcccagta

SEQ ID NO: 88978 - DNA, 20 bp, Artificial Sequence
  Description of Artificial Sequence: Synthetic oligonucleotide
  Target: ATXN1; (-) strand; PAM type: NRG; PAM sequence: CAG
aaacatttacccccacagcc

SEQ ID NO: 88979 - DNA, 20 bp, Artificial Sequence
  Description of Artificial Sequence: Synthetic oligonucleotide
  Target: ATXN1; (-) strand; PAM type: NRG; PAM sequence: CAG
aaaggaaacatttaccccca

SEQ ID NO: 88980 - DNA, 20 bp, Artificial Sequence
  Description of Artificial Sequence: Synthetic oligonucleotide
  Target: ATXN1; (-) strand; PAM type: NRG; PAM sequence: AGG
ttcctaaactgagtaaagaa

SEQ ID NO: 88981 - DNA, 20 bp, Artificial Sequence
  Description of Artificial Sequence: Synthetic oligonucleotide
  Target: ATXN1; (-) strand; PAM type: NRG; PAM sequence: AAG
tttcctaaactgagtaaaga

SEQ ID NO: 88982 - DNA, 20 bp, Artificial Sequence
  Description of Artificial Sequence: Synthetic oligonucleotide
  Target: ATXN1; (-) strand; PAM type: NRG; PAM sequence: AAG
acagtttcctaaactgagta

SEQ ID NO: 88983 - DNA, 20 bp, Artificial Sequence
  Description of Artificial Sequence: Synthetic oligonucleotide
  Target: ATXN1; (-) strand; PAM type: NRG; PAM sequence: GAG
taggcacagtttcctaaact

SEQ ID NO: 88984 - DNA, 20 bp, Artificial Sequence
  Description of Artificial Sequence: Synthetic oligonucleotide
  Target: ATXN1; (-) strand; PAM type: NRG; PAM sequence: CAG
tgtactatttattataggca

SEQ ID NO: 88985 - DNA, 20 bp, Artificial Sequence
  Description of Artificial Sequence: Synthetic oligonucleotide
  Target: ATXN1; (-) strand; PAM type: NRG; PAM sequence: AGG
atagatgtactatttattat

SEQ ID NO: 88986 - DNA, 20 bp, Artificial Sequence
  Description of Artificial Sequence: Synthetic oligonucleotide
  Target: ATXN1; (-) strand; PAM type: NRG; PAM sequence: TAG
catagatgtactatttatta

SEQ ID NO: 88987 - DNA, 20 bp, Artificial Sequence
  Description of Artificial Sequence: Synthetic oligonucleotide
  Target: ATXN1; (-) strand; PAM type: NRG; PAM sequence: TAG
ggcattaagtacattcacca

SEQ ID NO: 88988 - DNA, 20 bp, Artificial Sequence
  Description of Artificial Sequence: Synthetic oligonucleotide
  Target: ATXN1; (-) strand; PAM type: NRG; PAM sequence: AAG
atatgcatttcagtggcatt

SEQ ID NO: 88989 - DNA, 20 bp, Artificial Sequence
  Description of Artificial Sequence: Synthetic oligonucleotide
  Target: ATXN1; (-) strand; PAM type: NRG; PAM sequence: TGG
tttttaaatatgcatttcag

SEQ ID NO: 88990 - DNA, 20 bp, Artificial Sequence
  Description of Artificial Sequence: Synthetic oligonucleotide
  Target: ATXN1; (-) strand; PAM type: NRG; PAM sequence: CAG
ccatttttaaatatgcattt

SEQ ID NO: 88991 - DNA, 20 bp, Artificial Sequence
  Description of Artificial Sequence: Synthetic oligonucleotide
  Target: ATXN1; (-) strand; PAM type: NRG; PAM sequence: GAG
agtgccgggattacagtcgt

SEQ ID NO: 88992 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgccgggatta

SEQ ID NO: 88993 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgcc

SEQ ID NO: 88994 - DNA, 20 bp, Artificial Sequence
  Description of Artificial Sequence: Synthetic oligonucleotide
  Target: ATXN1; (-) strand; PAM type: NRG; PAM sequence: CGG
gcctcggcctcccaaagtgc

SEQ ID NO: 88995 - DNA, 20 bp, Artificial Sequence
  Description of Artificial Sequence: Synthetic oligonucleotide
  Target: ATXN1; (-) strand; PAM type: NRG; PAM sequence: AAG
ccacccgcctcggcctccca

SEQ ID NO: 88996 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccacccgcct

SEQ ID NO: 88997 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 88998 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 88999 - DNA, 20 bp, Artificial Sequence
  Description of Artificial Sequence: Synthetic oligonucleotide
  Target: ATXN1; (-) strand; PAM type: NRG; PAM sequence: TGG
tttcactatgttggccagat

SEQ ID NO: 89000 - DNA, 20 bp, Artificial Sequence
  Description of Artificial Sequence: Synthetic oligonucleotide
  Target: ATXN1; (-) strand; PAM type: NRG; PAM sequence: CAG
cggggtttcactatgttggc

SEQ ID NO: 89001 - DNA, 20 bp, Artificial Sequence
  Description of Artificial Sequence: Synthetic oligonucleotide
  Target: ATXN1; (-) strand; PAM type: NRG; PAM sequence: TGG
gagacggggtttcactatgt

SEQ ID NO: 89002 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 89003 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 89004 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 89005 - DNA, 20 bp, Artificial Sequence
  Description of Artificial Sequence: Synthetic oligonucleotide
  Target: ATXN1; (-) strand; PAM type: NRG; PAM sequence: GAG
ctagttttgtatttttagta

SEQ ID NO: 89006 - DNA, 20 bp, Artificial Sequence
  Description of Artificial Sequence: Synthetic oligonucleotide
  Target: ATXN1; (-) strand; PAM type: NRG; PAM sequence: TAG
agctagttttgtatttttag

SEQ ID NO: 89007 - DNA, 20 bp, Artificial Sequence
  Description of Artificial Sequence: Synthetic oligonucleotide
  Target: ATXN1; (-) strand; PAM type: NRG; PAM sequence: TAG
cccagctagttttgtatttt

SEQ ID NO: 89008 - DNA, 20 bp, Artificial Sequence
  Description of Artificial Sequence: Synthetic oligonucleotide
  Target: ATXN1; (-) strand; PAM type: NRG; PAM sequence: TAG
cgtgcgccatcacacccagc

SEQ ID NO: 89009 - DNA, 20 bp, Artificial Sequence
  Description of Artificial Sequence: Synthetic oligonucleotide
  Target: ATXN1; (-) strand; PAM type: NRG; PAM sequence: CAG
caggcgtgcgccatcacacc

SEQ ID NO: 89010 - DNA, 20 bp, Artificial Sequence
  Description of Artificial Sequence: Synthetic oligonucleotide
  Target: ATXN1; (-) strand; PAM type: NRG; PAM sequence: AGG
tcccgggtagctgggattac

SEQ ID NO: 89011 - DNA, 20 bp, Artificial Sequence
  Description of Artificial Sequence: Synthetic oligonucleotide
  Target: ATXN1; (-) strand; PAM type: NRG; PAM sequence: CAG
ctcccgggtagctgggatta

SEQ ID NO: 89012 - DNA, 20 bp, Artificial Sequence
  Description of Artificial Sequence: Synthetic oligonucleotide
  Target: ATXN1; (-) strand; PAM type: NRG; PAM sequence: GGG
gctcaggctcccgggtagct

SEQ ID NO: 89013 - DNA, 20 bp, Artificial Sequence
  Description of Artificial Sequence: Synthetic oligonucleotide
  Target: ATXN1; (-) strand; PAM type: NRG; PAM sequence: TGG
ggctcaggctcccgggtagc

SEQ ID NO: 89014 - DNA, 20 bp, Artificial Sequence
  Description of Artificial Sequence: Synthetic oligonucleotide
  Target: ATXN1; (-) strand; PAM type: NRG; PAM sequence: TAG
tcctggctcaggctcccggg

SEQ ID NO: 89015 - DNA, 20 bp, Artificial Sequence
  Description of Artificial Sequence: Synthetic oligonucleotide
  Target: ATXN1; (-) strand; PAM type: NRG; PAM sequence: GGG
ttctcctggctcaggctccc

SEQ ID NO: 89016 - DNA, 20 bp, Artificial Sequence
  Description of Artificial Sequence: Synthetic oligonucleotide
  Target: ATXN1; (-) strand; PAM type: NRG; PAM sequence: CGG
attctcctggctcaggctcc

SEQ ID NO: 89017 - DNA, 20 bp, Artificial Sequence
  Description of Artificial Sequence: Synthetic oligonucleotide
  Target: ATXN1; (-) strand; PAM type: NRG; PAM sequence: AGG
tcaagcaattctcctggctc

SEQ ID NO: 89018 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctggct

SEQ ID NO: 89019 - DNA, 20 bp, Artificial Sequence
  Description of Artificial Sequence: Synthetic oligonucleotide
  Target: ATXN1; (-) strand; PAM type: NRG; PAM sequence: TGG
ccaggttcaagcaattctcc

SEQ ID NO: 89020 - DNA, 20 bp, Artificial Sequence
  Description of Artificial Sequence: Synthetic oligonucleotide
  Target: ATXN1; (-) strand; PAM type: NRG; PAM sequence: AAG
aacctccaccccccaggttc

SEQ ID NO: 89021 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccacccccc

SEQ ID NO: 89022 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccaccccc

SEQ ID NO: 89023 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgtgatct

SEQ ID NO: 89024 - DNA, 20 bp, Artificial Sequence
  Description of Artificial Sequence: Synthetic oligonucleotide
  Target: ATXN1; (-) strand; PAM type: NRG; PAM sequence: TGG
ttgcctgcactggagtgcag

SEQ ID NO: 89025 - DNA, 20 bp, Artificial Sequence
  Description of Artificial Sequence: Synthetic oligonucleotide
  Target: ATXN1; (-) strand; PAM type: NRG; PAM sequence: CAG
ttgttgcctgcactggagtg

SEQ ID NO: 89026 - DNA, 20 bp, Artificial Sequence
  Description of Artificial Sequence: Synthetic oligonucleotide
  Target: ATXN1; (-) strand; PAM type: NRG; PAM sequence: GAG
cgctcttgttgcctgcactg

SEQ ID NO: 89027 - DNA, 20 bp, Artificial Sequence
  Description of Artificial Sequence: Synthetic oligonucleotide
  Target: ATXN1; (-) strand; PAM type: NRG; PAM sequence: TGG
ctcgctcttgttgcctgcac

SEQ ID NO: 89028 - DNA, 20 bp, Artificial Sequence
  Description of Artificial Sequence: Synthetic oligonucleotide
  Target: ATXN1; (-) strand; PAM type: NRG; PAM sequence: TGG
attgctttgtttttttgaga

SEQ ID NO: 89029 - DNA, 20 bp, Artificial Sequence
  Description of Artificial Sequence: Synthetic oligonucleotide
  Target: ATXN1; (-) strand; PAM type: NRG; PAM sequence: GAG
tgttattgctttgttttttt

SEQ ID NO: 89030 - DNA, 20 bp, Artificial Sequence
  Description of Artificial Sequence: Synthetic oligonucleotide
  Target: ATXN1; (-) strand; PAM type: NRG; PAM sequence: AAG
gttagagacactcaacataa

SEQ ID NO: 89031 - DNA, 20 bp, Artificial Sequence
  Description of Artificial Sequence: Synthetic oligonucleotide
  Target: ATXN1; (-) strand; PAM type: NRG; PAM sequence: GAG
aagtttttaaatggtagtta

SEQ ID NO: 89032 - DNA, 20 bp, Artificial Sequence
  Description of Artificial Sequence: Synthetic oligonucleotide
  Target: ATXN1; (-) strand; PAM type: NRG; PAM sequence: TAG
ttaagtttttaaatggtagt

SEQ ID NO: 89033 - DNA, 20 bp, Artificial Sequence
  Description of Artificial Sequence: Synthetic oligonucleotide
  Target: ATXN1; (-) strand; PAM type: NRG; PAM sequence: TAG
agatttaagtttttaaatgg

SEQ ID NO: 89034 - DNA, 20 bp, Artificial Sequence
  Description of Artificial Sequence: Synthetic oligonucleotide
  Target: ATXN1; (-) strand; PAM type: NRG; PAM sequence: TGG
tacagatttaagtttttaaa

SEQ ID NO: 89035 - DNA, 20 bp, Artificial Sequence
  Description of Artificial Sequence: Synthetic oligonucleotide
  Target: ATXN1; (-) strand; PAM type: NRG; PAM sequence: AAG
ctgctctcttatacagattt

SEQ ID NO: 89036 - DNA, 20 bp, Artificial Sequence
  Description of Artificial Sequence: Synthetic oligonucleotide
  Target: ATXN1; (-) strand; PAM type: NRG; PAM sequence: CAG
gttttgcctgctctcttata

SEQ ID NO: 89037 - DNA, 20 bp, Artificial Sequence
  Description of Artificial Sequence: Synthetic oligonucleotide
  Target: ATXN1; (-) strand; PAM type: NRG; PAM sequence: GGG
ccaaaacattcgtacagtgt

SEQ ID NO: 89038 - DNA, 20 bp, Artificial Sequence
  Description of Artificial Sequence: Synthetic oligonucleotide
  Target: ATXN1; (-) strand; PAM type: NRG; PAM sequence: TGG
tccaaaacattcgtacagtg

SEQ ID NO: 89039 - DNA, 20 bp, Artificial Sequence
  Description of Artificial Sequence: Synthetic oligonucleotide
  Target: ATXN1; (-) strand; PAM type: NRG; PAM sequence: CAG
gcacctccaaaacattcgta

SEQ ID NO: 89040 - DNA, 20 bp, Artificial Sequence
  Description of Artificial Sequence: Synthetic oligonucleotide
  Target: ATXN1; (-) strand; PAM type: NRG; PAM sequence: CAG
catgttttttatttttaact

SEQ ID NO: 89041 - DNA, 20 bp, Artificial Sequence
  Description of Artificial Sequence: Synthetic oligonucleotide
  Target: ATXN1; (-) strand; PAM type: NRG; PAM sequence: AGG
ctctggagaccaaattagat

SEQ ID NO: 89042 - DNA, 20 bp, Artificial Sequence
  Description of Artificial Sequence: Synthetic oligonucleotide
  Target: ATXN1; (-) strand; PAM type: NRG; PAM sequence: TAG
gctctggagaccaaattaga

SEQ ID NO: 89043 - DNA, 20 bp, Artificial Sequence
  Description of Artificial Sequence: Synthetic oligonucleotide
  Target: ATXN1; (-) strand; PAM type: NRG; PAM sequence: TAG
gcaggctctggagaccaaat

SEQ ID NO: 89044 - DNA, 20 bp, Artificial Sequence
  Description of Artificial Sequence: Synthetic oligonucleotide
  Target: ATXN1; (-) strand; PAM type: NRG; PAM sequence: GAG
actgtacttagcaggctctg

SEQ ID NO: 89045 - DNA, 20 bp, Artificial Sequence
  Description of Artificial Sequence: Synthetic oligonucleotide
  Target: ATXN1; (-) strand; PAM type: NRG; PAM sequence: TGG
aaactgtacttagcaggctc

SEQ ID NO: 89046 - DNA, 20 bp, Artificial Sequence
  Description of Artificial Sequence: Synthetic oligonucleotide
  Target: ATXN1; (-) strand; PAM type: NRG; PAM sequence: AGG
aaatggaaactgtacttagc

SEQ ID NO: 89047 - DNA, 20 bp, Artificial Sequence
  Description of Artificial Sequence: Synthetic oligonucleotide
  Target: ATXN1; (-) strand; PAM type: NRG; PAM sequence: CAG
gaaatggaaactgtacttag

SEQ ID NO: 89048 - DNA, 20 bp, Artificial Sequence
  Description of Artificial Sequence: Synthetic oligonucleotide
  Target: ATXN1; (-) strand; PAM type: NRG; PAM sequence: TAG
gtagaaatggaaactgtact

SEQ ID NO: 89049 - DNA, 20 bp, Artificial Sequence
  Description of Artificial Sequence: Synthetic oligonucleotide
  Target: ATXN1; (-) strand; PAM type: NRG; PAM sequence: TGG
ctcttgcacccgagtagaaa

SEQ ID NO: 89050 - DNA, 20 bp, Artificial Sequence
  Description of Artificial Sequence: Synthetic oligonucleotide
  Target: ATXN1; (-) strand; PAM type: NRG; PAM sequence: TAG
ccattgctcttgcacccgag

SEQ ID NO: 89051 - DNA, 20 bp, Artificial Sequence
  Description of Artificial Sequence: Synthetic oligonucleotide
  Target: ATXN1; (-) strand; PAM type: NRG; PAM sequence: GAG
aagccattgctcttgcaccc

SEQ ID NO: 89052 - DNA, 20 bp, Artificial Sequence
  Description of Artificial Sequence: Synthetic oligonucleotide
  Target: ATXN1; (-) strand; PAM type: NRG; PAM sequence: AAG
tgctccgtaaaacagcaaat

SEQ ID NO: 89053 - DNA, 20 bp, Artificial Sequence
  Description of Artificial Sequence: Synthetic oligonucleotide
  Target: ATXN1; (-) strand; PAM type: NRG; PAM sequence: CAG
taaggaactgctccgtaaaa

SEQ ID NO: 89054 - DNA, 20 bp, Artificial Sequence
  Description of Artificial Sequence: Synthetic oligonucleotide
  Target: ATXN1; (-) strand; PAM type: NRG; PAM sequence: AGG
ttcagaggcaatgatagtta

SEQ ID NO: 89055 - DNA, 20 bp, Artificial Sequence
  Description of Artificial Sequence: Synthetic oligonucleotide
  Target: ATXN1; (-) strand; PAM type: NRG; PAM sequence: AAG
gttcagaggcaatgatagtt

SEQ ID NO: 89056 - DNA, 20 bp, Artificial Sequence
  Description of Artificial Sequence: Synthetic oligonucleotide
  Target: ATXN1; (-) strand; PAM type: NRG; PAM sequence: TAG
agggggttcagaggcaatga

SEQ ID NO: 89057 - DNA, 20 bp, Artificial Sequence
  Description of Artificial Sequence: Synthetic oligonucleotide
  Target: ATXN1; (-) strand; PAM type: NRG; PAM sequence: AGG
tggggggaaagggggttcag

SEQ ID NO: 89058 - DNA, 20 bp, Artificial Sequence
  Description of Artificial Sequence: Synthetic oligonucleotide
  Target: ATXN1; (-) strand; PAM type: NRG; PAM sequence: GAG
ttggggggaaagggggttca

SEQ ID NO: 89059 - DNA, 20 bp, Artificial Sequence
  Description of Artificial Sequence: Synthetic oligonucleotide
  Target: ATXN1; (-) strand; PAM type: NRG; PAM sequence: CAG
tcttggggggaaagggggtt

SEQ ID NO: 89060 - DNA, 20 bp, Artificial Sequence
  Description of Artificial Sequence: Synthetic oligonucleotide
  Target: ATXN1; (-) strand; PAM type: NRG; PAM sequence: GGG
gtcaatcttggggggaaagg

SEQ ID NO: 89061 - DNA, 20 bp, Artificial Sequence
  Description of Artificial Sequence: Synthetic oligonucleotide
  Target: ATXN1; (-) strand; PAM type: NRG; PAM sequence: GGG
agtcaatcttggggggaaag

SEQ ID NO: 89062 - DNA, 20 bp, Artificial Sequence
  Description of Artificial Sequence: Synthetic oligonucleotide
  Target: ATXN1; (-) strand; PAM type: NRG; PAM sequence: GGG
cagtcaatcttggggggaaa

SEQ ID NO: 89063 - DNA, 20 bp, Artificial Sequence
  Description of Artificial Sequence: Synthetic oligonucleotide
  Target: ATXN1; (-) strand; PAM type: NRG; PAM sequence: AGG
acagtcaatcttggggggaa

SEQ ID NO: 89064 - DNA, 20 bp, Artificial Sequence
  Description of Artificial Sequence: Synthetic oligonucleotide
  Target: ATXN1; (-) strand; PAM type: NRG; PAM sequence: AAG
gacagtcaatcttgggggga

SEQ ID NO: 89065 - DNA, 20 bp, Artificial Sequence
  Description of Artificial Sequence: Synthetic oligonucleotide
  Target: ATXN1; (-) strand; PAM type: NRG; PAM sequence: GGG
gaccgacagtcaatcttggg

SEQ ID NO: 89066 - DNA, 20 bp, Artificial Sequence
  Description of Artificial Sequence: Synthetic oligonucleotide
  Target: ATXN1; (-) strand; PAM type: NRG; PAM sequence: GGG
agaccgacagtcaatcttgg

SEQ ID NO: 89067 - DNA, 20 bp, Artificial Sequence
  Description of Artificial Sequence: Synthetic oligonucleotide
  Target: ATXN1; (-) strand; PAM type: NRG; PAM sequence: GGG
tagaccgacagtcaatcttg

SEQ ID NO: 89068 - DNA, 20 bp, Artificial Sequence
  Description of Artificial Sequence: Synthetic oligonucleotide
  Target: ATXN1; (-) strand; PAM type: NRG; PAM sequence: GGG
gtagaccgacagtcaatctt

SEQ ID NO: 89069 - DNA, 20 bp, Artificial Sequence
  Description of Artificial Sequence: Synthetic oligonucleotide
  Target: ATXN1; (-) strand; PAM type: NRG; PAM sequence: TGG
tgtagaccgacagtcaatct

SEQ ID NO: 89070 - DNA, 20 bp, Artificial Sequence
  Description of Artificial Sequence: Synthetic oligonucleotide
  Target: ATXN1; (-) strand; PAM type: NRG; PAM sequence: CAG
taactgattctgtagaccga

SEQ ID NO: 89071 - DNA, 20 bp, Artificial Sequence
  Description of Artificial Sequence: Synthetic oligonucleotide
  Target: ATXN1; (-) strand; PAM type: NRG; PAM sequence: TAG
gtagcacttaactgattctg

SEQ ID NO: 89072 - DNA, 20 bp, Artificial Sequence
  Description of Artificial Sequence: Synthetic oligonucleotide
  Target: ATXN1; (-) strand; PAM type: NRG; PAM sequence: TAG
gagctgttagtagtgatttg

SEQ ID NO: 89073 - DNA, 20 bp, Artificial Sequence
  Description of Artificial Sequence: Synthetic oligonucleotide
  Target: ATXN1; (-) strand; PAM type: NRG; PAM sequence: TAG
cgcctcgcaggagctgttag

SEQ ID NO: 89074 - DNA, 20 bp, Artificial Sequence
  Description of Artificial Sequence: Synthetic oligonucleotide
  Target: ATXN1; (-) strand; PAM type: NRG; PAM sequence: TAG
gagcgcctcgcaggagctgt

SEQ ID NO: 89075 - DNA, 20 bp, Artificial Sequence
  Description of Artificial Sequence: Synthetic oligonucleotide
  Target: ATXN1; (-) strand; PAM type: NRG; PAM sequence: GAG
ttagagggagcgcctcgcag

SEQ ID NO: 89076 - DNA, 20 bp, Artificial Sequence
  Description of Artificial Sequence: Synthetic oligonucleotide
  Target: ATXN1; (-) strand; PAM type: NRG; PAM sequence: AGG
tcttagagggagcgcctcgc

SEQ ID NO: 89077 - DNA, 20 bp, Artificial Sequence
  Description of Artificial Sequence: Synthetic oligonucleotide
  Target: ATXN1; (-) strand; PAM type: NRG; PAM sequence: CAG
ttcttagagggagcgcctcg

SEQ ID NO: 89078 - DNA, 20 bp, Artificial Sequence
  Description of Artificial Sequence: Synthetic oligonucleotide
  Target: ATXN1; (-) strand; PAM type: NRG; PAM sequence: GAG
tctgtacagattcttagagg

SEQ ID NO: 89079 - DNA, 20 bp, Artificial Sequence
  Description of Artificial Sequence: Synthetic oligonucleotide
  Target: ATXN1; (-) strand; PAM type: NRG; PAM sequence: GGG
gatctgtacagattcttaga

SEQ ID NO: 89080 - DNA, 20 bp, Artificial Sequence
  Description of Artificial Sequence: Synthetic oligonucleotide
  Target: ATXN1; (-) strand; PAM type: NRG; PAM sequence: AGG
tgatctgtacagattcttag

SEQ ID NO: 89081 - DNA, 20 bp, Artificial Sequence
  Description of Artificial Sequence: Synthetic oligonucleotide
  Target: ATXN1; (-) strand; PAM type: NRG; PAM sequence: GAG
ttgatctgtacagattctta

SEQ ID NO: 89082 - DNA, 20 bp, Artificial Sequence
  Description of Artificial Sequence: Synthetic oligonucleotide
  Target: ATXN1; (-) strand; PAM type: NRG; PAM sequence: TAG
ttttgatctgtacagattct

SEQ ID NO: 89083 - DNA, 20 bp, Artificial Sequence
  Description of Artificial Sequence: Synthetic oligonucleotide
  Target: ATXN1; (-) strand; PAM type: NRG; PAM sequence: CAG
acttgagattttgatctgta

SEQ ID NO: 89084 - DNA, 20 bp, Artificial Sequence
  Description of Artificial Sequence: Synthetic oligonucleotide
  Target: ATXN1; (-) strand; PAM type: NRG; PAM sequence: GAG
ccctgggcaagtaagcactt

SEQ ID NO: 89085 - DNA, 20 bp, Artificial Sequence
  Description of Artificial Sequence: Synthetic oligonucleotide
  Target: ATXN1; (-) strand; PAM type: NRG; PAM sequence: AAG
atggcagtccctgggcaagt

SEQ ID NO: 89086 - DNA, 20 bp, Artificial Sequence
  Description of Artificial Sequence: Synthetic oligonucleotide
  Target: ATXN1; (-) strand; PAM type: NRG; PAM sequence: AAG
aattatggcagtccctgggc

SEQ ID NO: 89087 - DNA, 20 bp, Artificial Sequence
  Description of Artificial Sequence: Synthetic oligonucleotide
  Target: ATXN1; (-) strand; PAM type: NRG; PAM sequence: GGG
ctcaaattatggcagtccct

SEQ ID NO: 89088 - DNA, 20 bp, Artificial Sequence
  Description of Artificial Sequence: Synthetic oligonucleotide
  Target: ATXN1; (-) strand; PAM type: NRG; PAM sequence: TGG
cctcaaattatggcagtccc

SEQ ID NO: 89089 - DNA, 20 bp, Artificial Sequence
  Description of Artificial Sequence: Synthetic oligonucleotide
  Target: ATXN1; (-) strand; PAM type: NRG; PAM sequence: CAG
agcaacacctcaaattatgg

SEQ ID NO: 89090 - DNA, 20 bp, Artificial Sequence
  Description of Artificial Sequence: Synthetic oligonucleotide
  Target: ATXN1; (-) strand; PAM type: NRG; PAM sequence: TGG
agaagcaacacctcaaatta

SEQ ID NO: 89091 - DNA, 20 bp, Artificial Sequence
  Description of Artificial Sequence: Synthetic oligonucleotide
  Target: ATXN1; (-) strand; PAM type: NRG; PAM sequence: AAG
gttttttatactttaaaaag

SEQ ID NO: 89092 - DNA, 20 bp, Artificial Sequence
  Description of Artificial Sequence: Synthetic oligonucleotide
  Target: ATXN1; (-) strand; PAM type: NRG; PAM sequence: AAG
tctgttttttatactttaaa

SEQ ID NO: 89093 - DNA, 20 bp, Artificial Sequence
  Description of Artificial Sequence: Synthetic oligonucleotide
  Target: ATXN1; (-) strand; PAM type: NRG; PAM sequence: GAG
catttactttcatcagctta

SEQ ID NO: 89094 - DNA, 20 bp, Artificial Sequence
  Description of Artificial Sequence: Synthetic oligonucleotide
  Target: ATXN1; (-) strand; PAM type: NRG; PAM sequence: TAG
gacatttactttcatcagct

SEQ ID NO: 89095 - DNA, 20 bp, Artificial Sequence
  Description of Artificial Sequence: Synthetic oligonucleotide
  Target: ATXN1; (-) strand; PAM type: NRG; PAM sequence: CAG
gaaaggacatttactttcat

SEQ ID NO: 89096 - DNA, 20 bp, Artificial Sequence
  Description of Artificial Sequence: Synthetic oligonucleotide
  Target: ATXN1; (-) strand; PAM type: NRG; PAM sequence: AGG
tggggaagagatgtgttgaa

SEQ ID NO: 89097 - DNA, 20 bp, Artificial Sequence
  Description of Artificial Sequence: Synthetic oligonucleotide
  Target: ATXN1; (-) strand; PAM type: NRG; PAM sequence: AAG
ctggggaagagatgtgttga

SEQ ID NO: 89098 - DNA, 20 bp, Artificial Sequence
  Description of Artificial Sequence: Synthetic oligonucleotide
  Target: ATXN1; (-) strand; PAM type: NRG; PAM sequence: GAG
gattttcaagtgctggggaa

SEQ ID NO: 89099 - DNA, 20 bp, Artificial Sequence
  Description of Artificial Sequence: Synthetic oligonucleotide
  Target: ATXN1; (-) strand; PAM type: NRG; PAM sequence: AAG
aagattttcaagtgctgggg

SEQ ID NO: 89100 - DNA, 20 bp, Artificial Sequence
  Description of Artificial Sequence: Synthetic oligonucleotide
  Target: ATXN1; (-) strand; PAM type: NRG; PAM sequence: GGG
ggtaagattttcaagtgctg

SEQ ID NO: 89101 - DNA, 20 bp, Artificial Sequence
  Description of Artificial Sequence: Synthetic oligonucleotide
  Target: ATXN1; (-) strand; PAM type: NRG; PAM sequence: GGG
tggtaagattttcaagtgct

SEQ ID NO: 89102 - DNA, 20 bp, Artificial Sequence
  Description of Artificial Sequence: Synthetic oligonucleotide
  Target: ATXN1; (-) strand; PAM type: NRG; PAM sequence: TGG
ttggtaagattttcaagtgc

SEQ ID NO: 89103 - DNA, 20 bp, Artificial Sequence
  Description of Artificial Sequence: Synthetic oligonucleotide
  Target: ATXN1; (-) strand; PAM type: NRG; PAM sequence: AAG
ttcttgttggtaagattttc

SEQ ID NO: 89104 - DNA, 20 bp, Artificial Sequence
  Description of Artificial Sequence: Synthetic oligonucleotide
  Target: ATXN1; (-) strand; PAM type: NRG; PAM sequence: AAG
gggaagtacttcttgttggt

SEQ ID NO: 89105 - DNA, 20 bp, Artificial Sequence
  Description of Artificial Sequence: Synthetic oligonucleotide
  Target: ATXN1; (-) strand; PAM type: NRG; PAM sequence: TGG
gtgtgggaagtacttcttgt

SEQ ID NO: 89106 - DNA, 20 bp, Artificial Sequence
  Description of Artificial Sequence: Synthetic oligonucleotide
  Target: ATXN1; (-) strand; PAM type: NRG; PAM sequence: AAG
attaccgaccggagtgtggg

SEQ ID NO: 89107 - DNA, 20 bp, Artificial Sequence
  Description of Artificial Sequence: Synthetic oligonucleotide
  Target: ATXN1; (-) strand; PAM type: NRG; PAM sequence: GGG
gaaattaccgaccggagtgt

SEQ ID NO: 89108 - DNA, 20 bp, Artificial Sequence
  Description of Artificial Sequence: Synthetic oligonucleotide
  Target: ATXN1; (-) strand; PAM type: NRG; PAM sequence: TGG
agaaattaccgaccggagtg

SEQ ID NO: 89109 - DNA, 20 bp, Artificial Sequence
  Description of Artificial Sequence: Synthetic oligonucleotide
  Target: ATXN1; (-) strand; PAM type: NRG; PAM sequence: GAG
agtgcagaaattaccgaccg

SEQ ID NO: 89110 - DNA, 20 bp, Artificial Sequence
  Description of Artificial Sequence: Synthetic oligonucleotide
  Target: ATXN1; (-) strand; PAM type: NRG; PAM sequence: CGG
aaagtgcagaaattaccgac

SEQ ID NO: 89111 - DNA, 20 bp, Artificial Sequence
  Description of Artificial Sequence: Synthetic oligonucleotide
  Target: ATXN1; (-) strand; PAM type: NRG; PAM sequence: CAG
aaaggaaaagtaaaaaagtg

SEQ ID NO: 89112 - DNA, 20 bp, Artificial Sequence
  Description of Artificial Sequence: Synthetic oligonucleotide
  Target: ATXN1; (-) strand; PAM type: NRG; PAM sequence: AAG
gcttcaaaggaaaagtaaaa

SEQ ID NO: 89113 - DNA, 20 bp, Artificial Sequence
  Description of Artificial Sequence: Synthetic oligonucleotide
  Target: ATXN1; (-) strand; PAM type: NRG; PAM sequence: AAG
gcactgcggcttcaaaggaa

SEQ ID NO: 89114 - DNA, 20 bp, Artificial Sequence
  Description of Artificial Sequence: Synthetic oligonucleotide
  Target: ATXN1; (-) strand; PAM type: NRG; PAM sequence: AGG
acattgcactgcggcttcaa

SEQ ID NO: 89115 - DNA, 20 bp, Artificial Sequence
  Description of Artificial Sequence: Synthetic oligonucleotide
  Target: ATXN1; (-) strand; PAM type: NRG; PAM sequence: AAG
cacattgcactgcggcttca

SEQ ID NO: 89116 - DNA, 20 bp, Artificial Sequence
  Description of Artificial Sequence: Synthetic oligonucleotide
  Target: ATXN1; (-) strand; PAM type: NRG; PAM sequence: CGG
tgtagaatcacattgcactg

SEQ ID NO: 89117 - DNA, 20 bp, Artificial Sequence
  Description of Artificial Sequence: Synthetic oligonucleotide
  Target: ATXN1; (-) strand; PAM type: NRG; PAM sequence: TAG
gaattgtttcaccccgggtg

SEQ ID NO: 89118 - DNA, 20 bp, Artificial Sequence
  Description of Artificial Sequence: Synthetic oligonucleotide
  Target: ATXN1; (-) strand; PAM type: NRG; PAM sequence: GGG
gtaaggaattgtttcacccc

SEQ ID NO: 89119 - DNA, 20 bp, Artificial Sequence
  Description of Artificial Sequence: Synthetic oligonucleotide
  Target: ATXN1; (-) strand; PAM type: NRG; PAM sequence: CGG
cgtaaggaattgtttcaccc

SEQ ID NO: 89120 - DNA, 20 bp, Artificial Sequence
  Description of Artificial Sequence: Synthetic oligonucleotide
  Target: ATXN1; (-) strand; PAM type: NRG; PAM sequence: AGG
ctctccaaaggctccccgta

SEQ ID NO: 89121 - DNA, 20 bp, Artificial Sequence
  Description of Artificial Sequence: Synthetic oligonucleotide
  Target: ATXN1; (-) strand; PAM type: NRG; PAM sequence: AAG
gctctccaaaggctccccgt

SEQ ID NO: 89122 - DNA, 20 bp, Artificial Sequence
  Description of Artificial Sequence: Synthetic oligonucleotide
  Target: ATXN1; (-) strand; PAM type: NRG; PAM sequence: AGG
ttgtttggggtgctctccaa

SEQ ID NO: 89123 - DNA, 20 bp, Artificial Sequence
  Description of Artificial Sequence: Synthetic oligonucleotide
  Target: ATXN1; (-) strand; PAM type: NRG; PAM sequence: AAG
cttgtttggggtgctctcca

SEQ ID NO: 89124 - DNA, 20 bp, Artificial Sequence
  Description of Artificial Sequence: Synthetic oligonucleotide
  Target: ATXN1; (-) strand; PAM type: NRG; PAM sequence: GGG
tccagcagcccccttgtttg

SEQ ID NO: 89125 - DNA, 20 bp, Artificial Sequence
  Description of Artificial Sequence: Synthetic oligonucleotide
  Target: ATXN1; (-) strand; PAM type: NRG; PAM sequence: GGG
ttccagcagcccccttgttt

SEQ ID NO: 89126 - DNA, 20 bp, Artificial Sequence
  Description of Artificial Sequence: Synthetic oligonucleotide
  Target: ATXN1; (-) strand; PAM type: NRG; PAM sequence: TGG
attccagcagcccccttgtt

SEQ ID NO: 89127 - DNA, 20 bp, Artificial Sequence
  Description of Artificial Sequence: Synthetic oligonucleotide
  Target: ATXN1; (-) strand; PAM type: NRG; PAM sequence: CAG
gcatcacacttgcattccag

SEQ ID NO: 89128 - DNA, 20 bp, Artificial Sequence
  Description of Artificial Sequence: Synthetic oligonucleotide
  Target: ATXN1; (-) strand; PAM type: NRG; PAM sequence: CAG
tgggcatcacacttgcattc

SEQ ID NO: 89129 - DNA, 20 bp, Artificial Sequence
  Description of Artificial Sequence: Synthetic oligonucleotide
  Target: ATXN1; (-) strand; PAM type: NRG; PAM sequence: GGG
ggtagggagacagtctcctt

SEQ ID NO: 89130 - DNA, 20 bp, Artificial Sequence
  Description of Artificial Sequence: Synthetic oligonucleotide
  Target: ATXN1; (-) strand; PAM type: NRG; PAM sequence: TGG
aggtagggagacagtctcct

SEQ ID NO: 89131 - DNA, 20 bp, Artificial Sequence
  Description of Artificial Sequence: Synthetic oligonucleotide
  Target: ATXN1; (-) strand; PAM type: NRG; PAM sequence: CAG
tcagctctgaggtagggaga

SEQ ID NO: 89132 - DNA, 20 bp, Artificial Sequence
  Description of Artificial Sequence: Synthetic oligonucleotide
  Target: ATXN1; (-) strand; PAM type: NRG; PAM sequence: GAG
cacttcagctctgaggtagg

SEQ ID NO: 89133 - DNA, 20 bp, Artificial Sequence
  Description of Artificial Sequence: Synthetic oligonucleotide
  Target: ATXN1; (-) strand; PAM type: NRG; PAM sequence: GGG
atcacttcagctctgaggta

SEQ ID NO: 89134 - DNA, 20 bp, Artificial Sequence
  Description of Artificial Sequence: Synthetic oligonucleotide
  Target: ATXN1; (-) strand; PAM type: NRG; PAM sequence: AGG
gatcacttcagctctgaggt

SEQ ID NO: 89135 - DNA, 20 bp, Artificial Sequence
  Description of Artificial Sequence: Synthetic oligonucleotide
  Target: ATXN1; (-) strand; PAM type: NRG; PAM sequence: TAG
tgatcacttcagctctgagg

SEQ ID NO: 89136 - DNA, 20 bp, Artificial Sequence
  Description of Artificial Sequence: Synthetic oligonucleotide
  Target: ATXN1; (-) strand; PAM type: NRG; PAM sequence: AGG
atttgatcacttcagctctg

SEQ ID NO: 89137 - DNA, 20 bp, Artificial Sequence
  Description of Artificial Sequence: Synthetic oligonucleotide
  Target: ATXN1; (-) strand; PAM type: NRG; PAM sequence: GAG
catttgatcacttcagctct

SEQ ID NO: 89138 - DNA, 20 bp, Artificial Sequence
  Description of Artificial Sequence: Synthetic oligonucleotide
  Target: ATXN1; (-) strand; PAM type: NRG; PAM sequence: CAG
caagaagcatttgatcactt

SEQ ID NO: 89139 - DNA, 20 bp, Artificial Sequence
  Description of Artificial Sequence: Synthetic oligonucleotide
  Target: ATXN1; (-) strand; PAM type: NRG; PAM sequence: AAG
ttctcgtgaaggttgtcaag

SEQ ID NO: 89140 - DNA, 20 bp, Artificial Sequence
  Description of Artificial Sequence: Synthetic oligonucleotide
  Target: ATXN1; (-) strand; PAM type: NRG; PAM sequence: AAG
gacttctcgtgaaggttgtc

SEQ ID NO: 89141 - DNA, 20 bp, Artificial Sequence
  Description of Artificial Sequence: Synthetic oligonucleotide
  Target: ATXN1; (-) strand; PAM type: NRG; PAM sequence: AGG
aactttgagacttctcgtga

SEQ ID NO: 89142 - DNA, 20 bp, Artificial Sequence
  Description of Artificial Sequence: Synthetic oligonucleotide
  Target: ATXN1; (-) strand; PAM type: NRG; PAM sequence: AAG
taactttgagacttctcgtg

SEQ ID NO: 89143 - DNA, 20 bp, Artificial Sequence
  Description of Artificial Sequence: Synthetic oligonucleotide
  Target: ATXN1; (-) strand; PAM type: NRG; PAM sequence: GAG
aagcctgtgtgtgtaacttt

SEQ ID NO: 89144 - DNA, 20 bp, Artificial Sequence
  Description of Artificial Sequence: Synthetic oligonucleotide
  Target: ATXN1; (-) strand; PAM type: NRG; PAM sequence: AAG
gcagacgtttggaaatgact

SEQ ID NO: 89145 - DNA, 20 bp, Artificial Sequence
  Description of Artificial Sequence: Synthetic oligonucleotide
  Target: ATXN1; (-) strand; PAM type: NRG; PAM sequence: TGG
tgcacattggtgcagacgtt

SEQ ID NO: 89146 - DNA, 20 bp, Artificial Sequence
  Description of Artificial Sequence: Synthetic oligonucleotide
  Target: ATXN1; (-) strand; PAM type: NRG; PAM sequence: CAG
aaaagttctgcacattggtg

SEQ ID NO: 89147 - DNA, 20 bp, Artificial Sequence
  Description of Artificial Sequence: Synthetic oligonucleotide
  Target: ATXN1; (-) strand; PAM type: NRG; PAM sequence: TGG
gcaggaaaagttctgcacat

SEQ ID NO: 89148 - DNA, 20 bp, Artificial Sequence
  Description of Artificial Sequence: Synthetic oligonucleotide
  Target: ATXN1; (-) strand; PAM type: NRG; PAM sequence: AAG
cttagagagcagggcaggaa

SEQ ID NO: 89149 - DNA, 20 bp, Artificial Sequence
  Description of Artificial Sequence: Synthetic oligonucleotide
  Target: ATXN1; (-) strand; PAM type: NRG; PAM sequence: AGG
gagtgcttagagagcagggc

SEQ ID NO: 89150 - DNA, 20 bp, Artificial Sequence
  Description of Artificial Sequence: Synthetic oligonucleotide
  Target: ATXN1; (-) strand; PAM type: NRG; PAM sequence: CAG
tgagtgcttagagagcaggg

SEQ ID NO: 89151 - DNA, 20 bp, Artificial Sequence
  Description of Artificial Sequence: Synthetic oligonucleotide
  Target: ATXN1; (-) strand; PAM type: NRG; PAM sequence: GGG
cgctgagtgcttagagagca

SEQ ID NO: 89152 - DNA, 20 bp, Artificial Sequence
  Description of Artificial Sequence: Synthetic oligonucleotide
  Target: ATXN1; (-) strand; PAM type: NRG; PAM sequence: AGG
tcgctgagtgcttagagagc

SEQ ID NO: 89153 - DNA, 20 bp, Artificial Sequence
  Description of Artificial Sequence: Synthetic oligonucleotide
  Target: ATXN1; (-) strand; PAM type: NRG; PAM sequence: CAG
ctcgctgagtgcttagagag

SEQ ID NO: 89154 - DNA, 20 bp, Artificial Sequence
  Description of Artificial Sequence: Synthetic oligonucleotide
  Target: ATXN1; (-) strand; PAM type: NRG; PAM sequence: GAG
cccctcgctgagtgcttaga

SEQ ID NO: 89155 - DNA, 20 bp, Artificial Sequence
  Description of Artificial Sequence: Synthetic oligonucleotide
  Target: ATXN1; (-) strand; PAM type: NRG; PAM sequence: GAG
tccccctcgctgagtgctta

SEQ ID NO: 89156 - DNA, 20 bp, Artificial Sequence
  Description of Artificial Sequence: Synthetic oligonucleotide
  Target: ATXN1; (-) strand; PAM type: NRG; PAM sequence: TAG
cctccccctcgctgagtgct

SEQ ID NO: 89157 - DNA, 20 bp, Artificial Sequence
  Description of Artificial Sequence: Synthetic oligonucleotide
  Target: ATXN1; (-) strand; PAM type: NRG; PAM sequence: GAG
tgtgccccctccccctcgct

SEQ ID NO: 89158 - DNA, 20 bp, Artificial Sequence
  Description of Artificial Sequence: Synthetic oligonucleotide
  Target: ATXN1; (-) strand; PAM type: NRG; PAM sequence: TGG
agtgtggtcgcttgattcac

SEQ ID NO: 89159 - DNA, 20 bp, Artificial Sequence
  Description of Artificial Sequence: Synthetic oligonucleotide
  Target: ATXN1; (-) strand; PAM type: NRG; PAM sequence: TGG
actggtgtagggctacagtg

SEQ ID NO: 89160 - DNA, 20 bp, Artificial Sequence
  Description of Artificial Sequence: Synthetic oligonucleotide
  Target: ATXN1; (-) strand; PAM type: NRG; PAM sequence: CAG
agagcactggtgtagggcta

SEQ ID NO: 89161 - DNA, 20 bp, Artificial Sequence
  Description of Artificial Sequence: Synthetic oligonucleotide
  Target: ATXN1; (-) strand; PAM type: NRG; PAM sequence: GGG
gcctgcagagcactggtgta

SEQ ID NO: 89162 - DNA, 20 bp, Artificial Sequence
  Description of Artificial Sequence: Synthetic oligonucleotide
  Target: ATXN1; (-) strand; PAM type: NRG; PAM sequence: AGG
ggcctgcagagcactggtgt

SEQ ID NO: 89163 - DNA, 20 bp, Artificial Sequence
  Description of Artificial Sequence: Synthetic oligonucleotide
  Target: ATXN1; (-) strand; PAM type: NRG; PAM sequence: TAG
gggcctgcagagcactggtg

SEQ ID NO: 89164 - DNA, 20 bp, Artificial Sequence
  Description of Artificial Sequence: Synthetic oligonucleotide
  Target: ATXN1; (-) strand; PAM type: NRG; PAM sequence: TGG
caagggggcctgcagagcac

SEQ ID NO: 89165 - DNA, 20 bp, Artificial Sequence
  Description of Artificial Sequence: Synthetic oligonucleotide
  Target: ATXN1; (-) strand; PAM type: NRG; PAM sequence: GAG
aggaggcaagggggcctgca

SEQ ID NO: 89166 - DNA, 20 bp, Artificial Sequence
  Description of Artificial Sequence: Synthetic oligonucleotide
  Target: ATXN1; (-) strand; PAM type: NRG; PAM sequence: CAG
tgaggaggcaagggggcctg

SEQ ID NO: 89167 - DNA, 20 bp, Artificial Sequence
  Description of Artificial Sequence: Synthetic oligonucleotide
  Target: ATXN1; (-) strand; PAM type: NRG; PAM sequence: GGG
tgaggcctgaggaggcaagg

SEQ ID NO: 89168 - DNA, 20 bp, Artificial Sequence
  Description of Artificial Sequence: Synthetic oligonucleotide
  Target: ATXN1; (-) strand; PAM type: NRG; PAM sequence: GGG
gtgaggcctgaggaggcaag

SEQ ID NO: 89169 - DNA, 20 bp, Artificial Sequence
  Description of Artificial Sequence: Synthetic oligonucleotide
  Target: ATXN1; (-) strand; PAM type: NRG; PAM sequence: GGG
ggtgaggcctgaggaggcaa

SEQ ID NO: 89170 - DNA, 20 bp, Artificial Sequence
  Description of Artificial Sequence: Synthetic oligonucleotide
  Target: ATXN1; (-) strand; PAM type: NRG; PAM sequence: AGG
aggtgaggcctgaggaggca

SEQ ID NO: 89171 - DNA, 20 bp, Artificial Sequence
  Description of Artificial Sequence: Synthetic oligonucleotide
  Target: ATXN1; (-) strand; PAM type: NRG; PAM sequence: AAG
gaggtgaggcctgaggaggc

SEQ ID NO: 89172 - DNA, 20 bp, Artificial Sequence
  Description of Artificial Sequence: Synthetic oligonucleotide
  Target: ATXN1; (-) strand; PAM type: NRG; PAM sequence: AGG
gagagaggtgaggcctgagg

SEQ ID NO: 89173 - DNA, 20 bp, Artificial Sequence
  Description of Artificial Sequence: Synthetic oligonucleotide
  Target: ATXN1; (-) strand; PAM type: NRG; PAM sequence: GAG
tgagagaggtgaggcctgag

SEQ ID NO: 89174 - DNA, 20 bp, Artificial Sequence
  Description of Artificial Sequence: Synthetic oligonucleotide
  Target: ATXN1; (-) strand; PAM type: NRG; PAM sequence: AGG
gatgagagaggtgaggcctg

SEQ ID NO: 89175 - DNA, 20 bp, Artificial Sequence
  Description of Artificial Sequence: Synthetic oligonucleotide
  Target: ATXN1; (-) strand; PAM type: NRG; PAM sequence: GAG
agatgagagaggtgaggcct

SEQ ID NO: 89176 - DNA, 20 bp, Artificial Sequence
  Description of Artificial Sequence: Synthetic oligonucleotide
  Target: ATXN1; (-) strand; PAM type: NRG; PAM sequence: AGG
aattacagatgagagaggtg

SEQ ID NO: 89177 - DNA, 20 bp, Artificial Sequence
  Description of Artificial Sequence: Synthetic oligonucleotide
  Target: ATXN1; (-) strand; PAM type: NRG; PAM sequence: GAG
caattacagatgagagaggt

SEQ ID NO: 89178 - DNA, 20 bp, Artificial Sequence
  Description of Artificial Sequence: Synthetic oligonucleotide
  Target: ATXN1; (-) strand; PAM type: NRG; PAM sequence: AGG
tctgcaattacagatgagag

SEQ ID NO: 89179 - DNA, 20 bp, Artificial Sequence
  Description of Artificial Sequence: Synthetic oligonucleotide
  Target: ATXN1; (-) strand; PAM type: NRG; PAM sequence: GAG
ctctgcaattacagatgaga

SEQ ID NO: 89180 - DNA, 20 bp, Artificial Sequence
  Description of Artificial Sequence: Synthetic oligonucleotide
  Target: ATXN1; (-) strand; PAM type: NRG; PAM sequence: GAG
atctctgcaattacagatga

SEQ ID NO: 89181 - DNA, 20 bp, Artificial Sequence
  Description of Artificial Sequence: Synthetic oligonucleotide
  Target: ATXN1; (-) strand; PAM type: NRG; PAM sequence: GAG
caatctctgcaattacagat

SEQ ID NO: 89182 - DNA, 20 bp, Artificial Sequence
  Description of Artificial Sequence: Synthetic oligonucleotide
  Target: ATXN1; (-) strand; PAM type: NRG; PAM sequence: CAG
gggtccaatctctgcaatta

SEQ ID NO: 89183 - DNA, 20 bp, Artificial Sequence
  Description of Artificial Sequence: Synthetic oligonucleotide
  Target: ATXN1; (-) strand; PAM type: NRG; PAM sequence: GGG
gtagggattttaggatcact

SEQ ID NO: 89184 - DNA, 20 bp, Artificial Sequence
  Description of Artificial Sequence: Synthetic oligonucleotide
  Target: ATXN1; (-) strand; PAM type: NRG; PAM sequence: TGG
ggtagggattttaggatcac

SEQ ID NO: 89185 - DNA, 20 bp, Artificial Sequence
  Description of Artificial Sequence: Synthetic oligonucleotide
  Target: ATXN1; (-) strand; PAM type: NRG; PAM sequence: AGG
ctccagcgggtagggatttt

SEQ ID NO: 89186 - DNA, 20 bp, Artificial Sequence
  Description of Artificial Sequence: Synthetic oligonucleotide
  Target: ATXN1; (-) strand; PAM type: NRG; PAM sequence: TAG
gctccagcgggtagggattt

SEQ ID NO: 89187 - DNA, 20 bp, Artificial Sequence
  Description of Artificial Sequence: Synthetic oligonucleotide
  Target: ATXN1; (-) strand; PAM type: NRG; PAM sequence: GGG
ctaggatgctccagcgggta

SEQ ID NO: 89188 - DNA, 20 bp, Artificial Sequence
  Description of Artificial Sequence: Synthetic oligonucleotide
  Target: ATXN1; (-) strand; PAM type: NRG; PAM sequence: AGG
tctaggatgctccagcgggt

SEQ ID NO: 89189 - DNA, 20 bp, Artificial Sequence
  Description of Artificial Sequence: Synthetic oligonucleotide
  Target: ATXN1; (-) strand; PAM type: NRG; PAM sequence: TAG
ctctaggatgctccagcggg

SEQ ID NO: 89190 - DNA, 20 bp, Artificial Sequence
  Description of Artificial Sequence: Synthetic oligonucleotide
  Target: ATXN1; (-) strand; PAM type: NRG; PAM sequence: GGG
agactctaggatgctccagc

SEQ ID NO: 89191 - DNA, 20 bp, Artificial Sequence
  Description of Artificial Sequence: Synthetic oligonucleotide
  Target: ATXN1; (-) strand; PAM type: NRG; PAM sequence: CGG
gagactctaggatgctccag

SEQ ID NO: 89192 - DNA, 20 bp, Artificial Sequence
  Description of Artificial Sequence: Synthetic oligonucleotide
  Target: ATXN1; (-) strand; PAM type: NRG; PAM sequence: CAG
acagagactctaggatgctc

SEQ ID NO: 89193 - DNA, 20 bp, Artificial Sequence
  Description of Artificial Sequence: Synthetic oligonucleotide
  Target: ATXN1; (-) strand; PAM type: NRG; PAM sequence: AGG
attcctgtcacagagactct

SEQ ID NO: 89194 - DNA, 20 bp, Artificial Sequence
  Description of Artificial Sequence: Synthetic oligonucleotide
  Target: ATXN1; (-) strand; PAM type: NRG; PAM sequence: TAG
tattcctgtcacagagactc

SEQ ID NO: 89195 - DNA, 20 bp, Artificial Sequence
  Description of Artificial Sequence: Synthetic oligonucleotide
  Target: ATXN1; (-) strand; PAM type: NRG; PAM sequence: GAG
cgtgtcatattcctgtcaca

SEQ ID NO: 89196 - DNA, 20 bp, Artificial Sequence
  Description of Artificial Sequence: Synthetic oligonucleotide
  Target: ATXN1; (-) strand; PAM type: NRG; PAM sequence: CAG
atcgtgtcatattcctgtca

SEQ ID NO: 89197 - DNA, 20 bp, Artificial Sequence
  Description of Artificial Sequence: Synthetic oligonucleotide
  Target: ATXN1; (-) strand; PAM type: NRG; PAM sequence: GGG
gcttctgtgtgaactgctgt

SEQ ID NO: 89198 - DNA, 20 bp, Artificial Sequence
  Description of Artificial Sequence: Synthetic oligonucleotide
  Target: ATXN1; (-) strand; PAM type: NRG; PAM sequence: TGG
ggcttctgtgtgaactgctg

SEQ ID NO: 89199 - DNA, 20 bp, Artificial Sequence
  Description of Artificial Sequence: Synthetic oligonucleotide
  Target: ATXN1; (-) strand; PAM type: NRG; PAM sequence: TGG
taggctcactacctggattt

SEQ ID NO: 89200 - DNA, 20 bp, Artificial Sequence
  Description of Artificial Sequence: Synthetic oligonucleotide
  Target: ATXN1; (-) strand; PAM type: NRG; PAM sequence: TGG
cccagcataggctcactacc

SEQ ID NO: 89201 - DNA, 20 bp, Artificial Sequence
  Description of Artificial Sequence: Synthetic oligonucleotide
  Target: ATXN1; (-) strand; PAM type: NRG; PAM sequence: AGG
cctcccccaagtcccagcat

SEQ ID NO: 89202 - DNA, 20 bp, Artificial Sequence
  Description of Artificial Sequence: Synthetic oligonucleotide
  Target: ATXN1; (-) strand; PAM type: NRG; PAM sequence: TAG
ccctcccccaagtcccagca

SEQ ID NO: 89203 - DNA, 20 bp, Artificial Sequence
  Description of Artificial Sequence: Synthetic oligonucleotide
  Target: ATXN1; (-) strand; PAM type: NRG; PAM sequence: CAG
tttagccctcccccaagtcc

SEQ ID NO: 89204 - DNA, 20 bp, Artificial Sequence
  Description of Artificial Sequence: Synthetic oligonucleotide
  Target: ATXN1; (-) strand; PAM type: NRG; PAM sequence: AAG
cttcactttagccctccccc

SEQ ID NO: 89205 - DNA, 20 bp, Artificial Sequence
  Description of Artificial Sequence: Synthetic oligonucleotide
  Target: ATXN1; (-) strand; PAM type: NRG; PAM sequence: TAG
tctgatccctgccttcactt

SEQ ID NO: 89206 - DNA, 20 bp, Artificial Sequence
  Description of Artificial Sequence: Synthetic oligonucleotide
  Target: ATXN1; (-) strand; PAM type: NRG; PAM sequence: TGG
gctattgtttgaagtaggtc

SEQ ID NO: 89207 - DNA, 20 bp, Artificial Sequence
  Description of Artificial Sequence: Synthetic oligonucleotide
  Target: ATXN1; (-) strand; PAM type: NRG; PAM sequence: AGG
gtagggctattgtttgaagt

SEQ ID NO: 89208 - DNA, 20 bp, Artificial Sequence
  Description of Artificial Sequence: Synthetic oligonucleotide
  Target: ATXN1; (-) strand; PAM type: NRG; PAM sequence: TAG
agtagggctattgtttgaag

SEQ ID NO: 89209 - DNA, 20 bp, Artificial Sequence
  Description of Artificial Sequence: Synthetic oligonucleotide
  Target: ATXN1; (-) strand; PAM type: NRG; PAM sequence: AAG
aacagtagggctattgtttg

SEQ ID NO: 89210 - DNA, 20 bp, Artificial Sequence
  Description of Artificial Sequence: Synthetic oligonucleotide
  Target: ATXN1; (-) strand; PAM type: NRG; PAM sequence: GGG
gtggggtgagcaaaacagta

SEQ ID NO: 89211 - DNA, 20 bp, Artificial Sequence
  Description of Artificial Sequence: Synthetic oligonucleotide
  Target: ATXN1; (-) strand; PAM type: NRG; PAM sequence: AGG
tgtggggtgagcaaaacagt

SEQ ID NO: 89212 - DNA, 20 bp, Artificial Sequence
  Description of Artificial Sequence: Synthetic oligonucleotide
  Target: ATXN1; (-) strand; PAM type: NRG; PAM sequence: TAG
gtgtggggtgagcaaaacag

SEQ ID NO: 89213 - DNA, 20 bp, Artificial Sequence
  Description of Artificial Sequence: Synthetic oligonucleotide
  Target: ATXN1; (-) strand; PAM type: NRG; PAM sequence: CAG
ctagtgtggggtgagcaaaa

SEQ ID NO: 89214 - DNA, 20 bp, Artificial Sequence
  Description of Artificial Sequence: Synthetic oligonucleotide
  Target: ATXN1; (-) strand; PAM type: NRG; PAM sequence: GAG
cctaaaacctagtgtggggt

SEQ ID NO: 89215 - DNA, 20 bp, Artificial Sequence
  Description of Artificial Sequence: Synthetic oligonucleotide
  Target: ATXN1; (-) strand; PAM type: NRG; PAM sequence: GGG
tttccctaaaacctagtgtg

SEQ ID NO: 89216 - DNA, 20 bp, Artificial Sequence
  Description of Artificial Sequence: Synthetic oligonucleotide
  Target: ATXN1; (-) strand; PAM type: NRG; PAM sequence: GGG
ctttccctaaaacctagtgt

SEQ ID NO: 89217 - DNA, 20 bp, Artificial Sequence
  Description of Artificial Sequence: Synthetic oligonucleotide
  Target: ATXN1; (-) strand; PAM type: NRG; PAM sequence: TGG
tctttccctaaaacctagtg

SEQ ID NO: 89218 - DNA, 20 bp, Artificial Sequence
  Description of Artificial Sequence: Synthetic oligonucleotide
  Target: ATXN1; (-) strand; PAM type: NRG; PAM sequence: TAG
atatctctttccctaaaacc

SEQ ID NO: 89219 - DNA, 20 bp, Artificial Sequence
  Description of Artificial Sequence: Synthetic oligonucleotide
  Target: ATXN1; (-) strand; PAM type: NRG; PAM sequence: AGG
gagtcacctcacagaggacg

SEQ ID NO: 89220 - DNA, 20 bp, Artificial Sequence
  Description of Artificial Sequence: Synthetic oligonucleotide
  Target: ATXN1; (-) strand; PAM type: NRG; PAM sequence: GAG
tgagtcacctcacagaggac

SEQ ID NO: 89221 - DNA, 20 bp, Artificial Sequence
  Description of Artificial Sequence: Synthetic oligonucleotide
  Target: ATXN1; (-) strand; PAM type: NRG; PAM sequence: AGG
actgttgagtcacctcacag

SEQ ID NO: 89222 - DNA, 20 bp, Artificial Sequence
  Description of Artificial Sequence: Synthetic oligonucleotide
  Target: ATXN1; (-) strand; PAM type: NRG; PAM sequence: GAG
gactgttgagtcacctcaca

SEQ ID NO: 89223 - DNA, 20 bp, Artificial Sequence
  Description of Artificial Sequence: Synthetic oligonucleotide
  Target: ATXN1; (-) strand; PAM type: NRG; PAM sequence: CAG
gtgactgttgagtcacctca

SEQ ID NO: 89224 - DNA, 20 bp, Artificial Sequence
  Description of Artificial Sequence: Synthetic oligonucleotide
  Target: ATXN1; (-) strand; PAM type: NRG; PAM sequence: GAG
agtttgggtctgtgactgtt

SEQ ID NO: 89225 - DNA, 20 bp, Artificial Sequence
  Description of Artificial Sequence: Synthetic oligonucleotide
  Target: ATXN1; (-) strand; PAM type: NRG; PAM sequence: GGG
tctgctccatcattcagttt

SEQ ID NO: 89226 - DNA, 20 bp, Artificial Sequence
  Description of Artificial Sequence: Synthetic oligonucleotide
  Target: ATXN1; (-) strand; PAM type: NRG; PAM sequence: TGG
ttctgctccatcattcagtt

SEQ ID NO: 89227 - DNA, 20 bp, Artificial Sequence
  Description of Artificial Sequence: Synthetic oligonucleotide
  Target: ATXN1; (-) strand; PAM type: NRG; PAM sequence: CAG
ttttattctgctccatcatt

SEQ ID NO: 89228 - DNA, 20 bp, Artificial Sequence
  Description of Artificial Sequence: Synthetic oligonucleotide
  Target: ATXN1; (-) strand; PAM type: NRG; PAM sequence: TGG
agggaaagaattggactatg

SEQ ID NO: 89229 - DNA, 20 bp, Artificial Sequence
  Description of Artificial Sequence: Synthetic oligonucleotide
  Target: ATXN1; (-) strand; PAM type: NRG; PAM sequence: TGG
tactggatcagggaaagaat

SEQ ID NO: 89230 - DNA, 20 bp, Artificial Sequence
  Description of Artificial Sequence: Synthetic oligonucleotide
  Target: ATXN1; (-) strand; PAM type: NRG; PAM sequence: AAG
gtgacttactggatcaggga

SEQ ID NO: 89231 - DNA, 20 bp, Artificial Sequence
  Description of Artificial Sequence: Synthetic oligonucleotide
  Target: ATXN1; (-) strand; PAM type: NRG; PAM sequence: GGG
ctccgtgacttactggatca

SEQ ID NO: 89232 - DNA, 20 bp, Artificial Sequence
  Description of Artificial Sequence: Synthetic oligonucleotide
  Target: ATXN1; (-) strand; PAM type: NRG; PAM sequence: AGG
cctccgtgacttactggatc

SEQ ID NO: 89233 - DNA, 20 bp, Artificial Sequence
  Description of Artificial Sequence: Synthetic oligonucleotide
  Target: ATXN1; (-) strand; PAM type: NRG; PAM sequence: CAG
gcctccgtgacttactggat

SEQ ID NO: 89234 - DNA, 20 bp, Artificial Sequence
  Description of Artificial Sequence: Synthetic oligonucleotide
  Target: ATXN1; (-) strand; PAM type: NRG; PAM sequence: TGG
gaacggcctccgtgacttac

SEQ ID NO: 89235 - DNA, 20 bp, Artificial Sequence
  Description of Artificial Sequence: Synthetic oligonucleotide
  Target: ATXN1; (-) strand; PAM type: NRG; PAM sequence: CGG
ataggtctggatctcaggaa

SEQ ID NO: 89236 - DNA, 20 bp, Artificial Sequence
  Description of Artificial Sequence: Synthetic oligonucleotide
  Target: ATXN1; (-) strand; PAM type: NRG; PAM sequence: AGG
tataaataggtctggatctc

SEQ ID NO: 89237 - DNA, 20 bp, Artificial Sequence
  Description of Artificial Sequence: Synthetic oligonucleotide
  Target: ATXN1; (-) strand; PAM type: NRG; PAM sequence: CAG
gtataaataggtctggatct

SEQ ID NO: 89238 - DNA, 20 bp, Artificial Sequence
  Description of Artificial Sequence: Synthetic oligonucleotide
  Target: ATXN1; (-) strand; PAM type: NRG; PAM sequence: TGG
tgcacttgtataaataggtc

SEQ ID NO: 89239 - DNA, 20 bp, Artificial Sequence
  Description of Artificial Sequence: Synthetic oligonucleotide
  Target: ATXN1; (-) strand; PAM type: NRG; PAM sequence: AGG
cagcctgcacttgtataaat

SEQ ID NO: 89240 - DNA, 20 bp, Artificial Sequence
  Description of Artificial Sequence: Synthetic oligonucleotide
  Target: ATXN1; (-) strand; PAM type: NRG; PAM sequence: TAG
ccagcctgcacttgtataaa

SEQ ID NO: 89241 - DNA, 20 bp, Artificial Sequence
  Description of Artificial Sequence: Synthetic oligonucleotide
  Target: ATXN1; (-) strand; PAM type: NRG; PAM sequence: CAG
gaccttcagggaaaggtgcc

SEQ ID NO: 89242 - DNA, 20 bp, Artificial Sequence
  Description of Artificial Sequence: Synthetic oligonucleotide
  Target: ATXN1; (-) strand; PAM type: NRG; PAM sequence: AGG
tgagtgggaccttcagggaa

SEQ ID NO: 89243 - DNA, 20 bp, Artificial Sequence
  Description of Artificial Sequence: Synthetic oligonucleotide
  Target: ATXN1; (-) strand; PAM type: NRG; PAM sequence: AAG
ctgagtgggaccttcaggga

SEQ ID NO: 89244 - DNA, 20 bp, Artificial Sequence
  Description of Artificial Sequence: Synthetic oligonucleotide
  Target: ATXN1; (-) strand; PAM type: NRG; PAM sequence: GGG
ataactgagtgggaccttca

SEQ ID NO: 89245 - DNA, 20 bp, Artificial Sequence
  Description of Artificial Sequence: Synthetic oligonucleotide
  Target: ATXN1; (-) strand; PAM type: NRG; PAM sequence: AGG
aataactgagtgggaccttc

SEQ ID NO: 89246 - DNA, 20 bp, Artificial Sequence
  Description of Artificial Sequence: Synthetic oligonucleotide
  Target: ATXN1; (-) strand; PAM type: NRG; PAM sequence: CAG
gaataactgagtgggacctt

SEQ ID NO: 89247 - DNA, 20 bp, Artificial Sequence
  Description of Artificial Sequence: Synthetic oligonucleotide
  Target: ATXN1; (-) strand; PAM type: NRG; PAM sequence: GGG
aaccaagagaataactgagt

SEQ ID NO: 89248 - DNA, 20 bp, Artificial Sequence
  Description of Artificial Sequence: Synthetic oligonucleotide
  Target: ATXN1; (-) strand; PAM type: NRG; PAM sequence: TGG
gaaccaagagaataactgag

SEQ ID NO: 89249 - DNA, 20 bp, Artificial Sequence
  Description of Artificial Sequence: Synthetic oligonucleotide
  Target: ATXN1; (-) strand; PAM type: NRG; PAM sequence: GAG
ggggaaccaagagaataact

SEQ ID NO: 89250 - DNA, 20 bp, Artificial Sequence
  Description of Artificial Sequence: Synthetic oligonucleotide
  Target: ATXN1; (-) strand; PAM type: NRG; PAM sequence: GAG
cactgtgattggggaaccaa

SEQ ID NO: 89251 - DNA, 20 bp, Artificial Sequence
  Description of Artificial Sequence: Synthetic oligonucleotide
  Target: ATXN1; (-) strand; PAM type: NRG; PAM sequence: AAG
ctcactgtgattggggaacc

SEQ ID NO: 89252 - DNA, 20 bp, Artificial Sequence
  Description of Artificial Sequence: Synthetic oligonucleotide
  Target: ATXN1; (-) strand; PAM type: NRG; PAM sequence: GGG
gacaccactcactgtgattg

SEQ ID NO: 89253 - DNA, 20 bp, Artificial Sequence
  Description of Artificial Sequence: Synthetic oligonucleotide
  Target: ATXN1; (-) strand; PAM type: NRG; PAM sequence: GGG
tgacaccactcactgtgatt

SEQ ID NO: 89254 - DNA, 20 bp, Artificial Sequence
  Description of Artificial Sequence: Synthetic oligonucleotide
  Target: ATXN1; (-) strand; PAM type: NRG; PAM sequence: TGG
atgacaccactcactgtgat

SEQ ID NO: 89255 - DNA, 20 bp, Artificial Sequence
  Description of Artificial Sequence: Synthetic oligonucleotide
  Target: ATXN1; (-) strand; PAM type: NRG; PAM sequence: GGG
tctggtttgaggaagtgaat

SEQ ID NO: 89256 - DNA, 20 bp, Artificial Sequence
  Description of Artificial Sequence: Synthetic oligonucleotide
  Target: ATXN1; (-) strand; PAM type: NRG; PAM sequence: TGG
gtctggtttgaggaagtgaa

SEQ ID NO: 89257 - DNA, 20 bp, Artificial Sequence
  Description of Artificial Sequence: Synthetic oligonucleotide
  Target: ATXN1; (-) strand; PAM type: NRG; PAM sequence: AAG
gggtagtgtctggtttgagg

SEQ ID NO: 89258 - DNA, 20 bp, Artificial Sequence
  Description of Artificial Sequence: Synthetic oligonucleotide
  Target: ATXN1; (-) strand; PAM type: NRG; PAM sequence: AGG
ggggggtagtgtctggtttg

SEQ ID NO: 89259 - DNA, 20 bp, Artificial Sequence
  Description of Artificial Sequence: Synthetic oligonucleotide
  Target: ATXN1; (-) strand; PAM type: NRG; PAM sequence: GAG
aggggggtagtgtctggttt

SEQ ID NO: 89260 - DNA, 20 bp, Artificial Sequence
  Description of Artificial Sequence: Synthetic oligonucleotide
  Target: ATXN1; (-) strand; PAM type: NRG; PAM sequence: TGG
aatgagaggggggtagtgtc

SEQ ID NO: 89261 - DNA, 20 bp, Artificial Sequence
  Description of Artificial Sequence: Synthetic oligonucleotide
  Target: ATXN1; (-) strand; PAM type: NRG; PAM sequence: TAG
ggaagtgaatgagagggggg

SEQ ID NO: 89262 - DNA, 20 bp, Artificial Sequence
  Description of Artificial Sequence: Synthetic oligonucleotide
  Target: ATXN1; (-) strand; PAM type: NRG; PAM sequence: GGG
attggaagtgaatgagaggg

SEQ ID NO: 89263 - DNA, 20 bp, Artificial Sequence
  Description of Artificial Sequence: Synthetic oligonucleotide
  Target: ATXN1; (-) strand; PAM type: NRG; PAM sequence: GGG
tattggaagtgaatgagagg

SEQ ID NO: 89264 - DNA, 20 bp, Artificial Sequence
  Description of Artificial Sequence: Synthetic oligonucleotide
  Target: ATXN1; (-) strand; PAM type: NRG; PAM sequence: GGG
atattggaagtgaatgagag

SEQ ID NO: 89265 - DNA, 20 bp, Artificial Sequence
  Description of Artificial Sequence: Synthetic oligonucleotide
  Target: ATXN1; (-) strand; PAM type: NRG; PAM sequence: GGG
gatattggaagtgaatgaga

SEQ ID NO: 89266 - DNA, 20 bp, Artificial Sequence
  Description of Artificial Sequence: Synthetic oligonucleotide
  Target: ATXN1; (-) strand; PAM type: NRG; PAM sequence: AGG
agatattggaagtgaatgag

SEQ ID NO: 89267 - DNA, 20 bp, Artificial Sequence
  Description of Artificial Sequence: Synthetic oligonucleotide
  Target: ATXN1; (-) strand; PAM type: NRG; PAM sequence: GAG
tagatattggaagtgaatga

SEQ ID NO: 89268 - DNA, 20 bp, Artificial Sequence
  Description of Artificial Sequence: Synthetic oligonucleotide
  Target: ATXN1; (-) strand; PAM type: NRG; PAM sequence: GAG
attagatattggaagtgaat

SEQ ID NO: 89269 - DNA, 20 bp, Artificial Sequence
  Description of Artificial Sequence: Synthetic oligonucleotide
  Target: ATXN1; (-) strand; PAM type: NRG; PAM sequence: AAG
gatgagcaattagatattgg

SEQ ID NO: 89270 - DNA, 20 bp, Artificial Sequence
  Description of Artificial Sequence: Synthetic oligonucleotide
  Target: ATXN1; (-) strand; PAM type: NRG; PAM sequence: TGG
cttgatgagcaattagatat

SEQ ID NO: 89271 - DNA, 20 bp, Artificial Sequence
  Description of Artificial Sequence: Synthetic oligonucleotide
  Target: ATXN1; (-) strand; PAM type: NRG; PAM sequence: TAG
tagaggacttgatgagcaat

SEQ ID NO: 89272 - DNA, 20 bp, Artificial Sequence
  Description of Artificial Sequence: Synthetic oligonucleotide
  Target: ATXN1; (-) strand; PAM type: NRG; PAM sequence: GAG
aaggatttagaggacttgat

SEQ ID NO: 89273 - DNA, 20 bp, Artificial Sequence
  Description of Artificial Sequence: Synthetic oligonucleotide
  Target: ATXN1; (-) strand; PAM type: NRG; PAM sequence: AGG
gttaataagcaaggatttag

SEQ ID NO: 89274 - DNA, 20 bp, Artificial Sequence
  Description of Artificial Sequence: Synthetic oligonucleotide
  Target: ATXN1; (-) strand; PAM type: NRG; PAM sequence: GAG
tgttaataagcaaggattta

SEQ ID NO: 89275 - DNA, 20 bp, Artificial Sequence
  Description of Artificial Sequence: Synthetic oligonucleotide
  Target: ATXN1; (-) strand; PAM type: NRG; PAM sequence: TAG
gatgttaataagcaaggatt

SEQ ID NO: 89276 - DNA, 20 bp, Artificial Sequence
  Description of Artificial Sequence: Synthetic oligonucleotide
  Target: ATXN1; (-) strand; PAM type: NRG; PAM sequence: AGG
tggagagatgttaataagca

SEQ ID NO: 89277 - DNA, 20 bp, Artificial Sequence
  Description of Artificial Sequence: Synthetic oligonucleotide
  Target: ATXN1; (-) strand; PAM type: NRG; PAM sequence: AAG
ttggagagatgttaataagc

SEQ ID NO: 89278 - DNA, 20 bp, Artificial Sequence
  Description of Artificial Sequence: Synthetic oligonucleotide
  Target: ATXN1; (-) strand; PAM type: NRG; PAM sequence: AAG
cagattggagagatgttaat

SEQ ID NO: 89279 - DNA, 20 bp, Artificial Sequence
  Description of Artificial Sequence: Synthetic oligonucleotide
  Target: ATXN1; (-) strand; PAM type: NRG; PAM sequence: GAG
gaaagaatgagcagattgga

SEQ ID NO: 89280 - DNA, 20 bp, Artificial Sequence
  Description of Artificial Sequence: Synthetic oligonucleotide
  Target: ATXN1; (-) strand; PAM type: NRG; PAM sequence: GAG
tggaaagaatgagcagattg

SEQ ID NO: 89281 - DNA, 20 bp, Artificial Sequence
  Description of Artificial Sequence: Synthetic oligonucleotide
  Target: ATXN1; (-) strand; PAM type: NRG; PAM sequence: TGG
aatggaaagaatgagcagat

SEQ ID NO: 89282 - DNA, 20 bp, Artificial Sequence
  Description of Artificial Sequence: Synthetic oligonucleotide
  Target: ATXN1; (-) strand; PAM type: NRG; PAM sequence: CAG
gacagaatggaaagaatgag

SEQ ID NO: 89283 - DNA, 20 bp, Artificial Sequence
  Description of Artificial Sequence: Synthetic oligonucleotide
  Target: ATXN1; (-) strand; PAM type: NRG; PAM sequence: GAG
agtgacagaatggaaagaat

SEQ ID NO: 89284 - DNA, 20 bp, Artificial Sequence
  Description of Artificial Sequence: Synthetic oligonucleotide
  Target: ATXN1; (-) strand; PAM type: NRG; PAM sequence: AAG
aatggaagtgacagaatgga

SEQ ID NO: 89285 - DNA, 20 bp, Artificial Sequence
  Description of Artificial Sequence: Synthetic oligonucleotide
  Target: ATXN1; (-) strand; PAM type: NRG; PAM sequence: TGG
tggcaatggaagtgacagaa

SEQ ID NO: 89286 - DNA, 20 bp, Artificial Sequence
  Description of Artificial Sequence: Synthetic oligonucleotide
  Target: ATXN1; (-) strand; PAM type: NRG; PAM sequence: CAG
tggagtggcaatggaagtga

SEQ ID NO: 89287 - DNA, 20 bp, Artificial Sequence
  Description of Artificial Sequence: Synthetic oligonucleotide
  Target: ATXN1; (-) strand; PAM type: NRG; PAM sequence: AAG
ggagtttggagtggcaatgg

SEQ ID NO: 89288 - DNA, 20 bp, Artificial Sequence
  Description of Artificial Sequence: Synthetic oligonucleotide
  Target: ATXN1; (-) strand; PAM type: NRG; PAM sequence: TGG
catggagtttggagtggcaa

SEQ ID NO: 89289 - DNA, 20 bp, Artificial Sequence
  Description of Artificial Sequence: Synthetic oligonucleotide
  Target: ATXN1; (-) strand; PAM type: NRG; PAM sequence: TGG
tgttctcatggagtttggag

SEQ ID NO: 89290 - DNA, 20 bp, Artificial Sequence
  Description of Artificial Sequence: Synthetic oligonucleotide
  Target: ATXN1; (-) strand; PAM type: NRG; PAM sequence: GAG
ccttgttctcatggagtttg

SEQ ID NO: 89291 - DNA, 20 bp, Artificial Sequence
  Description of Artificial Sequence: Synthetic oligonucleotide
  Target: ATXN1; (-) strand; PAM type: NRG; PAM sequence: TGG
ccccttgttctcatggagtt

SEQ ID NO: 89292 - DNA, 20 bp, Artificial Sequence
  Description of Artificial Sequence: Synthetic oligonucleotide
  Target: ATXN1; (-) strand; PAM type: NRG; PAM sequence: GAG
acaggccccttgttctcatg

SEQ ID NO: 89293 - DNA, 20 bp, Artificial Sequence
  Description of Artificial Sequence: Synthetic oligonucleotide
  Target: ATXN1; (-) strand; PAM type: NRG; PAM sequence: TGG
agacaggccccttgttctca

SEQ ID NO: 89294 - DNA, 20 bp, Artificial Sequence
  Description of Artificial Sequence: Synthetic oligonucleotide
  Target: ATXN1; (-) strand; PAM type: NRG; PAM sequence: AGG
ctgcagggaccaggacagac

SEQ ID NO: 89295 - DNA, 20 bp, Artificial Sequence
  Description of Artificial Sequence: Synthetic oligonucleotide
  Target: ATXN1; (-) strand; PAM type: NRG; PAM sequence: CAG
tctgcagggaccaggacaga

SEQ ID NO: 89296 - DNA, 20 bp, Artificial Sequence
  Description of Artificial Sequence: Synthetic oligonucleotide
  Target: ATXN1; (-) strand; PAM type: NRG; PAM sequence: CAG
ggcttctgcagggaccagga

SEQ ID NO: 89297 - DNA, 20 bp, Artificial Sequence
  Description of Artificial Sequence: Synthetic oligonucleotide
  Target: ATXN1; (-) strand; PAM type: NRG; PAM sequence: AGG
ctgcggcttctgcagggacc

SEQ ID NO: 89298 - DNA, 20 bp, Artificial Sequence
  Description of Artificial Sequence: Synthetic oligonucleotide
  Target: ATXN1; (-) strand; PAM type: NRG; PAM sequence: CAG
gctgcggcttctgcagggac

SEQ ID NO: 89299 - DNA, 20 bp, Artificial Sequence
  Description of Artificial Sequence: Synthetic oligonucleotide
  Target: ATXN1; (-) strand; PAM type: NRG; PAM sequence: GGG
tgtgtgctgcggcttctgca

SEQ ID NO: 89300 - DNA, 20 bp, Artificial Sequence
  Description of Artificial Sequence: Synthetic oligonucleotide
  Target: ATXN1; (-) strand; PAM type: NRG; PAM sequence: AGG
ctgtgtgctgcggcttctgc

SEQ ID NO: 89301 - DNA, 20 bp, Artificial Sequence
  Description of Artificial Sequence: Synthetic oligonucleotide
  Target: ATXN1; (-) strand; PAM type: NRG; PAM sequence: CAG
tctgtgtgctgcggcttctg

SEQ ID NO: 89302 - DNA, 20 bp, Artificial Sequence
  Description of Artificial Sequence: Synthetic oligonucleotide
  Target: ATXN1; (-) strand; PAM type: NRG; PAM sequence: CGG
aatcacaggtctgtgtgctg

SEQ ID NO: 89303 - DNA, 20 bp, Artificial Sequence
  Description of Artificial Sequence: Synthetic oligonucleotide
  Target: ATXN1; (-) strand; PAM type: NRG; PAM sequence: AGG
acctgcttcatgctaatcac

SEQ ID NO: 89304 - DNA, 20 bp, Artificial Sequence
  Description of Artificial Sequence: Synthetic oligonucleotide
  Target: ATXN1; (-) strand; PAM type: NRG; PAM sequence: CAG
cacctgcttcatgctaatca

SEQ ID NO: 89305 - DNA, 20 bp, Artificial Sequence
  Description of Artificial Sequence: Synthetic oligonucleotide
  Target: ATXN1; (-) strand; PAM type: NRG; PAM sequence: GAG
ttgaaaattccagaaccaca

SEQ ID NO: 89306 - DNA, 20 bp, Artificial Sequence
  Description of Artificial Sequence: Synthetic oligonucleotide
  Target: ATXN1; (-) strand; PAM type: NRG; PAM sequence: CAG
tgttgaaaattccagaacca

SEQ ID NO: 89307 - DNA, 20 bp, Artificial Sequence
  Description of Artificial Sequence: Synthetic oligonucleotide
  Target: ATXN1; (-) strand; PAM type: NRG; PAM sequence: CAG
cagaggaatgttgaaaattc

SEQ ID NO: 89308 - DNA, 20 bp, Artificial Sequence
  Description of Artificial Sequence: Synthetic oligonucleotide
  Target: ATXN1; (-) strand; PAM type: NRG; PAM sequence: AGG
tgtagaaatccaggtgacag

SEQ ID NO: 89309 - DNA, 20 bp, Artificial Sequence
  Description of Artificial Sequence: Synthetic oligonucleotide
  Target: ATXN1; (-) strand; PAM type: NRG; PAM sequence: GAG
ttgtagaaatccaggtgaca

SEQ ID NO: 89310 - DNA, 20 bp, Artificial Sequence
  Description of Artificial Sequence: Synthetic oligonucleotide
  Target: ATXN1; (-) strand; PAM type: NRG; PAM sequence: CAG
agttgtagaaatccaggtga

SEQ ID NO: 89311 - DNA, 20 bp, Artificial Sequence
  Description of Artificial Sequence: Synthetic oligonucleotide
  Target: ATXN1; (-) strand; PAM type: NRG; PAM sequence: AGG
ggaagcagttgtagaaatcc

SEQ ID NO: 89312 - DNA, 20 bp, Artificial Sequence
  Description of Artificial Sequence: Synthetic oligonucleotide
  Target: ATXN1; (-) strand; PAM type: NRG; PAM sequence: CAG
aggaagcagttgtagaaatc

SEQ ID NO: 89313 - DNA, 20 bp, Artificial Sequence
  Description of Artificial Sequence: Synthetic oligonucleotide
  Target: ATXN1; (-) strand; PAM type: NRG; PAM sequence: TAG
gaccagagaggaagcagttg

SEQ ID NO: 89314 - DNA, 20 bp, Artificial Sequence
  Description of Artificial Sequence: Synthetic oligonucleotide
  Target: ATXN1; (-) strand; PAM type: NRG; PAM sequence: CAG
caaggagaccagagaggaag

SEQ ID NO: 89315 - DNA, 20 bp, Artificial Sequence
  Description of Artificial Sequence: Synthetic oligonucleotide
  Target: ATXN1; (-) strand; PAM type: NRG; PAM sequence: AAG
gggcaaggagaccagagagg

SEQ ID NO: 89316 - DNA, 20 bp, Artificial Sequence
  Description of Artificial Sequence: Synthetic oligonucleotide
  Target: ATXN1; (-) strand; PAM type: NRG; PAM sequence: AGG
ggtgggcaaggagaccagag

SEQ ID NO: 89317 - DNA, 20 bp, Artificial Sequence
  Description of Artificial Sequence: Synthetic oligonucleotide
  Target: ATXN1; (-) strand; PAM type: NRG; PAM sequence: GAG
tggtgggcaaggagaccaga

SEQ ID NO: 89318 - DNA, 20 bp, Artificial Sequence
  Description of Artificial Sequence: Synthetic oligonucleotide
  Target: ATXN1; (-) strand; PAM type: NRG; PAM sequence: GAG
ggtggtgggcaaggagacca

SEQ ID NO: 89319 - DNA, 20 bp, Artificial Sequence
  Description of Artificial Sequence: Synthetic oligonucleotide
  Target: ATXN1; (-) strand; PAM type: NRG; PAM sequence: CAG
caggtggtgggcaaggagac

SEQ ID NO: 89320 - DNA, 20 bp, Artificial Sequence
  Description of Artificial Sequence: Synthetic oligonucleotide
  Target: ATXN1; (-) strand; PAM type: NRG; PAM sequence: GAG
gggaccaggtggtgggcaag

SEQ ID NO: 89321 - DNA, 20 bp, Artificial Sequence
  Description of Artificial Sequence: Synthetic oligonucleotide
  Target: ATXN1; (-) strand; PAM type: NRG; PAM sequence: AGG
aagggaccaggtggtgggca

SEQ ID NO: 89322 - DNA, 20 bp, Artificial Sequence
  Description of Artificial Sequence: Synthetic oligonucleotide
  Target: ATXN1; (-) strand; PAM type: NRG; PAM sequence: AAG
taagggaccaggtggtgggc

SEQ ID NO: 89323 - DNA, 20 bp, Artificial Sequence
  Description of Artificial Sequence: Synthetic oligonucleotide
  Target: ATXN1; (-) strand; PAM type: NRG; PAM sequence: GGG
atgataagggaccaggtggt

SEQ ID NO: 89324 - DNA, 20 bp, Artificial Sequence
  Description of Artificial Sequence: Synthetic oligonucleotide
  Target: ATXN1; (-) strand; PAM type: NRG; PAM sequence: TGG
catgataagggaccaggtgg

SEQ ID NO: 89325 - DNA, 20 bp, Artificial Sequence
  Description of Artificial Sequence: Synthetic oligonucleotide
  Target: ATXN1; (-) strand; PAM type: NRG; PAM sequence: TGG
tggcatgataagggaccagg

SEQ ID NO: 89326 - DNA, 20 bp, Artificial Sequence
  Description of Artificial Sequence: Synthetic oligonucleotide
  Target: ATXN1; (-) strand; PAM type: NRG; PAM sequence: AGG
atttggcatgataagggacc

SEQ ID NO: 89327 - DNA, 20 bp, Artificial Sequence
  Description of Artificial Sequence: Synthetic oligonucleotide
  Target: ATXN1; (-) strand; PAM type: NRG; PAM sequence: CAG
catttggcatgataagggac

SEQ ID NO: 89328 - DNA, 20 bp, Artificial Sequence
  Description of Artificial Sequence: Synthetic oligonucleotide
  Target: ATXN1; (-) strand; PAM type: NRG; PAM sequence: GGG
ctatgcatttggcatgataa

SEQ ID NO: 89329 - DNA, 20 bp, Artificial Sequence
  Description of Artificial Sequence: Synthetic oligonucleotide
  Target: ATXN1; (-) strand; PAM type: NRG; PAM sequence: AGG
gctatgcatttggcatgata

SEQ ID NO: 89330 - DNA, 20 bp, Artificial Sequence
  Description of Artificial Sequence: Synthetic oligonucleotide
  Target: ATXN1; (-) strand; PAM type: NRG; PAM sequence: AAG
tgctatgcatttggcatgat

SEQ ID NO: 89331 - DNA, 20 bp, Artificial Sequence
  Description of Artificial Sequence: Synthetic oligonucleotide
  Target: ATXN1; (-) strand; PAM type: NRG; PAM sequence: TGG
ttctgttagtgctatgcatt

SEQ ID NO: 89332 - DNA, 20 bp, Artificial Sequence
  Description of Artificial Sequence: Synthetic oligonucleotide
  Target: ATXN1; (-) strand; PAM type: NRG; PAM sequence: TAG
tttcagtgatttcattctgt

SEQ ID NO: 89333 - DNA, 20 bp, Artificial Sequence
  Description of Artificial Sequence: Synthetic oligonucleotide
  Target: ATXN1; (-) strand; PAM type: NRG; PAM sequence: CAG
gaaaagtcaggtgtgtgttt

SEQ ID NO: 89334 - DNA, 20 bp, Artificial Sequence
  Description of Artificial Sequence: Synthetic oligonucleotide
  Target: ATXN1; (-) strand; PAM type: NRG; PAM sequence: AGG
ctgtagggatgtgaaaagtc

SEQ ID NO: 89335 - DNA, 20 bp, Artificial Sequence
  Description of Artificial Sequence: Synthetic oligonucleotide
  Target: ATXN1; (-) strand; PAM type: NRG; PAM sequence: CAG
actgtagggatgtgaaaagt

SEQ ID NO: 89336 - DNA, 20 bp, Artificial Sequence
  Description of Artificial Sequence: Synthetic oligonucleotide
  Target: ATXN1; (-) strand; PAM type: NRG; PAM sequence: AAG
aaggactgtagggatgtgaa

SEQ ID NO: 89337 - DNA, 20 bp, Artificial Sequence
  Description of Artificial Sequence: Synthetic oligonucleotide
  Target: ATXN1; (-) strand; PAM type: NRG; PAM sequence: GGG
agacccattcaaggactgta

SEQ ID NO: 89338 - DNA, 20 bp, Artificial Sequence
  Description of Artificial Sequence: Synthetic oligonucleotide
  Target: ATXN1; (-) strand; PAM type: NRG; PAM sequence: AGG
tagacccattcaaggactgt

SEQ ID NO: 89339 - DNA, 20 bp, Artificial Sequence
  Description of Artificial Sequence: Synthetic oligonucleotide
  Target: ATXN1; (-) strand; PAM type: NRG; PAM sequence: TAG
gtagacccattcaaggactg

SEQ ID NO: 89340 - DNA, 20 bp, Artificial Sequence
  Description of Artificial Sequence: Synthetic oligonucleotide
  Target: ATXN1; (-) strand; PAM type: NRG; PAM sequence: AGG
atgcaatgtagacccattca

SEQ ID NO: 89341 - DNA, 20 bp, Artificial Sequence
  Description of Artificial Sequence: Synthetic oligonucleotide
  Target: ATXN1; (-) strand; PAM type: NRG; PAM sequence: AAG
gatgcaatgtagacccattc

SEQ ID NO: 89342 - DNA, 20 bp, Artificial Sequence
  Description of Artificial Sequence: Synthetic oligonucleotide
  Target: ATXN1; (-) strand; PAM type: NRG; PAM sequence: TAG
attttatcttggatgcaatg

SEQ ID NO: 89343 - DNA, 20 bp, Artificial Sequence
  Description of Artificial Sequence: Synthetic oligonucleotide
  Target: ATXN1; (-) strand; PAM type: NRG; PAM sequence: TGG
agagatcttggattttatct

SEQ ID NO: 89344 - DNA, 20 bp, Artificial Sequence
  Description of Artificial Sequence: Synthetic oligonucleotide
  Target: ATXN1; (-) strand; PAM type: NRG; PAM sequence: TGG
tgtgagccaagcagagatct

SEQ ID NO: 89345 - DNA, 20 bp, Artificial Sequence
  Description of Artificial Sequence: Synthetic oligonucleotide
  Target: ATXN1; (-) strand; PAM type: NRG; PAM sequence: GAG
gggcccttgtgagccaagca

SEQ ID NO: 89346 - DNA, 20 bp, Artificial Sequence
  Description of Artificial Sequence: Synthetic oligonucleotide
  Target: ATXN1; (-) strand; PAM type: NRG; PAM sequence: CAG
aagggcccttgtgagccaag

SEQ ID NO: 89347 - DNA, 20 bp, Artificial Sequence
  Description of Artificial Sequence: Synthetic oligonucleotide
  Target: ATXN1; (-) strand; PAM type: NRG; PAM sequence: AAG
aggaagggcccttgtgagcc

SEQ ID NO: 89348 - DNA, 20 bp, Artificial Sequence
  Description of Artificial Sequence: Synthetic oligonucleotide
  Target: ATXN1; (-) strand; PAM type: NRG; PAM sequence: GAG
cgatcaggaagggcccttgt

SEQ ID NO: 89349 - DNA, 20 bp, Artificial Sequence
  Description of Artificial Sequence: Synthetic oligonucleotide
  Target: ATXN1; (-) strand; PAM type: NRG; PAM sequence: GGG
ctcagggtctcgatcaggaa

SEQ ID NO: 89350 - DNA, 20 bp, Artificial Sequence
  Description of Artificial Sequence: Synthetic oligonucleotide
  Target: ATXN1; (-) strand; PAM type: NRG; PAM sequence: AGG
gctcagggtctcgatcagga

SEQ ID NO: 89351 - DNA, 20 bp, Artificial Sequence
  Description of Artificial Sequence: Synthetic oligonucleotide
  Target: ATXN1; (-) strand; PAM type: NRG; PAM sequence: AAG
ggctcagggtctcgatcagg

SEQ ID NO: 89352 - DNA, 20 bp, Artificial Sequence
  Description of Artificial Sequence: Synthetic oligonucleotide
  Target: ATXN1; (-) strand; PAM type: NRG; PAM sequence: AGG
aggggctcagggtctcgatc

SEQ ID NO: 89353 - DNA, 20 bp, Artificial Sequence
  Description of Artificial Sequence: Synthetic oligonucleotide
  Target: ATXN1; (-) strand; PAM type: NRG; PAM sequence: CAG
gaggggctcagggtctcgat

SEQ ID NO: 89354 - DNA, 20 bp, Artificial Sequence
  Description of Artificial Sequence: Synthetic oligonucleotide
  Target: ATXN1; (-) strand; PAM type: NRG; PAM sequence: GGG
gacaccgctagaggggctca

SEQ ID NO: 89355 - DNA, 20 bp, Artificial Sequence
  Description of Artificial Sequence: Synthetic oligonucleotide
  Target: ATXN1; (-) strand; PAM type: NRG; PAM sequence: AGG
tgacaccgctagaggggctc

SEQ ID NO: 89356 - DNA, 20 bp, Artificial Sequence
  Description of Artificial Sequence: Synthetic oligonucleotide
  Target: ATXN1; (-) strand; PAM type: NRG; PAM sequence: CAG
ctgacaccgctagaggggct

SEQ ID NO: 89357 - DNA, 20 bp, Artificial Sequence
  Description of Artificial Sequence: Synthetic oligonucleotide
  Target: ATXN1; (-) strand; PAM type: NRG; PAM sequence: GGG
caggcctgacaccgctagag

SEQ ID NO: 89358 - DNA, 20 bp, Artificial Sequence
  Description of Artificial Sequence: Synthetic oligonucleotide
  Target: ATXN1; (-) strand; PAM type: NRG; PAM sequence: GGG
gcaggcctgacaccgctaga

SEQ ID NO: 89359 - DNA, 20 bp, Artificial Sequence
  Description of Artificial Sequence: Synthetic oligonucleotide
  Target: ATXN1; (-) strand; PAM type: NRG; PAM sequence: AGG
ggcaggcctgacaccgctag

SEQ ID NO: 89360 - DNA, 20 bp, Artificial Sequence
  Description of Artificial Sequence: Synthetic oligonucleotide
  Target: ATXN1; (-) strand; PAM type: NRG; PAM sequence: GAG
aggcaggcctgacaccgcta

SEQ ID NO: 89361 - DNA, 20 bp, Artificial Sequence
  Description of Artificial Sequence: Synthetic oligonucleotide
  Target: ATXN1; (-) strand; PAM type: NRG; PAM sequence: TAG
tgaggcaggcctgacaccgc

SEQ ID NO: 89362 - DNA, 20 bp, Artificial Sequence
  Description of Artificial Sequence: Synthetic oligonucleotide
  Target: ATXN1; (-) strand; PAM type: NRG; PAM sequence: AGG
tggtaggtccatagtgaggc

SEQ ID NO: 89363 - DNA, 20 bp, Artificial Sequence
  Description of Artificial Sequence: Synthetic oligonucleotide
  Target: ATXN1; (-) strand; PAM type: NRG; PAM sequence: CAG
ttggtaggtccatagtgagg

SEQ ID NO: 89364 - DNA, 20 bp, Artificial Sequence
  Description of Artificial Sequence: Synthetic oligonucleotide
  Target: ATXN1; (-) strand; PAM type: NRG; PAM sequence: AGG
agtttggtaggtccatagtg

SEQ ID NO: 89365 - DNA, 20 bp, Artificial Sequence
  Description of Artificial Sequence: Synthetic oligonucleotide
  Target: ATXN1; (-) strand; PAM type: NRG; PAM sequence: GAG
cagtttggtaggtccatagt

SEQ ID NO: 89366 - DNA, 20 bp, Artificial Sequence
  Description of Artificial Sequence: Synthetic oligonucleotide
  Target: ATXN1; (-) strand; PAM type: NRG; PAM sequence: TAG
taagcagtttggtaggtcca

SEQ ID NO: 89367 - DNA, 20 bp, Artificial Sequence
  Description of Artificial Sequence: Synthetic oligonucleotide
  Target: ATXN1; (-) strand; PAM type: NRG; PAM sequence: AGG
ggagcaataagcagtttggt

SEQ ID NO: 89368 - DNA, 20 bp, Artificial Sequence
  Description of Artificial Sequence: Synthetic oligonucleotide
  Target: ATXN1; (-) strand; PAM type: NRG; PAM sequence: TAG
aggagcaataagcagtttgg

SEQ ID NO: 89369 - DNA, 20 bp, Artificial Sequence
  Description of Artificial Sequence: Synthetic oligonucleotide
  Target: ATXN1; (-) strand; PAM type: NRG; PAM sequence: TGG
tgaaggagcaataagcagtt

SEQ ID NO: 89370 - DNA, 20 bp, Artificial Sequence
  Description of Artificial Sequence: Synthetic oligonucleotide
  Target: ATXN1; (-) strand; PAM type: NRG; PAM sequence: CAG
tgggctgaaggagcaataag

SEQ ID NO: 89371 - DNA, 20 bp, Artificial Sequence
  Description of Artificial Sequence: Synthetic oligonucleotide
  Target: ATXN1; (-) strand; PAM type: NRG; PAM sequence: AAG
ggatgggctgaaggagcaat

SEQ ID NO: 89372 - DNA, 20 bp, Artificial Sequence
  Description of Artificial Sequence: Synthetic oligonucleotide
  Target: ATXN1; (-) strand; PAM type: NRG; PAM sequence: GAG
attatatggatgggctgaag

SEQ ID NO: 89373 - DNA, 20 bp, Artificial Sequence
  Description of Artificial Sequence: Synthetic oligonucleotide
  Target: ATXN1; (-) strand; PAM type: NRG; PAM sequence: AGG
gtattatatggatgggctga

SEQ ID NO: 89374 - DNA, 20 bp, Artificial Sequence
  Description of Artificial Sequence: Synthetic oligonucleotide
  Target: ATXN1; (-) strand; PAM type: NRG; PAM sequence: AAG
agtattatatggatgggctg

SEQ ID NO: 89375 - DNA, 20 bp, Artificial Sequence
  Description of Artificial Sequence: Synthetic oligonucleotide
  Target: ATXN1; (-) strand; PAM type: NRG; PAM sequence: GGG
caaaatagtattatatggat

SEQ ID NO: 89376 - DNA, 20 bp, Artificial Sequence
  Description of Artificial Sequence: Synthetic oligonucleotide
  Target: ATXN1; (-) strand; PAM type: NRG; PAM sequence: TGG
gcaaaatagtattatatgga

SEQ ID NO: 89377 - DNA, 20 bp, Artificial Sequence
  Description of Artificial Sequence: Synthetic oligonucleotide
  Target: ATXN1; (-) strand; PAM type: NRG; PAM sequence: TGG
aagtgcaaaatagtattata

SEQ ID NO: 89378 - DNA, 20 bp, Artificial Sequence
  Description of Artificial Sequence: Synthetic oligonucleotide
  Target: ATXN1; (-) strand; PAM type: NRG; PAM sequence: TAG
aagacaaaagaagtgcaaaa

SEQ ID NO: 89379 - DNA, 20 bp, Artificial Sequence
  Description of Artificial Sequence: Synthetic oligonucleotide
  Target: ATXN1; (-) strand; PAM type: NRG; PAM sequence: AAG
tgggcaaagaaagacaaaag

SEQ ID NO: 89380 - DNA, 20 bp, Artificial Sequence
  Description of Artificial Sequence: Synthetic oligonucleotide
  Target: ATXN1; (-) strand; PAM type: NRG; PAM sequence: AAG
gcttgggcaaagaaagacaa

SEQ ID NO: 89381 - DNA, 20 bp, Artificial Sequence
  Description of Artificial Sequence: Synthetic oligonucleotide
  Target: ATXN1; (-) strand; PAM type: NRG; PAM sequence: AAG
cagacaagcttgggcaaaga

SEQ ID NO: 89382 - DNA, 20 bp, Artificial Sequence
  Description of Artificial Sequence: Synthetic oligonucleotide
  Target: ATXN1; (-) strand; PAM type: NRG; PAM sequence: AAG
tgttcagacaagcttgggca

SEQ ID NO: 89383 - DNA, 20 bp, Artificial Sequence
  Description of Artificial Sequence: Synthetic oligonucleotide
  Target: ATXN1; (-) strand; PAM type: NRG; PAM sequence: GGG
ggagttgttcagacaagctt

SEQ ID NO: 89384 - DNA, 20 bp, Artificial Sequence
  Description of Artificial Sequence: Synthetic oligonucleotide
  Target: ATXN1; (-) strand; PAM type: NRG; PAM sequence: TGG
aggagttgttcagacaagct

SEQ ID NO: 89385 - DNA, 20 bp, Artificial Sequence
  Description of Artificial Sequence: Synthetic oligonucleotide
  Target: ATXN1; (-) strand; PAM type: NRG; PAM sequence: AAG
gaatgaggagttgttcagac

SEQ ID NO: 89386 - DNA, 20 bp, Artificial Sequence
  Description of Artificial Sequence: Synthetic oligonucleotide
  Target: ATXN1; (-) strand; PAM type: NRG; PAM sequence: CAG
tttcagaatgaggagttgtt

SEQ ID NO: 89387 - DNA, 20 bp, Artificial Sequence
  Description of Artificial Sequence: Synthetic oligonucleotide
  Target: ATXN1; (-) strand; PAM type: NRG; PAM sequence: GAG
tccaagcttttcagaatgag

SEQ ID NO: 89388 - DNA, 20 bp, Artificial Sequence
  Description of Artificial Sequence: Synthetic oligonucleotide
  Target: ATXN1; (-) strand; PAM type: NRG; PAM sequence: AGG
agtccaagcttttcagaatg

SEQ ID NO: 89389 - DNA, 20 bp, Artificial Sequence
  Description of Artificial Sequence: Synthetic oligonucleotide
  Target: ATXN1; (-) strand; PAM type: NRG; PAM sequence: GAG
cagtccaagcttttcagaat

SEQ ID NO: 89390 - DNA, 20 bp, Artificial Sequence
  Description of Artificial Sequence: Synthetic oligonucleotide
  Target: ATXN1; (-) strand; PAM type: NRG; PAM sequence: CAG
gtccttcagtccaagctttt

SEQ ID NO: 89391 - DNA, 20 bp, Artificial Sequence
  Description of Artificial Sequence: Synthetic oligonucleotide
  Target: ATXN1; (-) strand; PAM type: NRG; PAM sequence: AAG
cagagcacgtccttcagtcc

SEQ ID NO: 89392 - DNA, 20 bp, Artificial Sequence
  Description of Artificial Sequence: Synthetic oligonucleotide
  Target: ATXN1; (-) strand; PAM type: NRG; PAM sequence: CAG
ggcctgcagagcacgtcctt

SEQ ID NO: 89393 - DNA, 20 bp, Artificial Sequence
  Description of Artificial Sequence: Synthetic oligonucleotide
  Target: ATXN1; (-) strand; PAM type: NRG; PAM sequence: GAG
gggtgctgagaaggcctgca

SEQ ID NO: 89394 - DNA, 20 bp, Artificial Sequence
  Description of Artificial Sequence: Synthetic oligonucleotide
  Target: ATXN1; (-) strand; PAM type: NRG; PAM sequence: CAG
aagggtgctgagaaggcctg

SEQ ID NO: 89395 - DNA, 20 bp, Artificial Sequence
  Description of Artificial Sequence: Synthetic oligonucleotide
  Target: ATXN1; (-) strand; PAM type: NRG; PAM sequence: AGG
tggaggaaagggtgctgaga

SEQ ID NO: 89396 - DNA, 20 bp, Artificial Sequence
  Description of Artificial Sequence: Synthetic oligonucleotide
  Target: ATXN1; (-) strand; PAM type: NRG; PAM sequence: AAG
ctggaggaaagggtgctgag

SEQ ID NO: 89397 - DNA, 20 bp, Artificial Sequence
  Description of Artificial Sequence: Synthetic oligonucleotide
  Target: ATXN1; (-) strand; PAM type: NRG; PAM sequence: GAG
tgactggaggaaagggtgct

SEQ ID NO: 89398 - DNA, 20 bp, Artificial Sequence
  Description of Artificial Sequence: Synthetic oligonucleotide
  Target: ATXN1; (-) strand; PAM type: NRG; PAM sequence: GGG
gtcaggttgactggaggaaa

SEQ ID NO: 89399 - DNA, 20 bp, Artificial Sequence
  Description of Artificial Sequence: Synthetic oligonucleotide
  Target: ATXN1; (-) strand; PAM type: NRG; PAM sequence: AGG
agtcaggttgactggaggaa

SEQ ID NO: 89400 - DNA, 20 bp, Artificial Sequence
  Description of Artificial Sequence: Synthetic oligonucleotide
  Target: ATXN1; (-) strand; PAM type: NRG; PAM sequence: AAG
gagtcaggttgactggagga

SEQ ID NO: 89401 - DNA, 20 bp, Artificial Sequence
  Description of Artificial Sequence: Synthetic oligonucleotide
  Target: ATXN1; (-) strand; PAM type: NRG; PAM sequence: AGG
acctgagtcaggttgactgg

SEQ ID NO: 89402 - DNA, 20 bp, Artificial Sequence
  Description of Artificial Sequence: Synthetic oligonucleotide
  Target: ATXN1; (-) strand; PAM type: NRG; PAM sequence: GAG
tacctgagtcaggttgactg

SEQ ID NO: 89403 - DNA, 20 bp, Artificial Sequence
  Description of Artificial Sequence: Synthetic oligonucleotide
  Target: ATXN1; (-) strand; PAM type: NRG; PAM sequence: TGG
catacctgagtcaggttgac

SEQ ID NO: 89404 - DNA, 20 bp, Artificial Sequence
  Description of Artificial Sequence: Synthetic oligonucleotide
  Target: ATXN1; (-) strand; PAM type: NRG; PAM sequence: AGG
gtatgtttcatacctgagtc

SEQ ID NO: 89405 - DNA, 20 bp, Artificial Sequence
  Description of Artificial Sequence: Synthetic oligonucleotide
  Target: ATXN1; (-) strand; PAM type: NRG; PAM sequence: CAG
ggtatgtttcatacctgagt

SEQ ID NO: 89406 - DNA, 20 bp, Artificial Sequence
  Description of Artificial Sequence: Synthetic oligonucleotide
  Target: ATXN1; (-) strand; PAM type: NRG; PAM sequence: GAG
gtagggtatgtttcatacct

SEQ ID NO: 89407 - DNA, 20 bp, Artificial Sequence
  Description of Artificial Sequence: Synthetic oligonucleotide
  Target: ATXN1; (-) strand; PAM type: NRG; PAM sequence: GGG
ctctgttaagcattatggta

SEQ ID NO: 89408 - DNA, 20 bp, Artificial Sequence
  Description of Artificial Sequence: Synthetic oligonucleotide
  Target: ATXN1; (-) strand; PAM type: NRG; PAM sequence: AGG
tctctgttaagcattatggt

SEQ ID NO: 89409 - DNA, 20 bp, Artificial Sequence
  Description of Artificial Sequence: Synthetic oligonucleotide
  Target: ATXN1; (-) strand; PAM type: NRG; PAM sequence: TAG
ctctctgttaagcattatgg

SEQ ID NO: 89410 - DNA, 20 bp, Artificial Sequence
  Description of Artificial Sequence: Synthetic oligonucleotide
  Target: ATXN1; (-) strand; PAM type: NRG; PAM sequence: TGG
ttgctctctgttaagcatta

SEQ ID NO: 89411 - DNA, 20 bp, Artificial Sequence
  Description of Artificial Sequence: Synthetic oligonucleotide
  Target: ATXN1; (-) strand; PAM type: NRG; PAM sequence: AAG
attaatcattgctctctgtt

SEQ ID NO: 89412 - DNA, 20 bp, Artificial Sequence
  Description of Artificial Sequence: Synthetic oligonucleotide
  Target: ATXN1; (-) strand; PAM type: NRG; PAM sequence: CAG
ctagtactgggagcaggcaa

SEQ ID NO: 89413 - DNA, 20 bp, Artificial Sequence
  Description of Artificial Sequence: Synthetic oligonucleotide
  Target: ATXN1; (-) strand; PAM type: NRG; PAM sequence: AGG
tgacctctagtactgggagc

SEQ ID NO: 89414 - DNA, 20 bp, Artificial Sequence
  Description of Artificial Sequence: Synthetic oligonucleotide
  Target: ATXN1; (-) strand; PAM type: NRG; PAM sequence: CAG
ttgacctctagtactgggag

SEQ ID NO: 89415 - DNA, 20 bp, Artificial Sequence
  Description of Artificial Sequence: Synthetic oligonucleotide
  Target: ATXN1; (-) strand; PAM type: NRG; PAM sequence: GAG
tctttgacctctagtactgg

SEQ ID NO: 89416 - DNA, 20 bp, Artificial Sequence
  Description of Artificial Sequence: Synthetic oligonucleotide
  Target: ATXN1; (-) strand; PAM type: NRG; PAM sequence: GGG
ggtctttgacctctagtact

SEQ ID NO: 89417 - DNA, 20 bp, Artificial Sequence
  Description of Artificial Sequence: Synthetic oligonucleotide
  Target: ATXN1; (-) strand; PAM type: NRG; PAM sequence: TGG
tggtctttgacctctagtac

SEQ ID NO: 89418 - DNA, 20 bp, Artificial Sequence
  Description of Artificial Sequence: Synthetic oligonucleotide
  Target: ATXN1; (-) strand; PAM type: NRG; PAM sequence: TAG
aggatgtggtctttgacctc

SEQ ID NO: 89419 - DNA, 20 bp, Artificial Sequence
  Description of Artificial Sequence: Synthetic oligonucleotide
  Target: ATXN1; (-) strand; PAM type: NRG; PAM sequence: TGG
ctaaagcataagataggatg

SEQ ID NO: 89420 - DNA, 20 bp, Artificial Sequence
  Description of Artificial Sequence: Synthetic oligonucleotide
  Target: ATXN1; (-) strand; PAM type: NRG; PAM sequence: AGG
ttgaggctaaagcataagat

SEQ ID NO: 89421 - DNA, 20 bp, Artificial Sequence
  Description of Artificial Sequence: Synthetic oligonucleotide
  Target: ATXN1; (-) strand; PAM type: NRG; PAM sequence: TAG
attgaggctaaagcataaga

SEQ ID NO: 89422 - DNA, 20 bp, Artificial Sequence
  Description of Artificial Sequence: Synthetic oligonucleotide
  Target: ATXN1; (-) strand; PAM type: NRG; PAM sequence: AAG
aggtattgaggctaaagcat

SEQ ID NO: 89423 - DNA, 20 bp, Artificial Sequence
  Description of Artificial Sequence: Synthetic oligonucleotide
  Target: ATXN1; (-) strand; PAM type: NRG; PAM sequence: AAG
tgctctaggtattgaggcta

SEQ ID NO: 89424 - DNA, 20 bp, Artificial Sequence
  Description of Artificial Sequence: Synthetic oligonucleotide
  Target: ATXN1; (-) strand; PAM type: NRG; PAM sequence: AGG
aaattctgctctaggtattg

SEQ ID NO: 89425 - DNA, 20 bp, Artificial Sequence
  Description of Artificial Sequence: Synthetic oligonucleotide
  Target: ATXN1; (-) strand; PAM type: NRG; PAM sequence: GAG
caaattctgctctaggtatt

SEQ ID NO: 89426 - DNA, 20 bp, Artificial Sequence
  Description of Artificial Sequence: Synthetic oligonucleotide
  Target: ATXN1; (-) strand; PAM type: NRG; PAM sequence: AGG
tgggcgccaaattctgctct

SEQ ID NO: 89427 - DNA, 20 bp, Artificial Sequence
  Description of Artificial Sequence: Synthetic oligonucleotide
  Target: ATXN1; (-) strand; PAM type: NRG; PAM sequence: TAG
ttgggcgccaaattctgctc

SEQ ID NO: 89428 - DNA, 20 bp, Artificial Sequence
  Description of Artificial Sequence: Synthetic oligonucleotide
  Target: ATXN1; (-) strand; PAM type: NRG; PAM sequence: GGG
agatttcttgcatacgtatt

SEQ ID NO: 89429 - DNA, 20 bp, Artificial Sequence
  Description of Artificial Sequence: Synthetic oligonucleotide
  Target: ATXN1; (-) strand; PAM type: NRG; PAM sequence: TGG
aagatttcttgcatacgtat

SEQ ID NO: 89430 - DNA, 20 bp, Artificial Sequence
  Description of Artificial Sequence: Synthetic oligonucleotide
  Target: ATXN1; (-) strand; PAM type: NRG; PAM sequence: AAG
cattcttcattaattcaaca

SEQ ID NO: 89431 - DNA, 20 bp, Artificial Sequence
  Description of Artificial Sequence: Synthetic oligonucleotide
  Target: ATXN1; (-) strand; PAM type: NRG; PAM sequence: AAG
gcccggccctctcttccttt

SEQ ID NO: 89432 - DNA, 20 bp, Artificial Sequence
  Description of Artificial Sequence: Synthetic oligonucleotide
  Target: ATXN1; (-) strand; PAM type: NRG; PAM sequence: CGG
caggcataagccactgtgcc

SEQ ID NO: 89433 - DNA, 20 bp, Artificial Sequence
  Description of Artificial Sequence: Synthetic oligonucleotide
  Target: ATXN1; (-) strand; PAM type: NRG; PAM sequence: AAG
agtgctgggattacaggcat

SEQ ID NO: 89434 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 89435 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 89436 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 89437 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 89438 - DNA, 20 bp, Artificial Sequence
  Description of Artificial Sequence: Synthetic oligonucleotide
  Target: ATXN1; (-) strand; PAM type: NRG; PAM sequence: AAG
ccacttgcctcggcctccca

SEQ ID NO: 89439 - DNA, 20 bp, Artificial Sequence
  Description of Artificial Sequence: Synthetic oligonucleotide
  Target: ATXN1; (-) strand; PAM type: NRG; PAM sequence: CGG
acctcgtgatccacttgcct

SEQ ID NO: 89440 - DNA, 20 bp, Artificial Sequence
  Description of Artificial Sequence: Synthetic oligonucleotide
  Target: ATXN1; (-) strand; PAM type: NRG; PAM sequence: TGG
tttcaccttgttggtcagga

SEQ ID NO: 89441 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccttgttggtc

SEQ ID NO: 89442 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccttgttggt

SEQ ID NO: 89443 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccttgt

SEQ ID NO: 89444 - DNA, 20 bp, Artificial Sequence
  Description of Artificial Sequence: Synthetic oligonucleotide
  Target: ATXN1; (-) strand; PAM type: NRG; PAM sequence: GGG
ttgtgtttttagtagagaca

SEQ ID NO: 89445 - DNA, 20 bp, Artificial Sequence
  Description of Artificial Sequence: Synthetic oligonucleotide
  Target: ATXN1; (-) strand; PAM type: NRG; PAM sequence: AGG
tttgtgtttttagtagagac

SEQ ID NO: 89446 - DNA, 20 bp, Artificial Sequence
  Description of Artificial Sequence: Synthetic oligonucleotide
  Target: ATXN1; (-) strand; PAM type: NRG; PAM sequence: CAG
ttttgtgtttttagtagaga

SEQ ID NO: 89447 - DNA, 20 bp, Artificial Sequence
  Description of Artificial Sequence: Synthetic oligonucleotide
  Target: ATXN1; (-) strand; PAM type: NRG; PAM sequence: GAG
atttttttgtgtttttagta

SEQ ID NO: 89448 - DNA, 20 bp, Artificial Sequence
  Description of Artificial Sequence: Synthetic oligonucleotide
  Target: ATXN1; (-) strand; PAM type: NRG; PAM sequence: TAG
ccatttttttgtgtttttag

SEQ ID NO: 89449 - DNA, 20 bp, Artificial Sequence
  Description of Artificial Sequence: Synthetic oligonucleotide
  Target: ATXN1; (-) strand; PAM type: NRG; PAM sequence: TAG
ggaccatttttttgtgtttt

SEQ ID NO: 89450 - DNA, 20 bp, Artificial Sequence
  Description of Artificial Sequence: Synthetic oligonucleotide
  Target: ATXN1; (-) strand; PAM type: NRG; PAM sequence: CGG
caagtgtgcactaccacgca

SEQ ID NO: 89451 - DNA, 20 bp, Artificial Sequence
  Description of Artificial Sequence: Synthetic oligonucleotide
  Target: ATXN1; (-) strand; PAM type: NRG; PAM sequence: AAG
tcctgagtagctaggattac

SEQ ID NO: 89452 - DNA, 20 bp, Artificial Sequence
  Description of Artificial Sequence: Synthetic oligonucleotide
  Target: ATXN1; (-) strand; PAM type: NRG; PAM sequence: AGG
cctcagtctcctgagtagct

SEQ ID NO: 89453 - DNA, 20 bp, Artificial Sequence
  Description of Artificial Sequence: Synthetic oligonucleotide
  Target: ATXN1; (-) strand; PAM type: NRG; PAM sequence: TAG
gcctcagtctcctgagtagc

SEQ ID NO: 89454 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagtctcctgag

SEQ ID NO: 89455 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagtctcct

SEQ ID NO: 89456 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 89457 - DNA, 20 bp, Artificial Sequence
  Description of Artificial Sequence: Synthetic oligonucleotide
  Target: ATXN1; (-) strand; PAM type: NRG; PAM sequence: AAG
caacttccgcctctgggttc

SEQ ID NO: 89458 - DNA, 20 bp, Artificial Sequence
  Description of Artificial Sequence: Synthetic oligonucleotide
  Target: ATXN1; (-) strand; PAM type: NRG; PAM sequence: GGG
tccctgcaacttccgcctct

SEQ ID NO: 89459 - DNA, 20 bp, Artificial Sequence
  Description of Artificial Sequence: Synthetic oligonucleotide
  Target: ATXN1; (-) strand; PAM type: NRG; PAM sequence: TGG
ctccctgcaacttccgcctc

SEQ ID NO: 89460 - DNA, 20 bp, Artificial Sequence
  Description of Artificial Sequence: Synthetic oligonucleotide
  Target: ATXN1; (-) strand; PAM type: NRG; PAM sequence: CGG
ggagcgcaatggtgcaatct

SEQ ID NO: 89461 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagcgcaa

SEQ ID NO: 89462 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtcgcccaggctg

SEQ ID NO: 89463 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtcgcccaggc

SEQ ID NO: 89464 - DNA, 20 bp, Artificial Sequence
  Description of Artificial Sequence: Synthetic oligonucleotide
  Target: ATXN1; (-) strand; PAM type: NRG; PAM sequence: AGG
ggagtcttgctctgtcgccc

SEQ ID NO: 89465 - DNA, 20 bp, Artificial Sequence
  Description of Artificial Sequence: Synthetic oligonucleotide
  Target: ATXN1; (-) strand; PAM type: NRG; PAM sequence: CAG
tggagtcttgctctgtcgcc

SEQ ID NO: 89466 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagatg

SEQ ID NO: 89467 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttttttgaga

SEQ ID NO: 89468 - DNA, 20 bp, Artificial Sequence
  Description of Artificial Sequence: Synthetic oligonucleotide
  Target: ATXN1; (-) strand; PAM type: NRG; PAM sequence: GAG
tccttttttttttttttttt

SEQ ID NO: 89469 - DNA, 20 bp, Artificial Sequence
  Description of Artificial Sequence: Synthetic oligonucleotide
  Target: ATXN1; (-) strand; PAM type: NRG; PAM sequence: GGG
taaagcacttaaccctctca

SEQ ID NO: 89470 - DNA, 20 bp, Artificial Sequence
  Description of Artificial Sequence: Synthetic oligonucleotide
  Target: ATXN1; (-) strand; PAM type: NRG; PAM sequence: AGG
ataaagcacttaaccctctc

SEQ ID NO: 89471 - DNA, 20 bp, Artificial Sequence
  Description of Artificial Sequence: Synthetic oligonucleotide
  Target: ATXN1; (-) strand; PAM type: NRG; PAM sequence: CAG
aataaagcacttaaccctct

SEQ ID NO: 89472 - DNA, 20 bp, Artificial Sequence
  Description of Artificial Sequence: Synthetic oligonucleotide
  Target: ATXN1; (-) strand; PAM type: NRG; PAM sequence: AAG
ggtttatttagccctgaata

SEQ ID NO: 89473 - DNA, 20 bp, Artificial Sequence
  Description of Artificial Sequence: Synthetic oligonucleotide
  Target: ATXN1; (-) strand; PAM type: NRG; PAM sequence: TAG
ttgtcccagtctggtttatt

SEQ ID NO: 89474 - DNA, 20 bp, Artificial Sequence
  Description of Artificial Sequence: Synthetic oligonucleotide
  Target: ATXN1; (-) strand; PAM type: NRG; PAM sequence: TGG
cctgaattcttgtcccagtc

SEQ ID NO: 89475 - DNA, 20 bp, Artificial Sequence
  Description of Artificial Sequence: Synthetic oligonucleotide
  Target: ATXN1; (-) strand; PAM type: NRG; PAM sequence: CAG
ggaggcctgaattcttgtcc

SEQ ID NO: 89476 - DNA, 20 bp, Artificial Sequence
  Description of Artificial Sequence: Synthetic oligonucleotide
  Target: ATXN1; (-) strand; PAM type: NRG; PAM sequence: AGG
atccatcagagaaagttagg

SEQ ID NO: 89477 - DNA, 20 bp, Artificial Sequence
  Description of Artificial Sequence: Synthetic oligonucleotide
  Target: ATXN1; (-) strand; PAM type: NRG; PAM sequence: GAG
gatccatcagagaaagttag

SEQ ID NO: 89478 - DNA, 20 bp, Artificial Sequence
  Description of Artificial Sequence: Synthetic oligonucleotide
  Target: ATXN1; (-) strand; PAM type: NRG; PAM sequence: AGG
aggatccatcagagaaagtt

SEQ ID NO: 89479 - DNA, 20 bp, Artificial Sequence
  Description of Artificial Sequence: Synthetic oligonucleotide
  Target: ATXN1; (-) strand; PAM type: NRG; PAM sequence: TAG
gaggatccatcagagaaagt

SEQ ID NO: 89480 - DNA, 20 bp, Artificial Sequence
  Description of Artificial Sequence: Synthetic oligonucleotide
  Target: ATXN1; (-) strand; PAM type: NRG; PAM sequence: AAG
gaaggaggatccatcagaga

SEQ ID NO: 89481 - DNA, 20 bp, Artificial Sequence
  Description of Artificial Sequence: Synthetic oligonucleotide
  Target: ATXN1; (-) strand; PAM type: NRG; PAM sequence: GAG
ggaagaaggaggatccatca

SEQ ID NO: 89482 - DNA, 20 bp, Artificial Sequence
  Description of Artificial Sequence: Synthetic oligonucleotide
  Target: ATXN1; (-) strand; PAM type: NRG; PAM sequence: CAG
ttggaagaaggaggatccat

SEQ ID NO: 89483 - DNA, 20 bp, Artificial Sequence
  Description of Artificial Sequence: Synthetic oligonucleotide
  Target: ATXN1; (-) strand; PAM type: NRG; PAM sequence: AGG
tgggatggattggaagaagg

SEQ ID NO: 89484 - DNA, 20 bp, Artificial Sequence
  Description of Artificial Sequence: Synthetic oligonucleotide
  Target: ATXN1; (-) strand; PAM type: NRG; PAM sequence: GAG
atgggatggattggaagaag

SEQ ID NO: 89485 - DNA, 20 bp, Artificial Sequence
  Description of Artificial Sequence: Synthetic oligonucleotide
  Target: ATXN1; (-) strand; PAM type: NRG; PAM sequence: AGG
ttatgggatggattggaaga

SEQ ID NO: 89486 - DNA, 20 bp, Artificial Sequence
  Description of Artificial Sequence: Synthetic oligonucleotide
  Target: ATXN1; (-) strand; PAM type: NRG; PAM sequence: AAG
tttatgggatggattggaag

SEQ ID NO: 89487 - DNA, 20 bp, Artificial Sequence
  Description of Artificial Sequence: Synthetic oligonucleotide
  Target: ATXN1; (-) strand; PAM type: NRG; PAM sequence: AAG
gcatttatgggatggattgg

SEQ ID NO: 89488 - DNA, 20 bp, Artificial Sequence
  Description of Artificial Sequence: Synthetic oligonucleotide
  Target: ATXN1; (-) strand; PAM type: NRG; PAM sequence: TGG
aaagcatttatgggatggat

SEQ ID NO: 89489 - DNA, 20 bp, Artificial Sequence
  Description of Artificial Sequence: Synthetic oligonucleotide
  Target: ATXN1; (-) strand; PAM type: NRG; PAM sequence: TGG
tttgaaaagcatttatggga

SEQ ID NO: 89490 - DNA, 20 bp, Artificial Sequence
  Description of Artificial Sequence: Synthetic oligonucleotide
  Target: ATXN1; (-) strand; PAM type: NRG; PAM sequence: GGG
gaaatttgaaaagcatttat

SEQ ID NO: 89491 - DNA, 20 bp, Artificial Sequence
  Description of Artificial Sequence: Synthetic oligonucleotide
  Target: ATXN1; (-) strand; PAM type: NRG; PAM sequence: TGG
agaaatttgaaaagcattta

SEQ ID NO: 89492 - DNA, 20 bp, Artificial Sequence
  Description of Artificial Sequence: Synthetic oligonucleotide
  Target: ATXN1; (-) strand; PAM type: NRG; PAM sequence: AAG
gaagagaagagaaatttgaa

SEQ ID NO: 89493 - DNA, 20 bp, Artificial Sequence
  Description of Artificial Sequence: Synthetic oligonucleotide
  Target: ATXN1; (-) strand; PAM type: NRG; PAM sequence: GAG
aggtgataaagtgaagagaa

SEQ ID NO: 89494 - DNA, 20 bp, Artificial Sequence
  Description of Artificial Sequence: Synthetic oligonucleotide
  Target: ATXN1; (-) strand; PAM type: NRG; PAM sequence: AAG
ggaggtgataaagtgaagag

SEQ ID NO: 89495 - DNA, 20 bp, Artificial Sequence
  Description of Artificial Sequence: Synthetic oligonucleotide
  Target: ATXN1; (-) strand; PAM type: NRG; PAM sequence: GAG
gcgggaggtgataaagtgaa

SEQ ID NO: 89496 - DNA, 20 bp, Artificial Sequence
  Description of Artificial Sequence: Synthetic oligonucleotide
  Target: ATXN1; (-) strand; PAM type: NRG; PAM sequence: AAG
tagcgggaggtgataaagtg

SEQ ID NO: 89497 - DNA, 20 bp, Artificial Sequence
  Description of Artificial Sequence: Synthetic oligonucleotide
  Target: ATXN1; (-) strand; PAM type: NRG; PAM sequence: AAG
tcgtctagcgggaggtgata

SEQ ID NO: 89498 - DNA, 20 bp, Artificial Sequence
  Description of Artificial Sequence: Synthetic oligonucleotide
  Target: ATXN1; (-) strand; PAM type: NRG; PAM sequence: AGG
gtagaagctcgtctagcggg

SEQ ID NO: 89499 - DNA, 20 bp, Artificial Sequence
  Description of Artificial Sequence: Synthetic oligonucleotide
  Target: ATXN1; (-) strand; PAM type: NRG; PAM sequence: GAG
tgtagaagctcgtctagcgg

SEQ ID NO: 89500 - DNA, 20 bp, Artificial Sequence
  Description of Artificial Sequence: Synthetic oligonucleotide
  Target: ATXN1; (-) strand; PAM type: NRG; PAM sequence: GGG
actgtagaagctcgtctagc

SEQ ID NO: 89501 - DNA, 20 bp, Artificial Sequence
  Description of Artificial Sequence: Synthetic oligonucleotide
  Target: ATXN1; (-) strand; PAM type: NRG; PAM sequence: CGG
aactgtagaagctcgtctag

SEQ ID NO: 89502 - DNA, 20 bp, Artificial Sequence
  Description of Artificial Sequence: Synthetic oligonucleotide
  Target: ATXN1; (-) strand; PAM type: NRG; PAM sequence: TAG
gaaaactgtagaagctcgtc

SEQ ID NO: 89503 - DNA, 20 bp, Artificial Sequence
  Description of Artificial Sequence: Synthetic oligonucleotide
  Target: ATXN1; (-) strand; PAM type: NRG; PAM sequence: AAG
agctgttaggaaaactgtag

SEQ ID NO: 89504 - DNA, 20 bp, Artificial Sequence
  Description of Artificial Sequence: Synthetic oligonucleotide
  Target: ATXN1; (-) strand; PAM type: NRG; PAM sequence: TAG
aatagctgttaggaaaactg

SEQ ID NO: 89505 - DNA, 20 bp, Artificial Sequence
  Description of Artificial Sequence: Synthetic oligonucleotide
  Target: ATXN1; (-) strand; PAM type: NRG; PAM sequence: AGG
atagagattcaatagctgtt

SEQ ID NO: 89506 - DNA, 20 bp, Artificial Sequence
  Description of Artificial Sequence: Synthetic oligonucleotide
  Target: ATXN1; (-) strand; PAM type: NRG; PAM sequence: TAG
gatagagattcaatagctgt

SEQ ID NO: 89507 - DNA, 20 bp, Artificial Sequence
  Description of Artificial Sequence: Synthetic oligonucleotide
  Target: ATXN1; (-) strand; PAM type: NRG; PAM sequence: TAG
aagagatgatagagattcaa

SEQ ID NO: 89508 - DNA, 20 bp, Artificial Sequence
  Description of Artificial Sequence: Synthetic oligonucleotide
  Target: ATXN1; (-) strand; PAM type: NRG; PAM sequence: GAG
aggattgaaaagagatgata

SEQ ID NO: 89509 - DNA, 20 bp, Artificial Sequence
  Description of Artificial Sequence: Synthetic oligonucleotide
  Target: ATXN1; (-) strand; PAM type: NRG; PAM sequence: TAG
ctaggattgaaaagagatga

SEQ ID NO: 89510 - DNA, 20 bp, Artificial Sequence
  Description of Artificial Sequence: Synthetic oligonucleotide
  Target: ATXN1; (-) strand; PAM type: NRG; PAM sequence: GAG
tctaagtctaggattgaaaa

SEQ ID NO: 89511 - DNA, 20 bp, Artificial Sequence
  Description of Artificial Sequence: Synthetic oligonucleotide
  Target: ATXN1; (-) strand; PAM type: NRG; PAM sequence: AAG
tatctaagtctaggattgaa

SEQ ID NO: 89512 - DNA, 20 bp, Artificial Sequence
  Description of Artificial Sequence: Synthetic oligonucleotide
  Target: ATXN1; (-) strand; PAM type: NRG; PAM sequence: AGG
aaaattgtatatctaagtct

SEQ ID NO: 89513 - DNA, 20 bp, Artificial Sequence
  Description of Artificial Sequence: Synthetic oligonucleotide
  Target: ATXN1; (-) strand; PAM type: NRG; PAM sequence: TAG
gaaaattgtatatctaagtc

SEQ ID NO: 89514 - DNA, 20 bp, Artificial Sequence
  Description of Artificial Sequence: Synthetic oligonucleotide
  Target: ATXN1; (-) strand; PAM type: NRG; PAM sequence: AAG
tgacagaaaattgtatatct

SEQ ID NO: 89515 - DNA, 20 bp, Artificial Sequence
  Description of Artificial Sequence: Synthetic oligonucleotide
  Target: ATXN1; (-) strand; PAM type: NRG; PAM sequence: CAG
ccaatgagacatttaggtga

SEQ ID NO: 89516 - DNA, 20 bp, Artificial Sequence
  Description of Artificial Sequence: Synthetic oligonucleotide
  Target: ATXN1; (-) strand; PAM type: NRG; PAM sequence: AGG
gagctgccaatgagacattt

SEQ ID NO: 89517 - DNA, 20 bp, Artificial Sequence
  Description of Artificial Sequence: Synthetic oligonucleotide
  Target: ATXN1; (-) strand; PAM type: NRG; PAM sequence: TAG
tgagctgccaatgagacatt

SEQ ID NO: 89518 - DNA, 20 bp, Artificial Sequence
  Description of Artificial Sequence: Synthetic oligonucleotide
  Target: ATXN1; (-) strand; PAM type: NRG; PAM sequence: GAG
tttgaatttgagctgccaat

SEQ ID NO: 89519 - DNA, 20 bp, Artificial Sequence
  Description of Artificial Sequence: Synthetic oligonucleotide
  Target: ATXN1; (-) strand; PAM type: NRG; PAM sequence: GAG
tttcttcatcttttgaattt

SEQ ID NO: 89520 - DNA, 20 bp, Artificial Sequence
  Description of Artificial Sequence: Synthetic oligonucleotide
  Target: ATXN1; (-) strand; PAM type: NRG; PAM sequence: TAG
tttcttggtggcagggtggt

SEQ ID NO: 89521 - DNA, 20 bp, Artificial Sequence
  Description of Artificial Sequence: Synthetic oligonucleotide
  Target: ATXN1; (-) strand; PAM type: NRG; PAM sequence: TGG
tctttttcttggtggcaggg

SEQ ID NO: 89522 - DNA, 20 bp, Artificial Sequence
  Description of Artificial Sequence: Synthetic oligonucleotide
  Target: ATXN1; (-) strand; PAM type: NRG; PAM sequence: GGG
acttctttttcttggtggca

SEQ ID NO: 89523 - DNA, 20 bp, Artificial Sequence
  Description of Artificial Sequence: Synthetic oligonucleotide
  Target: ATXN1; (-) strand; PAM type: NRG; PAM sequence: AGG
aacttctttttcttggtggc

SEQ ID NO: 89524 - DNA, 20 bp, Artificial Sequence
  Description of Artificial Sequence: Synthetic oligonucleotide
  Target: ATXN1; (-) strand; PAM type: NRG; PAM sequence: CAG
caacttctttttcttggtgg

SEQ ID NO: 89525 - DNA, 20 bp, Artificial Sequence
  Description of Artificial Sequence: Synthetic oligonucleotide
  Target: ATXN1; (-) strand; PAM type: NRG; PAM sequence: TGG
gaacaacttctttttcttgg

SEQ ID NO: 89526 - DNA, 20 bp, Artificial Sequence
  Description of Artificial Sequence: Synthetic oligonucleotide
  Target: ATXN1; (-) strand; PAM type: NRG; PAM sequence: TGG
gaggaacaacttctttttct

SEQ ID NO: 89527 - DNA, 20 bp, Artificial Sequence
  Description of Artificial Sequence: Synthetic oligonucleotide
  Target: ATXN1; (-) strand; PAM type: NRG; PAM sequence: AGG
gagcctacagattcctgagg

SEQ ID NO: 89528 - DNA, 20 bp, Artificial Sequence
  Description of Artificial Sequence: Synthetic oligonucleotide
  Target: ATXN1; (-) strand; PAM type: NRG; PAM sequence: GAG
ggagcctacagattcctgag

SEQ ID NO: 89529 - DNA, 20 bp, Artificial Sequence
  Description of Artificial Sequence: Synthetic oligonucleotide
  Target: ATXN1; (-) strand; PAM type: NRG; PAM sequence: AGG
gaggagcctacagattcctg

SEQ ID NO: 89530 - DNA, 20 bp, Artificial Sequence
  Description of Artificial Sequence: Synthetic oligonucleotide
  Target: ATXN1; (-) strand; PAM type: NRG; PAM sequence: GAG
ggaggagcctacagattcct

SEQ ID NO: 89531 - DNA, 20 bp, Artificial Sequence
  Description of Artificial Sequence: Synthetic oligonucleotide
  Target: ATXN1; (-) strand; PAM type: NRG; PAM sequence: CAG
gaatggggaggaggagccta

SEQ ID NO: 89532 - DNA, 20 bp, Artificial Sequence
  Description of Artificial Sequence: Synthetic oligonucleotide
  Target: ATXN1; (-) strand; PAM type: NRG; PAM sequence: GAG
actgtatgaatggggaggag

SEQ ID NO: 89533 - DNA, 20 bp, Artificial Sequence
  Description of Artificial Sequence: Synthetic oligonucleotide
  Target: ATXN1; (-) strand; PAM type: NRG; PAM sequence: AGG
tgactgtatgaatggggagg

SEQ ID NO: 89534 - DNA, 20 bp, Artificial Sequence
  Description of Artificial Sequence: Synthetic oligonucleotide
  Target: ATXN1; (-) strand; PAM type: NRG; PAM sequence: GAG
ctgactgtatgaatggggag

SEQ ID NO: 89535 - DNA, 20 bp, Artificial Sequence
  Description of Artificial Sequence: Synthetic oligonucleotide
  Target: ATXN1; (-) strand; PAM type: NRG; PAM sequence: AGG
tgctgactgtatgaatgggg

SEQ ID NO: 89536 - DNA, 20 bp, Artificial Sequence
  Description of Artificial Sequence: Synthetic oligonucleotide
  Target: ATXN1; (-) strand; PAM type: NRG; PAM sequence: GAG
gtgctgactgtatgaatggg

SEQ ID NO: 89537 - DNA, 20 bp, Artificial Sequence
  Description of Artificial Sequence: Synthetic oligonucleotide
  Target: ATXN1; (-) strand; PAM type: NRG; PAM sequence: GGG
aagtgctgactgtatgaatg

SEQ ID NO: 89538 - DNA, 20 bp, Artificial Sequence
  Description of Artificial Sequence: Synthetic oligonucleotide
  Target: ATXN1; (-) strand; PAM type: NRG; PAM sequence: GGG
caagtgctgactgtatgaat

SEQ ID NO: 89539 - DNA, 20 bp, Artificial Sequence
  Description of Artificial Sequence: Synthetic oligonucleotide
  Target: ATXN1; (-) strand; PAM type: NRG; PAM sequence: TGG
tcaagtgctgactgtatgaa

SEQ ID NO: 89540 - DNA, 20 bp, Artificial Sequence
  Description of Artificial Sequence: Synthetic oligonucleotide
  Target: ATXN1; (-) strand; PAM type: NRG; PAM sequence: AAG
agcttccacatttctgtctc

SEQ ID NO: 89541 - DNA, 20 bp, Artificial Sequence
  Description of Artificial Sequence: Synthetic oligonucleotide
  Target: ATXN1; (-) strand; PAM type: NRG; PAM sequence: TAG
taattaaaaaaaatagatgc

SEQ ID NO: 89542 - DNA, 20 bp, Artificial Sequence
  Description of Artificial Sequence: Synthetic oligonucleotide
  Target: ATXN1; (-) strand; PAM type: NRG; PAM sequence: TAG
gaaatagtaattaaaaaaaa

SEQ ID NO: 89543 - DNA, 20 bp, Artificial Sequence
  Description of Artificial Sequence: Synthetic oligonucleotide
  Target: ATXN1; (-) strand; PAM type: NRG; PAM sequence: TAG
tatatgtcctagtatagaaa

SEQ ID NO: 89544 - DNA, 20 bp, Artificial Sequence
  Description of Artificial Sequence: Synthetic oligonucleotide
  Target: ATXN1; (-) strand; PAM type: NRG; PAM sequence: TAG
acatggtatatgtcctagta

SEQ ID NO: 89545 - DNA, 20 bp, Artificial Sequence
  Description of Artificial Sequence: Synthetic oligonucleotide
  Target: ATXN1; (-) strand; PAM type: NRG; PAM sequence: TAG
aaaacacatggtatatgtcc

SEQ ID NO: 89546 - DNA, 20 bp, Artificial Sequence
  Description of Artificial Sequence: Synthetic oligonucleotide
  Target: ATXN1; (-) strand; PAM type: NRG; PAM sequence: TGG
aataagacatgtaaaacaca

SEQ ID NO: 89547 - DNA, 20 bp, Artificial Sequence
  Description of Artificial Sequence: Synthetic oligonucleotide
  Target: ATXN1; (-) strand; PAM type: NRG; PAM sequence: AAG
tctgccattttaaatgaaat

SEQ ID NO: 89548 - DNA, 20 bp, Artificial Sequence
  Description of Artificial Sequence: Synthetic oligonucleotide
  Target: ATXN1; (-) strand; PAM type: NRG; PAM sequence: TGG
catgacttcttaccaaggtt

SEQ ID NO: 89549 - DNA, 20 bp, Artificial Sequence
  Description of Artificial Sequence: Synthetic oligonucleotide
  Target: ATXN1; (-) strand; PAM type: NRG; PAM sequence: AGG
atttgcatgacttcttacca

SEQ ID NO: 89550 - DNA, 20 bp, Artificial Sequence
  Description of Artificial Sequence: Synthetic oligonucleotide
  Target: ATXN1; (-) strand; PAM type: NRG; PAM sequence: AAG
catttgcatgacttcttacc

SEQ ID NO: 89551 - DNA, 20 bp, Artificial Sequence
  Description of Artificial Sequence: Synthetic oligonucleotide
  Target: ATXN1; (-) strand; PAM type: NRG; PAM sequence: CAG
caagtatgagtggcaaatat

SEQ ID NO: 89552 - DNA, 20 bp, Artificial Sequence
  Description of Artificial Sequence: Synthetic oligonucleotide
  Target: ATXN1; (-) strand; PAM type: NRG; PAM sequence: TGG
ttgatggtgccaagtatgag

SEQ ID NO: 89553 - DNA, 20 bp, Artificial Sequence
  Description of Artificial Sequence: Synthetic oligonucleotide
  Target: ATXN1; (-) strand; PAM type: NRG; PAM sequence: GAG
aagttgatggtgccaagtat

SEQ ID NO: 89554 - DNA, 20 bp, Artificial Sequence
  Description of Artificial Sequence: Synthetic oligonucleotide
  Target: ATXN1; (-) strand; PAM type: NRG; PAM sequence: AAG
aaagagaagttgatggtgcc

SEQ ID NO: 89555 - DNA, 20 bp, Artificial Sequence
  Description of Artificial Sequence: Synthetic oligonucleotide
  Target: ATXN1; (-) strand; PAM type: NRG; PAM sequence: TGG
ttgagaaaaagagaagttga

SEQ ID NO: 89556 - DNA, 20 bp, Artificial Sequence
  Description of Artificial Sequence: Synthetic oligonucleotide
  Target: ATXN1; (-) strand; PAM type: NRG; PAM sequence: AAG
gaggagtttgagaaaaagag

SEQ ID NO: 89557 - DNA, 20 bp, Artificial Sequence
  Description of Artificial Sequence: Synthetic oligonucleotide
  Target: ATXN1; (-) strand; PAM type: NRG; PAM sequence: GAG
tttgaggagtttgagaaaaa

SEQ ID NO: 89558 - DNA, 20 bp, Artificial Sequence
  Description of Artificial Sequence: Synthetic oligonucleotide
  Target: ATXN1; (-) strand; PAM type: NRG; PAM sequence: AAG
tatttgaggagtttgagaaa

SEQ ID NO: 89559 - DNA, 20 bp, Artificial Sequence
  Description of Artificial Sequence: Synthetic oligonucleotide
  Target: ATXN1; (-) strand; PAM type: NRG; PAM sequence: GAG
gtgttgtatttgaggagttt

SEQ ID NO: 89560 - DNA, 20 bp, Artificial Sequence
  Description of Artificial Sequence: Synthetic oligonucleotide
  Target: ATXN1; (-) strand; PAM type: NRG; PAM sequence: GAG
gatttggtgttgtatttgag

SEQ ID NO: 89561 - DNA, 20 bp, Artificial Sequence
  Description of Artificial Sequence: Synthetic oligonucleotide
  Target: ATXN1; (-) strand; PAM type: NRG; PAM sequence: AGG
aggatttggtgttgtatttg

SEQ ID NO: 89562 - DNA, 20 bp, Artificial Sequence
  Description of Artificial Sequence: Synthetic oligonucleotide
  Target: ATXN1; (-) strand; PAM type: NRG; PAM sequence: GAG
gaggatttggtgttgtattt

SEQ ID NO: 89563 - DNA, 20 bp, Artificial Sequence
  Description of Artificial Sequence: Synthetic oligonucleotide
  Target: ATXN1; (-) strand; PAM type: NRG; PAM sequence: TGG
gtggaacaaccgggaggatt

SEQ ID NO: 89564 - DNA, 20 bp, Artificial Sequence
  Description of Artificial Sequence: Synthetic oligonucleotide
  Target: ATXN1; (-) strand; PAM type: NRG; PAM sequence: AGG
ggactggtggaacaaccggg

SEQ ID NO: 89565 - DNA, 20 bp, Artificial Sequence
  Description of Artificial Sequence: Synthetic oligonucleotide
  Target: ATXN1; (-) strand; PAM type: NRG; PAM sequence: GAG
aggactggtggaacaaccgg

SEQ ID NO: 89566 - DNA, 20 bp, Artificial Sequence
  Description of Artificial Sequence: Synthetic oligonucleotide
  Target: ATXN1; (-) strand; PAM type: NRG; PAM sequence: GGG
ggaggactggtggaacaacc

SEQ ID NO: 89567 - DNA, 20 bp, Artificial Sequence
  Description of Artificial Sequence: Synthetic oligonucleotide
  Target: ATXN1; (-) strand; PAM type: NRG; PAM sequence: CGG
gggaggactggtggaacaac

SEQ ID NO: 89568 - DNA, 20 bp, Artificial Sequence
  Description of Artificial Sequence: Synthetic oligonucleotide
  Target: ATXN1; (-) strand; PAM type: NRG; PAM sequence: TGG
cagtagagtgggaggactgg

SEQ ID NO: 89569 - DNA, 20 bp, Artificial Sequence
  Description of Artificial Sequence: Synthetic oligonucleotide
  Target: ATXN1; (-) strand; PAM type: NRG; PAM sequence: TGG
tggcagtagagtgggaggac

SEQ ID NO: 89570 - DNA, 20 bp, Artificial Sequence
  Description of Artificial Sequence: Synthetic oligonucleotide
  Target: ATXN1; (-) strand; PAM type: NRG; PAM sequence: AGG
agtagtggcagtagagtggg

SEQ ID NO: 89571 - DNA, 20 bp, Artificial Sequence
  Description of Artificial Sequence: Synthetic oligonucleotide
  Target: ATXN1; (-) strand; PAM type: NRG; PAM sequence: GAG
gagtagtggcagtagagtgg

SEQ ID NO: 89572 - DNA, 20 bp, Artificial Sequence
  Description of Artificial Sequence: Synthetic oligonucleotide
  Target: ATXN1; (-) strand; PAM type: NRG; PAM sequence: GGG
tagagtagtggcagtagagt

SEQ ID NO: 89573 - DNA, 20 bp, Artificial Sequence
  Description of Artificial Sequence: Synthetic oligonucleotide
  Target: ATXN1; (-) strand; PAM type: NRG; PAM sequence: TGG
ttagagtagtggcagtagag

SEQ ID NO: 89574 - DNA, 20 bp, Artificial Sequence
  Description of Artificial Sequence: Synthetic oligonucleotide
  Target: ATXN1; (-) strand; PAM type: NRG; PAM sequence: GAG
aggttagagtagtggcagta

SEQ ID NO: 89575 - DNA, 20 bp, Artificial Sequence
  Description of Artificial Sequence: Synthetic oligonucleotide
  Target: ATXN1; (-) strand; PAM type: NRG; PAM sequence: TAG
ccaggttagagtagtggcag

SEQ ID NO: 89576 - DNA, 20 bp, Artificial Sequence
  Description of Artificial Sequence: Synthetic oligonucleotide
  Target: ATXN1; (-) strand; PAM type: NRG; PAM sequence: CAG
ggtccaggttagagtagtgg

SEQ ID NO: 89577 - DNA, 20 bp, Artificial Sequence
  Description of Artificial Sequence: Synthetic oligonucleotide
  Target: ATXN1; (-) strand; PAM type: NRG; PAM sequence: TGG
gagggtccaggttagagtag

SEQ ID NO: 89578 - DNA, 20 bp, Artificial Sequence
  Description of Artificial Sequence: Synthetic oligonucleotide
  Target: ATXN1; (-) strand; PAM type: NRG; PAM sequence: TAG
taggagggtccaggttagag

SEQ ID NO: 89579 - DNA, 20 bp, Artificial Sequence
  Description of Artificial Sequence: Synthetic oligonucleotide
  Target: ATXN1; (-) strand; PAM type: NRG; PAM sequence: GAG
ctttaggagggtccaggtta

SEQ ID NO: 89580 - DNA, 20 bp, Artificial Sequence
  Description of Artificial Sequence: Synthetic oligonucleotide
  Target: ATXN1; (-) strand; PAM type: NRG; PAM sequence: TAG
gactttaggagggtccaggt

SEQ ID NO: 89581 - DNA, 20 bp, Artificial Sequence
  Description of Artificial Sequence: Synthetic oligonucleotide
  Target: ATXN1; (-) strand; PAM type: NRG; PAM sequence: AGG
aggagactttaggagggtcc

SEQ ID NO: 89582 - DNA, 20 bp, Artificial Sequence
  Description of Artificial Sequence: Synthetic oligonucleotide
  Target: ATXN1; (-) strand; PAM type: NRG; PAM sequence: CAG
caggagactttaggagggtc

SEQ ID NO: 89583 - DNA, 20 bp, Artificial Sequence
  Description of Artificial Sequence: Synthetic oligonucleotide
  Target: ATXN1; (-) strand; PAM type: NRG; PAM sequence: GGG
aagtccaggagactttagga

SEQ ID NO: 89584 - DNA, 20 bp, Artificial Sequence
  Description of Artificial Sequence: Synthetic oligonucleotide
  Target: ATXN1; (-) strand; PAM type: NRG; PAM sequence: AGG
gaagtccaggagactttagg

SEQ ID NO: 89585 - DNA, 20 bp, Artificial Sequence
  Description of Artificial Sequence: Synthetic oligonucleotide
  Target: ATXN1; (-) strand; PAM type: NRG; PAM sequence: GAG
agaagtccaggagactttag

SEQ ID NO: 89586 - DNA, 20 bp, Artificial Sequence
  Description of Artificial Sequence: Synthetic oligonucleotide
  Target: ATXN1; (-) strand; PAM type: NRG; PAM sequence: AGG
gaagaagtccaggagacttt

SEQ ID NO: 89587 - DNA, 20 bp, Artificial Sequence
  Description of Artificial Sequence: Synthetic oligonucleotide
  Target: ATXN1; (-) strand; PAM type: NRG; PAM sequence: TAG
tgaagaagtccaggagactt

SEQ ID NO: 89588 - DNA, 20 bp, Artificial Sequence
  Description of Artificial Sequence: Synthetic oligonucleotide
  Target: ATXN1; (-) strand; PAM type: NRG; PAM sequence: GAG
gtactcttgaagaagtccag

SEQ ID NO: 89589 - DNA, 20 bp, Artificial Sequence
  Description of Artificial Sequence: Synthetic oligonucleotide
  Target: ATXN1; (-) strand; PAM type: NRG; PAM sequence: AGG
aggtactcttgaagaagtcc

SEQ ID NO: 89590 - DNA, 20 bp, Artificial Sequence
  Description of Artificial Sequence: Synthetic oligonucleotide
  Target: ATXN1; (-) strand; PAM type: NRG; PAM sequence: CAG
taggtactcttgaagaagtc

SEQ ID NO: 89591 - DNA, 20 bp, Artificial Sequence
  Description of Artificial Sequence: Synthetic oligonucleotide
  Target: ATXN1; (-) strand; PAM type: NRG; PAM sequence: AAG
ccatctaggtactcttgaag

SEQ ID NO: 89592 - DNA, 20 bp, Artificial Sequence
  Description of Artificial Sequence: Synthetic oligonucleotide
  Target: ATXN1; (-) strand; PAM type: NRG; PAM sequence: AAG
agaccatctaggtactcttg

SEQ ID NO: 89593 - DNA, 20 bp, Artificial Sequence
  Description of Artificial Sequence: Synthetic oligonucleotide
  Target: ATXN1; (-) strand; PAM type: NRG; PAM sequence: AGG
ttgagacagagagaccatct

SEQ ID NO: 89594 - DNA, 20 bp, Artificial Sequence
  Description of Artificial Sequence: Synthetic oligonucleotide
  Target: ATXN1; (-) strand; PAM type: NRG; PAM sequence: TAG
attgagacagagagaccatc

SEQ ID NO: 89595 - DNA, 20 bp, Artificial Sequence
  Description of Artificial Sequence: Synthetic oligonucleotide
  Target: ATXN1; (-) strand; PAM type: NRG; PAM sequence: GAG
tggggtgttattgagacaga

SEQ ID NO: 89596 - DNA, 20 bp, Artificial Sequence
  Description of Artificial Sequence: Synthetic oligonucleotide
  Target: ATXN1; (-) strand; PAM type: NRG; PAM sequence: GAG
attggggtgttattgagaca

SEQ ID NO: 89597 - DNA, 20 bp, Artificial Sequence
  Description of Artificial Sequence: Synthetic oligonucleotide
  Target: ATXN1; (-) strand; PAM type: NRG; PAM sequence: CAG
tcattggggtgttattgaga

SEQ ID NO: 89598 - DNA, 20 bp, Artificial Sequence
  Description of Artificial Sequence: Synthetic oligonucleotide
  Target: ATXN1; (-) strand; PAM type: NRG; PAM sequence: GAG
gaattcattggggtgttatt

SEQ ID NO: 89599 - DNA, 20 bp, Artificial Sequence
  Description of Artificial Sequence: Synthetic oligonucleotide
  Target: ATXN1; (-) strand; PAM type: NRG; PAM sequence: GGG
gtagaagatagaattcattg

SEQ ID NO: 89600 - DNA, 20 bp, Artificial Sequence
  Description of Artificial Sequence: Synthetic oligonucleotide
  Target: ATXN1; (-) strand; PAM type: NRG; PAM sequence: GGG
agtagaagatagaattcatt

SEQ ID NO: 89601 - DNA, 20 bp, Artificial Sequence
  Description of Artificial Sequence: Synthetic oligonucleotide
  Target: ATXN1; (-) strand; PAM type: NRG; PAM sequence: TGG
gagtagaagatagaattcat

SEQ ID NO: 89602 - DNA, 20 bp, Artificial Sequence
  Description of Artificial Sequence: Synthetic oligonucleotide
  Target: ATXN1; (-) strand; PAM type: NRG; PAM sequence: TAG
tctctgggcagagtagaaga

SEQ ID NO: 89603 - DNA, 20 bp, Artificial Sequence
  Description of Artificial Sequence: Synthetic oligonucleotide
  Target: ATXN1; (-) strand; PAM type: NRG; PAM sequence: AAG
tcattctctgggcagagtag

SEQ ID NO: 89604 - DNA, 20 bp, Artificial Sequence
  Description of Artificial Sequence: Synthetic oligonucleotide
  Target: ATXN1; (-) strand; PAM type: NRG; PAM sequence: TAG
agttcattctctgggcagag

SEQ ID NO: 89605 - DNA, 20 bp, Artificial Sequence
  Description of Artificial Sequence: Synthetic oligonucleotide
  Target: ATXN1; (-) strand; PAM type: NRG; PAM sequence: GAG
gaaagttcattctctgggca

SEQ ID NO: 89606 - DNA, 20 bp, Artificial Sequence
  Description of Artificial Sequence: Synthetic oligonucleotide
  Target: ATXN1; (-) strand; PAM type: NRG; PAM sequence: CAG
tagaaagttcattctctggg

SEQ ID NO: 89607 - DNA, 20 bp, Artificial Sequence
  Description of Artificial Sequence: Synthetic oligonucleotide
  Target: ATXN1; (-) strand; PAM type: NRG; PAM sequence: GGG
ttttagaaagttcattctct

SEQ ID NO: 89608 - DNA, 20 bp, Artificial Sequence
  Description of Artificial Sequence: Synthetic oligonucleotide
  Target: ATXN1; (-) strand; PAM type: NRG; PAM sequence: TGG
cttttagaaagttcattctc

SEQ ID NO: 89609 - DNA, 20 bp, Artificial Sequence
  Description of Artificial Sequence: Synthetic oligonucleotide
  Target: ATXN1; (-) strand; PAM type: NRG; PAM sequence: AAG
aaatgacttctacttttaga

SEQ ID NO: 89610 - DNA, 20 bp, Artificial Sequence
  Description of Artificial Sequence: Synthetic oligonucleotide
  Target: ATXN1; (-) strand; PAM type: NRG; PAM sequence: TAG
ccggaaatgacttctacttt

SEQ ID NO: 89611 - DNA, 20 bp, Artificial Sequence
  Description of Artificial Sequence: Synthetic oligonucleotide
  Target: ATXN1; (-) strand; PAM type: NRG; PAM sequence: CGG
ttccccaccttgcttggaac

SEQ ID NO: 89612 - DNA, 20 bp, Artificial Sequence
  Description of Artificial Sequence: Synthetic oligonucleotide
  Target: ATXN1; (-) strand; PAM type: NRG; PAM sequence: TGG
tgcaacttccccaccttgct

SEQ ID NO: 89613 - DNA, 20 bp, Artificial Sequence
  Description of Artificial Sequence: Synthetic oligonucleotide
  Target: ATXN1; (-) strand; PAM type: NRG; PAM sequence: TAG
ctctcagctgcatcaacctc

SEQ ID NO: 89614 - DNA, 20 bp, Artificial Sequence
  Description of Artificial Sequence: Synthetic oligonucleotide
  Target: ATXN1; (-) strand; PAM type: NRG; PAM sequence: CAG
atcacatggaaaataactct

SEQ ID NO: 89615 - DNA, 20 bp, Artificial Sequence
  Description of Artificial Sequence: Synthetic oligonucleotide
  Target: ATXN1; (-) strand; PAM type: NRG; PAM sequence: TGG
tgcaagaattccccatcaca

SEQ ID NO: 89616 - DNA, 20 bp, Artificial Sequence
  Description of Artificial Sequence: Synthetic oligonucleotide
  Target: ATXN1; (-) strand; PAM type: NRG; PAM sequence: AAG
ttaaccaccttctttcctgc

SEQ ID NO: 89617 - DNA, 20 bp, Artificial Sequence
  Description of Artificial Sequence: Synthetic oligonucleotide
  Target: ATXN1; (-) strand; PAM type: NRG; PAM sequence: GAG
tccccagtgttccctctact

SEQ ID NO: 89618 - DNA, 20 bp, Artificial Sequence
  Description of Artificial Sequence: Synthetic oligonucleotide
  Target: ATXN1; (-) strand; PAM type: NRG; PAM sequence: CAG
tctcagtctgctattttccc

SEQ ID NO: 89619 - DNA, 20 bp, Artificial Sequence
  Description of Artificial Sequence: Synthetic oligonucleotide
  Target: ATXN1; (-) strand; PAM type: NRG; PAM sequence: CAG
ccattggacctcttctctct

SEQ ID NO: 89620 - DNA, 20 bp, Artificial Sequence
  Description of Artificial Sequence: Synthetic oligonucleotide
  Target: ATXN1; (-) strand; PAM type: NRG; PAM sequence: TGG
actcccccactcataaccat

SEQ ID NO: 89621 - DNA, 20 bp, Artificial Sequence
  Description of Artificial Sequence: Synthetic oligonucleotide
  Target: ATXN1; (-) strand; PAM type: NRG; PAM sequence: AAG
aaaaattatcagtaattttt

SEQ ID NO: 89622 - DNA, 20 bp, Artificial Sequence
  Description of Artificial Sequence: Synthetic oligonucleotide
  Target: ATXN1; (-) strand; PAM type: NRG; PAM sequence: CAG
cctttatgtctaaaaattat

SEQ ID NO: 89623 - DNA, 20 bp, Artificial Sequence
  Description of Artificial Sequence: Synthetic oligonucleotide
  Target: ATXN1; (-) strand; PAM type: NRG; PAM sequence: TAG
cataaacttaggtataaaca

SEQ ID NO: 89624 - DNA, 20 bp, Artificial Sequence
  Description of Artificial Sequence: Synthetic oligonucleotide
  Target: ATXN1; (-) strand; PAM type: NRG; PAM sequence: AGG
ctttatttaaacataaactt

SEQ ID NO: 89625 - DNA, 20 bp, Artificial Sequence
  Description of Artificial Sequence: Synthetic oligonucleotide
  Target: ATXN1; (-) strand; PAM type: NRG; PAM sequence: TAG
cctttatttaaacataaact

SEQ ID NO: 89626 - DNA, 20 bp, Artificial Sequence
  Description of Artificial Sequence: Synthetic oligonucleotide
  Target: ATXN1; (-) strand; PAM type: NRG; PAM sequence: TAG
cacattttattttattcttg

SEQ ID NO: 89627 - DNA, 20 bp, Artificial Sequence
  Description of Artificial Sequence: Synthetic oligonucleotide
  Target: ATXN1; (-) strand; PAM type: NRG; PAM sequence: CGG
ctttcttcctttggatagat

SEQ ID NO: 89628 - DNA, 20 bp, Artificial Sequence
  Description of Artificial Sequence: Synthetic oligonucleotide
  Target: ATXN1; (-) strand; PAM type: NRG; PAM sequence: TAG
ttttgctttcttcctttgga

SEQ ID NO: 89629 - DNA, 20 bp, Artificial Sequence
  Description of Artificial Sequence: Synthetic oligonucleotide
  Target: ATXN1; (-) strand; PAM type: NRG; PAM sequence: TGG
tttgttttgctttcttcctt

SEQ ID NO: 89630 - DNA, 20 bp, Artificial Sequence
  Description of Artificial Sequence: Synthetic oligonucleotide
  Target: ATXN1; (-) strand; PAM type: NRG; PAM sequence: TGG
ttcatttaatgttttctact

SEQ ID NO: 89631 - DNA, 20 bp, Artificial Sequence
  Description of Artificial Sequence: Synthetic oligonucleotide
  Target: ATXN1; (-) strand; PAM type: NRG; PAM sequence: TAG
atcatttttattaagatttt

SEQ ID NO: 89632 - DNA, 20 bp, Artificial Sequence
  Description of Artificial Sequence: Synthetic oligonucleotide
  Target: ATXN1; (-) strand; PAM type: NRG; PAM sequence: AAG
ttactgtaatcatttttatt

SEQ ID NO: 89633 - DNA, 20 bp, Artificial Sequence
  Description of Artificial Sequence: Synthetic oligonucleotide
  Target: ATXN1; (-) strand; PAM type: NRG; PAM sequence: CAG
ttgattagtgactttatacc

SEQ ID NO: 89634 - DNA, 20 bp, Artificial Sequence
  Description of Artificial Sequence: Synthetic oligonucleotide
  Target: ATXN1; (-) strand; PAM type: NRG; PAM sequence: TAG
acttgtctctgttatttgat

SEQ ID NO: 89635 - DNA, 20 bp, Artificial Sequence
  Description of Artificial Sequence: Synthetic oligonucleotide
  Target: ATXN1; (-) strand; PAM type: NRG; PAM sequence: TAG
cccccaccacatattgtgca

SEQ ID NO: 89636 - DNA, 20 bp, Artificial Sequence
  Description of Artificial Sequence: Synthetic oligonucleotide
  Target: ATXN1; (-) strand; PAM type: NRG; PAM sequence: TAG
tttcttttttaaaaatcttt

SEQ ID NO: 89637 - DNA, 20 bp, Artificial Sequence
  Description of Artificial Sequence: Synthetic oligonucleotide
  Target: ATXN1; (-) strand; PAM type: NRG; PAM sequence: TAG
gctatcctggtttttgtttt

SEQ ID NO: 89638 - DNA, 20 bp, Artificial Sequence
  Description of Artificial Sequence: Synthetic oligonucleotide
  Target: ATXN1; (-) strand; PAM type: NRG; PAM sequence: TGG
tgatattcagagtgctatcc

SEQ ID NO: 89639 - DNA, 20 bp, Artificial Sequence
  Description of Artificial Sequence: Synthetic oligonucleotide
  Target: ATXN1; (-) strand; PAM type: NRG; PAM sequence: GAG
tccattttgtctgatattca

SEQ ID NO: 89640 - DNA, 20 bp, Artificial Sequence
  Description of Artificial Sequence: Synthetic oligonucleotide
  Target: ATXN1; (-) strand; PAM type: NRG; PAM sequence: CAG
attccattttgtctgatatt

SEQ ID NO: 89641 - DNA, 20 bp, Artificial Sequence
  Description of Artificial Sequence: Synthetic oligonucleotide
  Target: ATXN1; (-) strand; PAM type: NRG; PAM sequence: AGG
gttgttccttttgccagcct

SEQ ID NO: 89642 - DNA, 20 bp, Artificial Sequence
  Description of Artificial Sequence: Synthetic oligonucleotide
  Target: ATXN1; (-) strand; PAM type: NRG; PAM sequence: TAG
ggttgttccttttgccagcc

SEQ ID NO: 89643 - DNA, 20 bp, Artificial Sequence
  Description of Artificial Sequence: Synthetic oligonucleotide
  Target: ATXN1; (-) strand; PAM type: NRG; PAM sequence: CAG
ttattggttgttccttttgc

SEQ ID NO: 89644 - DNA, 20 bp, Artificial Sequence
  Description of Artificial Sequence: Synthetic oligonucleotide
  Target: ATXN1; (-) strand; PAM type: NRG; PAM sequence: TGG
gattataaaatcatctttat

SEQ ID NO: 89645 - DNA, 20 bp, Artificial Sequence
  Description of Artificial Sequence: Synthetic oligonucleotide
  Target: ATXN1; (-) strand; PAM type: NRG; PAM sequence: TAG
atatctctgtgccattttgt

SEQ ID NO: 89646 - DNA, 20 bp, Artificial Sequence
  Description of Artificial Sequence: Synthetic oligonucleotide
  Target: ATXN1; (-) strand; PAM type: NRG; PAM sequence: TAG
tatttatttatttctcttca

SEQ ID NO: 89647 - DNA, 20 bp, Artificial Sequence
  Description of Artificial Sequence: Synthetic oligonucleotide
  Target: ATXN1; (-) strand; PAM type: NRG; PAM sequence: AAG
cacagacgtggggaattttt

SEQ ID NO: 89648 - DNA, 20 bp, Artificial Sequence
  Description of Artificial Sequence: Synthetic oligonucleotide
  Target: ATXN1; (-) strand; PAM type: NRG; PAM sequence: GGG
cattttaattcacagacgtg

SEQ ID NO: 89649 - DNA, 20 bp, Artificial Sequence
  Description of Artificial Sequence: Synthetic oligonucleotide
  Target: ATXN1; (-) strand; PAM type: NRG; PAM sequence: GGG
acattttaattcacagacgt

SEQ ID NO: 89650 - DNA, 20 bp, Artificial Sequence
  Description of Artificial Sequence: Synthetic oligonucleotide
  Target: ATXN1; (-) strand; PAM type: NRG; PAM sequence: TGG
aacattttaattcacagacg

SEQ ID NO: 89651 - DNA, 20 bp, Artificial Sequence
  Description of Artificial Sequence: Synthetic oligonucleotide
  Target: ATXN1; (-) strand; PAM type: NRG; PAM sequence: CAG
gtagtaaacattttaattca

SEQ ID NO: 89652 - DNA, 20 bp, Artificial Sequence
  Description of Artificial Sequence: Synthetic oligonucleotide
  Target: ATXN1; (-) strand; PAM type: NRG; PAM sequence: TAG
ttcctctgggaattgtctag

SEQ ID NO: 89653 - DNA, 20 bp, Artificial Sequence
  Description of Artificial Sequence: Synthetic oligonucleotide
  Target: ATXN1; (-) strand; PAM type: NRG; PAM sequence: TAG
tatttcctctgggaattgtc

SEQ ID NO: 89654 - DNA, 20 bp, Artificial Sequence
  Description of Artificial Sequence: Synthetic oligonucleotide
  Target: ATXN1; (-) strand; PAM type: NRG; PAM sequence: GGG
atttccattttatttcctct

SEQ ID NO: 89655 - DNA, 20 bp, Artificial Sequence
  Description of Artificial Sequence: Synthetic oligonucleotide
  Target: ATXN1; (-) strand; PAM type: NRG; PAM sequence: TGG
tatttccattttatttcctc

SEQ ID NO: 89656 - DNA, 20 bp, Artificial Sequence
  Description of Artificial Sequence: Synthetic oligonucleotide
  Target: ATXN1; (-) strand; PAM type: NRG; PAM sequence: CAG
acttttattgtcacttaact

SEQ ID NO: 89657 - DNA, 20 bp, Artificial Sequence
  Description of Artificial Sequence: Synthetic oligonucleotide
  Target: ATXN1; (-) strand; PAM type: NRG; PAM sequence: GAG
ttcagccgaggtcttgcaat

SEQ ID NO: 89658 - DNA, 20 bp, Artificial Sequence
  Description of Artificial Sequence: Synthetic oligonucleotide
  Target: ATXN1; (-) strand; PAM type: NRG; PAM sequence: AGG
ggctgttcagacttcagccg

SEQ ID NO: 89659 - DNA, 20 bp, Artificial Sequence
  Description of Artificial Sequence: Synthetic oligonucleotide
  Target: ATXN1; (-) strand; PAM type: NRG; PAM sequence: GAG
aggctgttcagacttcagcc

SEQ ID NO: 89660 - DNA, 20 bp, Artificial Sequence
  Description of Artificial Sequence: Synthetic oligonucleotide
  Target: ATXN1; (-) strand; PAM type: NRG; PAM sequence: CAG
gctgcaggctgttcagactt

SEQ ID NO: 89661 - DNA, 20 bp, Artificial Sequence
  Description of Artificial Sequence: Synthetic oligonucleotide
  Target: ATXN1; (-) strand; PAM type: NRG; PAM sequence: CAG
tacaagagctgcaggctgtt

SEQ ID NO: 89662 - DNA, 20 bp, Artificial Sequence
  Description of Artificial Sequence: Synthetic oligonucleotide
  Target: ATXN1; (-) strand; PAM type: NRG; PAM sequence: AGG
aatatggctacaagagctgc

SEQ ID NO: 89663 - DNA, 20 bp, Artificial Sequence
  Description of Artificial Sequence: Synthetic oligonucleotide
  Target: ATXN1; (-) strand; PAM type: NRG; PAM sequence: CAG
gaatatggctacaagagctg

SEQ ID NO: 89664 - DNA, 20 bp, Artificial Sequence
  Description of Artificial Sequence: Synthetic oligonucleotide
  Target: ATXN1; (-) strand; PAM type: NRG; PAM sequence: GAG
tgatctgaatatggctacaa

SEQ ID NO: 89665 - DNA, 20 bp, Artificial Sequence
  Description of Artificial Sequence: Synthetic oligonucleotide
  Target: ATXN1; (-) strand; PAM type: NRG; PAM sequence: AAG
actgatctgaatatggctac

SEQ ID NO: 89666 - DNA, 20 bp, Artificial Sequence
  Description of Artificial Sequence: Synthetic oligonucleotide
  Target: ATXN1; (-) strand; PAM type: NRG; PAM sequence: TGG
gaaatctactgatctgaata

SEQ ID NO: 89667 - DNA, 20 bp, Artificial Sequence
  Description of Artificial Sequence: Synthetic oligonucleotide
  Target: ATXN1; (-) strand; PAM type: NRG; PAM sequence: TAG
ctctggcaattctccttgtc

SEQ ID NO: 89668 - DNA, 20 bp, Artificial Sequence
  Description of Artificial Sequence: Synthetic oligonucleotide
  Target: ATXN1; (-) strand; PAM type: NRG; PAM sequence: TGG
atgaaatgaccctttaactc

SEQ ID NO: 89669 - DNA, 20 bp, Artificial Sequence
  Description of Artificial Sequence: Synthetic oligonucleotide
  Target: ATXN1; (-) strand; PAM type: NRG; PAM sequence: AAG
gattgatgtatcttcctaat

SEQ ID NO: 89670 - DNA, 20 bp, Artificial Sequence
  Description of Artificial Sequence: Synthetic oligonucleotide
  Target: ATXN1; (-) strand; PAM type: NRG; PAM sequence: AAG
tcctaggtacacacactttt

SEQ ID NO: 89671 - DNA, 20 bp, Artificial Sequence
  Description of Artificial Sequence: Synthetic oligonucleotide
  Target: ATXN1; (-) strand; PAM type: NRG; PAM sequence: AGG
ttctttttttttctgttcct

SEQ ID NO: 89672 - DNA, 20 bp, Artificial Sequence
  Description of Artificial Sequence: Synthetic oligonucleotide
  Target: ATXN1; (-) strand; PAM type: NRG; PAM sequence: TAG
cttctttttttttctgttcc

SEQ ID NO: 89673 - DNA, 20 bp, Artificial Sequence
  Description of Artificial Sequence: Synthetic oligonucleotide
  Target: ATXN1; (-) strand; PAM type: NRG; PAM sequence: TGG
taggcatgagacaccgtgcc

SEQ ID NO: 89674 - DNA, 20 bp, Artificial Sequence
  Description of Artificial Sequence: Synthetic oligonucleotide
  Target: ATXN1; (-) strand; PAM type: NRG; PAM sequence: GAG
agtgctaggattataggcat

SEQ ID NO: 89675 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctaggattat

SEQ ID NO: 89676 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtgctaggatta

SEQ ID NO: 89677 - DNA, 20 bp, Artificial Sequence
  Description of Artificial Sequence: Synthetic oligonucleotide
  Target: ATXN1; (-) strand; PAM type: NRG; PAM sequence: AGG
ccttggcctcccaaagtgct

SEQ ID NO: 89678 - DNA, 20 bp, Artificial Sequence
  Description of Artificial Sequence: Synthetic oligonucleotide
  Target: ATXN1; (-) strand; PAM type: NRG; PAM sequence: TAG
gccttggcctcccaaagtgc

SEQ ID NO: 89679 - DNA, 20 bp, Artificial Sequence
  Description of Artificial Sequence: Synthetic oligonucleotide
  Target: ATXN1; (-) strand; PAM type: NRG; PAM sequence: AAG
ccacctgccttggcctccca

SEQ ID NO: 89680 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgttccacctgcct

SEQ ID NO: 89681 - DNA, 20 bp, Artificial Sequence
  Description of Artificial Sequence: Synthetic oligonucleotide
  Target: ATXN1; (-) strand; PAM type: NRG; PAM sequence: AGG
ggtcttgaactcctgacctc

SEQ ID NO: 89682 - DNA, 20 bp, Artificial Sequence
  Description of Artificial Sequence: Synthetic oligonucleotide
  Target: ATXN1; (-) strand; PAM type: NRG; PAM sequence: CAG
tggtcttgaactcctgacct

SEQ ID NO: 89683 - DNA, 20 bp, Artificial Sequence
  Description of Artificial Sequence: Synthetic oligonucleotide
  Target: ATXN1; (-) strand; PAM type: NRG; PAM sequence: TGG
tttcgccacgttggccaggc

SEQ ID NO: 89684 - DNA, 20 bp, Artificial Sequence
  Description of Artificial Sequence: Synthetic oligonucleotide
  Target: ATXN1; (-) strand; PAM type: NRG; PAM sequence: AGG
agggtttcgccacgttggcc

SEQ ID NO: 89685 - DNA, 20 bp, Artificial Sequence
  Description of Artificial Sequence: Synthetic oligonucleotide
  Target: ATXN1; (-) strand; PAM type: NRG; PAM sequence: CAG
cagggtttcgccacgttggc

SEQ ID NO: 89686 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcgccacgt

SEQ ID NO: 89687 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 89688 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 89689 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 89690 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 89691 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 89692 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 89693 - DNA, 20 bp, Artificial Sequence
  Description of Artificial Sequence: Synthetic oligonucleotide
  Target: ATXN1; (-) strand; PAM type: NRG; PAM sequence: CAG
caggcatgcaccaccgtgcc

SEQ ID NO: 89694 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 89695 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 89696 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 89697 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 89698 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 89699 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 89700 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 89701 - DNA, 20 bp, Artificial Sequence
  Description of Artificial Sequence: Synthetic oligonucleotide
  Target: ATXN1; (-) strand; PAM type: NRG; PAM sequence: AAG
aaactctgttccctgggttc

SEQ ID NO: 89702 - DNA, 20 bp, Artificial Sequence
  Description of Artificial Sequence: Synthetic oligonucleotide
  Target: ATXN1; (-) strand; PAM type: NRG; PAM sequence: GGG
cactgcaaactctgttccct

SEQ ID NO: 89703 - DNA, 20 bp, Artificial Sequence
  Description of Artificial Sequence: Synthetic oligonucleotide
  Target: ATXN1; (-) strand; PAM type: NRG; PAM sequence: TGG
tcactgcaaactctgttccc

SEQ ID NO: 89704 - DNA, 20 bp, Artificial Sequence
  Description of Artificial Sequence: Synthetic oligonucleotide
  Target: ATXN1; (-) strand; PAM type: NRG; PAM sequence: TGG
ggagttcagtggcacaatct

SEQ ID NO: 89705 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagttcag

SEQ ID NO: 89706 - DNA, 20 bp, Artificial Sequence
  Description of Artificial Sequence: Synthetic oligonucleotide
  Target: ATXN1; (-) strand; PAM type: NRG; PAM sequence: CAG
ctttcacccaggctggagtt

SEQ ID NO: 89707 - DNA, 20 bp, Artificial Sequence
  Description of Artificial Sequence: Synthetic oligonucleotide
  Target: ATXN1; (-) strand; PAM type: NRG; PAM sequence: GAG
tcgctctttcacccaggctg

SEQ ID NO: 89708 - DNA, 20 bp, Artificial Sequence
  Description of Artificial Sequence: Synthetic oligonucleotide
  Target: ATXN1; (-) strand; PAM type: NRG; PAM sequence: TGG
tttcgctctttcacccaggc

SEQ ID NO: 89709 - DNA, 20 bp, Artificial Sequence
  Description of Artificial Sequence: Synthetic oligonucleotide
  Target: ATXN1; (-) strand; PAM type: NRG; PAM sequence: AGG
agagtttcgctctttcaccc

SEQ ID NO: 89710 - DNA, 20 bp, Artificial Sequence
  Description of Artificial Sequence: Synthetic oligonucleotide
  Target: ATXN1; (-) strand; PAM type: NRG; PAM sequence: CAG
cagagtttcgctctttcacc

SEQ ID NO: 89711 - DNA, 20 bp, Artificial Sequence
  Description of Artificial Sequence: Synthetic oligonucleotide
  Target: ATXN1; (-) strand; PAM type: NRG; PAM sequence: GAG
ctttttttttttttgagaca

SEQ ID NO: 89712 - DNA, 20 bp, Artificial Sequence
  Description of Artificial Sequence: Synthetic oligonucleotide
  Target: ATXN1; (-) strand; PAM type: NRG; PAM sequence: CAG
ttctttttttttttttgaga

SEQ ID NO: 89713 - DNA, 20 bp, Artificial Sequence
  Description of Artificial Sequence: Synthetic oligonucleotide
  Target: ATXN1; (-) strand; PAM type: NRG; PAM sequence: GAG
tcttttcttttttttttttt

SEQ ID NO: 89714 - DNA, 20 bp, Artificial Sequence
  Description of Artificial Sequence: Synthetic oligonucleotide
  Target: ATXN1; (-) strand; PAM type: NRG; PAM sequence: TGG
ttccttctttttccctactt

SEQ ID NO: 89715 - DNA, 20 bp, Artificial Sequence
  Description of Artificial Sequence: Synthetic oligonucleotide
  Target: ATXN1; (-) strand; PAM type: NRG; PAM sequence: AAG
taattttattaagctcttca

SEQ ID NO: 89716 - DNA, 20 bp, Artificial Sequence
  Description of Artificial Sequence: Synthetic oligonucleotide
  Target: ATXN1; (-) strand; PAM type: NRG; PAM sequence: AAG
agatgttaattaattttatt

SEQ ID NO: 89717 - DNA, 20 bp, Artificial Sequence
  Description of Artificial Sequence: Synthetic oligonucleotide
  Target: ATXN1; (-) strand; PAM type: NRG; PAM sequence: TAG
atttttgtgattagttttgc

SEQ ID NO: 89718 - DNA, 20 bp, Artificial Sequence
  Description of Artificial Sequence: Synthetic oligonucleotide
  Target: ATXN1; (-) strand; PAM type: NRG; PAM sequence: TAG
catttacttatttttgtgat

SEQ ID NO: 89719 - DNA, 20 bp, Artificial Sequence
  Description of Artificial Sequence: Synthetic oligonucleotide
  Target: ATXN1; (-) strand; PAM type: NRG; PAM sequence: TAG
tttagtgtctgtaggattta

SEQ ID NO: 89720 - DNA, 20 bp, Artificial Sequence
  Description of Artificial Sequence: Synthetic oligonucleotide
  Target: ATXN1; (-) strand; PAM type: NRG; PAM sequence: AGG
cttatctatttagtgtctgt

SEQ ID NO: 89721 - DNA, 20 bp, Artificial Sequence
  Description of Artificial Sequence: Synthetic oligonucleotide
  Target: ATXN1; (-) strand; PAM type: NRG; PAM sequence: TAG
tcttatctatttagtgtctg

SEQ ID NO: 89722 - DNA, 20 bp, Artificial Sequence
  Description of Artificial Sequence: Synthetic oligonucleotide
  Target: ATXN1; (-) strand; PAM type: NRG; PAM sequence: TAG
atactttcttcttatctatt

SEQ ID NO: 89723 - DNA, 20 bp, Artificial Sequence
  Description of Artificial Sequence: Synthetic oligonucleotide
  Target: ATXN1; (-) strand; PAM type: NRG; PAM sequence: TAG
atttattgacataaagtttt

SEQ ID NO: 89724 - DNA, 20 bp, Artificial Sequence
  Description of Artificial Sequence: Synthetic oligonucleotide
  Target: ATXN1; (-) strand; PAM type: NRG; PAM sequence: AAG
ttgtgagatttattgacata

SEQ ID NO: 89725 - DNA, 20 bp, Artificial Sequence
  Description of Artificial Sequence: Synthetic oligonucleotide
  Target: ATXN1; (-) strand; PAM type: NRG; PAM sequence: GAG
ttttatttcatccaagttgt

SEQ ID NO: 89726 - DNA, 20 bp, Artificial Sequence
  Description of Artificial Sequence: Synthetic oligonucleotide
  Target: ATXN1; (-) strand; PAM type: NRG; PAM sequence: AAG
agaagttttttatttcatcc

SEQ ID NO: 89727 - DNA, 20 bp, Artificial Sequence
  Description of Artificial Sequence: Synthetic oligonucleotide
  Target: ATXN1; (-) strand; PAM type: NRG; PAM sequence: AAG
tatgctttctatttttcaag

SEQ ID NO: 89728 - DNA, 20 bp, Artificial Sequence
  Description of Artificial Sequence: Synthetic oligonucleotide
  Target: ATXN1; (-) strand; PAM type: NRG; PAM sequence: AAG
agttatgctttctatttttc

SEQ ID NO: 89729 - DNA, 20 bp, Artificial Sequence
  Description of Artificial Sequence: Synthetic oligonucleotide
  Target: ATXN1; (-) strand; PAM type: NRG; PAM sequence: AAG
tgtttattcttgctattggt

SEQ ID NO: 89730 - DNA, 20 bp, Artificial Sequence
  Description of Artificial Sequence: Synthetic oligonucleotide
  Target: ATXN1; (-) strand; PAM type: NRG; PAM sequence: TGG
tttctgtttattcttgctat

SEQ ID NO: 89731 - DNA, 20 bp, Artificial Sequence
  Description of Artificial Sequence: Synthetic oligonucleotide
  Target: ATXN1; (-) strand; PAM type: NRG; PAM sequence: CAG
ttaacatatagccaactctt

SEQ ID NO: 89732 - DNA, 20 bp, Artificial Sequence
  Description of Artificial Sequence: Synthetic oligonucleotide
  Target: ATXN1; (-) strand; PAM type: NRG; PAM sequence: TAG
gaattcaatttcttaacata

SEQ ID NO: 89733 - DNA, 20 bp, Artificial Sequence
  Description of Artificial Sequence: Synthetic oligonucleotide
  Target: ATXN1; (-) strand; PAM type: NRG; PAM sequence: AGG
gttgtatcatcattgtgcca

SEQ ID NO: 89734 - DNA, 20 bp, Artificial Sequence
  Description of Artificial Sequence: Synthetic oligonucleotide
  Target: ATXN1; (-) strand; PAM type: NRG; PAM sequence: AAG
agttgtatcatcattgtgcc

SEQ ID NO: 89735 - DNA, 20 bp, Artificial Sequence
  Description of Artificial Sequence: Synthetic oligonucleotide
  Target: ATXN1; (-) strand; PAM type: NRG; PAM sequence: CAG
accacaatcaggatacagaa

SEQ ID NO: 89736 - DNA, 20 bp, Artificial Sequence
  Description of Artificial Sequence: Synthetic oligonucleotide
  Target: ATXN1; (-) strand; PAM type: NRG; PAM sequence: CAG
ctaccaccacaatcaggata

SEQ ID NO: 89737 - DNA, 20 bp, Artificial Sequence
  Description of Artificial Sequence: Synthetic oligonucleotide
  Target: ATXN1; (-) strand; PAM type: NRG; PAM sequence: AGG
gcataactaccaccacaatc

SEQ ID NO: 89738 - DNA, 20 bp, Artificial Sequence
  Description of Artificial Sequence: Synthetic oligonucleotide
  Target: ATXN1; (-) strand; PAM type: NRG; PAM sequence: CAG
tgcataactaccaccacaat

SEQ ID NO: 89739 - DNA, 20 bp, Artificial Sequence
  Description of Artificial Sequence: Synthetic oligonucleotide
  Target: ATXN1; (-) strand; PAM type: NRG; PAM sequence: GAG
tatgcattttaacatgtgta

SEQ ID NO: 89740 - DNA, 20 bp, Artificial Sequence
  Description of Artificial Sequence: Synthetic oligonucleotide
  Target: ATXN1; (-) strand; PAM type: NRG; PAM sequence: TAG
tctatgcattttaacatgtg

SEQ ID NO: 89741 - DNA, 20 bp, Artificial Sequence
  Description of Artificial Sequence: Synthetic oligonucleotide
  Target: ATXN1; (-) strand; PAM type: NRG; PAM sequence: AAG
tttaatttaaaaacattata

SEQ ID NO: 89742 - DNA, 20 bp, Artificial Sequence
  Description of Artificial Sequence: Synthetic oligonucleotide
  Target: ATXN1; (-) strand; PAM type: NRG; PAM sequence: AAG
tctctttgtgtgaaggttct

SEQ ID NO: 89743 - DNA, 20 bp, Artificial Sequence
  Description of Artificial Sequence: Synthetic oligonucleotide
  Target: ATXN1; (-) strand; PAM type: NRG; PAM sequence: AGG
ttggagttctctttgtgtga

SEQ ID NO: 89744 - DNA, 20 bp, Artificial Sequence
  Description of Artificial Sequence: Synthetic oligonucleotide
  Target: ATXN1; (-) strand; PAM type: NRG; PAM sequence: AAG
cttggagttctctttgtgtg

SEQ ID NO: 89745 - DNA, 20 bp, Artificial Sequence
  Description of Artificial Sequence: Synthetic oligonucleotide
  Target: ATXN1; (-) strand; PAM type: NRG; PAM sequence: GAG
cagtgaaatctttgggcttg

SEQ ID NO: 89746 - DNA, 20 bp, Artificial Sequence
  Description of Artificial Sequence: Synthetic oligonucleotide
  Target: ATXN1; (-) strand; PAM type: NRG; PAM sequence: TGG
cacagtgaaatctttgggct

SEQ ID NO: 89747 - DNA, 20 bp, Artificial Sequence
  Description of Artificial Sequence: Synthetic oligonucleotide
  Target: ATXN1; (-) strand; PAM type: NRG; PAM sequence: GGG
aattccacagtgaaatcttt

SEQ ID NO: 89748 - DNA, 20 bp, Artificial Sequence
  Description of Artificial Sequence: Synthetic oligonucleotide
  Target: ATXN1; (-) strand; PAM type: NRG; PAM sequence: TGG
aaattccacagtgaaatctt

SEQ ID NO: 89749 - DNA, 20 bp, Artificial Sequence
  Description of Artificial Sequence: Synthetic oligonucleotide
  Target: ATXN1; (-) strand; PAM type: NRG; PAM sequence: CAG
ttaaaattgatgaaattcca

SEQ ID NO: 89750 - DNA, 20 bp, Artificial Sequence
  Description of Artificial Sequence: Synthetic oligonucleotide
  Target: ATXN1; (-) strand; PAM type: NRG; PAM sequence: AAG
ttttctgaaagaatttatgt

SEQ ID NO: 89751 - DNA, 20 bp, Artificial Sequence
  Description of Artificial Sequence: Synthetic oligonucleotide
  Target: ATXN1; (-) strand; PAM type: NRG; PAM sequence: AAG
tgttttttactattttctga

SEQ ID NO: 89752 - DNA, 20 bp, Artificial Sequence
  Description of Artificial Sequence: Synthetic oligonucleotide
  Target: ATXN1; (-) strand; PAM type: NRG; PAM sequence: GAG
ttatataaaatgtattcgtg

SEQ ID NO: 89753 - DNA, 20 bp, Artificial Sequence
  Description of Artificial Sequence: Synthetic oligonucleotide
  Target: ATXN1; (-) strand; PAM type: NRG; PAM sequence: TGG
gattatataaaatgtattcg

SEQ ID NO: 89754 - DNA, 20 bp, Artificial Sequence
  Description of Artificial Sequence: Synthetic oligonucleotide
  Target: ATXN1; (-) strand; PAM type: NRG; PAM sequence: TAG
ctagggtttagtgttagtgt

SEQ ID NO: 89755 - DNA, 20 bp, Artificial Sequence
  Description of Artificial Sequence: Synthetic oligonucleotide
  Target: ATXN1; (-) strand; PAM type: NRG; PAM sequence: TAG
tatttactagggtttagtgt

SEQ ID NO: 89756 - DNA, 20 bp, Artificial Sequence
  Description of Artificial Sequence: Synthetic oligonucleotide
  Target: ATXN1; (-) strand; PAM type: NRG; PAM sequence: TAG
atataatatttactagggtt

SEQ ID NO: 89757 - DNA, 20 bp, Artificial Sequence
  Description of Artificial Sequence: Synthetic oligonucleotide
  Target: ATXN1; (-) strand; PAM type: NRG; PAM sequence: GGG
tctttatataatatttacta

SEQ ID NO: 89758 - DNA, 20 bp, Artificial Sequence
  Description of Artificial Sequence: Synthetic oligonucleotide
  Target: ATXN1; (-) strand; PAM type: NRG; PAM sequence: AGG
ttctttatataatatttact

SEQ ID NO: 89759 - DNA, 20 bp, Artificial Sequence
  Description of Artificial Sequence: Synthetic oligonucleotide
  Target: ATXN1; (-) strand; PAM type: NRG; PAM sequence: TAG
tttctttatataatatttac

SEQ ID NO: 89760 - DNA, 20 bp, Artificial Sequence
  Description of Artificial Sequence: Synthetic oligonucleotide
  Target: ATXN1; (-) strand; PAM type: NRG; PAM sequence: TGG
actatgtttattaagaacat

SEQ ID NO: 89761 - DNA, 20 bp, Artificial Sequence
  Description of Artificial Sequence: Synthetic oligonucleotide
  Target: ATXN1; (-) strand; PAM type: NRG; PAM sequence: AAG
tttttgcgactatgtttatt

SEQ ID NO: 89762 - DNA, 20 bp, Artificial Sequence
  Description of Artificial Sequence: Synthetic oligonucleotide
  Target: ATXN1; (-) strand; PAM type: NRG; PAM sequence: AAG
attttggctaacattttatt

SEQ ID NO: 89763 - DNA, 20 bp, Artificial Sequence
  Description of Artificial Sequence: Synthetic oligonucleotide
  Target: ATXN1; (-) strand; PAM type: NRG; PAM sequence: TGG
tgacctattgctggatattt

SEQ ID NO: 89764 - DNA, 20 bp, Artificial Sequence
  Description of Artificial Sequence: Synthetic oligonucleotide
  Target: ATXN1; (-) strand; PAM type: NRG; PAM sequence: TGG
gtgttattttgacctattgc

SEQ ID NO: 89765 - DNA, 20 bp, Artificial Sequence
  Description of Artificial Sequence: Synthetic oligonucleotide
  Target: ATXN1; (-) strand; PAM type: NRG; PAM sequence: CAG
tgagttcctgggataagaac

SEQ ID NO: 89766 - DNA, 20 bp, Artificial Sequence
  Description of Artificial Sequence: Synthetic oligonucleotide
  Target: ATXN1; (-) strand; PAM type: NRG; PAM sequence: AAG
caaacttgagttcctgggat

SEQ ID NO: 89767 - DNA, 20 bp, Artificial Sequence
  Description of Artificial Sequence: Synthetic oligonucleotide
  Target: ATXN1; (-) strand; PAM type: NRG; PAM sequence: GGG
taaaccaaacttgagttcct

SEQ ID NO: 89768 - DNA, 20 bp, Artificial Sequence
  Description of Artificial Sequence: Synthetic oligonucleotide
  Target: ATXN1; (-) strand; PAM type: NRG; PAM sequence: TGG
ttaaaccaaacttgagttcc

SEQ ID NO: 89769 - DNA, 20 bp, Artificial Sequence
  Description of Artificial Sequence: Synthetic oligonucleotide
  Target: ATXN1; (-) strand; PAM type: NRG; PAM sequence: GAG
ttaagtgttaaaccaaactt

SEQ ID NO: 89770 - DNA, 20 bp, Artificial Sequence
  Description of Artificial Sequence: Synthetic oligonucleotide
  Target: ATXN1; (-) strand; PAM type: NRG; PAM sequence: AAG
gaattatattgattggtttt

SEQ ID NO: 89771 - DNA, 20 bp, Artificial Sequence
  Description of Artificial Sequence: Synthetic oligonucleotide
  Target: ATXN1; (-) strand; PAM type: NRG; PAM sequence: TGG
atgtggtgaattatattgat

SEQ ID NO: 89772 - DNA, 20 bp, Artificial Sequence
  Description of Artificial Sequence: Synthetic oligonucleotide
  Target: ATXN1; (-) strand; PAM type: NRG; PAM sequence: TGG
atatggttttccgctttatg

SEQ ID NO: 89773 - DNA, 20 bp, Artificial Sequence
  Description of Artificial Sequence: Synthetic oligonucleotide
  Target: ATXN1; (-) strand; PAM type: NRG; PAM sequence: TGG
gcctctgttgagatgtcata

SEQ ID NO: 89774 - DNA, 20 bp, Artificial Sequence
  Description of Artificial Sequence: Synthetic oligonucleotide
  Target: ATXN1; (-) strand; PAM type: NRG; PAM sequence: GAG
agttcatttttgcctctgtt

SEQ ID NO: 89775 - DNA, 20 bp, Artificial Sequence
  Description of Artificial Sequence: Synthetic oligonucleotide
  Target: ATXN1; (-) strand; PAM type: NRG; PAM sequence: CAG
aatgtgtgttgaattttgtg

SEQ ID NO: 89776 - DNA, 20 bp, Artificial Sequence
  Description of Artificial Sequence: Synthetic oligonucleotide
  Target: ATXN1; (-) strand; PAM type: NRG; PAM sequence: GGG
tgtgtttgtttgtttttatc

SEQ ID NO: 89777 - DNA, 20 bp, Artificial Sequence
  Description of Artificial Sequence: Synthetic oligonucleotide
  Target: ATXN1; (-) strand; PAM type: NRG; PAM sequence: CGG
ttgtgtttgtttgtttttat

SEQ ID NO: 89778 - DNA, 20 bp, Artificial Sequence
  Description of Artificial Sequence: Synthetic oligonucleotide
  Target: ATXN1; (-) strand; PAM type: NRG; PAM sequence: AAG
ccttctattctcttttttct

SEQ ID NO: 89779 - DNA, 20 bp, Artificial Sequence
  Description of Artificial Sequence: Synthetic oligonucleotide
  Target: ATXN1; (-) strand; PAM type: NRG; PAM sequence: AAG
tgccttttattggattgacg

SEQ ID NO: 89780 - DNA, 20 bp, Artificial Sequence
  Description of Artificial Sequence: Synthetic oligonucleotide
  Target: ATXN1; (-) strand; PAM type: NRG; PAM sequence: TGG
gtttttcatttgccttttat

SEQ ID NO: 89781 - DNA, 20 bp, Artificial Sequence
  Description of Artificial Sequence: Synthetic oligonucleotide
  Target: ATXN1; (-) strand; PAM type: NRG; PAM sequence: AGG
ttcatcatgatgttagctgt

SEQ ID NO: 89782 - DNA, 20 bp, Artificial Sequence
  Description of Artificial Sequence: Synthetic oligonucleotide
  Target: ATXN1; (-) strand; PAM type: NRG; PAM sequence: TAG
tttcatcatgatgttagctg

SEQ ID NO: 89783 - DNA, 20 bp, Artificial Sequence
  Description of Artificial Sequence: Synthetic oligonucleotide
  Target: ATXN1; (-) strand; PAM type: NRG; PAM sequence: TAG
ccactatttcatcatgatgt

SEQ ID NO: 89784 - DNA, 20 bp, Artificial Sequence
  Description of Artificial Sequence: Synthetic oligonucleotide
  Target: ATXN1; (-) strand; PAM type: NRG; PAM sequence: AAG
tttttctgatcgtacaggga

SEQ ID NO: 89785 - DNA, 20 bp, Artificial Sequence
  Description of Artificial Sequence: Synthetic oligonucleotide
  Target: ATXN1; (-) strand; PAM type: NRG; PAM sequence: GGG
actttttttctgatcgtaca

SEQ ID NO: 89786 - DNA, 20 bp, Artificial Sequence
  Description of Artificial Sequence: Synthetic oligonucleotide
  Target: ATXN1; (-) strand; PAM type: NRG; PAM sequence: AGG
gactttttttctgatcgtac

SEQ ID NO: 89787 - DNA, 20 bp, Artificial Sequence
  Description of Artificial Sequence: Synthetic oligonucleotide
  Target: ATXN1; (-) strand; PAM type: NRG; PAM sequence: CAG
ggactttttttctgatcgta

SEQ ID NO: 89788 - DNA, 20 bp, Artificial Sequence
  Description of Artificial Sequence: Synthetic oligonucleotide
  Target: ATXN1; (-) strand; PAM type: NRG; PAM sequence: AGG
ttcaaattatttatataacc

SEQ ID NO: 89789 - DNA, 20 bp, Artificial Sequence
  Description of Artificial Sequence: Synthetic oligonucleotide
  Target: ATXN1; (-) strand; PAM type: NRG; PAM sequence: CAG
tttcaaattatttatataac

SEQ ID NO: 89790 - DNA, 20 bp, Artificial Sequence
  Description of Artificial Sequence: Synthetic oligonucleotide
  Target: ATXN1; (-) strand; PAM type: NRG; PAM sequence: TGG
gcagagacattgcatatctt

SEQ ID NO: 89791 - DNA, 20 bp, Artificial Sequence
  Description of Artificial Sequence: Synthetic oligonucleotide
  Target: ATXN1; (-) strand; PAM type: NRG; PAM sequence: GAG
gtttccctgtttttcctgca

SEQ ID NO: 89792 - DNA, 20 bp, Artificial Sequence
  Description of Artificial Sequence: Synthetic oligonucleotide
  Target: ATXN1; (-) strand; PAM type: NRG; PAM sequence: CAG
atgtttccctgtttttcctg

SEQ ID NO: 89793 - DNA, 20 bp, Artificial Sequence
  Description of Artificial Sequence: Synthetic oligonucleotide
  Target: ATXN1; (-) strand; PAM type: NRG; PAM sequence: AGG
ctttttaatgaatttctgcc

SEQ ID NO: 89794 - DNA, 20 bp, Artificial Sequence
  Description of Artificial Sequence: Synthetic oligonucleotide
  Target: ATXN1; (-) strand; PAM type: NRG; PAM sequence: CAG
cctttttaatgaatttctgc

SEQ ID NO: 89795 - DNA, 20 bp, Artificial Sequence
  Description of Artificial Sequence: Synthetic oligonucleotide
  Target: ATXN1; (-) strand; PAM type: NRG; PAM sequence: CGG
gaaacttcaattcaaaaaca

SEQ ID NO: 89796 - DNA, 20 bp, Artificial Sequence
  Description of Artificial Sequence: Synthetic oligonucleotide
  Target: ATXN1; (-) strand; PAM type: NRG; PAM sequence: AGG
aatcataagagagaaattta

SEQ ID NO: 89797 - DNA, 20 bp, Artificial Sequence
  Description of Artificial Sequence: Synthetic oligonucleotide
  Target: ATXN1; (-) strand; PAM type: NRG; PAM sequence: AAG
gaatcataagagagaaattt

SEQ ID NO: 89798 - DNA, 20 bp, Artificial Sequence
  Description of Artificial Sequence: Synthetic oligonucleotide
  Target: ATXN1; (-) strand; PAM type: NRG; PAM sequence: GAG
gattgcactgaatcataaga

SEQ ID NO: 89799 - DNA, 20 bp, Artificial Sequence
  Description of Artificial Sequence: Synthetic oligonucleotide
  Target: ATXN1; (-) strand; PAM type: NRG; PAM sequence: GAG
cagattgcactgaatcataa

SEQ ID NO: 89800 - DNA, 20 bp, Artificial Sequence
  Description of Artificial Sequence: Synthetic oligonucleotide
  Target: ATXN1; (-) strand; PAM type: NRG; PAM sequence: AAG
ttcagattgcactgaatcat

SEQ ID NO: 89801 - DNA, 20 bp, Artificial Sequence
  Description of Artificial Sequence: Synthetic oligonucleotide
  Target: ATXN1; (-) strand; PAM type: NRG; PAM sequence: CAG
aagcctgttagaagttagtt

SEQ ID NO: 89802 - DNA, 20 bp, Artificial Sequence
  Description of Artificial Sequence: Synthetic oligonucleotide
  Target: ATXN1; (-) strand; PAM type: NRG; PAM sequence: TAG
caaaaaagcctgttagaagt

SEQ ID NO: 89803 - DNA, 20 bp, Artificial Sequence
  Description of Artificial Sequence: Synthetic oligonucleotide
  Target: ATXN1; (-) strand; PAM type: NRG; PAM sequence: AAG
cccccaaaaaagcctgttag

SEQ ID NO: 89804 - DNA, 20 bp, Artificial Sequence
  Description of Artificial Sequence: Synthetic oligonucleotide
  Target: ATXN1; (-) strand; PAM type: NRG; PAM sequence: TAG
taccccccaaaaaagcctgt

SEQ ID NO: 89805 - DNA, 20 bp, Artificial Sequence
  Description of Artificial Sequence: Synthetic oligonucleotide
  Target: ATXN1; (-) strand; PAM type: NRG; PAM sequence: AAG
aatccccctaccccccaaaa

SEQ ID NO: 89806 - DNA, 20 bp, Artificial Sequence
  Description of Artificial Sequence: Synthetic oligonucleotide
  Target: ATXN1; (-) strand; PAM type: NRG; PAM sequence: GAG
gtggtgttctatctccttca

SEQ ID NO: 89807 - DNA, 20 bp, Artificial Sequence
  Description of Artificial Sequence: Synthetic oligonucleotide
  Target: ATXN1; (-) strand; PAM type: NRG; PAM sequence: CAG
tggtggtgttctatctcctt

SEQ ID NO: 89808 - DNA, 20 bp, Artificial Sequence
  Description of Artificial Sequence: Synthetic oligonucleotide
  Target: ATXN1; (-) strand; PAM type: NRG; PAM sequence: TGG
ttccctcaagattattttgg

SEQ ID NO: 89809 - DNA, 20 bp, Artificial Sequence
  Description of Artificial Sequence: Synthetic oligonucleotide
  Target: ATXN1; (-) strand; PAM type: NRG; PAM sequence: TGG
tttttccctcaagattattt

SEQ ID NO: 89810 - DNA, 20 bp, Artificial Sequence
  Description of Artificial Sequence: Synthetic oligonucleotide
  Target: ATXN1; (-) strand; PAM type: NRG; PAM sequence: AAG
tctgtcttgttttttccctc

SEQ ID NO: 89811 - DNA, 20 bp, Artificial Sequence
  Description of Artificial Sequence: Synthetic oligonucleotide
  Target: ATXN1; (-) strand; PAM type: NRG; PAM sequence: GAG
atcttgaaaacagatagcgt

SEQ ID NO: 89812 - DNA, 20 bp, Artificial Sequence
  Description of Artificial Sequence: Synthetic oligonucleotide
  Target: ATXN1; (-) strand; PAM type: NRG; PAM sequence: TAG
tggtaaatcttgaaaacaga

SEQ ID NO: 89813 - DNA, 20 bp, Artificial Sequence
  Description of Artificial Sequence: Synthetic oligonucleotide
  Target: ATXN1; (-) strand; PAM type: NRG; PAM sequence: CAG
tttatggtaaatcttgaaaa

SEQ ID NO: 89814 - DNA, 20 bp, Artificial Sequence
  Description of Artificial Sequence: Synthetic oligonucleotide
  Target: ATXN1; (-) strand; PAM type: NRG; PAM sequence: TGG
ttaaaaactaaatagcttta

SEQ ID NO: 89815 - DNA, 20 bp, Artificial Sequence
  Description of Artificial Sequence: Synthetic oligonucleotide
  Target: ATXN1; (-) strand; PAM type: NRG; PAM sequence: TAG
tgttaaaattaaaaactaaa

SEQ ID NO: 89816 - DNA, 20 bp, Artificial Sequence
  Description of Artificial Sequence: Synthetic oligonucleotide
  Target: ATXN1; (-) strand; PAM type: NRG; PAM sequence: TGG
tccggcctgggtgactgagc

SEQ ID NO: 89817 - DNA, 20 bp, Artificial Sequence
  Description of Artificial Sequence: Synthetic oligonucleotide
  Target: ATXN1; (-) strand; PAM type: NRG; PAM sequence: GAG
gcactccggcctgggtgact

SEQ ID NO: 89818 - DNA, 20 bp, Artificial Sequence
  Description of Artificial Sequence: Synthetic oligonucleotide
  Target: ATXN1; (-) strand; PAM type: NRG; PAM sequence: GGG
atgccactgcactccggcct

SEQ ID NO: 89819 - DNA, 20 bp, Artificial Sequence
  Description of Artificial Sequence: Synthetic oligonucleotide
  Target: ATXN1; (-) strand; PAM type: NRG; PAM sequence: TGG
catgccactgcactccggcc

SEQ ID NO: 89820 - DNA, 20 bp, Artificial Sequence
  Description of Artificial Sequence: Synthetic oligonucleotide
  Target: ATXN1; (-) strand; PAM type: NRG; PAM sequence: CGG
gtgatcatgccactgcactc

SEQ ID NO: 89821 - DNA, 20 bp, Artificial Sequence
  Description of Artificial Sequence: Synthetic oligonucleotide
  Target: ATXN1; (-) strand; PAM type: NRG; PAM sequence: GAG
caggaggttgaggctacagt

SEQ ID NO: 89822 - DNA, 20 bp, Artificial Sequence
  Description of Artificial Sequence: Synthetic oligonucleotide
  Target: ATXN1; (-) strand; PAM type: NRG; PAM sequence: CAG
agcccaggaggttgaggcta

SEQ ID NO: 89823 - DNA, 20 bp, Artificial Sequence
  Description of Artificial Sequence: Synthetic oligonucleotide
  Target: ATXN1; (-) strand; PAM type: NRG; PAM sequence: AGG
cgcttgagcccaggaggttg

SEQ ID NO: 89824 - DNA, 20 bp, Artificial Sequence
  Description of Artificial Sequence: Synthetic oligonucleotide
  Target: ATXN1; (-) strand; PAM type: NRG; PAM sequence: GAG
tcgcttgagcccaggaggtt

SEQ ID NO: 89825 - DNA, 20 bp, Artificial Sequence
  Description of Artificial Sequence: Synthetic oligonucleotide
  Target: ATXN1; (-) strand; PAM type: NRG; PAM sequence: AGG
gaggatcgcttgagcccagg

SEQ ID NO: 89826 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcttgagcccag

SEQ ID NO: 89827 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcgcttgagccc

SEQ ID NO: 89828 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcgcttgagcc

SEQ ID NO: 89829 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggaggatcgctt

SEQ ID NO: 89830 - DNA, 20 bp, Artificial Sequence
  Description of Artificial Sequence: Synthetic oligonucleotide
  Target: ATXN1; (-) strand; PAM type: NRG; PAM sequence: AGG
actggtgaggctgaggtggg

SEQ ID NO: 89831 - DNA, 20 bp, Artificial Sequence
  Description of Artificial Sequence: Synthetic oligonucleotide
  Target: ATXN1; (-) strand; PAM type: NRG; PAM sequence: GAG
tactggtgaggctgaggtgg

SEQ ID NO: 89832 - DNA, 20 bp, Artificial Sequence
  Description of Artificial Sequence: Synthetic oligonucleotide
  Target: ATXN1; (-) strand; PAM type: NRG; PAM sequence: GGG
tctactggtgaggctgaggt

SEQ ID NO: 89833 - DNA, 20 bp, Artificial Sequence
  Description of Artificial Sequence: Synthetic oligonucleotide
  Target: ATXN1; (-) strand; PAM type: NRG; PAM sequence: TGG
atctactggtgaggctgagg

SEQ ID NO: 89834 - DNA, 20 bp, Artificial Sequence
  Description of Artificial Sequence: Synthetic oligonucleotide
  Target: ATXN1; (-) strand; PAM type: NRG; PAM sequence: AGG
cccatctactggtgaggctg

SEQ ID NO: 89835 - DNA, 20 bp, Artificial Sequence
  Description of Artificial Sequence: Synthetic oligonucleotide
  Target: ATXN1; (-) strand; PAM type: NRG; PAM sequence: GAG
tcccatctactggtgaggct

SEQ ID NO: 89836 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccatctactggtg

SEQ ID NO: 89837 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccatctactggt

SEQ ID NO: 89838 - DNA, 20 bp, Artificial Sequence
  Description of Artificial Sequence: Synthetic oligonucleotide
  Target: ATXN1; (-) strand; PAM type: NRG; PAM sequence: TGG
gtgcctgtagtcccatctac

SEQ ID NO: 89839 - DNA, 20 bp, Artificial Sequence
  Description of Artificial Sequence: Synthetic oligonucleotide
  Target: ATXN1; (-) strand; PAM type: NRG; PAM sequence: TAG
ggtgaggtggcatgtgcctg

SEQ ID NO: 89840 - DNA, 20 bp, Artificial Sequence
  Description of Artificial Sequence: Synthetic oligonucleotide
  Target: ATXN1; (-) strand; PAM type: NRG; PAM sequence: TGG
caaaaatcagctgggtgagg

SEQ ID NO: 89841 - DNA, 20 bp, Artificial Sequence
  Description of Artificial Sequence: Synthetic oligonucleotide
  Target: ATXN1; (-) strand; PAM type: NRG; PAM sequence: AGG
atacaaaaatcagctgggtg

SEQ ID NO: 89842 - DNA, 20 bp, Artificial Sequence
  Description of Artificial Sequence: Synthetic oligonucleotide
  Target: ATXN1; (-) strand; PAM type: NRG; PAM sequence: GAG
aatacaaaaatcagctgggt

SEQ ID NO: 89843 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaatcagct

SEQ ID NO: 89844 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaatcagc

SEQ ID NO: 89845 - DNA, 20 bp, Artificial Sequence
  Description of Artificial Sequence: Synthetic oligonucleotide
  Target: ATXN1; (-) strand; PAM type: NRG; PAM sequence: CAG
tctactaaaaatacaaaaat

SEQ ID NO: 89846 - DNA, 20 bp, Artificial Sequence
  Description of Artificial Sequence: Synthetic oligonucleotide
  Target: ATXN1; (-) strand; PAM type: NRG; PAM sequence: TAG
tgagaccagcctgggcagca

SEQ ID NO: 89847 - DNA, 20 bp, Artificial Sequence
  Description of Artificial Sequence: Synthetic oligonucleotide
  Target: ATXN1; (-) strand; PAM type: NRG; PAM sequence: CAG
gagtttgagaccagcctggg

SEQ ID NO: 89848 - DNA, 20 bp, Artificial Sequence
  Description of Artificial Sequence: Synthetic oligonucleotide
  Target: ATXN1; (-) strand; PAM type: NRG; PAM sequence: GGG
caggagtttgagaccagcct

SEQ ID NO: 89849 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagaccagcc

SEQ ID NO: 89850 - DNA, 20 bp, Artificial Sequence
  Description of Artificial Sequence: Synthetic oligonucleotide
  Target: ATXN1; (-) strand; PAM type: NRG; PAM sequence: CAG
tgagctcaggagtttgagac

SEQ ID NO: 89851 - DNA, 20 bp, Artificial Sequence
  Description of Artificial Sequence: Synthetic oligonucleotide
  Target: ATXN1; (-) strand; PAM type: NRG; PAM sequence: GAG
ttgcttgagctcaggagttt

SEQ ID NO: 89852 - DNA, 20 bp, Artificial Sequence
  Description of Artificial Sequence: Synthetic oligonucleotide
  Target: ATXN1; (-) strand; PAM type: NRG; PAM sequence: GAG
gaaagattgcttgagctcag

SEQ ID NO: 89853 - DNA, 20 bp, Artificial Sequence
  Description of Artificial Sequence: Synthetic oligonucleotide
  Target: ATXN1; (-) strand; PAM type: NRG; PAM sequence: AGG
cagaaagattgcttgagctc

SEQ ID NO: 89854 - DNA, 20 bp, Artificial Sequence
  Description of Artificial Sequence: Synthetic oligonucleotide
  Target: ATXN1; (-) strand; PAM type: NRG; PAM sequence: CAG
gcagaaagattgcttgagct

SEQ ID NO: 89855 - DNA, 20 bp, Artificial Sequence
  Description of Artificial Sequence: Synthetic oligonucleotide
  Target: ATXN1; (-) strand; PAM type: NRG; PAM sequence: GAG
ccgaggcagaaagattgctt

SEQ ID NO: 89856 - DNA, 20 bp, Artificial Sequence
  Description of Artificial Sequence: Synthetic oligonucleotide
  Target: ATXN1; (-) strand; PAM type: NRG; PAM sequence: AAG
ctttgggaggccgaggcaga

SEQ ID NO: 89857 - DNA, 20 bp, Artificial Sequence
  Description of Artificial Sequence: Synthetic oligonucleotide
  Target: ATXN1; (-) strand; PAM type: NRG; PAM sequence: CAG
agtactttgggaggccgagg

SEQ ID NO: 89858 - DNA, 20 bp, Artificial Sequence
  Description of Artificial Sequence: Synthetic oligonucleotide
  Target: ATXN1; (-) strand; PAM type: NRG; PAM sequence: AGG
cccagtactttgggaggccg

SEQ ID NO: 89859 - DNA, 20 bp, Artificial Sequence
  Description of Artificial Sequence: Synthetic oligonucleotide
  Target: ATXN1; (-) strand; PAM type: NRG; PAM sequence: GAG
tcccagtactttgggaggcc

SEQ ID NO: 89860 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagtactttggg

SEQ ID NO: 89861 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagtactttgg

SEQ ID NO: 89862 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagtacttt

SEQ ID NO: 89863 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagtactt

SEQ ID NO: 89864 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtaatcc

SEQ ID NO: 89865 - DNA, 20 bp, Artificial Sequence
  Description of Artificial Sequence: Synthetic oligonucleotide
  Target: ATXN1; (-) strand; PAM type: NRG; PAM sequence: TGG
taataataggctgggtgtgg

SEQ ID NO: 89866 - DNA, 20 bp, Artificial Sequence
  Description of Artificial Sequence: Synthetic oligonucleotide
  Target: ATXN1; (-) strand; PAM type: NRG; PAM sequence: TGG
taataataataggctgggtg

SEQ ID NO: 89867 - DNA, 20 bp, Artificial Sequence
  Description of Artificial Sequence: Synthetic oligonucleotide
  Target: ATXN1; (-) strand; PAM type: NRG; PAM sequence: GGG
aaaaataataataataggct

SEQ ID NO: 89868 - DNA, 20 bp, Artificial Sequence
  Description of Artificial Sequence: Synthetic oligonucleotide
  Target: ATXN1; (-) strand; PAM type: NRG; PAM sequence: TGG
taaaaataataataataggc

SEQ ID NO: 89869 - DNA, 20 bp, Artificial Sequence
  Description of Artificial Sequence: Synthetic oligonucleotide
  Target: ATXN1; (-) strand; PAM type: NRG; PAM sequence: AGG
ctattaaaaataataataat

SEQ ID NO: 89870 - DNA, 20 bp, Artificial Sequence
  Description of Artificial Sequence: Synthetic oligonucleotide
  Target: ATXN1; (-) strand; PAM type: NRG; PAM sequence: TAG
tctattaaaaataataataa

SEQ ID NO: 89871 - DNA, 20 bp, Artificial Sequence
  Description of Artificial Sequence: Synthetic oligonucleotide
  Target: ATXN1; (-) strand; PAM type: NRG; PAM sequence: GAG
tccatcctgggcagcagagt

SEQ ID NO: 89872 - DNA, 20 bp, Artificial Sequence
  Description of Artificial Sequence: Synthetic oligonucleotide
  Target: ATXN1; (-) strand; PAM type: NRG; PAM sequence: GAG
gcattccatcctgggcagca

SEQ ID NO: 89873 - DNA, 20 bp, Artificial Sequence
  Description of Artificial Sequence: Synthetic oligonucleotide
  Target: ATXN1; (-) strand; PAM type: NRG; PAM sequence: CAG
ttgcattccatcctgggcag

SEQ ID NO: 89874 - DNA, 20 bp, Artificial Sequence
  Description of Artificial Sequence: Synthetic oligonucleotide
  Target: ATXN1; (-) strand; PAM type: NRG; PAM sequence: CAG
gcattgcattccatcctggg

SEQ ID NO: 89875 - DNA, 20 bp, Artificial Sequence
  Description of Artificial Sequence: Synthetic oligonucleotide
  Target: ATXN1; (-) strand; PAM type: NRG; PAM sequence: GGG
gcagcattgcattccatcct

SEQ ID NO: 89876 - DNA, 20 bp, Artificial Sequence
  Description of Artificial Sequence: Synthetic oligonucleotide
  Target: ATXN1; (-) strand; PAM type: NRG; PAM sequence: TGG
tgcagcattgcattccatcc

SEQ ID NO: 89877 - DNA, 20 bp, Artificial Sequence
  Description of Artificial Sequence: Synthetic oligonucleotide
  Target: ATXN1; (-) strand; PAM type: NRG; PAM sequence: CAG
gtttgaggctacagtgactg

SEQ ID NO: 89878 - DNA, 20 bp, Artificial Sequence
  Description of Artificial Sequence: Synthetic oligonucleotide
  Target: ATXN1; (-) strand; PAM type: NRG; PAM sequence: CAG
ggcccaggagtttgaggcta

SEQ ID NO: 89879 - DNA, 20 bp, Artificial Sequence
  Description of Artificial Sequence: Synthetic oligonucleotide
  Target: ATXN1; (-) strand; PAM type: NRG; PAM sequence: AGG
cgcttgggcccaggagtttg

SEQ ID NO: 89880 - DNA, 20 bp, Artificial Sequence
  Description of Artificial Sequence: Synthetic oligonucleotide
  Target: ATXN1; (-) strand; PAM type: NRG; PAM sequence: GAG
tcgcttgggcccaggagttt

SEQ ID NO: 89881 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcttgggcccag

SEQ ID NO: 89882 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcgcttgggccc

SEQ ID NO: 89883 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcgcttgggcc

SEQ ID NO: 89884 - DNA, 20 bp, Artificial Sequence
  Description of Artificial Sequence: Synthetic oligonucleotide
  Target: ATXN1; (-) strand; PAM type: NRG; PAM sequence: GGG
ctgaggtgggaggatcgctt

SEQ ID NO: 89885 - DNA, 20 bp, Artificial Sequence
  Description of Artificial Sequence: Synthetic oligonucleotide
  Target: ATXN1; (-) strand; PAM type: NRG; PAM sequence: TGG
gctgaggtgggaggatcgct

SEQ ID NO: 89886 - DNA, 20 bp, Artificial Sequence
  Description of Artificial Sequence: Synthetic oligonucleotide
  Target: ATXN1; (-) strand; PAM type: NRG; PAM sequence: AGG
ccttgggaggctgaggtggg

SEQ ID NO: 89887 - DNA, 20 bp, Artificial Sequence
  Description of Artificial Sequence: Synthetic oligonucleotide
  Target: ATXN1; (-) strand; PAM type: NRG; PAM sequence: GAG
accttgggaggctgaggtgg

SEQ ID NO: 89888 - DNA, 20 bp, Artificial Sequence
  Description of Artificial Sequence: Synthetic oligonucleotide
  Target: ATXN1; (-) strand; PAM type: NRG; PAM sequence: GGG
gcaccttgggaggctgaggt

SEQ ID NO: 89889 - DNA, 20 bp, Artificial Sequence
  Description of Artificial Sequence: Synthetic oligonucleotide
  Target: ATXN1; (-) strand; PAM type: NRG; PAM sequence: TGG
agcaccttgggaggctgagg

SEQ ID NO: 89890 - DNA, 20 bp, Artificial Sequence
  Description of Artificial Sequence: Synthetic oligonucleotide
  Target: ATXN1; (-) strand; PAM type: NRG; PAM sequence: AGG
cccagcaccttgggaggctg

SEQ ID NO: 89891 - DNA, 20 bp, Artificial Sequence
  Description of Artificial Sequence: Synthetic oligonucleotide
  Target: ATXN1; (-) strand; PAM type: NRG; PAM sequence: GAG
tcccagcaccttgggaggct

SEQ ID NO: 89892 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcaccttggg

SEQ ID NO: 89893 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcaccttgg

SEQ ID NO: 89894 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacctt

SEQ ID NO: 89895 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcacct

SEQ ID NO: 89896 - DNA, 20 bp, Artificial Sequence
  Description of Artificial Sequence: Synthetic oligonucleotide
  Target: ATXN1; (-) strand; PAM type: NRG; PAM sequence: CAG
atggctcttgcctgtaatcc

SEQ ID NO: 89897 - DNA, 20 bp, Artificial Sequence
  Description of Artificial Sequence: Synthetic oligonucleotide
  Target: ATXN1; (-) strand; PAM type: NRG; PAM sequence: TGG
ctgtcatgggctgggctcta

SEQ ID NO: 89898 - DNA, 20 bp, Artificial Sequence
  Description of Artificial Sequence: Synthetic oligonucleotide
  Target: ATXN1; (-) strand; PAM type: NRG; PAM sequence: GGG
ttaaaatactgtcatgggct

SEQ ID NO: 89899 - DNA, 20 bp, Artificial Sequence
  Description of Artificial Sequence: Synthetic oligonucleotide
  Target: ATXN1; (-) strand; PAM type: NRG; PAM sequence: TGG
attaaaatactgtcatgggc

SEQ ID NO: 89900 - DNA, 20 bp, Artificial Sequence
  Description of Artificial Sequence: Synthetic oligonucleotide
  Target: ATXN1; (-) strand; PAM type: NRG; PAM sequence: GGG
cttgattaaaatactgtcat

SEQ ID NO: 89901 - DNA, 20 bp, Artificial Sequence
  Description of Artificial Sequence: Synthetic oligonucleotide
  Target: ATXN1; (-) strand; PAM type: NRG; PAM sequence: TGG
tcttgattaaaatactgtca

SEQ ID NO: 89902 - DNA, 20 bp, Artificial Sequence
  Description of Artificial Sequence: Synthetic oligonucleotide
  Target: ATXN1; (-) strand; PAM type: NRG; PAM sequence: AGG
ctgatctgcagtctgtactt

SEQ ID NO: 89903 - DNA, 20 bp, Artificial Sequence
  Description of Artificial Sequence: Synthetic oligonucleotide
  Target: ATXN1; (-) strand; PAM type: NRG; PAM sequence: TAG
actgatctgcagtctgtact

SEQ ID NO: 89904 - DNA, 20 bp, Artificial Sequence
  Description of Artificial Sequence: Synthetic oligonucleotide
  Target: ATXN1; (-) strand; PAM type: NRG; PAM sequence: CAG
ctctctgttccactgatctg

SEQ ID NO: 89905 - DNA, 20 bp, Artificial Sequence
  Description of Artificial Sequence: Synthetic oligonucleotide
  Target: ATXN1; (-) strand; PAM type: NRG; PAM sequence: AAG
tttggttttatatgtgtttt

SEQ ID NO: 89906 - DNA, 20 bp, Artificial Sequence
  Description of Artificial Sequence: Synthetic oligonucleotide
  Target: ATXN1; (-) strand; PAM type: NRG; PAM sequence: TGG
cacctttgtcaaaaatcatt

SEQ ID NO: 89907 - DNA, 20 bp, Artificial Sequence
  Description of Artificial Sequence: Synthetic oligonucleotide
  Target: ATXN1; (-) strand; PAM type: NRG; PAM sequence: AAG
gtatgaaacaacaattattg

SEQ ID NO: 89908 - DNA, 20 bp, Artificial Sequence
  Description of Artificial Sequence: Synthetic oligonucleotide
  Target: ATXN1; (-) strand; PAM type: NRG; PAM sequence: CAG
gaggtgtaggggtcaagatt

SEQ ID NO: 89909 - DNA, 20 bp, Artificial Sequence
  Description of Artificial Sequence: Synthetic oligonucleotide
  Target: ATXN1; (-) strand; PAM type: NRG; PAM sequence: AAG
agatatgaggtgtaggggtc

SEQ ID NO: 89910 - DNA, 20 bp, Artificial Sequence
  Description of Artificial Sequence: Synthetic oligonucleotide
  Target: ATXN1; (-) strand; PAM type: NRG; PAM sequence: GGG
aattaagatatgaggtgtag

SEQ ID NO: 89911 - DNA, 20 bp, Artificial Sequence
  Description of Artificial Sequence: Synthetic oligonucleotide
  Target: ATXN1; (-) strand; PAM type: NRG; PAM sequence: GGG
aaattaagatatgaggtgta

SEQ ID NO: 89912 - DNA, 20 bp, Artificial Sequence
  Description of Artificial Sequence: Synthetic oligonucleotide
  Target: ATXN1; (-) strand; PAM type: NRG; PAM sequence: AGG
caaattaagatatgaggtgt

SEQ ID NO: 89913 - DNA, 20 bp, Artificial Sequence
  Description of Artificial Sequence: Synthetic oligonucleotide
  Target: ATXN1; (-) strand; PAM type: NRG; PAM sequence: TAG
tcaaattaagatatgaggtg

SEQ ID NO: 89914 - DNA, 20 bp, Artificial Sequence
  Description of Artificial Sequence: Synthetic oligonucleotide
  Target: ATXN1; (-) strand; PAM type: NRG; PAM sequence: AGG
ccatttcaaattaagatatg

SEQ ID NO: 89915 - DNA, 20 bp, Artificial Sequence
  Description of Artificial Sequence: Synthetic oligonucleotide
  Target: ATXN1; (-) strand; PAM type: NRG; PAM sequence: GAG
gccatttcaaattaagatat

SEQ ID NO: 89916 - DNA, 20 bp, Artificial Sequence
  Description of Artificial Sequence: Synthetic oligonucleotide
  Target: ATXN1; (-) strand; PAM type: NRG; PAM sequence: AAG
tatatgagccatttcaaatt

SEQ ID NO: 89917 - DNA, 20 bp, Artificial Sequence
  Description of Artificial Sequence: Synthetic oligonucleotide
  Target: ATXN1; (-) strand; PAM type: NRG; PAM sequence: GAG
gccttaacatttaagtatat

SEQ ID NO: 89918 - DNA, 20 bp, Artificial Sequence
  Description of Artificial Sequence: Synthetic oligonucleotide
  Target: ATXN1; (-) strand; PAM type: NRG; PAM sequence: AAG
ctagtttagccttaacattt

SEQ ID NO: 89919 - DNA, 20 bp, Artificial Sequence
  Description of Artificial Sequence: Synthetic oligonucleotide
  Target: ATXN1; (-) strand; PAM type: NRG; PAM sequence: TAG
ctcctggaagatttctagtt

SEQ ID NO: 89920 - DNA, 20 bp, Artificial Sequence
  Description of Artificial Sequence: Synthetic oligonucleotide
  Target: ATXN1; (-) strand; PAM type: NRG; PAM sequence: TAG
gttttctcctggaagatttc

SEQ ID NO: 89921 - DNA, 20 bp, Artificial Sequence
  Description of Artificial Sequence: Synthetic oligonucleotide
  Target: ATXN1; (-) strand; PAM type: NRG; PAM sequence: AAG
atcctcctgttttctcctgg

SEQ ID NO: 89922 - DNA, 20 bp, Artificial Sequence
  Description of Artificial Sequence: Synthetic oligonucleotide
  Target: ATXN1; (-) strand; PAM type: NRG; PAM sequence: TGG
gttatcctcctgttttctcc

SEQ ID NO: 89923 - DNA, 20 bp, Artificial Sequence
  Description of Artificial Sequence: Synthetic oligonucleotide
  Target: ATXN1; (-) strand; PAM type: NRG; PAM sequence: AAG
ttgcttaccctgtggttgct

SEQ ID NO: 89924 - DNA, 20 bp, Artificial Sequence
  Description of Artificial Sequence: Synthetic oligonucleotide
  Target: ATXN1; (-) strand; PAM type: NRG; PAM sequence: TGG
taacatttttgcttaccctg

SEQ ID NO: 89925 - DNA, 20 bp, Artificial Sequence
  Description of Artificial Sequence: Synthetic oligonucleotide
  Target: ATXN1; (-) strand; PAM type: NRG; PAM sequence: AAG
agtctaatttatcatttttt

SEQ ID NO: 89926 - DNA, 20 bp, Artificial Sequence
  Description of Artificial Sequence: Synthetic oligonucleotide
  Target: ATXN1; (-) strand; PAM type: NRG; PAM sequence: AAG
agcccctttaaattttaatg

SEQ ID NO: 89927 - DNA, 20 bp, Artificial Sequence
  Description of Artificial Sequence: Synthetic oligonucleotide
  Target: ATXN1; (-) strand; PAM type: NRG; PAM sequence: GAG
ttttttaaactgtgtttgat

SEQ ID NO: 89928 - DNA, 20 bp, Artificial Sequence
  Description of Artificial Sequence: Synthetic oligonucleotide
  Target: ATXN1; (-) strand; PAM type: NRG; PAM sequence: TGG
atgaattttttctcagtgtt

SEQ ID NO: 89929 - DNA, 20 bp, Artificial Sequence
  Description of Artificial Sequence: Synthetic oligonucleotide
  Target: ATXN1; (-) strand; PAM type: NRG; PAM sequence: CAG
cagaaatatgaattttttct

SEQ ID NO: 89930 - DNA, 20 bp, Artificial Sequence
  Description of Artificial Sequence: Synthetic oligonucleotide
  Target: ATXN1; (-) strand; PAM type: NRG; PAM sequence: CAG
tctggatttaagtcatttat

SEQ ID NO: 89931 - DNA, 20 bp, Artificial Sequence
  Description of Artificial Sequence: Synthetic oligonucleotide
  Target: ATXN1; (-) strand; PAM type: NRG; PAM sequence: AAG
tctttatatagtctggattt

SEQ ID NO: 89932 - DNA, 20 bp, Artificial Sequence
  Description of Artificial Sequence: Synthetic oligonucleotide
  Target: ATXN1; (-) strand; PAM type: NRG; PAM sequence: TGG
tatgagttctttatatagtc

SEQ ID NO: 89933 - DNA, 20 bp, Artificial Sequence
  Description of Artificial Sequence: Synthetic oligonucleotide
  Target: ATXN1; (-) strand; PAM type: NRG; PAM sequence: TAG
atatatatgagttctttata

SEQ ID NO: 89934 - DNA, 20 bp, Artificial Sequence
  Description of Artificial Sequence: Synthetic oligonucleotide
  Target: ATXN1; (-) strand; PAM type: NRG; PAM sequence: GAG
atatatatgtgtatatatat

SEQ ID NO: 89935 - DNA, 20 bp, Artificial Sequence
  Description of Artificial Sequence: Synthetic oligonucleotide
  Target: ATXN1; (-) strand; PAM type: NRG; PAM sequence: TGG
tatatctatatagatataga

SEQ ID NO: 89936 - DNA, 20 bp, Artificial Sequence
  Description of Artificial Sequence: Synthetic oligonucleotide
  Target: ATXN1; (-) strand; PAM type: NRG; PAM sequence: TAG
aatctatatctatatagata

SEQ ID NO: 89937 - DNA, 20 bp, Artificial Sequence
  Description of Artificial Sequence: Synthetic oligonucleotide
  Target: ATXN1; (-) strand; PAM type: NRG; PAM sequence: TAG
acaaacaatctatatctata

SEQ ID NO: 89938 - DNA, 20 bp, Artificial Sequence
  Description of Artificial Sequence: Synthetic oligonucleotide
  Target: ATXN1; (-) strand; PAM type: NRG; PAM sequence: CAG
tgcacttccagcctgggcaa

SEQ ID NO: 89939 - DNA, 20 bp, Artificial Sequence
  Description of Artificial Sequence: Synthetic oligonucleotide
  Target: ATXN1; (-) strand; PAM type: NRG; PAM sequence: GGG
tgccactgcacttccagcct

SEQ ID NO: 89940 - DNA, 20 bp, Artificial Sequence
  Description of Artificial Sequence: Synthetic oligonucleotide
  Target: ATXN1; (-) strand; PAM type: NRG; PAM sequence: TGG
gtgccactgcacttccagcc

SEQ ID NO: 89941 - DNA, 20 bp, Artificial Sequence
  Description of Artificial Sequence: Synthetic oligonucleotide
  Target: ATXN1; (-) strand; PAM type: NRG; PAM sequence: CAG
tgatggtgccactgcacttc

SEQ ID NO: 89942 - DNA, 20 bp, Artificial Sequence
  Description of Artificial Sequence: Synthetic oligonucleotide
  Target: ATXN1; (-) strand; PAM type: NRG; PAM sequence: TGG
aagcctgcagtgagtcatga

SEQ ID NO: 89943 - DNA, 20 bp, Artificial Sequence
  Description of Artificial Sequence: Synthetic oligonucleotide
  Target: ATXN1; (-) strand; PAM type: NRG; PAM sequence: GAG
ggaggggtcaagcctgcagt

SEQ ID NO: 89944 - DNA, 20 bp, Artificial Sequence
  Description of Artificial Sequence: Synthetic oligonucleotide
  Target: ATXN1; (-) strand; PAM type: NRG; PAM sequence: CAG
cctgggaggggtcaagcctg

SEQ ID NO: 89945 - DNA, 20 bp, Artificial Sequence
  Description of Artificial Sequence: Synthetic oligonucleotide
  Target: ATXN1; (-) strand; PAM type: NRG; PAM sequence: AAG
acttgagcctgggaggggtc

SEQ ID NO: 89946 - DNA, 20 bp, Artificial Sequence
  Description of Artificial Sequence: Synthetic oligonucleotide
  Target: ATXN1; (-) strand; PAM type: NRG; PAM sequence: GGG
ggatcacttgagcctgggag

SEQ ID NO: 89947 - DNA, 20 bp, Artificial Sequence
  Description of Artificial Sequence: Synthetic oligonucleotide
  Target: ATXN1; (-) strand; PAM type: NRG; PAM sequence: GGG
aggatcacttgagcctggga

SEQ ID NO: 89948 - DNA, 20 bp, Artificial Sequence
  Description of Artificial Sequence: Synthetic oligonucleotide
  Target: ATXN1; (-) strand; PAM type: NRG; PAM sequence: AGG
gaggatcacttgagcctggg

SEQ ID NO: 89949 - DNA, 20 bp, Artificial Sequence
  Description of Artificial Sequence: Synthetic oligonucleotide
  Target: ATXN1; (-) strand; PAM type: NRG; PAM sequence: GAG
ggaggatcacttgagcctgg

SEQ ID NO: 89950 - DNA, 20 bp, Artificial Sequence
  Description of Artificial Sequence: Synthetic oligonucleotide
  Target: ATXN1; (-) strand; PAM type: NRG; PAM sequence: GGG
tgggaggatcacttgagcct

SEQ ID NO: 89951 - DNA, 20 bp, Artificial Sequence
  Description of Artificial Sequence: Synthetic oligonucleotide
  Target: ATXN1; (-) strand; PAM type: NRG; PAM sequence: TGG
gtgggaggatcacttgagcc

SEQ ID NO: 89952 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggaggatcactt

SEQ ID NO: 89953 - DNA, 20 bp, Artificial Sequence
  Description of Artificial Sequence: Synthetic oligonucleotide
  Target: ATXN1; (-) strand; PAM type: NRG; PAM sequence: AGG
actcaggaggctgaggtggg

SEQ ID NO: 89954 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggtgg

SEQ ID NO: 89955 - DNA, 20 bp, Artificial Sequence
  Description of Artificial Sequence: Synthetic oligonucleotide
  Target: ATXN1; (-) strand; PAM type: NRG; PAM sequence: GGG
gatactcaggaggctgaggt

SEQ ID NO: 89956 - DNA, 20 bp, Artificial Sequence
  Description of Artificial Sequence: Synthetic oligonucleotide
  Target: ATXN1; (-) strand; PAM type: NRG; PAM sequence: TGG
agatactcaggaggctgagg

SEQ ID NO: 89957 - DNA, 20 bp, Artificial Sequence
  Description of Artificial Sequence: Synthetic oligonucleotide
  Target: ATXN1; (-) strand; PAM type: NRG; PAM sequence: AGG
cccagatactcaggaggctg

SEQ ID NO: 89958 - DNA, 20 bp, Artificial Sequence
  Description of Artificial Sequence: Synthetic oligonucleotide
  Target: ATXN1; (-) strand; PAM type: NRG; PAM sequence: GAG
tcccagatactcaggaggct

SEQ ID NO: 89959 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagatactcagg

SEQ ID NO: 89960 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagatactcag

SEQ ID NO: 89961 - DNA, 20 bp, Artificial Sequence
  Description of Artificial Sequence: Synthetic oligonucleotide
  Target: ATXN1; (-) strand; PAM type: NRG; PAM sequence: AGG
acctgtaatcccagatactc

SEQ ID NO: 89962 - DNA, 20 bp, Artificial Sequence
  Description of Artificial Sequence: Synthetic oligonucleotide
  Target: ATXN1; (-) strand; PAM type: NRG; PAM sequence: CAG
cacctgtaatcccagatact

SEQ ID NO: 89963 - DNA, 20 bp, Artificial Sequence
  Description of Artificial Sequence: Synthetic oligonucleotide
  Target: ATXN1; (-) strand; PAM type: NRG; PAM sequence: CAG
gtggcacgcacctgtaatcc

SEQ ID NO: 89964 - DNA, 20 bp, Artificial Sequence
  Description of Artificial Sequence: Synthetic oligonucleotide
  Target: ATXN1; (-) strand; PAM type: NRG; PAM sequence: TGG
caaaaactaggcggcagcag

SEQ ID NO: 89965 - DNA, 20 bp, Artificial Sequence
  Description of Artificial Sequence: Synthetic oligonucleotide
  Target: ATXN1; (-) strand; PAM type: NRG; PAM sequence: CAG
atacaaaaactaggcggcag

SEQ ID NO: 89966 - DNA, 20 bp, Artificial Sequence
  Description of Artificial Sequence: Synthetic oligonucleotide
  Target: ATXN1; (-) strand; PAM type: NRG; PAM sequence: CAG
aaaatacaaaaactaggcgg

SEQ ID NO: 89967 - DNA, 20 bp, Artificial Sequence
  Description of Artificial Sequence: Synthetic oligonucleotide
  Target: ATXN1; (-) strand; PAM type: NRG; PAM sequence: CGG
ttaaaaatacaaaaactagg

SEQ ID NO: 89968 - DNA, 20 bp, Artificial Sequence
  Description of Artificial Sequence: Synthetic oligonucleotide
  Target: ATXN1; (-) strand; PAM type: NRG; PAM sequence: AGG
ctattaaaaatacaaaaact

SEQ ID NO: 89969 - DNA, 20 bp, Artificial Sequence
  Description of Artificial Sequence: Synthetic oligonucleotide
  Target: ATXN1; (-) strand; PAM type: NRG; PAM sequence: TAG
tctattaaaaatacaaaaac

SEQ ID NO: 89970 - DNA, 20 bp, Artificial Sequence
  Description of Artificial Sequence: Synthetic oligonucleotide
  Target: ATXN1; (-) strand; PAM type: NRG; PAM sequence: TGG
cgagatcagcctgggcaaca

SEQ ID NO: 89971 - DNA, 20 bp, Artificial Sequence
  Description of Artificial Sequence: Synthetic oligonucleotide
  Target: ATXN1; (-) strand; PAM type: NRG; PAM sequence: GGG
tagaagttcgagatcagcct

SEQ ID NO: 89972 - DNA, 20 bp, Artificial Sequence
  Description of Artificial Sequence: Synthetic oligonucleotide
  Target: ATXN1; (-) strand; PAM type: NRG; PAM sequence: TGG
ctagaagttcgagatcagcc

SEQ ID NO: 89973 - DNA, 20 bp, Artificial Sequence
  Description of Artificial Sequence: Synthetic oligonucleotide
  Target: ATXN1; (-) strand; PAM type: NRG; PAM sequence: CAG
tgagtctagaagttcgagat

SEQ ID NO: 89974 - DNA, 20 bp, Artificial Sequence
  Description of Artificial Sequence: Synthetic oligonucleotide
  Target: ATXN1; (-) strand; PAM type: NRG; PAM sequence: GAG
ttgcttgagtctagaagttc

SEQ ID NO: 89975 - DNA, 20 bp, Artificial Sequence
  Description of Artificial Sequence: Synthetic oligonucleotide
  Target: ATXN1; (-) strand; PAM type: NRG; PAM sequence: AAG
ggcatattgcttgagtctag

SEQ ID NO: 89976 - DNA, 20 bp, Artificial Sequence
  Description of Artificial Sequence: Synthetic oligonucleotide
  Target: ATXN1; (-) strand; PAM type: NRG; PAM sequence: TAG
gcaggcatattgcttgagtc

SEQ ID NO: 89977 - DNA, 20 bp, Artificial Sequence
  Description of Artificial Sequence: Synthetic oligonucleotide
  Target: ATXN1; (-) strand; PAM type: NRG; PAM sequence: GAG
ccaaggcaggcatattgctt

SEQ ID NO: 89978 - DNA, 20 bp, Artificial Sequence
  Description of Artificial Sequence: Synthetic oligonucleotide
  Target: ATXN1; (-) strand; PAM type: NRG; PAM sequence: AGG
tgctagccagaggccaaggc

SEQ ID NO: 89979 - DNA, 20 bp, Artificial Sequence
  Description of Artificial Sequence: Synthetic oligonucleotide
  Target: ATXN1; (-) strand; PAM type: NRG; PAM sequence: CAG
atgctagccagaggccaagg

SEQ ID NO: 89980 - DNA, 20 bp, Artificial Sequence
  Description of Artificial Sequence: Synthetic oligonucleotide
  Target: ATXN1; (-) strand; PAM type: NRG; PAM sequence: AGG
aaaatgctagccagaggcca

SEQ ID NO: 89981 - DNA, 20 bp, Artificial Sequence
  Description of Artificial Sequence: Synthetic oligonucleotide
  Target: ATXN1; (-) strand; PAM type: NRG; PAM sequence: AAG
aaaaatgctagccagaggcc

SEQ ID NO: 89982 - DNA, 20 bp, Artificial Sequence
  Description of Artificial Sequence: Synthetic oligonucleotide
  Target: ATXN1; (-) strand; PAM type: NRG; PAM sequence: AGG
atttaaaaaatgctagccag

SEQ ID NO: 89983 - DNA, 20 bp, Artificial Sequence
  Description of Artificial Sequence: Synthetic oligonucleotide
  Target: ATXN1; (-) strand; PAM type: NRG; PAM sequence: GAG
aatttaaaaaatgctagcca

SEQ ID NO: 89984 - DNA, 20 bp, Artificial Sequence
  Description of Artificial Sequence: Synthetic oligonucleotide
  Target: ATXN1; (-) strand; PAM type: NRG; PAM sequence: CAG
ttaatttaaaaaatgctagc

SEQ ID NO: 89985 - DNA, 20 bp, Artificial Sequence
  Description of Artificial Sequence: Synthetic oligonucleotide
  Target: ATXN1; (-) strand; PAM type: NRG; PAM sequence: TAG
acagttaatttaaaaaatgc

SEQ ID NO: 89986 - DNA, 20 bp, Artificial Sequence
  Description of Artificial Sequence: Synthetic oligonucleotide
  Target: ATXN1; (-) strand; PAM type: NRG; PAM sequence: CAG
tgtattgttgcaggtagcaa

SEQ ID NO: 89987 - DNA, 20 bp, Artificial Sequence
  Description of Artificial Sequence: Synthetic oligonucleotide
  Target: ATXN1; (-) strand; PAM type: NRG; PAM sequence: TAG
atcatctgtattgttgcagg

SEQ ID NO: 89988 - DNA, 20 bp, Artificial Sequence
  Description of Artificial Sequence: Synthetic oligonucleotide
  Target: ATXN1; (-) strand; PAM type: NRG; PAM sequence: AGG
gagatcatctgtattgttgc

SEQ ID NO: 89989 - DNA, 20 bp, Artificial Sequence
  Description of Artificial Sequence: Synthetic oligonucleotide
  Target: ATXN1; (-) strand; PAM type: NRG; PAM sequence: CAG
tgagatcatctgtattgttg

SEQ ID NO: 89990 - DNA, 20 bp, Artificial Sequence
  Description of Artificial Sequence: Synthetic oligonucleotide
  Target: ATXN1; (-) strand; PAM type: NRG; PAM sequence: GAG
ttgttcagcatatcattttt

SEQ ID NO: 89991 - DNA, 20 bp, Artificial Sequence
  Description of Artificial Sequence: Synthetic oligonucleotide
  Target: ATXN1; (-) strand; PAM type: NRG; PAM sequence: CAG
cgtatctgctttcttttgtt

SEQ ID NO: 89992 - DNA, 20 bp, Artificial Sequence
  Description of Artificial Sequence: Synthetic oligonucleotide
  Target: ATXN1; (-) strand; PAM type: NRG; PAM sequence: CAG
ttcatacaaatggaatcagt

SEQ ID NO: 89993 - DNA, 20 bp, Artificial Sequence
  Description of Artificial Sequence: Synthetic oligonucleotide
  Target: ATXN1; (-) strand; PAM type: NRG; PAM sequence: CAG
gagcttcatacaaatggaat

SEQ ID NO: 89994 - DNA, 20 bp, Artificial Sequence
  Description of Artificial Sequence: Synthetic oligonucleotide
  Target: ATXN1; (-) strand; PAM type: NRG; PAM sequence: TGG
gttcttgagcttcatacaaa

SEQ ID NO: 89995 - DNA, 20 bp, Artificial Sequence
  Description of Artificial Sequence: Synthetic oligonucleotide
  Target: ATXN1; (-) strand; PAM type: NRG; PAM sequence: GAG
attgaattttgtttgttctt

SEQ ID NO: 89996 - DNA, 20 bp, Artificial Sequence
  Description of Artificial Sequence: Synthetic oligonucleotide
  Target: ATXN1; (-) strand; PAM type: NRG; PAM sequence: GAG
gggacatttccatcacccca

SEQ ID NO: 89997 - DNA, 20 bp, Artificial Sequence
  Description of Artificial Sequence: Synthetic oligonucleotide
  Target: ATXN1; (-) strand; PAM type: NRG; PAM sequence: CAG
atgggacatttccatcaccc

SEQ ID NO: 89998 - DNA, 20 bp, Artificial Sequence
  Description of Artificial Sequence: Synthetic oligonucleotide
  Target: ATXN1; (-) strand; PAM type: NRG; PAM sequence: GGG
cagcatcctaatcaagatat

SEQ ID NO: 89999 - DNA, 20 bp, Artificial Sequence
  Description of Artificial Sequence: Synthetic oligonucleotide
  Target: ATXN1; (-) strand; PAM type: NRG; PAM sequence: TGG
tcagcatcctaatcaagata

SEQ ID NO: 90000 - DNA, 20 bp, Artificial Sequence
  Description of Artificial Sequence: Synthetic oligonucleotide
  Target: ATXN1; (-) strand; PAM type: NRG; PAM sequence: AAG
acataatcagcatcctaatc

SEQ ID NO: 90001 - DNA, 20 bp, Artificial Sequence
  Description of Artificial Sequence: Synthetic oligonucleotide
  Target: ATXN1; (-) strand; PAM type: NRG; PAM sequence: CAG
aatgcatacatccacataat

SEQ ID NO: 90002 - DNA, 20 bp, Artificial Sequence
  Description of Artificial Sequence: Synthetic oligonucleotide
  Target: ATXN1; (-) strand; PAM type: NRG; PAM sequence: GAG
tcttaagcgtacagcgcaat

SEQ ID NO: 90003 - DNA, 20 bp, Artificial Sequence
  Description of Artificial Sequence: Synthetic oligonucleotide
  Target: ATXN1; (-) strand; PAM type: NRG; PAM sequence: CAG
atcaacacatcttaagcgta

SEQ ID NO: 90004 - DNA, 20 bp, Artificial Sequence
  Description of Artificial Sequence: Synthetic oligonucleotide
  Target: ATXN1; (-) strand; PAM type: NRG; PAM sequence: AAG
cagtgaaatcaacacatctt

SEQ ID NO: 90005 - DNA, 20 bp, Artificial Sequence
  Description of Artificial Sequence: Synthetic oligonucleotide
  Target: ATXN1; (-) strand; PAM type: NRG; PAM sequence: CAG
ttctatttagggagaacata

SEQ ID NO: 90006 - DNA, 20 bp, Artificial Sequence
  Description of Artificial Sequence: Synthetic oligonucleotide
  Target: ATXN1; (-) strand; PAM type: NRG; PAM sequence: GAG
taaattagtttctatttagg

SEQ ID NO: 90007 - DNA, 20 bp, Artificial Sequence
  Description of Artificial Sequence: Synthetic oligonucleotide
  Target: ATXN1; (-) strand; PAM type: NRG; PAM sequence: GGG
aataaattagtttctattta

SEQ ID NO: 90008 - DNA, 20 bp, Artificial Sequence
  Description of Artificial Sequence: Synthetic oligonucleotide
  Target: ATXN1; (-) strand; PAM type: NRG; PAM sequence: AGG
taataaattagtttctattt

SEQ ID NO: 90009 - DNA, 20 bp, Artificial Sequence
  Description of Artificial Sequence: Synthetic oligonucleotide
  Target: ATXN1; (-) strand; PAM type: NRG; PAM sequence: TAG
ctaataaattagtttctatt

SEQ ID NO: 90010 - DNA, 20 bp, Artificial Sequence
  Description of Artificial Sequence: Synthetic oligonucleotide
  Target: ATXN1; (-) strand; PAM type: NRG; PAM sequence: TAG
ctttcttttcactaataaat

SEQ ID NO: 90011 - DNA, 20 bp, Artificial Sequence
  Description of Artificial Sequence: Synthetic oligonucleotide
  Target: ATXN1; (-) strand; PAM type: NRG; PAM sequence: AAG
tattattaatagtgaaaaga

SEQ ID NO: 90012 - DNA, 20 bp, Artificial Sequence
  Description of Artificial Sequence: Synthetic oligonucleotide
  Target: ATXN1; (-) strand; PAM type: NRG; PAM sequence: AAG
agtttattattaatagtgaa

SEQ ID NO: 90013 - DNA, 20 bp, Artificial Sequence
  Description of Artificial Sequence: Synthetic oligonucleotide
  Target: ATXN1; (-) strand; PAM type: NRG; PAM sequence: TAG
ataaattagtttattattaa

SEQ ID NO: 90014 - DNA, 20 bp, Artificial Sequence
  Description of Artificial Sequence: Synthetic oligonucleotide
  Target: ATXN1; (-) strand; PAM type: NRG; PAM sequence: TAG
ctttcttttcactaataaat

SEQ ID NO: 90015 - DNA, 20 bp, Artificial Sequence
  Description of Artificial Sequence: Synthetic oligonucleotide
  Target: ATXN1; (-) strand; PAM type: NRG; PAM sequence: AAG
ccacagaccctccaggtaga

SEQ ID NO: 90016 - DNA, 20 bp, Artificial Sequence
  Description of Artificial Sequence: Synthetic oligonucleotide
  Target: ATXN1; (-) strand; PAM type: NRG; PAM sequence: TAG
atccccacagaccctccagg

SEQ ID NO: 90017 - DNA, 20 bp, Artificial Sequence
  Description of Artificial Sequence: Synthetic oligonucleotide
  Target: ATXN1; (-) strand; PAM type: NRG; PAM sequence: AGG
gttatccccacagaccctcc

SEQ ID NO: 90018 - DNA, 20 bp, Artificial Sequence
  Description of Artificial Sequence: Synthetic oligonucleotide
  Target: ATXN1; (-) strand; PAM type: NRG; PAM sequence: CAG
ggttatccccacagaccctc

SEQ ID NO: 90019 - DNA, 20 bp, Artificial Sequence
  Description of Artificial Sequence: Synthetic oligonucleotide
  Target: ATXN1; (-) strand; PAM type: NRG; PAM sequence: CAG
cggaataggggttatcccca

SEQ ID NO: 90020 - DNA, 20 bp, Artificial Sequence
  Description of Artificial Sequence: Synthetic oligonucleotide
  Target: ATXN1; (-) strand; PAM type: NRG; PAM sequence: GGG
tgttcctttgtacggaatag

SEQ ID NO: 90021 - DNA, 20 bp, Artificial Sequence
  Description of Artificial Sequence: Synthetic oligonucleotide
  Target: ATXN1; (-) strand; PAM type: NRG; PAM sequence: GGG
ctgttcctttgtacggaata

SEQ ID NO: 90022 - DNA, 20 bp, Artificial Sequence
  Description of Artificial Sequence: Synthetic oligonucleotide
  Target: ATXN1; (-) strand; PAM type: NRG; PAM sequence: AGG
actgttcctttgtacggaat

SEQ ID NO: 90023 - DNA, 20 bp, Artificial Sequence
  Description of Artificial Sequence: Synthetic oligonucleotide
  Target: ATXN1; (-) strand; PAM type: NRG; PAM sequence: TAG
cactgttcctttgtacggaa

SEQ ID NO: 90024 - DNA, 20 bp, Artificial Sequence
  Description of Artificial Sequence: Synthetic oligonucleotide
  Target: ATXN1; (-) strand; PAM type: NRG; PAM sequence: CGG
atgttcactgttcctttgta

SEQ ID NO: 90025 - DNA, 20 bp, Artificial Sequence
  Description of Artificial Sequence: Synthetic oligonucleotide
  Target: ATXN1; (-) strand; PAM type: NRG; PAM sequence: AAG
ttgcgtggctgttttcactc

SEQ ID NO: 90026 - DNA, 20 bp, Artificial Sequence
  Description of Artificial Sequence: Synthetic oligonucleotide
  Target: ATXN1; (-) strand; PAM type: NRG; PAM sequence: TGG
cacttgctgtctgccttgcg

SEQ ID NO: 90027 - DNA, 20 bp, Artificial Sequence
  Description of Artificial Sequence: Synthetic oligonucleotide
  Target: ATXN1; (-) strand; PAM type: NRG; PAM sequence: AGG
caccgttcttcccctgcctt

SEQ ID NO: 90028 - DNA, 20 bp, Artificial Sequence
  Description of Artificial Sequence: Synthetic oligonucleotide
  Target: ATXN1; (-) strand; PAM type: NRG; PAM sequence: TAG
ccaccgttcttcccctgcct

SEQ ID NO: 90029 - DNA, 20 bp, Artificial Sequence
  Description of Artificial Sequence: Synthetic oligonucleotide
  Target: ATXN1; (-) strand; PAM type: NRG; PAM sequence: CAG
tatttctcttctcactgtag

SEQ ID NO: 90030 - DNA, 20 bp, Artificial Sequence
  Description of Artificial Sequence: Synthetic oligonucleotide
  Target: ATXN1; (-) strand; PAM type: NRG; PAM sequence: TAG
ctctatttctcttctcactg

SEQ ID NO: 90031 - DNA, 20 bp, Artificial Sequence
  Description of Artificial Sequence: Synthetic oligonucleotide
  Target: ATXN1; (-) strand; PAM type: NRG; PAM sequence: CAG
tataccttccccttctgact

SEQ ID NO: 90032 - DNA, 20 bp, Artificial Sequence
  Description of Artificial Sequence: Synthetic oligonucleotide
  Target: ATXN1; (-) strand; PAM type: NRG; PAM sequence: TGG
ttcactcgtgtcttcctgtt

SEQ ID NO: 90033 - DNA, 20 bp, Artificial Sequence
  Description of Artificial Sequence: Synthetic oligonucleotide
  Target: ATXN1; (-) strand; PAM type: NRG; PAM sequence: CAG
tactttctacttcttgcgtt

SEQ ID NO: 90034 - DNA, 20 bp, Artificial Sequence
  Description of Artificial Sequence: Synthetic oligonucleotide
  Target: ATXN1; (-) strand; PAM type: NRG; PAM sequence: AGG
ttatttggaaacacgaattt

SEQ ID NO: 90035 - DNA, 20 bp, Artificial Sequence
  Description of Artificial Sequence: Synthetic oligonucleotide
  Target: ATXN1; (-) strand; PAM type: NRG; PAM sequence: TAG
attatttggaaacacgaatt

SEQ ID NO: 90036 - DNA, 20 bp, Artificial Sequence
  Description of Artificial Sequence: Synthetic oligonucleotide
  Target: ATXN1; (-) strand; PAM type: NRG; PAM sequence: TGG
aatgtggtaactggattatt

SEQ ID NO: 90037 - DNA, 20 bp, Artificial Sequence
  Description of Artificial Sequence: Synthetic oligonucleotide
  Target: ATXN1; (-) strand; PAM type: NRG; PAM sequence: TGG
tttgagtgtaatgtggtaac

SEQ ID NO: 90038 - DNA, 20 bp, Artificial Sequence
  Description of Artificial Sequence: Synthetic oligonucleotide
  Target: ATXN1; (-) strand; PAM type: NRG; PAM sequence: TGG
ttctttttttgagtgtaatg

SEQ ID NO: 90039 - DNA, 20 bp, Artificial Sequence
  Description of Artificial Sequence: Synthetic oligonucleotide
  Target: ATXN1; (-) strand; PAM type: NRG; PAM sequence: GAG
ctgcctttggttcttttttt

SEQ ID NO: 90040 - DNA, 20 bp, Artificial Sequence
  Description of Artificial Sequence: Synthetic oligonucleotide
  Target: ATXN1; (-) strand; PAM type: NRG; PAM sequence: TGG
tttccaaataaaactgcctt

SEQ ID NO: 90041 - DNA, 20 bp, Artificial Sequence
  Description of Artificial Sequence: Synthetic oligonucleotide
  Target: ATXN1; (-) strand; PAM type: NRG; PAM sequence: GAG
cagaggtgtcgagggaggaa

SEQ ID NO: 90042 - DNA, 20 bp, Artificial Sequence
  Description of Artificial Sequence: Synthetic oligonucleotide
  Target: ATXN1; (-) strand; PAM type: NRG; PAM sequence: AAG
aacagaggtgtcgagggagg

SEQ ID NO: 90043 - DNA, 20 bp, Artificial Sequence
  Description of Artificial Sequence: Synthetic oligonucleotide
  Target: ATXN1; (-) strand; PAM type: NRG; PAM sequence: AGG
attaacagaggtgtcgaggg

SEQ ID NO: 90044 - DNA, 20 bp, Artificial Sequence
  Description of Artificial Sequence: Synthetic oligonucleotide
  Target: ATXN1; (-) strand; PAM type: NRG; PAM sequence: GAG
gattaacagaggtgtcgagg

SEQ ID NO: 90045 - DNA, 20 bp, Artificial Sequence
  Description of Artificial Sequence: Synthetic oligonucleotide
  Target: ATXN1; (-) strand; PAM type: NRG; PAM sequence: GGG
ttgattaacagaggtgtcga

SEQ ID NO: 90046 - DNA, 20 bp, Artificial Sequence
  Description of Artificial Sequence: Synthetic oligonucleotide
  Target: ATXN1; (-) strand; PAM type: NRG; PAM sequence: AGG
tttgattaacagaggtgtcg

SEQ ID NO: 90047 - DNA, 20 bp, Artificial Sequence
  Description of Artificial Sequence: Synthetic oligonucleotide
  Target: ATXN1; (-) strand; PAM type: NRG; PAM sequence: GAG
atttgattaacagaggtgtc

SEQ ID NO: 90048 - DNA, 20 bp, Artificial Sequence
  Description of Artificial Sequence: Synthetic oligonucleotide
  Target: ATXN1; (-) strand; PAM type: NRG; PAM sequence: AGG
gcttccaatttgattaacag

SEQ ID NO: 90049 - DNA, 20 bp, Artificial Sequence
  Description of Artificial Sequence: Synthetic oligonucleotide
  Target: ATXN1; (-) strand; PAM type: NRG; PAM sequence: GAG
agcttccaatttgattaaca

SEQ ID NO: 90050 - DNA, 20 bp, Artificial Sequence
  Description of Artificial Sequence: Synthetic oligonucleotide
  Target: ATXN1; (-) strand; PAM type: NRG; PAM sequence: CAG
ctagcttccaatttgattaa

SEQ ID NO: 90051 - DNA, 20 bp, Artificial Sequence
  Description of Artificial Sequence: Synthetic oligonucleotide
  Target: ATXN1; (-) strand; PAM type: NRG; PAM sequence: TAG
ctttactcagttccctcccc

SEQ ID NO: 90052 - DNA, 20 bp, Artificial Sequence
  Description of Artificial Sequence: Synthetic oligonucleotide
  Target: ATXN1; (-) strand; PAM type: NRG; PAM sequence: CAG
ttcaggtccctgcctttact

SEQ ID NO: 90053 - DNA, 20 bp, Artificial Sequence
  Description of Artificial Sequence: Synthetic oligonucleotide
  Target: ATXN1; (-) strand; PAM type: NRG; PAM sequence: AGG
aaaaacggagggatatgttc

SEQ ID NO: 90054 - DNA, 20 bp, Artificial Sequence
  Description of Artificial Sequence: Synthetic oligonucleotide
  Target: ATXN1; (-) strand; PAM type: NRG; PAM sequence: CAG
caaaaacggagggatatgtt

SEQ ID NO: 90055 - DNA, 20 bp, Artificial Sequence
  Description of Artificial Sequence: Synthetic oligonucleotide
  Target: ATXN1; (-) strand; PAM type: NRG; PAM sequence: GGG
aaaaaaaaagcaaaaacgga

SEQ ID NO: 90056 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaagcaaaaacgg

SEQ ID NO: 90057 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaagcaaaaacg

SEQ ID NO: 90058 - DNA, 20 bp, Artificial Sequence
  Description of Artificial Sequence: Synthetic oligonucleotide
  Target: ATXN1; (-) strand; PAM type: NRG; PAM sequence: CGG
aaaaaaaaaaaaagcaaaaa

SEQ ID NO: 90059 - DNA, 20 bp, Artificial Sequence
  Description of Artificial Sequence: Synthetic oligonucleotide
  Target: ATXN1; (-) strand; PAM type: NRG; PAM sequence: AAG
gggcaaaagaaaaaaaaaaa

SEQ ID NO: 90060 - DNA, 20 bp, Artificial Sequence
  Description of Artificial Sequence: Synthetic oligonucleotide
  Target: ATXN1; (-) strand; PAM type: NRG; PAM sequence: AAG
ggtggctgattaaggggcaa

SEQ ID NO: 90061 - DNA, 20 bp, Artificial Sequence
  Description of Artificial Sequence: Synthetic oligonucleotide
  Target: ATXN1; (-) strand; PAM type: NRG; PAM sequence: GGG
tttgaaggtggctgattaag

SEQ ID NO: 90062 - DNA, 20 bp, Artificial Sequence
  Description of Artificial Sequence: Synthetic oligonucleotide
  Target: ATXN1; (-) strand; PAM type: NRG; PAM sequence: GGG
ttttgaaggtggctgattaa

SEQ ID NO: 90063 - DNA, 20 bp, Artificial Sequence
  Description of Artificial Sequence: Synthetic oligonucleotide
  Target: ATXN1; (-) strand; PAM type: NRG; PAM sequence: AGG
gttttgaaggtggctgatta

SEQ ID NO: 90064 - DNA, 20 bp, Artificial Sequence
  Description of Artificial Sequence: Synthetic oligonucleotide
  Target: ATXN1; (-) strand; PAM type: NRG; PAM sequence: AAG
tgttttgaaggtggctgatt

SEQ ID NO: 90065 - DNA, 20 bp, Artificial Sequence
  Description of Artificial Sequence: Synthetic oligonucleotide
  Target: ATXN1; (-) strand; PAM type: NRG; PAM sequence: TGG
gaaaggcactgttttgaagg

SEQ ID NO: 90066 - DNA, 20 bp, Artificial Sequence
  Description of Artificial Sequence: Synthetic oligonucleotide
  Target: ATXN1; (-) strand; PAM type: NRG; PAM sequence: AGG
ctagaaaggcactgttttga

SEQ ID NO: 90067 - DNA, 20 bp, Artificial Sequence
  Description of Artificial Sequence: Synthetic oligonucleotide
  Target: ATXN1; (-) strand; PAM type: NRG; PAM sequence: AAG
cctagaaaggcactgttttg

SEQ ID NO: 90068 - DNA, 20 bp, Artificial Sequence
  Description of Artificial Sequence: Synthetic oligonucleotide
  Target: ATXN1; (-) strand; PAM type: NRG; PAM sequence: AGG
gcaggacgttagccctagaa

SEQ ID NO: 90069 - DNA, 20 bp, Artificial Sequence
  Description of Artificial Sequence: Synthetic oligonucleotide
  Target: ATXN1; (-) strand; PAM type: NRG; PAM sequence: AAG
ggcaggacgttagccctaga

SEQ ID NO: 90070 - DNA, 20 bp, Artificial Sequence
  Description of Artificial Sequence: Synthetic oligonucleotide
  Target: ATXN1; (-) strand; PAM type: NRG; PAM sequence: TAG
cacaggcaggacgttagccc

SEQ ID NO: 90071 - DNA, 20 bp, Artificial Sequence
  Description of Artificial Sequence: Synthetic oligonucleotide
  Target: ATXN1; (-) strand; PAM type: NRG; PAM sequence: TAG
agatgccacaggcaggacgt

SEQ ID NO: 90072 - DNA, 20 bp, Artificial Sequence
  Description of Artificial Sequence: Synthetic oligonucleotide
  Target: ATXN1; (-) strand; PAM type: NRG; PAM sequence: AGG
agtgatgagatgccacaggc

SEQ ID NO: 90073 - DNA, 20 bp, Artificial Sequence
  Description of Artificial Sequence: Synthetic oligonucleotide
  Target: ATXN1; (-) strand; PAM type: NRG; PAM sequence: CAG
cagtgatgagatgccacagg

SEQ ID NO: 90074 - DNA, 20 bp, Artificial Sequence
  Description of Artificial Sequence: Synthetic oligonucleotide
  Target: ATXN1; (-) strand; PAM type: NRG; PAM sequence: AGG
tatcagtgatgagatgccac

SEQ ID NO: 90075 - DNA, 20 bp, Artificial Sequence
  Description of Artificial Sequence: Synthetic oligonucleotide
  Target: ATXN1; (-) strand; PAM type: NRG; PAM sequence: CAG
ttatcagtgatgagatgcca

SEQ ID NO: 90076 - DNA, 20 bp, Artificial Sequence
  Description of Artificial Sequence: Synthetic oligonucleotide
  Target: ATXN1; (-) strand; PAM type: NRG; PAM sequence: GAG
tcctgatgtttatcagtgat

SEQ ID NO: 90077 - DNA, 20 bp, Artificial Sequence
  Description of Artificial Sequence: Synthetic oligonucleotide
  Target: ATXN1; (-) strand; PAM type: NRG; PAM sequence: CAG
agttacttcctgatgtttat

SEQ ID NO: 90078 - DNA, 20 bp, Artificial Sequence
  Description of Artificial Sequence: Synthetic oligonucleotide
  Target: ATXN1; (-) strand; PAM type: NRG; PAM sequence: CAG
aatctataaatggcgaatgg

SEQ ID NO: 90079 - DNA, 20 bp, Artificial Sequence
  Description of Artificial Sequence: Synthetic oligonucleotide
  Target: ATXN1; (-) strand; PAM type: NRG; PAM sequence: TGG
ataaatctataaatggcgaa

SEQ ID NO: 90080 - DNA, 20 bp, Artificial Sequence
  Description of Artificial Sequence: Synthetic oligonucleotide
  Target: ATXN1; (-) strand; PAM type: NRG; PAM sequence: TGG
ggtacatataaatctataaa

SEQ ID NO: 90081 - DNA, 20 bp, Artificial Sequence
  Description of Artificial Sequence: Synthetic oligonucleotide
  Target: ATXN1; (-) strand; PAM type: NRG; PAM sequence: AGG
gtgaatctcattatcctagc

SEQ ID NO: 90082 - DNA, 20 bp, Artificial Sequence
  Description of Artificial Sequence: Synthetic oligonucleotide
  Target: ATXN1; (-) strand; PAM type: NRG; PAM sequence: CAG
tgtgaatctcattatcctag

SEQ ID NO: 90083 - DNA, 20 bp, Artificial Sequence
  Description of Artificial Sequence: Synthetic oligonucleotide
  Target: ATXN1; (-) strand; PAM type: NRG; PAM sequence: TAG
gattgtgaatctcattatcc

SEQ ID NO: 90084 - DNA, 20 bp, Artificial Sequence
  Description of Artificial Sequence: Synthetic oligonucleotide
  Target: ATXN1; (-) strand; PAM type: NRG; PAM sequence: CAG
tcagttactaagggaatgaa

SEQ ID NO: 90085 - DNA, 20 bp, Artificial Sequence
  Description of Artificial Sequence: Synthetic oligonucleotide
  Target: ATXN1; (-) strand; PAM type: NRG; PAM sequence: GGG
gagtttcattcagttactaa

SEQ ID NO: 90086 - DNA, 20 bp, Artificial Sequence
  Description of Artificial Sequence: Synthetic oligonucleotide
  Target: ATXN1; (-) strand; PAM type: NRG; PAM sequence: AGG
tgagtttcattcagttacta

SEQ ID NO: 90087 - DNA, 20 bp, Artificial Sequence
  Description of Artificial Sequence: Synthetic oligonucleotide
  Target: ATXN1; (-) strand; PAM type: NRG; PAM sequence: AAG
gtgagtttcattcagttact

SEQ ID NO: 90088 - DNA, 20 bp, Artificial Sequence
  Description of Artificial Sequence: Synthetic oligonucleotide
  Target: ATXN1; (-) strand; PAM type: NRG; PAM sequence: CAG
agccatttgtgagtttcatt

SEQ ID NO: 90089 - DNA, 20 bp, Artificial Sequence
  Description of Artificial Sequence: Synthetic oligonucleotide
  Target: ATXN1; (-) strand; PAM type: NRG; PAM sequence: GAG
actccctcgtagccatttgt

SEQ ID NO: 90090 - DNA, 20 bp, Artificial Sequence
  Description of Artificial Sequence: Synthetic oligonucleotide
  Target: ATXN1; (-) strand; PAM type: NRG; PAM sequence: TAG
tgaactaggatactccctcg

SEQ ID NO: 90091 - DNA, 20 bp, Artificial Sequence
  Description of Artificial Sequence: Synthetic oligonucleotide
  Target: ATXN1; (-) strand; PAM type: NRG; PAM sequence: AGG
agcttgggcttcagtgaact

SEQ ID NO: 90092 - DNA, 20 bp, Artificial Sequence
  Description of Artificial Sequence: Synthetic oligonucleotide
  Target: ATXN1; (-) strand; PAM type: NRG; PAM sequence: TAG
cagcttgggcttcagtgaac

SEQ ID NO: 90093 - DNA, 20 bp, Artificial Sequence
  Description of Artificial Sequence: Synthetic oligonucleotide
  Target: ATXN1; (-) strand; PAM type: NRG; PAM sequence: CAG
cctgaggccagcttgggctt

SEQ ID NO: 90094 - DNA, 20 bp, Artificial Sequence
  Description of Artificial Sequence: Synthetic oligonucleotide
  Target: ATXN1; (-) strand; PAM type: NRG; PAM sequence: GGG
ctggttcctgaggccagctt

SEQ ID NO: 90095 - DNA, 20 bp, Artificial Sequence
  Description of Artificial Sequence: Synthetic oligonucleotide
  Target: ATXN1; (-) strand; PAM type: NRG; PAM sequence: TGG
tctggttcctgaggccagct

SEQ ID NO: 90096 - DNA, 20 bp, Artificial Sequence
  Description of Artificial Sequence: Synthetic oligonucleotide
  Target: ATXN1; (-) strand; PAM type: NRG; PAM sequence: CAG
ttatctctggttcctgaggc

SEQ ID NO: 90097 - DNA, 20 bp, Artificial Sequence
  Description of Artificial Sequence: Synthetic oligonucleotide
  Target: ATXN1; (-) strand; PAM type: NRG; PAM sequence: AGG
aatgttatctctggttcctg

SEQ ID NO: 90098 - DNA, 20 bp, Artificial Sequence
  Description of Artificial Sequence: Synthetic oligonucleotide
  Target: ATXN1; (-) strand; PAM type: NRG; PAM sequence: GAG
aaatgttatctctggttcct

SEQ ID NO: 90099 - DNA, 20 bp, Artificial Sequence
  Description of Artificial Sequence: Synthetic oligonucleotide
  Target: ATXN1; (-) strand; PAM type: NRG; PAM sequence: TGG
aaaaggagaaatgttatctc

SEQ ID NO: 90100 - DNA, 20 bp, Artificial Sequence
  Description of Artificial Sequence: Synthetic oligonucleotide
  Target: ATXN1; (-) strand; PAM type: NRG; PAM sequence: GAG
agtaattcagctggaaaaag

SEQ ID NO: 90101 - DNA, 20 bp, Artificial Sequence
  Description of Artificial Sequence: Synthetic oligonucleotide
  Target: ATXN1; (-) strand; PAM type: NRG; PAM sequence: AGG
ttagtaattcagctggaaaa

SEQ ID NO: 90102 - DNA, 20 bp, Artificial Sequence
  Description of Artificial Sequence: Synthetic oligonucleotide
  Target: ATXN1; (-) strand; PAM type: NRG; PAM sequence: AAG
cttagtaattcagctggaaa

SEQ ID NO: 90103 - DNA, 20 bp, Artificial Sequence
  Description of Artificial Sequence: Synthetic oligonucleotide
  Target: ATXN1; (-) strand; PAM type: NRG; PAM sequence: TGG
gcttgtcttagtaattcagc

SEQ ID NO: 90104 - DNA, 20 bp, Artificial Sequence
  Description of Artificial Sequence: Synthetic oligonucleotide
  Target: ATXN1; (-) strand; PAM type: NRG; PAM sequence: CAG
tcttgcttgtcttagtaatt

SEQ ID NO: 90105 - DNA, 20 bp, Artificial Sequence
  Description of Artificial Sequence: Synthetic oligonucleotide
  Target: ATXN1; (-) strand; PAM type: NRG; PAM sequence: TAG
gagtcatctcttgcttgtct

SEQ ID NO: 90106 - DNA, 20 bp, Artificial Sequence
  Description of Artificial Sequence: Synthetic oligonucleotide
  Target: ATXN1; (-) strand; PAM type: NRG; PAM sequence: GAG
tcatcaactatgcttattat

SEQ ID NO: 90107 - DNA, 20 bp, Artificial Sequence
  Description of Artificial Sequence: Synthetic oligonucleotide
  Target: ATXN1; (-) strand; PAM type: NRG; PAM sequence: TGG
atgactcagagaggaagagt

SEQ ID NO: 90108 - DNA, 20 bp, Artificial Sequence
  Description of Artificial Sequence: Synthetic oligonucleotide
  Target: ATXN1; (-) strand; PAM type: NRG; PAM sequence: GAG
agggatgactcagagaggaa

SEQ ID NO: 90109 - DNA, 20 bp, Artificial Sequence
  Description of Artificial Sequence: Synthetic oligonucleotide
  Target: ATXN1; (-) strand; PAM type: NRG; PAM sequence: AAG
gaagggatgactcagagagg

SEQ ID NO: 90110 - DNA, 20 bp, Artificial Sequence
  Description of Artificial Sequence: Synthetic oligonucleotide
  Target: ATXN1; (-) strand; PAM type: NRG; PAM sequence: AGG
ctggaagggatgactcagag

SEQ ID NO: 90111 - DNA, 20 bp, Artificial Sequence
  Description of Artificial Sequence: Synthetic oligonucleotide
  Target: ATXN1; (-) strand; PAM type: NRG; PAM sequence: GAG
actggaagggatgactcaga

SEQ ID NO: 90112 - DNA, 20 bp, Artificial Sequence
  Description of Artificial Sequence: Synthetic oligonucleotide
  Target: ATXN1; (-) strand; PAM type: NRG; PAM sequence: GAG
tcactggaagggatgactca

SEQ ID NO: 90113 - DNA, 20 bp, Artificial Sequence
  Description of Artificial Sequence: Synthetic oligonucleotide
  Target: ATXN1; (-) strand; PAM type: NRG; PAM sequence: CAG
tttcactggaagggatgact

SEQ ID NO: 90114 - DNA, 20 bp, Artificial Sequence
  Description of Artificial Sequence: Synthetic oligonucleotide
  Target: ATXN1; (-) strand; PAM type: NRG; PAM sequence: GGG
tagcgattctttcactggaa

SEQ ID NO: 90115 - DNA, 20 bp, Artificial Sequence
  Description of Artificial Sequence: Synthetic oligonucleotide
  Target: ATXN1; (-) strand; PAM type: NRG; PAM sequence: AGG
ctagcgattctttcactgga

SEQ ID NO: 90116 - DNA, 20 bp, Artificial Sequence
  Description of Artificial Sequence: Synthetic oligonucleotide
  Target: ATXN1; (-) strand; PAM type: NRG; PAM sequence: AAG
cctagcgattctttcactgg

SEQ ID NO: 90117 - DNA, 20 bp, Artificial Sequence
  Description of Artificial Sequence: Synthetic oligonucleotide
  Target: ATXN1; (-) strand; PAM type: NRG; PAM sequence: TGG
actcctagcgattctttcac

SEQ ID NO: 90118 - DNA, 20 bp, Artificial Sequence
  Description of Artificial Sequence: Synthetic oligonucleotide
  Target: ATXN1; (-) strand; PAM type: NRG; PAM sequence: TAG
tcagccagggttaatactcc

SEQ ID NO: 90119 - DNA, 20 bp, Artificial Sequence
  Description of Artificial Sequence: Synthetic oligonucleotide
  Target: ATXN1; (-) strand; PAM type: NRG; PAM sequence: GGG
ggcatctactttttcagcca

SEQ ID NO: 90120 - DNA, 20 bp, Artificial Sequence
  Description of Artificial Sequence: Synthetic oligonucleotide
  Target: ATXN1; (-) strand; PAM type: NRG; PAM sequence: AGG
tggcatctactttttcagcc

SEQ ID NO: 90121 - DNA, 20 bp, Artificial Sequence
  Description of Artificial Sequence: Synthetic oligonucleotide
  Target: ATXN1; (-) strand; PAM type: NRG; PAM sequence: CAG
atggcatctactttttcagc

SEQ ID NO: 90122 - DNA, 20 bp, Artificial Sequence
  Description of Artificial Sequence: Synthetic oligonucleotide
  Target: ATXN1; (-) strand; PAM type: NRG; PAM sequence: CAG
tcacatggcatctacttttt

SEQ ID NO: 90123 - DNA, 20 bp, Artificial Sequence
  Description of Artificial Sequence: Synthetic oligonucleotide
  Target: ATXN1; (-) strand; PAM type: NRG; PAM sequence: TGG
taaagtttaatgtgctcaca

SEQ ID NO: 90124 - DNA, 20 bp, Artificial Sequence
  Description of Artificial Sequence: Synthetic oligonucleotide
  Target: ATXN1; (-) strand; PAM type: NRG; PAM sequence: AAG
taccactccattgtttggta

SEQ ID NO: 90125 - DNA, 20 bp, Artificial Sequence
  Description of Artificial Sequence: Synthetic oligonucleotide
  Target: ATXN1; (-) strand; PAM type: NRG; PAM sequence: TGG
tcccttaccactccattgtt

SEQ ID NO: 90126 - DNA, 20 bp, Artificial Sequence
  Description of Artificial Sequence: Synthetic oligonucleotide
  Target: ATXN1; (-) strand; PAM type: NRG; PAM sequence: CAG
ctagattcagatagtttgga

SEQ ID NO: 90127 - DNA, 20 bp, Artificial Sequence
  Description of Artificial Sequence: Synthetic oligonucleotide
  Target: ATXN1; (-) strand; PAM type: NRG; PAM sequence: TGG
ccctctagattcagatagtt

SEQ ID NO: 90128 - DNA, 20 bp, Artificial Sequence
  Description of Artificial Sequence: Synthetic oligonucleotide
  Target: ATXN1; (-) strand; PAM type: NRG; PAM sequence: TAG
gcggtccctctagattcaga

SEQ ID NO: 90129 - DNA, 20 bp, Artificial Sequence
  Description of Artificial Sequence: Synthetic oligonucleotide
  Target: ATXN1; (-) strand; PAM type: NRG; PAM sequence: CAG
tggagcggtccctctagatt

SEQ ID NO: 90130 - DNA, 20 bp, Artificial Sequence
  Description of Artificial Sequence: Synthetic oligonucleotide
  Target: ATXN1; (-) strand; PAM type: NRG; PAM sequence: TAG
tattcatggagcggtccctc

SEQ ID NO: 90131 - DNA, 20 bp, Artificial Sequence
  Description of Artificial Sequence: Synthetic oligonucleotide
  Target: ATXN1; (-) strand; PAM type: NRG; PAM sequence: CGG
attgaaacttattcatggag

SEQ ID NO: 90132 - DNA, 20 bp, Artificial Sequence
  Description of Artificial Sequence: Synthetic oligonucleotide
  Target: ATXN1; (-) strand; PAM type: NRG; PAM sequence: GAG
tgtattgaaacttattcatg

SEQ ID NO: 90133 - DNA, 20 bp, Artificial Sequence
  Description of Artificial Sequence: Synthetic oligonucleotide
  Target: ATXN1; (-) strand; PAM type: NRG; PAM sequence: TGG
attgtattgaaacttattca

SEQ ID NO: 90134 - DNA, 20 bp, Artificial Sequence
  Description of Artificial Sequence: Synthetic oligonucleotide
  Target: ATXN1; (-) strand; PAM type: NRG; PAM sequence: CGG
gtaaattgaaatagaggaag

SEQ ID NO: 90135 - DNA, 20 bp, Artificial Sequence
  Description of Artificial Sequence: Synthetic oligonucleotide
  Target: ATXN1; (-) strand; PAM type: NRG; PAM sequence: AAG
tttgtaaattgaaatagagg

SEQ ID NO: 90136 - DNA, 20 bp, Artificial Sequence
  Description of Artificial Sequence: Synthetic oligonucleotide
  Target: ATXN1; (-) strand; PAM type: NRG; PAM sequence: AGG
gcgtttgtaaattgaaatag

SEQ ID NO: 90137 - DNA, 20 bp, Artificial Sequence
  Description of Artificial Sequence: Synthetic oligonucleotide
  Target: ATXN1; (-) strand; PAM type: NRG; PAM sequence: GAG
agcgtttgtaaattgaaata

SEQ ID NO: 90138 - DNA, 20 bp, Artificial Sequence
  Description of Artificial Sequence: Synthetic oligonucleotide
  Target: ATXN1; (-) strand; PAM type: NRG; PAM sequence: TAG
ccagcgtttgtaaattgaaa

SEQ ID NO: 90139 - DNA, 20 bp, Artificial Sequence
  Description of Artificial Sequence: Synthetic oligonucleotide
  Target: ATXN1; (-) strand; PAM type: NRG; PAM sequence: CAG
gaaagctattcctgtaaacc

SEQ ID NO: 90140 - DNA, 20 bp, Artificial Sequence
  Description of Artificial Sequence: Synthetic oligonucleotide
  Target: ATXN1; (-) strand; PAM type: NRG; PAM sequence: AAG
ttttataggaatgtctcaga

SEQ ID NO: 90141 - DNA, 20 bp, Artificial Sequence
  Description of Artificial Sequence: Synthetic oligonucleotide
  Target: ATXN1; (-) strand; PAM type: NRG; PAM sequence: CAG
ctaattttataggaatgtct

SEQ ID NO: 90142 - DNA, 20 bp, Artificial Sequence
  Description of Artificial Sequence: Synthetic oligonucleotide
  Target: ATXN1; (-) strand; PAM type: NRG; PAM sequence: AGG
agtgagtaagctaattttat

SEQ ID NO: 90143 - DNA, 20 bp, Artificial Sequence
  Description of Artificial Sequence: Synthetic oligonucleotide
  Target: ATXN1; (-) strand; PAM type: NRG; PAM sequence: TAG
cagtgagtaagctaatttta

SEQ ID NO: 90144 - DNA, 20 bp, Artificial Sequence
  Description of Artificial Sequence: Synthetic oligonucleotide
  Target: ATXN1; (-) strand; PAM type: NRG; PAM sequence: AAG
tttttaaaaattcagtgagt

SEQ ID NO: 90145 - DNA, 20 bp, Artificial Sequence
  Description of Artificial Sequence: Synthetic oligonucleotide
  Target: ATXN1; (-) strand; PAM type: NRG; PAM sequence: GAG
ctcctttttaaaaattcagt

SEQ ID NO: 90146 - DNA, 20 bp, Artificial Sequence
  Description of Artificial Sequence: Synthetic oligonucleotide
  Target: ATXN1; (-) strand; PAM type: NRG; PAM sequence: CAG
tgttctcctttttaaaaatt

SEQ ID NO: 90147 - DNA, 20 bp, Artificial Sequence
  Description of Artificial Sequence: Synthetic oligonucleotide
  Target: ATXN1; (-) strand; PAM type: NRG; PAM sequence: TGG
cagaggccaatggcgtcctt

SEQ ID NO: 90148 - DNA, 20 bp, Artificial Sequence
  Description of Artificial Sequence: Synthetic oligonucleotide
  Target: ATXN1; (-) strand; PAM type: NRG; PAM sequence: TGG
catacgcccccagaggccaa

SEQ ID NO: 90149 - DNA, 20 bp, Artificial Sequence
  Description of Artificial Sequence: Synthetic oligonucleotide
  Target: ATXN1; (-) strand; PAM type: NRG; PAM sequence: AGG
tcacacacatacgcccccag

SEQ ID NO: 90150 - DNA, 20 bp, Artificial Sequence
  Description of Artificial Sequence: Synthetic oligonucleotide
  Target: ATXN1; (-) strand; PAM type: NRG; PAM sequence: GAG
ttcacacacatacgccccca

SEQ ID NO: 90151 - DNA, 20 bp, Artificial Sequence
  Description of Artificial Sequence: Synthetic oligonucleotide
  Target: ATXN1; (-) strand; PAM type: NRG; PAM sequence: CAG
tgttcacacacatacgcccc

SEQ ID NO: 90152 - DNA, 20 bp, Artificial Sequence
  Description of Artificial Sequence: Synthetic oligonucleotide
  Target: ATXN1; (-) strand; PAM type: NRG; PAM sequence: CAG
acatcatttctacacagcat

SEQ ID NO: 90153 - DNA, 20 bp, Artificial Sequence
  Description of Artificial Sequence: Synthetic oligonucleotide
  Target: ATXN1; (-) strand; PAM type: NRG; PAM sequence: CAG
attgacacatcatttctaca

SEQ ID NO: 90154 - DNA, 20 bp, Artificial Sequence
  Description of Artificial Sequence: Synthetic oligonucleotide
  Target: ATXN1; (-) strand; PAM type: NRG; PAM sequence: TAG
ttgagcagttttcacacaag

SEQ ID NO: 90155 - DNA, 20 bp, Artificial Sequence
  Description of Artificial Sequence: Synthetic oligonucleotide
  Target: ATXN1; (-) strand; PAM type: NRG; PAM sequence: AAG
ggattgagcagttttcacac

SEQ ID NO: 90156 - DNA, 20 bp, Artificial Sequence
  Description of Artificial Sequence: Synthetic oligonucleotide
  Target: ATXN1; (-) strand; PAM type: NRG; PAM sequence: CAG
gaagtaactcttggattgag

SEQ ID NO: 90157 - DNA, 20 bp, Artificial Sequence
  Description of Artificial Sequence: Synthetic oligonucleotide
  Target: ATXN1; (-) strand; PAM type: NRG; PAM sequence: GAG
caagaagtaactcttggatt

SEQ ID NO: 90158 - DNA, 20 bp, Artificial Sequence
  Description of Artificial Sequence: Synthetic oligonucleotide
  Target: ATXN1; (-) strand; PAM type: NRG; PAM sequence: TGG
tagaaacaagaagtaactct

SEQ ID NO: 90159 - DNA, 20 bp, Artificial Sequence
  Description of Artificial Sequence: Synthetic oligonucleotide
  Target: ATXN1; (-) strand; PAM type: NRG; PAM sequence: AAG
gttcagtcagtagaaacaag

SEQ ID NO: 90160 - DNA, 20 bp, Artificial Sequence
  Description of Artificial Sequence: Synthetic oligonucleotide
  Target: ATXN1; (-) strand; PAM type: NRG; PAM sequence: AAG
catgttcagtcagtagaaac

SEQ ID NO: 90161 - DNA, 20 bp, Artificial Sequence
  Description of Artificial Sequence: Synthetic oligonucleotide
  Target: ATXN1; (-) strand; PAM type: NRG; PAM sequence: TAG
ctctcttcatgttcagtcag

SEQ ID NO: 90162 - DNA, 20 bp, Artificial Sequence
  Description of Artificial Sequence: Synthetic oligonucleotide
  Target: ATXN1; (-) strand; PAM type: NRG; PAM sequence: CAG
gttctctcttcatgttcagt

SEQ ID NO: 90163 - DNA, 20 bp, Artificial Sequence
  Description of Artificial Sequence: Synthetic oligonucleotide
  Target: ATXN1; (-) strand; PAM type: NRG; PAM sequence: CAG
tttggttctctcttcatgtt

SEQ ID NO: 90164 - DNA, 20 bp, Artificial Sequence
  Description of Artificial Sequence: Synthetic oligonucleotide
  Target: ATXN1; (-) strand; PAM type: NRG; PAM sequence: TGG
ctttccctgtctggaatatt

SEQ ID NO: 90165 - DNA, 20 bp, Artificial Sequence
  Description of Artificial Sequence: Synthetic oligonucleotide
  Target: ATXN1; (-) strand; PAM type: NRG; PAM sequence: TGG
tctcagattctttccctgtc

SEQ ID NO: 90166 - DNA, 20 bp, Artificial Sequence
  Description of Artificial Sequence: Synthetic oligonucleotide
  Target: ATXN1; (-) strand; PAM type: NRG; PAM sequence: CAG
cactccactctatgttttct

SEQ ID NO: 90167 - DNA, 20 bp, Artificial Sequence
  Description of Artificial Sequence: Synthetic oligonucleotide
  Target: ATXN1; (-) strand; PAM type: NRG; PAM sequence: TGG
gaggatgaaaagcatccagt

SEQ ID NO: 90168 - DNA, 20 bp, Artificial Sequence
  Description of Artificial Sequence: Synthetic oligonucleotide
  Target: ATXN1; (-) strand; PAM type: NRG; PAM sequence: CAG
catggaggatgaaaagcatc

SEQ ID NO: 90169 - DNA, 20 bp, Artificial Sequence
  Description of Artificial Sequence: Synthetic oligonucleotide
  Target: ATXN1; (-) strand; PAM type: NRG; PAM sequence: AAG
agaactgcatggaggatgaa

SEQ ID NO: 90170 - DNA, 20 bp, Artificial Sequence
  Description of Artificial Sequence: Synthetic oligonucleotide
  Target: ATXN1; (-) strand; PAM type: NRG; PAM sequence: AGG
gcgggtggagaactgcatgg

SEQ ID NO: 90171 - DNA, 20 bp, Artificial Sequence
  Description of Artificial Sequence: Synthetic oligonucleotide
  Target: ATXN1; (-) strand; PAM type: NRG; PAM sequence: GAG
agcgggtggagaactgcatg

SEQ ID NO: 90172 - DNA, 20 bp, Artificial Sequence
  Description of Artificial Sequence: Synthetic oligonucleotide
  Target: ATXN1; (-) strand; PAM type: NRG; PAM sequence: TGG
taagcgggtggagaactgca

SEQ ID NO: 90173 - DNA, 20 bp, Artificial Sequence
  Description of Artificial Sequence: Synthetic oligonucleotide
  Target: ATXN1; (-) strand; PAM type: NRG; PAM sequence: GAG
tgaggggtagtaagcgggtg

SEQ ID NO: 90174 - DNA, 20 bp, Artificial Sequence
  Description of Artificial Sequence: Synthetic oligonucleotide
  Target: ATXN1; (-) strand; PAM type: NRG; PAM sequence: TGG
agtgaggggtagtaagcggg

SEQ ID NO: 90175 - DNA, 20 bp, Artificial Sequence
  Description of Artificial Sequence: Synthetic oligonucleotide
  Target: ATXN1; (-) strand; PAM type: NRG; PAM sequence: GGG
ttaagtgaggggtagtaagc

SEQ ID NO: 90176 - DNA, 20 bp, Artificial Sequence
  Description of Artificial Sequence: Synthetic oligonucleotide
  Target: ATXN1; (-) strand; PAM type: NRG; PAM sequence: CGG
tttaagtgaggggtagtaag

SEQ ID NO: 90177 - DNA, 20 bp, Artificial Sequence
  Description of Artificial Sequence: Synthetic oligonucleotide
  Target: ATXN1; (-) strand; PAM type: NRG; PAM sequence: AAG
cactttaagtgaggggtagt

SEQ ID NO: 90178 - DNA, 20 bp, Artificial Sequence
  Description of Artificial Sequence: Synthetic oligonucleotide
  Target: ATXN1; (-) strand; PAM type: NRG; PAM sequence: TAG
accacactttaagtgagggg

SEQ ID NO: 90179 - DNA, 20 bp, Artificial Sequence
  Description of Artificial Sequence: Synthetic oligonucleotide
  Target: ATXN1; (-) strand; PAM type: NRG; PAM sequence: GGG
aggaccacactttaagtgag

SEQ ID NO: 90180 - DNA, 20 bp, Artificial Sequence
  Description of Artificial Sequence: Synthetic oligonucleotide
  Target: ATXN1; (-) strand; PAM type: NRG; PAM sequence: GGG
caggaccacactttaagtga

SEQ ID NO: 90181 - DNA, 20 bp, Artificial Sequence
  Description of Artificial Sequence: Synthetic oligonucleotide
  Target: ATXN1; (-) strand; PAM type: NRG; PAM sequence: AGG
ccaggaccacactttaagtg

SEQ ID NO: 90182 - DNA, 20 bp, Artificial Sequence
  Description of Artificial Sequence: Synthetic oligonucleotide
  Target: ATXN1; (-) strand; PAM type: NRG; PAM sequence: GAG
cccaggaccacactttaagt

SEQ ID NO: 90183 - DNA, 20 bp, Artificial Sequence
  Description of Artificial Sequence: Synthetic oligonucleotide
  Target: ATXN1; (-) strand; PAM type: NRG; PAM sequence: AAG
tggccccaggaccacacttt

SEQ ID NO: 90184 - DNA, 20 bp, Artificial Sequence
  Description of Artificial Sequence: Synthetic oligonucleotide
  Target: ATXN1; (-) strand; PAM type: NRG; PAM sequence: AGG
aaactgatgctgctggcccc

SEQ ID NO: 90185 - DNA, 20 bp, Artificial Sequence
  Description of Artificial Sequence: Synthetic oligonucleotide
  Target: ATXN1; (-) strand; PAM type: NRG; PAM sequence: CAG
gaaactgatgctgctggccc

SEQ ID NO: 90186 - DNA, 20 bp, Artificial Sequence
  Description of Artificial Sequence: Synthetic oligonucleotide
  Target: ATXN1; (-) strand; PAM type: NRG; PAM sequence: TGG
ctccgtgaaactgatgctgc

SEQ ID NO: 90187 - DNA, 20 bp, Artificial Sequence
  Description of Artificial Sequence: Synthetic oligonucleotide
  Target: ATXN1; (-) strand; PAM type: NRG; PAM sequence: GAG
atagttctagggtggagcct

SEQ ID NO: 90188 - DNA, 20 bp, Artificial Sequence
  Description of Artificial Sequence: Synthetic oligonucleotide
  Target: ATXN1; (-) strand; PAM type: NRG; PAM sequence: GAG
gatttaatagttctagggtg

SEQ ID NO: 90189 - DNA, 20 bp, Artificial Sequence
  Description of Artificial Sequence: Synthetic oligonucleotide
  Target: ATXN1; (-) strand; PAM type: NRG; PAM sequence: TGG
ctgatttaatagttctaggg

SEQ ID NO: 90190 - DNA, 20 bp, Artificial Sequence
  Description of Artificial Sequence: Synthetic oligonucleotide
  Target: ATXN1; (-) strand; PAM type: NRG; PAM sequence: GGG
gttctgatttaatagttcta

SEQ ID NO: 90191 - DNA, 20 bp, Artificial Sequence
  Description of Artificial Sequence: Synthetic oligonucleotide
  Target: ATXN1; (-) strand; PAM type: NRG; PAM sequence: AGG
ggttctgatttaatagttct

SEQ ID NO: 90192 - DNA, 20 bp, Artificial Sequence
  Description of Artificial Sequence: Synthetic oligonucleotide
  Target: ATXN1; (-) strand; PAM type: NRG; PAM sequence: TAG
gggttctgatttaatagttc

SEQ ID NO: 90193 - DNA, 20 bp, Artificial Sequence
  Description of Artificial Sequence: Synthetic oligonucleotide
  Target: ATXN1; (-) strand; PAM type: NRG; PAM sequence: TAG
gcccaggggttctgatttaa

SEQ ID NO: 90194 - DNA, 20 bp, Artificial Sequence
  Description of Artificial Sequence: Synthetic oligonucleotide
  Target: ATXN1; (-) strand; PAM type: NRG; PAM sequence: GGG
tttctgggcgccaggcccag

SEQ ID NO: 90195 - DNA, 20 bp, Artificial Sequence
  Description of Artificial Sequence: Synthetic oligonucleotide
  Target: ATXN1; (-) strand; PAM type: NRG; PAM sequence: GGG
atttctgggcgccaggccca

SEQ ID NO: 90196 - DNA, 20 bp, Artificial Sequence
  Description of Artificial Sequence: Synthetic oligonucleotide
  Target: ATXN1; (-) strand; PAM type: NRG; PAM sequence: AGG
gatttctgggcgccaggccc

SEQ ID NO: 90197 - DNA, 20 bp, Artificial Sequence
  Description of Artificial Sequence: Synthetic oligonucleotide
  Target: ATXN1; (-) strand; PAM type: NRG; PAM sequence: CAG
agatttctgggcgccaggcc

SEQ ID NO: 90198 - DNA, 20 bp, Artificial Sequence
  Description of Artificial Sequence: Synthetic oligonucleotide
  Target: ATXN1; (-) strand; PAM type: NRG; PAM sequence: AGG
accacagatttctgggcgcc

SEQ ID NO: 90199 - DNA, 20 bp, Artificial Sequence
  Description of Artificial Sequence: Synthetic oligonucleotide
  Target: ATXN1; (-) strand; PAM type: NRG; PAM sequence: CAG
gaccacagatttctgggcgc

SEQ ID NO: 90200 - DNA, 20 bp, Artificial Sequence
  Description of Artificial Sequence: Synthetic oligonucleotide
  Target: ATXN1; (-) strand; PAM type: NRG; PAM sequence: GGG
tgtttagaccacagatttct

SEQ ID NO: 90201 - DNA, 20 bp, Artificial Sequence
  Description of Artificial Sequence: Synthetic oligonucleotide
  Target: ATXN1; (-) strand; PAM type: NRG; PAM sequence: TGG
ttgtttagaccacagatttc

SEQ ID NO: 90202 - DNA, 20 bp, Artificial Sequence
  Description of Artificial Sequence: Synthetic oligonucleotide
  Target: ATXN1; (-) strand; PAM type: NRG; PAM sequence: CAG
tggaaggcttgtttagacca

SEQ ID NO: 90203 - DNA, 20 bp, Artificial Sequence
  Description of Artificial Sequence: Synthetic oligonucleotide
  Target: ATXN1; (-) strand; PAM type: NRG; PAM sequence: TAG
aggcacctggaaggcttgtt

SEQ ID NO: 90204 - DNA, 20 bp, Artificial Sequence
  Description of Artificial Sequence: Synthetic oligonucleotide
  Target: ATXN1; (-) strand; PAM type: NRG; PAM sequence: AGG
ttgcatcagaggcacctgga

SEQ ID NO: 90205 - DNA, 20 bp, Artificial Sequence
  Description of Artificial Sequence: Synthetic oligonucleotide
  Target: ATXN1; (-) strand; PAM type: NRG; PAM sequence: AAG
tttgcatcagaggcacctgg

SEQ ID NO: 90206 - DNA, 20 bp, Artificial Sequence
  Description of Artificial Sequence: Synthetic oligonucleotide
  Target: ATXN1; (-) strand; PAM type: NRG; PAM sequence: TGG
atgtttgcatcagaggcacc

SEQ ID NO: 90207 - DNA, 20 bp, Artificial Sequence
  Description of Artificial Sequence: Synthetic oligonucleotide
  Target: ATXN1; (-) strand; PAM type: NRG; PAM sequence: AGG
ttattgaatgtttgcatcag

SEQ ID NO: 90208 - DNA, 20 bp, Artificial Sequence
  Description of Artificial Sequence: Synthetic oligonucleotide
  Target: ATXN1; (-) strand; PAM type: NRG; PAM sequence: GAG
tttattgaatgtttgcatca

SEQ ID NO: 90209 - DNA, 20 bp, Artificial Sequence
  Description of Artificial Sequence: Synthetic oligonucleotide
  Target: ATXN1; (-) strand; PAM type: NRG; PAM sequence: CAG
attttattgaatgtttgcat

SEQ ID NO: 90210 - DNA, 20 bp, Artificial Sequence
  Description of Artificial Sequence: Synthetic oligonucleotide
  Target: ATXN1; (-) strand; PAM type: NRG; PAM sequence: AAG
cgcgcggccagggaccagtt

SEQ ID NO: 90211 - DNA, 20 bp, Artificial Sequence
  Description of Artificial Sequence: Synthetic oligonucleotide
  Target: ATXN1; (-) strand; PAM type: NRG; PAM sequence: CAG
tactacgcgcggccagggac

SEQ ID NO: 90212 - DNA, 20 bp, Artificial Sequence
  Description of Artificial Sequence: Synthetic oligonucleotide
  Target: ATXN1; (-) strand; PAM type: NRG; PAM sequence: GGG
tgagttactacgcgcggcca

SEQ ID NO: 90213 - DNA, 20 bp, Artificial Sequence
  Description of Artificial Sequence: Synthetic oligonucleotide
  Target: ATXN1; (-) strand; PAM type: NRG; PAM sequence: AGG
atgagttactacgcgcggcc

SEQ ID NO: 90214 - DNA, 20 bp, Artificial Sequence
  Description of Artificial Sequence: Synthetic oligonucleotide
  Target: ATXN1; (-) strand; PAM type: NRG; PAM sequence: CAG
catgagttactacgcgcggc

SEQ ID NO: 90215 - DNA, 20 bp, Artificial Sequence
  Description of Artificial Sequence: Synthetic oligonucleotide
  Target: ATXN1; (-) strand; PAM type: NRG; PAM sequence: CGG
taggcatgagttactacgcg

SEQ ID NO: 90216 - DNA, 20 bp, Artificial Sequence
  Description of Artificial Sequence: Synthetic oligonucleotide
  Target: ATXN1; (-) strand; PAM type: NRG; PAM sequence: GAG
agtactgggattataggcat

SEQ ID NO: 90217 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtactgggattat

SEQ ID NO: 90218 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtactgggatta

SEQ ID NO: 90219 - DNA, 20 bp, Artificial Sequence
  Description of Artificial Sequence: Synthetic oligonucleotide
  Target: ATXN1; (-) strand; PAM type: NRG; PAM sequence: GGG
ctttggcctcccaaagtact

SEQ ID NO: 90220 - DNA, 20 bp, Artificial Sequence
  Description of Artificial Sequence: Synthetic oligonucleotide
  Target: ATXN1; (-) strand; PAM type: NRG; PAM sequence: TGG
gctttggcctcccaaagtac

SEQ ID NO: 90221 - DNA, 20 bp, Artificial Sequence
  Description of Artificial Sequence: Synthetic oligonucleotide
  Target: ATXN1; (-) strand; PAM type: NRG; PAM sequence: AAG
ccacccgctttggcctccca

SEQ ID NO: 90222 - DNA, 20 bp, Artificial Sequence
  Description of Artificial Sequence: Synthetic oligonucleotide
  Target: ATXN1; (-) strand; PAM type: NRG; PAM sequence: TGG
ctcatgtgatccacccgctt

SEQ ID NO: 90223 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtctcaaacttc

SEQ ID NO: 90224 - DNA, 20 bp, Artificial Sequence
  Description of Artificial Sequence: Synthetic oligonucleotide
  Target: ATXN1; (-) strand; PAM type: NRG; PAM sequence: TGG
atttcacatgttggccaggc

SEQ ID NO: 90225 - DNA, 20 bp, Artificial Sequence
  Description of Artificial Sequence: Synthetic oligonucleotide
  Target: ATXN1; (-) strand; PAM type: NRG; PAM sequence: AGG
cgagatttcacatgttggcc

SEQ ID NO: 90226 - DNA, 20 bp, Artificial Sequence
  Description of Artificial Sequence: Synthetic oligonucleotide
  Target: ATXN1; (-) strand; PAM type: NRG; PAM sequence: CAG
acgagatttcacatgttggc

SEQ ID NO: 90227 - DNA, 20 bp, Artificial Sequence
  Description of Artificial Sequence: Synthetic oligonucleotide
  Target: ATXN1; (-) strand; PAM type: NRG; PAM sequence: TGG
aaagacgagatttcacatgt

SEQ ID NO: 90228 - DNA, 20 bp, Artificial Sequence
  Description of Artificial Sequence: Synthetic oligonucleotide
  Target: ATXN1; (-) strand; PAM type: NRG; PAM sequence: GAG
ttttgtatttttataaagac

SEQ ID NO: 90229 - DNA, 20 bp, Artificial Sequence
  Description of Artificial Sequence: Synthetic oligonucleotide
  Target: ATXN1; (-) strand; PAM type: NRG; PAM sequence: AAG
ctaatttttgtatttttata

SEQ ID NO: 90230 - DNA, 20 bp, Artificial Sequence
  Description of Artificial Sequence: Synthetic oligonucleotide
  Target: ATXN1; (-) strand; PAM type: NRG; PAM sequence: TGG
gaggtgcacaccaccacgcc

SEQ ID NO: 90231 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggactag

SEQ ID NO: 90232 - DNA, 20 bp, Artificial Sequence
  Description of Artificial Sequence: Synthetic oligonucleotide
  Target: ATXN1; (-) strand; PAM type: NRG; PAM sequence: GAG
ctcccaagtagctgggacta

SEQ ID NO: 90233 - DNA, 20 bp, Artificial Sequence
  Description of Artificial Sequence: Synthetic oligonucleotide
  Target: ATXN1; (-) strand; PAM type: NRG; PAM sequence: TAG
acctcccaagtagctgggac

SEQ ID NO: 90234 - DNA, 20 bp, Artificial Sequence
  Description of Artificial Sequence: Synthetic oligonucleotide
  Target: ATXN1; (-) strand; PAM type: NRG; PAM sequence: GGG
cctcaacctcccaagtagct

SEQ ID NO: 90235 - DNA, 20 bp, Artificial Sequence
  Description of Artificial Sequence: Synthetic oligonucleotide
  Target: ATXN1; (-) strand; PAM type: NRG; PAM sequence: TGG
gcctcaacctcccaagtagc

SEQ ID NO: 90236 - DNA, 20 bp, Artificial Sequence
  Description of Artificial Sequence: Synthetic oligonucleotide
  Target: ATXN1; (-) strand; PAM type: NRG; PAM sequence: TAG
ctctgcctcaacctcccaag

SEQ ID NO: 90237 - DNA, 20 bp, Artificial Sequence
  Description of Artificial Sequence: Synthetic oligonucleotide
  Target: ATXN1; (-) strand; PAM type: NRG; PAM sequence: AAG
attctctgcctcaacctccc

SEQ ID NO: 90238 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcctgggttc

SEQ ID NO: 90239 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcctcct

SEQ ID NO: 90240 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctccgcctcc

SEQ ID NO: 90241 - DNA, 20 bp, Artificial Sequence
  Description of Artificial Sequence: Synthetic oligonucleotide
  Target: ATXN1; (-) strand; PAM type: NRG; PAM sequence: TGG
ggcatggagtggtgtgatct

SEQ ID NO: 90242 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggcatggag

SEQ ID NO: 90243 - DNA, 20 bp, Artificial Sequence
  Description of Artificial Sequence: Synthetic oligonucleotide
  Target: ATXN1; (-) strand; PAM type: NRG; PAM sequence: GAG
ctgtcgcccaggctggcatg

SEQ ID NO: 90244 - DNA, 20 bp, Artificial Sequence
  Description of Artificial Sequence: Synthetic oligonucleotide
  Target: ATXN1; (-) strand; PAM type: NRG; PAM sequence: TGG
ctctgtcgcccaggctggca

SEQ ID NO: 90245 - DNA, 20 bp, Artificial Sequence
  Description of Artificial Sequence: Synthetic oligonucleotide
  Target: ATXN1; (-) strand; PAM type: NRG; PAM sequence: TGG
tcttactctgtcgcccaggc

SEQ ID NO: 90246 - DNA, 20 bp, Artificial Sequence
  Description of Artificial Sequence: Synthetic oligonucleotide
  Target: ATXN1; (-) strand; PAM type: NRG; PAM sequence: AGG
acagtcttactctgtcgccc

SEQ ID NO: 90247 - DNA, 20 bp, Artificial Sequence
  Description of Artificial Sequence: Synthetic oligonucleotide
  Target: ATXN1; (-) strand; PAM type: NRG; PAM sequence: CAG
tacagtcttactctgtcgcc

SEQ ID NO: 90248 - DNA, 20 bp, Artificial Sequence
  Description of Artificial Sequence: Synthetic oligonucleotide
  Target: ATXN1; (-) strand; PAM type: NRG; PAM sequence: CAG
tttttctttctttttttcta

SEQ ID NO: 90249 - DNA, 20 bp, Artificial Sequence
  Description of Artificial Sequence: Synthetic oligonucleotide
  Target: ATXN1; (-) strand; PAM type: NRG; PAM sequence: TGG
gtgtgtgtgtgtgtggtgtg

SEQ ID NO: 90250 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtgtgtgtgtgtgtg

SEQ ID NO: 90251 - DNA, 20 bp, Artificial Sequence
  Description of Artificial Sequence: Synthetic oligonucleotide
  Target: ATXN1; (-) strand; PAM type: NRG; PAM sequence: TGG
atgcaaatggggccaggttt

SEQ ID NO: 90252 - DNA, 20 bp, Artificial Sequence
  Description of Artificial Sequence: Synthetic oligonucleotide
  Target: ATXN1; (-) strand; PAM type: NRG; PAM sequence: AGG
tagtacatgcaaatggggcc

SEQ ID NO: 90253 - DNA, 20 bp, Artificial Sequence
  Description of Artificial Sequence: Synthetic oligonucleotide
  Target: ATXN1; (-) strand; PAM type: NRG; PAM sequence: CAG
gtagtacatgcaaatggggc

SEQ ID NO: 90254 - DNA, 20 bp, Artificial Sequence
  Description of Artificial Sequence: Synthetic oligonucleotide
  Target: ATXN1; (-) strand; PAM type: NRG; PAM sequence: GGG
agcagtagtacatgcaaatg

SEQ ID NO: 90255 - DNA, 20 bp, Artificial Sequence
  Description of Artificial Sequence: Synthetic oligonucleotide
  Target: ATXN1; (-) strand; PAM type: NRG; PAM sequence: GGG
tagcagtagtacatgcaaat

SEQ ID NO: 90256 - DNA, 20 bp, Artificial Sequence
  Description of Artificial Sequence: Synthetic oligonucleotide
  Target: ATXN1; (-) strand; PAM type: NRG; PAM sequence: TGG
gtagcagtagtacatgcaaa

SEQ ID NO: 90257 - DNA, 20 bp, Artificial Sequence
  Description of Artificial Sequence: Synthetic oligonucleotide
  Target: ATXN1; (-) strand; PAM type: NRG; PAM sequence: TAG
gtgagggatgagtgtagcag

SEQ ID NO: 90258 - DNA, 20 bp, Artificial Sequence
  Description of Artificial Sequence: Synthetic oligonucleotide
  Target: ATXN1; (-) strand; PAM type: NRG; PAM sequence: CAG
ggagtgagggatgagtgtag

SEQ ID NO: 90259 - DNA, 20 bp, Artificial Sequence
  Description of Artificial Sequence: Synthetic oligonucleotide
  Target: ATXN1; (-) strand; PAM type: NRG; PAM sequence: TAG
gtgggagtgagggatgagtg

SEQ ID NO: 90260 - DNA, 20 bp, Artificial Sequence
  Description of Artificial Sequence: Synthetic oligonucleotide
  Target: ATXN1; (-) strand; PAM type: NRG; PAM sequence: GAG
ggtgggtgggagtgagggat

SEQ ID NO: 90261 - DNA, 20 bp, Artificial Sequence
  Description of Artificial Sequence: Synthetic oligonucleotide
  Target: ATXN1; (-) strand; PAM type: NRG; PAM sequence: GGG
cgaaaggtgggtgggagtga

SEQ ID NO: 90262 - DNA, 20 bp, Artificial Sequence
  Description of Artificial Sequence: Synthetic oligonucleotide
  Target: ATXN1; (-) strand; PAM type: NRG; PAM sequence: AGG
ccgaaaggtgggtgggagtg

SEQ ID NO: 90263 - DNA, 20 bp, Artificial Sequence
  Description of Artificial Sequence: Synthetic oligonucleotide
  Target: ATXN1; (-) strand; PAM type: NRG; PAM sequence: GAG
tccgaaaggtgggtgggagt

SEQ ID NO: 90264 - DNA, 20 bp, Artificial Sequence
  Description of Artificial Sequence: Synthetic oligonucleotide
  Target: ATXN1; (-) strand; PAM type: NRG; PAM sequence: GAG
tacctccgaaaggtgggtgg

SEQ ID NO: 90265 - DNA, 20 bp, Artificial Sequence
  Description of Artificial Sequence: Synthetic oligonucleotide
  Target: ATXN1; (-) strand; PAM type: NRG; PAM sequence: GGG
cctacctccgaaaggtgggt

SEQ ID NO: 90266 - DNA, 20 bp, Artificial Sequence
  Description of Artificial Sequence: Synthetic oligonucleotide
  Target: ATXN1; (-) strand; PAM type: NRG; PAM sequence: TGG
gcctacctccgaaaggtggg

SEQ ID NO: 90267 - DNA, 20 bp, Artificial Sequence
  Description of Artificial Sequence: Synthetic oligonucleotide
  Target: ATXN1; (-) strand; PAM type: NRG; PAM sequence: GGG
gcggcctacctccgaaaggt

SEQ ID NO: 90268 - DNA, 20 bp, Artificial Sequence
  Description of Artificial Sequence: Synthetic oligonucleotide
  Target: ATXN1; (-) strand; PAM type: NRG; PAM sequence: TGG
ggcggcctacctccgaaagg

SEQ ID NO: 90269 - DNA, 20 bp, Artificial Sequence
  Description of Artificial Sequence: Synthetic oligonucleotide
  Target: ATXN1; (-) strand; PAM type: NRG; PAM sequence: AGG
atgggcggcctacctccgaa

SEQ ID NO: 90270 - DNA, 20 bp, Artificial Sequence
  Description of Artificial Sequence: Synthetic oligonucleotide
  Target: ATXN1; (-) strand; PAM type: NRG; PAM sequence: AAG
gatgggcggcctacctccga

SEQ ID NO: 90271 - DNA, 20 bp, Artificial Sequence
  Description of Artificial Sequence: Synthetic oligonucleotide
  Target: ATXN1; (-) strand; PAM type: NRG; PAM sequence: CGG
ctgctaaatctagtgatggg

SEQ ID NO: 90272 - DNA, 20 bp, Artificial Sequence
  Description of Artificial Sequence: Synthetic oligonucleotide
  Target: ATXN1; (-) strand; PAM type: NRG; PAM sequence: GGG
gctctgctaaatctagtgat

SEQ ID NO: 90273 - DNA, 20 bp, Artificial Sequence
  Description of Artificial Sequence: Synthetic oligonucleotide
  Target: ATXN1; (-) strand; PAM type: NRG; PAM sequence: TGG
tgctctgctaaatctagtga

SEQ ID NO: 90274 - DNA, 20 bp, Artificial Sequence
  Description of Artificial Sequence: Synthetic oligonucleotide
  Target: ATXN1; (-) strand; PAM type: NRG; PAM sequence: TAG
agcggatgctctgctaaatc

SEQ ID NO: 90275 - DNA, 20 bp, Artificial Sequence
  Description of Artificial Sequence: Synthetic oligonucleotide
  Target: ATXN1; (-) strand; PAM type: NRG; PAM sequence: CGG
ctgtgtctcatttcagtcag

SEQ ID NO: 90276 - DNA, 20 bp, Artificial Sequence
  Description of Artificial Sequence: Synthetic oligonucleotide
  Target: ATXN1; (-) strand; PAM type: NRG; PAM sequence: CAG
cagctgtgtctcatttcagt

SEQ ID NO: 90277 - DNA, 20 bp, Artificial Sequence
  Description of Artificial Sequence: Synthetic oligonucleotide
  Target: ATXN1; (-) strand; PAM type: NRG; PAM sequence: CAG
ctcccagctgtgtctcattt

SEQ ID NO: 90278 - DNA, 20 bp, Artificial Sequence
  Description of Artificial Sequence: Synthetic oligonucleotide
  Target: ATXN1; (-) strand; PAM type: NRG; PAM sequence: CAG
gggtggtggtgggtgcctcc

SEQ ID NO: 90279 - DNA, 20 bp, Artificial Sequence
  Description of Artificial Sequence: Synthetic oligonucleotide
  Target: ATXN1; (-) strand; PAM type: NRG; PAM sequence: GGG
ctacaaaggcgggtggtggt

SEQ ID NO: 90280 - DNA, 20 bp, Artificial Sequence
  Description of Artificial Sequence: Synthetic oligonucleotide
  Target: ATXN1; (-) strand; PAM type: NRG; PAM sequence: TGG
tctacaaaggcgggtggtgg

SEQ ID NO: 90281 - DNA, 20 bp, Artificial Sequence
  Description of Artificial Sequence: Synthetic oligonucleotide
  Target: ATXN1; (-) strand; PAM type: NRG; PAM sequence: TGG
tgttctacaaaggcgggtgg

SEQ ID NO: 90282 - DNA, 20 bp, Artificial Sequence
  Description of Artificial Sequence: Synthetic oligonucleotide
  Target: ATXN1; (-) strand; PAM type: NRG; PAM sequence: TGG
agctgttctacaaaggcggg

SEQ ID NO: 90283 - DNA, 20 bp, Artificial Sequence
  Description of Artificial Sequence: Synthetic oligonucleotide
  Target: ATXN1; (-) strand; PAM type: NRG; PAM sequence: GGG
ggtagctgttctacaaaggc

SEQ ID NO: 90284 - DNA, 20 bp, Artificial Sequence
  Description of Artificial Sequence: Synthetic oligonucleotide
  Target: ATXN1; (-) strand; PAM type: NRG; PAM sequence: CGG
gggtagctgttctacaaagg

SEQ ID NO: 90285 - DNA, 20 bp, Artificial Sequence
  Description of Artificial Sequence: Synthetic oligonucleotide
  Target: ATXN1; (-) strand; PAM type: NRG; PAM sequence: AGG
tttgggtagctgttctacaa

SEQ ID NO: 90286 - DNA, 20 bp, Artificial Sequence
  Description of Artificial Sequence: Synthetic oligonucleotide
  Target: ATXN1; (-) strand; PAM type: NRG; PAM sequence: AAG
ttttgggtagctgttctaca

SEQ ID NO: 90287 - DNA, 20 bp, Artificial Sequence
  Description of Artificial Sequence: Synthetic oligonucleotide
  Target: ATXN1; (-) strand; PAM type: NRG; PAM sequence: TAG
gctatccttgtctttttggg

SEQ ID NO: 90288 - DNA, 20 bp, Artificial Sequence
  Description of Artificial Sequence: Synthetic oligonucleotide
  Target: ATXN1; (-) strand; PAM type: NRG; PAM sequence: GGG
cttgctatccttgtcttttt

SEQ ID NO: 90289 - DNA, 20 bp, Artificial Sequence
  Description of Artificial Sequence: Synthetic oligonucleotide
  Target: ATXN1; (-) strand; PAM type: NRG; PAM sequence: TGG
acttgctatccttgtctttt

SEQ ID NO: 90290 - DNA, 20 bp, Artificial Sequence
  Description of Artificial Sequence: Synthetic oligonucleotide
  Target: ATXN1; (-) strand; PAM type: NRG; PAM sequence: GGG
atagattggaaaagcttcag

SEQ ID NO: 90291 - DNA, 20 bp, Artificial Sequence
  Description of Artificial Sequence: Synthetic oligonucleotide
  Target: ATXN1; (-) strand; PAM type: NRG; PAM sequence: GGG
aatagattggaaaagcttca

SEQ ID NO: 90292 - DNA, 20 bp, Artificial Sequence
  Description of Artificial Sequence: Synthetic oligonucleotide
  Target: ATXN1; (-) strand; PAM type: NRG; PAM sequence: AGG
gaatagattggaaaagcttc

SEQ ID NO: 90293 - DNA, 20 bp, Artificial Sequence
  Description of Artificial Sequence: Synthetic oligonucleotide
  Target: ATXN1; (-) strand; PAM type: NRG; PAM sequence: CAG
ggaatagattggaaaagctt

SEQ ID NO: 90294 - DNA, 20 bp, Artificial Sequence
  Description of Artificial Sequence: Synthetic oligonucleotide
  Target: ATXN1; (-) strand; PAM type: NRG; PAM sequence: AAG
caaaaaggaatagattggaa

SEQ ID NO: 90295 - DNA, 20 bp, Artificial Sequence
  Description of Artificial Sequence: Synthetic oligonucleotide
  Target: ATXN1; (-) strand; PAM type: NRG; PAM sequence: TGG
aatcacaaaaaggaatagat

SEQ ID NO: 90296 - DNA, 20 bp, Artificial Sequence
  Description of Artificial Sequence: Synthetic oligonucleotide
  Target: ATXN1; (-) strand; PAM type: NRG; PAM sequence: TAG
aaaacaatcacaaaaaggaa

SEQ ID NO: 90297 - DNA, 20 bp, Artificial Sequence
  Description of Artificial Sequence: Synthetic oligonucleotide
  Target: ATXN1; (-) strand; PAM type: NRG; PAM sequence: AGG
aaaggaaaacaatcacaaaa

SEQ ID NO: 90298 - DNA, 20 bp, Artificial Sequence
  Description of Artificial Sequence: Synthetic oligonucleotide
  Target: ATXN1; (-) strand; PAM type: NRG; PAM sequence: AAG
aaaaggaaaacaatcacaaa

SEQ ID NO: 90299 - DNA, 20 bp, Artificial Sequence
  Description of Artificial Sequence: Synthetic oligonucleotide
  Target: ATXN1; (-) strand; PAM type: NRG; PAM sequence: AGG
tgtgttaacactatttcaaa

SEQ ID NO: 90300 - DNA, 20 bp, Artificial Sequence
  Description of Artificial Sequence: Synthetic oligonucleotide
  Target: ATXN1; (-) strand; PAM type: NRG; PAM sequence: AAG
atgtgttaacactatttcaa

SEQ ID NO: 90301 - DNA, 20 bp, Artificial Sequence
  Description of Artificial Sequence: Synthetic oligonucleotide
  Target: ATXN1; (-) strand; PAM type: NRG; PAM sequence: AGG
aatgttaagtgtcagctggg

SEQ ID NO: 90302 - DNA, 20 bp, Artificial Sequence
  Description of Artificial Sequence: Synthetic oligonucleotide
  Target: ATXN1; (-) strand; PAM type: NRG; PAM sequence: GAG
aaatgttaagtgtcagctgg

SEQ ID NO: 90303 - DNA, 20 bp, Artificial Sequence
  Description of Artificial Sequence: Synthetic oligonucleotide
  Target: ATXN1; (-) strand; PAM type: NRG; PAM sequence: GGG
acaaatgttaagtgtcagct

SEQ ID NO: 90304 - DNA, 20 bp, Artificial Sequence
  Description of Artificial Sequence: Synthetic oligonucleotide
  Target: ATXN1; (-) strand; PAM type: NRG; PAM sequence: TGG
gacaaatgttaagtgtcagc

SEQ ID NO: 90305 - DNA, 20 bp, Artificial Sequence
  Description of Artificial Sequence: Synthetic oligonucleotide
  Target: ATXN1; (-) strand; PAM type: NRG; PAM sequence: CAG
atgggacaaatgttaagtgt

SEQ ID NO: 90306 - DNA, 20 bp, Artificial Sequence
  Description of Artificial Sequence: Synthetic oligonucleotide
  Target: ATXN1; (-) strand; PAM type: NRG; PAM sequence: AAG
aaaaagatgggacaaatgtt

SEQ ID NO: 90307 - DNA, 20 bp, Artificial Sequence
  Description of Artificial Sequence: Synthetic oligonucleotide
  Target: ATXN1; (-) strand; PAM type: NRG; PAM sequence: GGG
attgatgcttagaaaaagat

SEQ ID NO: 90308 - DNA, 20 bp, Artificial Sequence
  Description of Artificial Sequence: Synthetic oligonucleotide
  Target: ATXN1; (-) strand; PAM type: NRG; PAM sequence: TGG
tattgatgcttagaaaaaga

SEQ ID NO: 90309 - DNA, 20 bp, Artificial Sequence
  Description of Artificial Sequence: Synthetic oligonucleotide
  Target: ATXN1; (-) strand; PAM type: NRG; PAM sequence: AAG
tatatattgatgcttagaaa

SEQ ID NO: 90310 - DNA, 20 bp, Artificial Sequence
  Description of Artificial Sequence: Synthetic oligonucleotide
  Target: ATXN1; (-) strand; PAM type: NRG; PAM sequence: TAG
aatatttatatattgatgct

SEQ ID NO: 90311 - DNA, 20 bp, Artificial Sequence
  Description of Artificial Sequence: Synthetic oligonucleotide
  Target: ATXN1; (-) strand; PAM type: NRG; PAM sequence: AAG
aattacaaattttaaaaatt

SEQ ID NO: 90312 - DNA, 20 bp, Artificial Sequence
  Description of Artificial Sequence: Synthetic oligonucleotide
  Target: ATXN1; (-) strand; PAM type: NRG; PAM sequence: AAG
gctttcaaaggaatgtatac

SEQ ID NO: 90313 - DNA, 20 bp, Artificial Sequence
  Description of Artificial Sequence: Synthetic oligonucleotide
  Target: ATXN1; (-) strand; PAM type: NRG; PAM sequence: AGG
acccatcacagagctttcaa

SEQ ID NO: 90314 - DNA, 20 bp, Artificial Sequence
  Description of Artificial Sequence: Synthetic oligonucleotide
  Target: ATXN1; (-) strand; PAM type: NRG; PAM sequence: AAG
cacccatcacagagctttca

SEQ ID NO: 90315 - DNA, 20 bp, Artificial Sequence
  Description of Artificial Sequence: Synthetic oligonucleotide
  Target: ATXN1; (-) strand; PAM type: NRG; PAM sequence: GAG
ttcagcctacacccatcaca

SEQ ID NO: 90316 - DNA, 20 bp, Artificial Sequence
  Description of Artificial Sequence: Synthetic oligonucleotide
  Target: ATXN1; (-) strand; PAM type: NRG; PAM sequence: CAG
agttcagcctacacccatca

SEQ ID NO: 90317 - DNA, 20 bp, Artificial Sequence
  Description of Artificial Sequence: Synthetic oligonucleotide
  Target: ATXN1; (-) strand; PAM type: NRG; PAM sequence: CAG
aacagtacagcccagcagtt

SEQ ID NO: 90318 - DNA, 20 bp, Artificial Sequence
  Description of Artificial Sequence: Synthetic oligonucleotide
  Target: ATXN1; (-) strand; PAM type: NRG; PAM sequence: CAG
tctaaaacagtacagcccag

SEQ ID NO: 90319 - DNA, 20 bp, Artificial Sequence
  Description of Artificial Sequence: Synthetic oligonucleotide
  Target: ATXN1; (-) strand; PAM type: NRG; PAM sequence: CAG
tgctctaaaacagtacagcc

SEQ ID NO: 90320 - DNA, 20 bp, Artificial Sequence
  Description of Artificial Sequence: Synthetic oligonucleotide
  Target: ATXN1; (-) strand; PAM type: NRG; PAM sequence: CAG
ttttttgctctaaaacagta

SEQ ID NO: 90321 - DNA, 20 bp, Artificial Sequence
  Description of Artificial Sequence: Synthetic oligonucleotide
  Target: ATXN1; (-) strand; PAM type: NRG; PAM sequence: CAG
tatctttttttgctctaaaa

SEQ ID NO: 90322 - DNA, 20 bp, Artificial Sequence
  Description of Artificial Sequence: Synthetic oligonucleotide
  Target: ATXN1; (-) strand; PAM type: NRG; PAM sequence: GAG
aaaaattagaattacagcat

SEQ ID NO: 90323 - DNA, 20 bp, Artificial Sequence
  Description of Artificial Sequence: Synthetic oligonucleotide
  Target: ATXN1; (-) strand; PAM type: NRG; PAM sequence: CAG
acacagaaaaattagaatta

SEQ ID NO: 90324 - DNA, 20 bp, Artificial Sequence
  Description of Artificial Sequence: Synthetic oligonucleotide
  Target: ATXN1; (-) strand; PAM type: NRG; PAM sequence: TAG
cctttgaaacacagaaaaat

SEQ ID NO: 90325 - DNA, 20 bp, Artificial Sequence
  Description of Artificial Sequence: Synthetic oligonucleotide
  Target: ATXN1; (-) strand; PAM type: NRG; PAM sequence: CAG
atagccccccctttgaaaca

SEQ ID NO: 90326 - DNA, 20 bp, Artificial Sequence
  Description of Artificial Sequence: Synthetic oligonucleotide
  Target: ATXN1; (-) strand; PAM type: NRG; PAM sequence: TAG
aaattaatttaataaattaa

SEQ ID NO: 90327 - DNA, 20 bp, Artificial Sequence
  Description of Artificial Sequence: Synthetic oligonucleotide
  Target: ATXN1; (-) strand; PAM type: NRG; PAM sequence: GAG
tctggataagaattcacctt

SEQ ID NO: 90328 - DNA, 20 bp, Artificial Sequence
  Description of Artificial Sequence: Synthetic oligonucleotide
  Target: ATXN1; (-) strand; PAM type: NRG; PAM sequence: AAG
ctcctggaattgatctggat

SEQ ID NO: 90329 - DNA, 20 bp, Artificial Sequence
  Description of Artificial Sequence: Synthetic oligonucleotide
  Target: ATXN1; (-) strand; PAM type: NRG; PAM sequence: TGG
cgtaactcctggaattgatc

SEQ ID NO: 90330 - DNA, 20 bp, Artificial Sequence
  Description of Artificial Sequence: Synthetic oligonucleotide
  Target: ATXN1; (-) strand; PAM type: NRG; PAM sequence: TGG
attccacgccccgtaactcc

SEQ ID NO: 90331 - DNA, 20 bp, Artificial Sequence
  Description of Artificial Sequence: Synthetic oligonucleotide
  Target: ATXN1; (-) strand; PAM type: NRG; PAM sequence: TGG
atagaatggtgtggcttatc

SEQ ID NO: 90332 - DNA, 20 bp, Artificial Sequence
  Description of Artificial Sequence: Synthetic oligonucleotide
  Target: ATXN1; (-) strand; PAM type: NRG; PAM sequence: TGG
cttgatggcatagaatggtg

SEQ ID NO: 90333 - DNA, 20 bp, Artificial Sequence
  Description of Artificial Sequence: Synthetic oligonucleotide
  Target: ATXN1; (-) strand; PAM type: NRG; PAM sequence: TGG
tgtgacttgatggcatagaa

SEQ ID NO: 90334 - DNA, 20 bp, Artificial Sequence
  Description of Artificial Sequence: Synthetic oligonucleotide
  Target: ATXN1; (-) strand; PAM type: NRG; PAM sequence: TAG
gtttctgtgacttgatggca

SEQ ID NO: 90335 - DNA, 20 bp, Artificial Sequence
  Description of Artificial Sequence: Synthetic oligonucleotide
  Target: ATXN1; (-) strand; PAM type: NRG; PAM sequence: TGG
agccagtttctgtgacttga

SEQ ID NO: 90336 - DNA, 20 bp, Artificial Sequence
  Description of Artificial Sequence: Synthetic oligonucleotide
  Target: ATXN1; (-) strand; PAM type: NRG; PAM sequence: CAG
aaattagagtgtagggaagc

SEQ ID NO: 90337 - DNA, 20 bp, Artificial Sequence
  Description of Artificial Sequence: Synthetic oligonucleotide
  Target: ATXN1; (-) strand; PAM type: NRG; PAM sequence: AAG
gcacaaattagagtgtaggg

SEQ ID NO: 90338 - DNA, 20 bp, Artificial Sequence
  Description of Artificial Sequence: Synthetic oligonucleotide
  Target: ATXN1; (-) strand; PAM type: NRG; PAM sequence: GGG
aaggcacaaattagagtgta

SEQ ID NO: 90339 - DNA, 20 bp, Artificial Sequence
  Description of Artificial Sequence: Synthetic oligonucleotide
  Target: ATXN1; (-) strand; PAM type: NRG; PAM sequence: AGG
caaggcacaaattagagtgt

SEQ ID NO: 90340 - DNA, 20 bp, Artificial Sequence
  Description of Artificial Sequence: Synthetic oligonucleotide
  Target: ATXN1; (-) strand; PAM type: NRG; PAM sequence: TAG
acaaggcacaaattagagtg

SEQ ID NO: 90341 - DNA, 20 bp, Artificial Sequence
  Description of Artificial Sequence: Synthetic oligonucleotide
  Target: ATXN1; (-) strand; PAM type: NRG; PAM sequence: GAG
aacagacaaggcacaaatta

SEQ ID NO: 90342 - DNA, 20 bp, Artificial Sequence
  Description of Artificial Sequence: Synthetic oligonucleotide
  Target: ATXN1; (-) strand; PAM type: NRG; PAM sequence: TAG
gcaacagacaaggcacaaat

SEQ ID NO: 90343 - DNA, 20 bp, Artificial Sequence
  Description of Artificial Sequence: Synthetic oligonucleotide
  Target: ATXN1; (-) strand; PAM type: NRG; PAM sequence: AGG
catgcccaaagcaacagaca

SEQ ID NO: 90344 - DNA, 20 bp, Artificial Sequence
  Description of Artificial Sequence: Synthetic oligonucleotide
  Target: ATXN1; (-) strand; PAM type: NRG; PAM sequence: AAG
tcatgcccaaagcaacagac

SEQ ID NO: 90345 - DNA, 20 bp, Artificial Sequence
  Description of Artificial Sequence: Synthetic oligonucleotide
  Target: ATXN1; (-) strand; PAM type: NRG; PAM sequence: CAG
ctgtttcatgcccaaagcaa

SEQ ID NO: 90346 - DNA, 20 bp, Artificial Sequence
  Description of Artificial Sequence: Synthetic oligonucleotide
  Target: ATXN1; (-) strand; PAM type: NRG; PAM sequence: AAG
cacattctgtttcatgccca

SEQ ID NO: 90347 - DNA, 20 bp, Artificial Sequence
  Description of Artificial Sequence: Synthetic oligonucleotide
  Target: ATXN1; (-) strand; PAM type: NRG; PAM sequence: AAG
aatgaagtgagaaatgaaag

SEQ ID NO: 90348 - DNA, 20 bp, Artificial Sequence
  Description of Artificial Sequence: Synthetic oligonucleotide
  Target: ATXN1; (-) strand; PAM type: NRG; PAM sequence: AAG
ggtaatgaagtgagaaatga

SEQ ID NO: 90349 - DNA, 20 bp, Artificial Sequence
  Description of Artificial Sequence: Synthetic oligonucleotide
  Target: ATXN1; (-) strand; PAM type: NRG; PAM sequence: GAG
tccactttaggtaatgaagt

SEQ ID NO: 90350 - DNA, 20 bp, Artificial Sequence
  Description of Artificial Sequence: Synthetic oligonucleotide
  Target: ATXN1; (-) strand; PAM type: NRG; PAM sequence: AAG
tatgtccactttaggtaatg

SEQ ID NO: 90351 - DNA, 20 bp, Artificial Sequence
  Description of Artificial Sequence: Synthetic oligonucleotide
  Target: ATXN1; (-) strand; PAM type: NRG; PAM sequence: AGG
ggaaggtgtatgtccacttt

SEQ ID NO: 90352 - DNA, 20 bp, Artificial Sequence
  Description of Artificial Sequence: Synthetic oligonucleotide
  Target: ATXN1; (-) strand; PAM type: NRG; PAM sequence: TAG
gggaaggtgtatgtccactt

SEQ ID NO: 90353 - DNA, 20 bp, Artificial Sequence
  Description of Artificial Sequence: Synthetic oligonucleotide
  Target: ATXN1; (-) strand; PAM type: NRG; PAM sequence: AGG
aggggagagggagtatggga

SEQ ID NO: 90354 - DNA, 20 bp, Artificial Sequence
  Description of Artificial Sequence: Synthetic oligonucleotide
  Target: ATXN1; (-) strand; PAM type: NRG; PAM sequence: AAG
gaggggagagggagtatggg

SEQ ID NO: 90355 - DNA, 20 bp, Artificial Sequence
  Description of Artificial Sequence: Synthetic oligonucleotide
  Target: ATXN1; (-) strand; PAM type: NRG; PAM sequence: GGG
ggagaggggagagggagtat

SEQ ID NO: 90356 - DNA, 20 bp, Artificial Sequence
  Description of Artificial Sequence: Synthetic oligonucleotide
  Target: ATXN1; (-) strand; PAM type: NRG; PAM sequence: TGG
aggagaggggagagggagta

SEQ ID NO: 90357 - DNA, 20 bp, Artificial Sequence
  Description of Artificial Sequence: Synthetic oligonucleotide
  Target: ATXN1; (-) strand; PAM type: NRG; PAM sequence: GAG
agggaaggagaggggagagg

SEQ ID NO: 90358 - DNA, 20 bp, Artificial Sequence
  Description of Artificial Sequence: Synthetic oligonucleotide
  Target: ATXN1; (-) strand; PAM type: NRG; PAM sequence: GGG
ttagggaaggagaggggaga

SEQ ID NO: 90359 - DNA, 20 bp, Artificial Sequence
  Description of Artificial Sequence: Synthetic oligonucleotide
  Target: ATXN1; (-) strand; PAM type: NRG; PAM sequence: AGG
gttagggaaggagaggggag

SEQ ID NO: 90360 - DNA, 20 bp, Artificial Sequence
  Description of Artificial Sequence: Synthetic oligonucleotide
  Target: ATXN1; (-) strand; PAM type: NRG; PAM sequence: GAG
ggttagggaaggagagggga

SEQ ID NO: 90361 - DNA, 20 bp, Artificial Sequence
  Description of Artificial Sequence: Synthetic oligonucleotide
  Target: ATXN1; (-) strand; PAM type: NRG; PAM sequence: GAG
taggttagggaaggagaggg

SEQ ID NO: 90362 - DNA, 20 bp, Artificial Sequence
  Description of Artificial Sequence: Synthetic oligonucleotide
  Target: ATXN1; (-) strand; PAM type: NRG; PAM sequence: GGG
gataggttagggaaggagag

SEQ ID NO: 90363 - DNA, 20 bp, Artificial Sequence
  Description of Artificial Sequence: Synthetic oligonucleotide
  Target: ATXN1; (-) strand; PAM type: NRG; PAM sequence: GGG
ggataggttagggaaggaga

SEQ ID NO: 90364 - DNA, 20 bp, Artificial Sequence
  Description of Artificial Sequence: Synthetic oligonucleotide
  Target: ATXN1; (-) strand; PAM type: NRG; PAM sequence: AGG
gggataggttagggaaggag

SEQ ID NO: 90365 - DNA, 20 bp, Artificial Sequence
  Description of Artificial Sequence: Synthetic oligonucleotide
  Target: ATXN1; (-) strand; PAM type: NRG; PAM sequence: GAG
ggggataggttagggaagga

SEQ ID NO: 90366 - DNA, 20 bp, Artificial Sequence
  Description of Artificial Sequence: Synthetic oligonucleotide
  Target: ATXN1; (-) strand; PAM type: NRG; PAM sequence: GAG
caggggataggttagggaag

SEQ ID NO: 90367 - DNA, 20 bp, Artificial Sequence
  Description of Artificial Sequence: Synthetic oligonucleotide
  Target: ATXN1; (-) strand; PAM type: NRG; PAM sequence: AGG
ggcaggggataggttaggga

SEQ ID NO: 90368 - DNA, 20 bp, Artificial Sequence
  Description of Artificial Sequence: Synthetic oligonucleotide
  Target: ATXN1; (-) strand; PAM type: NRG; PAM sequence: AAG
gggcaggggataggttaggg

SEQ ID NO: 90369 - DNA, 20 bp, Artificial Sequence
  Description of Artificial Sequence: Synthetic oligonucleotide
  Target: ATXN1; (-) strand; PAM type: NRG; PAM sequence: GGG
ggtgggcaggggataggtta

SEQ ID NO: 90370 - DNA, 20 bp, Artificial Sequence
  Description of Artificial Sequence: Synthetic oligonucleotide
  Target: ATXN1; (-) strand; PAM type: NRG; PAM sequence: AGG
gggtgggcaggggataggtt

SEQ ID NO: 90371 - DNA, 20 bp, Artificial Sequence
  Description of Artificial Sequence: Synthetic oligonucleotide
  Target: ATXN1; (-) strand; PAM type: NRG; PAM sequence: TAG
agggtgggcaggggataggt

SEQ ID NO: 90372 - DNA, 20 bp, Artificial Sequence
  Description of Artificial Sequence: Synthetic oligonucleotide
  Target: ATXN1; (-) strand; PAM type: NRG; PAM sequence: AGG
ggccagggtgggcaggggat

SEQ ID NO: 90373 - DNA, 20 bp, Artificial Sequence
  Description of Artificial Sequence: Synthetic oligonucleotide
  Target: ATXN1; (-) strand; PAM type: NRG; PAM sequence: TAG
gggccagggtgggcagggga

SEQ ID NO: 90374 - DNA, 20 bp, Artificial Sequence
  Description of Artificial Sequence: Synthetic oligonucleotide
  Target: ATXN1; (-) strand; PAM type: NRG; PAM sequence: GGG
aatggggccagggtgggcag

SEQ ID NO: 90375 - DNA, 20 bp, Artificial Sequence
  Description of Artificial Sequence: Synthetic oligonucleotide
  Target: ATXN1; (-) strand; PAM type: NRG; PAM sequence: GGG
taatggggccagggtgggca

SEQ ID NO: 90376 - DNA, 20 bp, Artificial Sequence
  Description of Artificial Sequence: Synthetic oligonucleotide
  Target: ATXN1; (-) strand; PAM type: NRG; PAM sequence: AGG
ataatggggccagggtgggc

SEQ ID NO: 90377 - DNA, 20 bp, Artificial Sequence
  Description of Artificial Sequence: Synthetic oligonucleotide
  Target: ATXN1; (-) strand; PAM type: NRG; PAM sequence: CAG
aataatggggccagggtggg

SEQ ID NO: 90378 - DNA, 20 bp, Artificial Sequence
  Description of Artificial Sequence: Synthetic oligonucleotide
  Target: ATXN1; (-) strand; PAM type: NRG; PAM sequence: GGG
agaaataatggggccagggt

SEQ ID NO: 90379 - DNA, 20 bp, Artificial Sequence
  Description of Artificial Sequence: Synthetic oligonucleotide
  Target: ATXN1; (-) strand; PAM type: NRG; PAM sequence: TGG
gagaaataatggggccaggg

SEQ ID NO: 90380 - DNA, 20 bp, Artificial Sequence
  Description of Artificial Sequence: Synthetic oligonucleotide
  Target: ATXN1; (-) strand; PAM type: NRG; PAM sequence: GGG
agtgagaaataatggggcca

SEQ ID NO: 90381 - DNA, 20 bp, Artificial Sequence
  Description of Artificial Sequence: Synthetic oligonucleotide
  Target: ATXN1; (-) strand; PAM type: NRG; PAM sequence: AGG
aagtgagaaataatggggcc

SEQ ID NO: 90382 - DNA, 20 bp, Artificial Sequence
  Description of Artificial Sequence: Synthetic oligonucleotide
  Target: ATXN1; (-) strand; PAM type: NRG; PAM sequence: CAG
caagtgagaaataatggggc

SEQ ID NO: 90383 - DNA, 20 bp, Artificial Sequence
  Description of Artificial Sequence: Synthetic oligonucleotide
  Target: ATXN1; (-) strand; PAM type: NRG; PAM sequence: GGG
tatccaagtgagaaataatg

SEQ ID NO: 90384 - DNA, 20 bp, Artificial Sequence
  Description of Artificial Sequence: Synthetic oligonucleotide
  Target: ATXN1; (-) strand; PAM type: NRG; PAM sequence: GGG
ttatccaagtgagaaataat

SEQ ID NO: 90385 - DNA, 20 bp, Artificial Sequence
  Description of Artificial Sequence: Synthetic oligonucleotide
  Target: ATXN1; (-) strand; PAM type: NRG; PAM sequence: TGG
gttatccaagtgagaaataa

SEQ ID NO: 90386 - DNA, 20 bp, Artificial Sequence
  Description of Artificial Sequence: Synthetic oligonucleotide
  Target: ATXN1; (-) strand; PAM type: NRG; PAM sequence: GAG
gaccttcctgttatccaagt

SEQ ID NO: 90387 - DNA, 20 bp, Artificial Sequence
  Description of Artificial Sequence: Synthetic oligonucleotide
  Target: ATXN1; (-) strand; PAM type: NRG; PAM sequence: AAG
gtacgaccttcctgttatcc

SEQ ID NO: 90388 - DNA, 20 bp, Artificial Sequence
  Description of Artificial Sequence: Synthetic oligonucleotide
  Target: ATXN1; (-) strand; PAM type: NRG; PAM sequence: GAG
gacgatgagttcaaaaggga

SEQ ID NO: 90389 - DNA, 20 bp, Artificial Sequence
  Description of Artificial Sequence: Synthetic oligonucleotide
  Target: ATXN1; (-) strand; PAM type: NRG; PAM sequence: GAG
tggacgatgagttcaaaagg

SEQ ID NO: 90390 - DNA, 20 bp, Artificial Sequence
  Description of Artificial Sequence: Synthetic oligonucleotide
  Target: ATXN1; (-) strand; PAM type: NRG; PAM sequence: GGG
tgtggacgatgagttcaaaa

SEQ ID NO: 90391 - DNA, 20 bp, Artificial Sequence
  Description of Artificial Sequence: Synthetic oligonucleotide
  Target: ATXN1; (-) strand; PAM type: NRG; PAM sequence: AGG
gtgtggacgatgagttcaaa

SEQ ID NO: 90392 - DNA, 20 bp, Artificial Sequence
  Description of Artificial Sequence: Synthetic oligonucleotide
  Target: ATXN1; (-) strand; PAM type: NRG; PAM sequence: AAG
agtgtggacgatgagttcaa

SEQ ID NO: 90393 - DNA, 20 bp, Artificial Sequence
  Description of Artificial Sequence: Synthetic oligonucleotide
  Target: ATXN1; (-) strand; PAM type: NRG; PAM sequence: GAG
tttgacccagtgtggacgat

SEQ ID NO: 90394 - DNA, 20 bp, Artificial Sequence
  Description of Artificial Sequence: Synthetic oligonucleotide
  Target: ATXN1; (-) strand; PAM type: NRG; PAM sequence: TGG
attttagatttgacccagtg

SEQ ID NO: 90395 - DNA, 20 bp, Artificial Sequence
  Description of Artificial Sequence: Synthetic oligonucleotide
  Target: ATXN1; (-) strand; PAM type: NRG; PAM sequence: CAG
gatgtattttagatttgacc

SEQ ID NO: 90396 - DNA, 20 bp, Artificial Sequence
  Description of Artificial Sequence: Synthetic oligonucleotide
  Target: ATXN1; (-) strand; PAM type: NRG; PAM sequence: TAG
tggcatatgcagatgtattt

SEQ ID NO: 90397 - DNA, 20 bp, Artificial Sequence
  Description of Artificial Sequence: Synthetic oligonucleotide
  Target: ATXN1; (-) strand; PAM type: NRG; PAM sequence: CAG
tttagcggatgtggcatatg

SEQ ID NO: 90398 - DNA, 20 bp, Artificial Sequence
  Description of Artificial Sequence: Synthetic oligonucleotide
  Target: ATXN1; (-) strand; PAM type: NRG; PAM sequence: TGG
gtaatgatttttagcggatg

SEQ ID NO: 90399 - DNA, 20 bp, Artificial Sequence
  Description of Artificial Sequence: Synthetic oligonucleotide
  Target: ATXN1; (-) strand; PAM type: NRG; PAM sequence: CGG
gctattgtaatgatttttag

SEQ ID NO: 90400 - DNA, 20 bp, Artificial Sequence
  Description of Artificial Sequence: Synthetic oligonucleotide
  Target: ATXN1; (-) strand; PAM type: NRG; PAM sequence: TAG
gaagctattgtaatgatttt

SEQ ID NO: 90401 - DNA, 20 bp, Artificial Sequence
  Description of Artificial Sequence: Synthetic oligonucleotide
  Target: ATXN1; (-) strand; PAM type: NRG; PAM sequence: AAG
atatactcatgtttaaatag

SEQ ID NO: 90402 - DNA, 20 bp, Artificial Sequence
  Description of Artificial Sequence: Synthetic oligonucleotide
  Target: ATXN1; (-) strand; PAM type: NRG; PAM sequence: TAG
gggatatactcatgtttaaa

SEQ ID NO: 90403 - DNA, 20 bp, Artificial Sequence
  Description of Artificial Sequence: Synthetic oligonucleotide
  Target: ATXN1; (-) strand; PAM type: NRG; PAM sequence: GGG
tagcatggggccaggctgat

SEQ ID NO: 90404 - DNA, 20 bp, Artificial Sequence
  Description of Artificial Sequence: Synthetic oligonucleotide
  Target: ATXN1; (-) strand; PAM type: NRG; PAM sequence: TGG
gtagcatggggccaggctga

SEQ ID NO: 90405 - DNA, 20 bp, Artificial Sequence
  Description of Artificial Sequence: Synthetic oligonucleotide
  Target: ATXN1; (-) strand; PAM type: NRG; PAM sequence: AGG
aacgcatgtagcatggggcc

SEQ ID NO: 90406 - DNA, 20 bp, Artificial Sequence
  Description of Artificial Sequence: Synthetic oligonucleotide
  Target: ATXN1; (-) strand; PAM type: NRG; PAM sequence: CAG
gaacgcatgtagcatggggc

SEQ ID NO: 90407 - DNA, 20 bp, Artificial Sequence
  Description of Artificial Sequence: Synthetic oligonucleotide
  Target: ATXN1; (-) strand; PAM type: NRG; PAM sequence: GGG
gtctgaacgcatgtagcatg

SEQ ID NO: 90408 - DNA, 20 bp, Artificial Sequence
  Description of Artificial Sequence: Synthetic oligonucleotide
  Target: ATXN1; (-) strand; PAM type: NRG; PAM sequence: GGG
tgtctgaacgcatgtagcat

SEQ ID NO: 90409 - DNA, 20 bp, Artificial Sequence
  Description of Artificial Sequence: Synthetic oligonucleotide
  Target: ATXN1; (-) strand; PAM type: NRG; PAM sequence: TGG
atgtctgaacgcatgtagca

SEQ ID NO: 90410 - DNA, 20 bp, Artificial Sequence
  Description of Artificial Sequence: Synthetic oligonucleotide
  Target: ATXN1; (-) strand; PAM type: NRG; PAM sequence: TAG
tgataatgtctgaacgcatg

SEQ ID NO: 90411 - DNA, 20 bp, Artificial Sequence
  Description of Artificial Sequence: Synthetic oligonucleotide
  Target: ATXN1; (-) strand; PAM type: NRG; PAM sequence: AAG
tgtctcttaagattgttata

SEQ ID NO: 90412 - DNA, 20 bp, Artificial Sequence
  Description of Artificial Sequence: Synthetic oligonucleotide
  Target: ATXN1; (-) strand; PAM type: NRG; PAM sequence: AAG
aataatagcctctgtctctt

SEQ ID NO: 90413 - DNA, 20 bp, Artificial Sequence
  Description of Artificial Sequence: Synthetic oligonucleotide
  Target: ATXN1; (-) strand; PAM type: NRG; PAM sequence: TAG
tatctctaacgttaaaataa

SEQ ID NO: 90414 - DNA, 20 bp, Artificial Sequence
  Description of Artificial Sequence: Synthetic oligonucleotide
  Target: ATXN1; (-) strand; PAM type: NRG; PAM sequence: GAG
ttaacatacctcagctgtaa

SEQ ID NO: 90415 - DNA, 20 bp, Artificial Sequence
  Description of Artificial Sequence: Synthetic oligonucleotide
  Target: ATXN1; (-) strand; PAM type: NRG; PAM sequence: AAG
atttaacatacctcagctgt

SEQ ID NO: 90416 - DNA, 20 bp, Artificial Sequence
  Description of Artificial Sequence: Synthetic oligonucleotide
  Target: ATXN1; (-) strand; PAM type: NRG; PAM sequence: CAG
gcaagttatttaacatacct

SEQ ID NO: 90417 - DNA, 20 bp, Artificial Sequence
  Description of Artificial Sequence: Synthetic oligonucleotide
  Target: ATXN1; (-) strand; PAM type: NRG; PAM sequence: AAG
ctagctttgtgactttgagc

SEQ ID NO: 90418 - DNA, 20 bp, Artificial Sequence
  Description of Artificial Sequence: Synthetic oligonucleotide
  Target: ATXN1; (-) strand; PAM type: NRG; PAM sequence: GAG
tttactagctttgtgacttt

SEQ ID NO: 90419 - DNA, 20 bp, Artificial Sequence
  Description of Artificial Sequence: Synthetic oligonucleotide
  Target: ATXN1; (-) strand; PAM type: NRG; PAM sequence: TAG
tcagctgccctaaattttac

SEQ ID NO: 90420 - DNA, 20 bp, Artificial Sequence
  Description of Artificial Sequence: Synthetic oligonucleotide
  Target: ATXN1; (-) strand; PAM type: NRG; PAM sequence: CAG
catgttataggttccagagt

SEQ ID NO: 90421 - DNA, 20 bp, Artificial Sequence
  Description of Artificial Sequence: Synthetic oligonucleotide
  Target: ATXN1; (-) strand; PAM type: NRG; PAM sequence: GAG
aacacatgttataggttcca

SEQ ID NO: 90422 - DNA, 20 bp, Artificial Sequence
  Description of Artificial Sequence: Synthetic oligonucleotide
  Target: ATXN1; (-) strand; PAM type: NRG; PAM sequence: CAG
ttaacacatgttataggttc

SEQ ID NO: 90423 - DNA, 20 bp, Artificial Sequence
  Description of Artificial Sequence: Synthetic oligonucleotide
  Target: ATXN1; (-) strand; PAM type: NRG; PAM sequence: AGG
tttgaattaacacatgttat

SEQ ID NO: 90424 - DNA, 20 bp, Artificial Sequence
  Description of Artificial Sequence: Synthetic oligonucleotide
  Target: ATXN1; (-) strand; PAM type: NRG; PAM sequence: TAG
ttttgaattaacacatgtta

SEQ ID NO: 90425 - DNA, 20 bp, Artificial Sequence
  Description of Artificial Sequence: Synthetic oligonucleotide
  Target: ATXN1; (-) strand; PAM type: NRG; PAM sequence: TAG
accactgccgttgatggcag

SEQ ID NO: 90426 - DNA, 20 bp, Artificial Sequence
  Description of Artificial Sequence: Synthetic oligonucleotide
  Target: ATXN1; (-) strand; PAM type: NRG; PAM sequence: CAG
ggaaccactgccgttgatgg

SEQ ID NO: 90427 - DNA, 20 bp, Artificial Sequence
  Description of Artificial Sequence: Synthetic oligonucleotide
  Target: ATXN1; (-) strand; PAM type: NRG; PAM sequence: TGG
ttgggaaccactgccgttga

SEQ ID NO: 90428 - DNA, 20 bp, Artificial Sequence
  Description of Artificial Sequence: Synthetic oligonucleotide
  Target: ATXN1; (-) strand; PAM type: NRG; PAM sequence: GGG
ttttgattgaagaaaatgtt

SEQ ID NO: 90429 - DNA, 20 bp, Artificial Sequence
  Description of Artificial Sequence: Synthetic oligonucleotide
  Target: ATXN1; (-) strand; PAM type: NRG; PAM sequence: TGG
tttttgattgaagaaaatgt

SEQ ID NO: 90430 - DNA, 20 bp, Artificial Sequence
  Description of Artificial Sequence: Synthetic oligonucleotide
  Target: ATXN1; (-) strand; PAM type: NRG; PAM sequence: AAG
gtctgcaacatttttgattg

SEQ ID NO: 90431 - DNA, 20 bp, Artificial Sequence
  Description of Artificial Sequence: Synthetic oligonucleotide
  Target: ATXN1; (-) strand; PAM type: NRG; PAM sequence: AAG
agttaaacatctagtgcctg

SEQ ID NO: 90432 - DNA, 20 bp, Artificial Sequence
  Description of Artificial Sequence: Synthetic oligonucleotide
  Target: ATXN1; (-) strand; PAM type: NRG; PAM sequence: TAG
gatattaagagttaaacatc

SEQ ID NO: 90433 - DNA, 20 bp, Artificial Sequence
  Description of Artificial Sequence: Synthetic oligonucleotide
  Target: ATXN1; (-) strand; PAM type: NRG; PAM sequence: GAG
tcttgatcaacagatattaa

SEQ ID NO: 90434 - DNA, 20 bp, Artificial Sequence
  Description of Artificial Sequence: Synthetic oligonucleotide
  Target: ATXN1; (-) strand; PAM type: NRG; PAM sequence: AAG
cttcttgatcaacagatatt

SEQ ID NO: 90435 - DNA, 20 bp, Artificial Sequence
  Description of Artificial Sequence: Synthetic oligonucleotide
  Target: ATXN1; (-) strand; PAM type: NRG; PAM sequence: CAG
ttgtacatcttcttgatcaa

SEQ ID NO: 90436 - DNA, 20 bp, Artificial Sequence
  Description of Artificial Sequence: Synthetic oligonucleotide
  Target: ATXN1; (-) strand; PAM type: NRG; PAM sequence: TAG
tcacagcgttactaagttca

SEQ ID NO: 90437 - DNA, 20 bp, Artificial Sequence
  Description of Artificial Sequence: Synthetic oligonucleotide
  Target: ATXN1; (-) strand; PAM type: NRG; PAM sequence: AAG
aattcattcacagcgttact

SEQ ID NO: 90438 - DNA, 20 bp, Artificial Sequence
  Description of Artificial Sequence: Synthetic oligonucleotide
  Target: ATXN1; (-) strand; PAM type: NRG; PAM sequence: CAG
cattagccagaattcattca

SEQ ID NO: 90439 - DNA, 20 bp, Artificial Sequence
  Description of Artificial Sequence: Synthetic oligonucleotide
  Target: ATXN1; (-) strand; PAM type: NRG; PAM sequence: CAG
tgatattgtaagtcattagc

SEQ ID NO: 90440 - DNA, 20 bp, Artificial Sequence
  Description of Artificial Sequence: Synthetic oligonucleotide
  Target: ATXN1; (-) strand; PAM type: NRG; PAM sequence: TAG
tggctgatattgtaagtcat

SEQ ID NO: 90441 - DNA, 20 bp, Artificial Sequence
  Description of Artificial Sequence: Synthetic oligonucleotide
  Target: ATXN1; (-) strand; PAM type: NRG; PAM sequence: AAG
atgtagctggctgatattgt

SEQ ID NO: 90442 - DNA, 20 bp, Artificial Sequence
  Description of Artificial Sequence: Synthetic oligonucleotide
  Target: ATXN1; (-) strand; PAM type: NRG; PAM sequence: TGG
ttcttccaaatatatgtagc

SEQ ID NO: 90443 - DNA, 20 bp, Artificial Sequence
  Description of Artificial Sequence: Synthetic oligonucleotide
  Target: ATXN1; (-) strand; PAM type: NRG; PAM sequence: TAG
agctttcttccaaatatatg

SEQ ID NO: 90444 - DNA, 20 bp, Artificial Sequence
  Description of Artificial Sequence: Synthetic oligonucleotide
  Target: ATXN1; (-) strand; PAM type: NRG; PAM sequence: GAG
agaatcactaacagaaatag

SEQ ID NO: 90445 - DNA, 20 bp, Artificial Sequence
  Description of Artificial Sequence: Synthetic oligonucleotide
  Target: ATXN1; (-) strand; PAM type: NRG; PAM sequence: AGG
tcagaatcactaacagaaat

SEQ ID NO: 90446 - DNA, 20 bp, Artificial Sequence
  Description of Artificial Sequence: Synthetic oligonucleotide
  Target: ATXN1; (-) strand; PAM type: NRG; PAM sequence: TAG
atcagaatcactaacagaaa

SEQ ID NO: 90447 - DNA, 20 bp, Artificial Sequence
  Description of Artificial Sequence: Synthetic oligonucleotide
  Target: ATXN1; (-) strand; PAM type: NRG; PAM sequence: CAG
ttggtcatcagaatcactaa

SEQ ID NO: 90448 - DNA, 20 bp, Artificial Sequence
  Description of Artificial Sequence: Synthetic oligonucleotide
  Target: ATXN1; (-) strand; PAM type: NRG; PAM sequence: CAG
tggtctgtagatttggtcat

SEQ ID NO: 90449 - DNA, 20 bp, Artificial Sequence
  Description of Artificial Sequence: Synthetic oligonucleotide
  Target: ATXN1; (-) strand; PAM type: NRG; PAM sequence: TGG
caaagcatggtctgtagatt

SEQ ID NO: 90450 - DNA, 20 bp, Artificial Sequence
  Description of Artificial Sequence: Synthetic oligonucleotide
  Target: ATXN1; (-) strand; PAM type: NRG; PAM sequence: TAG
ccaacacaaagcatggtctg

SEQ ID NO: 90451 - DNA, 20 bp, Artificial Sequence
  Description of Artificial Sequence: Synthetic oligonucleotide
  Target: ATXN1; (-) strand; PAM type: NRG; PAM sequence: TGG
attcataccaacacaaagca

SEQ ID NO: 90452 - DNA, 20 bp, Artificial Sequence
  Description of Artificial Sequence: Synthetic oligonucleotide
  Target: ATXN1; (-) strand; PAM type: NRG; PAM sequence: AAG
tgcacattcataccaacaca

SEQ ID NO: 90453 - DNA, 20 bp, Artificial Sequence
  Description of Artificial Sequence: Synthetic oligonucleotide
  Target: ATXN1; (-) strand; PAM type: NRG; PAM sequence: AGG
gaccacatttcttgtaaaag

SEQ ID NO: 90454 - DNA, 20 bp, Artificial Sequence
  Description of Artificial Sequence: Synthetic oligonucleotide
  Target: ATXN1; (-) strand; PAM type: NRG; PAM sequence: GAG
agaccacatttcttgtaaaa

SEQ ID NO: 90455 - DNA, 20 bp, Artificial Sequence
  Description of Artificial Sequence: Synthetic oligonucleotide
  Target: ATXN1; (-) strand; PAM type: NRG; PAM sequence: AAG
ggagaccacatttcttgtaa

SEQ ID NO: 90456 - DNA, 20 bp, Artificial Sequence
  Description of Artificial Sequence: Synthetic oligonucleotide
  Target: ATXN1; (-) strand; PAM type: NRG; PAM sequence: GAG
gtagattccaaaacatatgg

SEQ ID NO: 90457 - DNA, 20 bp, Artificial Sequence
  Description of Artificial Sequence: Synthetic oligonucleotide
  Target: ATXN1; (-) strand; PAM type: NRG; PAM sequence: GGG
ctgtagattccaaaacatat

SEQ ID NO: 90458 - DNA, 20 bp, Artificial Sequence
  Description of Artificial Sequence: Synthetic oligonucleotide
  Target: ATXN1; (-) strand; PAM type: NRG; PAM sequence: TGG
tctgtagattccaaaacata

SEQ ID NO: 90459 - DNA, 20 bp, Artificial Sequence
  Description of Artificial Sequence: Synthetic oligonucleotide
  Target: ATXN1; (-) strand; PAM type: NRG; PAM sequence: TAG
tctaggggttttctaatctg

SEQ ID NO: 90460 - DNA, 20 bp, Artificial Sequence
  Description of Artificial Sequence: Synthetic oligonucleotide
  Target: ATXN1; (-) strand; PAM type: NRG; PAM sequence: GGG
gactttggcttatattctag

SEQ ID NO: 90461 - DNA, 20 bp, Artificial Sequence
  Description of Artificial Sequence: Synthetic oligonucleotide
  Target: ATXN1; (-) strand; PAM type: NRG; PAM sequence: GGG
ggactttggcttatattcta

SEQ ID NO: 90462 - DNA, 20 bp, Artificial Sequence
  Description of Artificial Sequence: Synthetic oligonucleotide
  Target: ATXN1; (-) strand; PAM type: NRG; PAM sequence: AGG
tggactttggcttatattct

SEQ ID NO: 90463 - DNA, 20 bp, Artificial Sequence
  Description of Artificial Sequence: Synthetic oligonucleotide
  Target: ATXN1; (-) strand; PAM type: NRG; PAM sequence: TAG
atggactttggcttatattc

SEQ ID NO: 90464 - DNA, 20 bp, Artificial Sequence
  Description of Artificial Sequence: Synthetic oligonucleotide
  Target: ATXN1; (-) strand; PAM type: NRG; PAM sequence: TGG
atgctaaggagtatggactt

SEQ ID NO: 90465 - DNA, 20 bp, Artificial Sequence
  Description of Artificial Sequence: Synthetic oligonucleotide
  Target: ATXN1; (-) strand; PAM type: NRG; PAM sequence: TGG
atttcaaatgctaaggagta

SEQ ID NO: 90466 - DNA, 20 bp, Artificial Sequence
  Description of Artificial Sequence: Synthetic oligonucleotide
  Target: ATXN1; (-) strand; PAM type: NRG; PAM sequence: GAG
acggcatttcaaatgctaag

SEQ ID NO: 90467 - DNA, 20 bp, Artificial Sequence
  Description of Artificial Sequence: Synthetic oligonucleotide
  Target: ATXN1; (-) strand; PAM type: NRG; PAM sequence: AGG
ttacggcatttcaaatgcta

SEQ ID NO: 90468 - DNA, 20 bp, Artificial Sequence
  Description of Artificial Sequence: Synthetic oligonucleotide
  Target: ATXN1; (-) strand; PAM type: NRG; PAM sequence: AAG
cttacggcatttcaaatgct

SEQ ID NO: 90469 - DNA, 20 bp, Artificial Sequence
  Description of Artificial Sequence: Synthetic oligonucleotide
  Target: ATXN1; (-) strand; PAM type: NRG; PAM sequence: CGG
gagccaaactgggaaactta

SEQ ID NO: 90470 - DNA, 20 bp, Artificial Sequence
  Description of Artificial Sequence: Synthetic oligonucleotide
  Target: ATXN1; (-) strand; PAM type: NRG; PAM sequence: GGG
aagtaagttggagccaaact

SEQ ID NO: 90471 - DNA, 20 bp, Artificial Sequence
  Description of Artificial Sequence: Synthetic oligonucleotide
  Target: ATXN1; (-) strand; PAM type: NRG; PAM sequence: TGG
aaagtaagttggagccaaac

SEQ ID NO: 90472 - DNA, 20 bp, Artificial Sequence
  Description of Artificial Sequence: Synthetic oligonucleotide
  Target: ATXN1; (-) strand; PAM type: NRG; PAM sequence: GAG
ctagttggaaaagtaagttg

SEQ ID NO: 90473 - DNA, 20 bp, Artificial Sequence
  Description of Artificial Sequence: Synthetic oligonucleotide
  Target: ATXN1; (-) strand; PAM type: NRG; PAM sequence: TGG
atctagttggaaaagtaagt

SEQ ID NO: 90474 - DNA, 20 bp, Artificial Sequence
  Description of Artificial Sequence: Synthetic oligonucleotide
  Target: ATXN1; (-) strand; PAM type: NRG; PAM sequence: AAG
ggaaatctagttggaaaagt

SEQ ID NO: 90475 - DNA, 20 bp, Artificial Sequence
  Description of Artificial Sequence: Synthetic oligonucleotide
  Target: ATXN1; (-) strand; PAM type: NRG; PAM sequence: AAG
tacaggaaatctagttggaa

SEQ ID NO: 90476 - DNA, 20 bp, Artificial Sequence
  Description of Artificial Sequence: Synthetic oligonucleotide
  Target: ATXN1; (-) strand; PAM type: NRG; PAM sequence: TGG
ggggttacaggaaatctagt

SEQ ID NO: 90477 - DNA, 20 bp, Artificial Sequence
  Description of Artificial Sequence: Synthetic oligonucleotide
  Target: ATXN1; (-) strand; PAM type: NRG; PAM sequence: TAG
gtatggggttacaggaaatc

SEQ ID NO: 90478 - DNA, 20 bp, Artificial Sequence
  Description of Artificial Sequence: Synthetic oligonucleotide
  Target: ATXN1; (-) strand; PAM type: NRG; PAM sequence: AGG
gggacgtggtatggggttac

SEQ ID NO: 90479 - DNA, 20 bp, Artificial Sequence
  Description of Artificial Sequence: Synthetic oligonucleotide
  Target: ATXN1; (-) strand; PAM type: NRG; PAM sequence: CAG
ggggacgtggtatggggtta

SEQ ID NO: 90480 - DNA, 20 bp, Artificial Sequence
  Description of Artificial Sequence: Synthetic oligonucleotide
  Target: ATXN1; (-) strand; PAM type: NRG; PAM sequence: GGG
ggcttaggggacgtggtatg

SEQ ID NO: 90481 - DNA, 20 bp, Artificial Sequence
  Description of Artificial Sequence: Synthetic oligonucleotide
  Target: ATXN1; (-) strand; PAM type: NRG; PAM sequence: GGG
gggcttaggggacgtggtat

SEQ ID NO: 90482 - DNA, 20 bp, Artificial Sequence
  Description of Artificial Sequence: Synthetic oligonucleotide
  Target: ATXN1; (-) strand; PAM type: NRG; PAM sequence: TGG
agggcttaggggacgtggta

SEQ ID NO: 90483 - DNA, 20 bp, Artificial Sequence
  Description of Artificial Sequence: Synthetic oligonucleotide
  Target: ATXN1; (-) strand; PAM type: NRG; PAM sequence: TGG
gaggtagggcttaggggacg

SEQ ID NO: 90484 - DNA, 20 bp, Artificial Sequence
  Description of Artificial Sequence: Synthetic oligonucleotide
  Target: ATXN1; (-) strand; PAM type: NRG; PAM sequence: GGG
caactagaggtagggcttag

SEQ ID NO: 90485 - DNA, 20 bp, Artificial Sequence
  Description of Artificial Sequence: Synthetic oligonucleotide
  Target: ATXN1; (-) strand; PAM type: NRG; PAM sequence: GGG
acaactagaggtagggctta

SEQ ID NO: 90486 - DNA, 20 bp, Artificial Sequence
  Description of Artificial Sequence: Synthetic oligonucleotide
  Target: ATXN1; (-) strand; PAM type: NRG; PAM sequence: AGG
cacaactagaggtagggctt

SEQ ID NO: 90487 - DNA, 20 bp, Artificial Sequence
  Description of Artificial Sequence: Synthetic oligonucleotide
  Target: ATXN1; (-) strand; PAM type: NRG; PAM sequence: TAG
acacaactagaggtagggct

SEQ ID NO: 90488 - DNA, 20 bp, Artificial Sequence
  Description of Artificial Sequence: Synthetic oligonucleotide
  Target: ATXN1; (-) strand; PAM type: NRG; PAM sequence: GGG
gtctaacacaactagaggta

SEQ ID NO: 90489 - DNA, 20 bp, Artificial Sequence
  Description of Artificial Sequence: Synthetic oligonucleotide
  Target: ATXN1; (-) strand; PAM type: NRG; PAM sequence: AGG
tgtctaacacaactagaggt

SEQ ID NO: 90490 - DNA, 20 bp, Artificial Sequence
  Description of Artificial Sequence: Synthetic oligonucleotide
  Target: ATXN1; (-) strand; PAM type: NRG; PAM sequence: TAG
ttgtctaacacaactagagg

SEQ ID NO: 90491 - DNA, 20 bp, Artificial Sequence
  Description of Artificial Sequence: Synthetic oligonucleotide
  Target: ATXN1; (-) strand; PAM type: NRG; PAM sequence: AGG
tgcttgtctaacacaactag

SEQ ID NO: 90492 - DNA, 20 bp, Artificial Sequence
  Description of Artificial Sequence: Synthetic oligonucleotide
  Target: ATXN1; (-) strand; PAM type: NRG; PAM sequence: GAG
atgcttgtctaacacaacta

SEQ ID NO: 90493 - DNA, 20 bp, Artificial Sequence
  Description of Artificial Sequence: Synthetic oligonucleotide
  Target: ATXN1; (-) strand; PAM type: NRG; PAM sequence: TAG
gaatgcttgtctaacacaac

SEQ ID NO: 90494 - DNA, 20 bp, Artificial Sequence
  Description of Artificial Sequence: Synthetic oligonucleotide
  Target: ATXN1; (-) strand; PAM type: NRG; PAM sequence: GGG
tgcatggtatccagtaattt

SEQ ID NO: 90495 - DNA, 20 bp, Artificial Sequence
  Description of Artificial Sequence: Synthetic oligonucleotide
  Target: ATXN1; (-) strand; PAM type: NRG; PAM sequence: TGG
gtgcatggtatccagtaatt

SEQ ID NO: 90496 - DNA, 20 bp, Artificial Sequence
  Description of Artificial Sequence: Synthetic oligonucleotide
  Target: ATXN1; (-) strand; PAM type: NRG; PAM sequence: CAG
gcttgagtgtgcatggtatc

SEQ ID NO: 90497 - DNA, 20 bp, Artificial Sequence
  Description of Artificial Sequence: Synthetic oligonucleotide
  Target: ATXN1; (-) strand; PAM type: NRG; PAM sequence: TGG
cctctaggcttgagtgtgca

SEQ ID NO: 90498 - DNA, 20 bp, Artificial Sequence
  Description of Artificial Sequence: Synthetic oligonucleotide
  Target: ATXN1; (-) strand; PAM type: NRG; PAM sequence: GAG
ggctgtggtcctctaggctt

SEQ ID NO: 90499 - DNA, 20 bp, Artificial Sequence
  Description of Artificial Sequence: Synthetic oligonucleotide
  Target: ATXN1; (-) strand; PAM type: NRG; PAM sequence: AGG
agaaatggctgtggtcctct

SEQ ID NO: 90500 - DNA, 20 bp, Artificial Sequence
  Description of Artificial Sequence: Synthetic oligonucleotide
  Target: ATXN1; (-) strand; PAM type: NRG; PAM sequence: TAG
cagaaatggctgtggtcctc

SEQ ID NO: 90501 - DNA, 20 bp, Artificial Sequence
  Description of Artificial Sequence: Synthetic oligonucleotide
  Target: ATXN1; (-) strand; PAM type: NRG; PAM sequence: TGG
aattgcagcagaaatggctg

SEQ ID NO: 90502 - DNA, 20 bp, Artificial Sequence
  Description of Artificial Sequence: Synthetic oligonucleotide
  Target: ATXN1; (-) strand; PAM type: NRG; PAM sequence: TGG
gtagagaattgcagcagaaa

SEQ ID NO: 90503 - DNA, 20 bp, Artificial Sequence
  Description of Artificial Sequence: Synthetic oligonucleotide
  Target: ATXN1; (-) strand; PAM type: NRG; PAM sequence: CAG
cttcaggtagagaattgcag

SEQ ID NO: 90504 - DNA, 20 bp, Artificial Sequence
  Description of Artificial Sequence: Synthetic oligonucleotide
  Target: ATXN1; (-) strand; PAM type: NRG; PAM sequence: CAG
gttcttcaggtagagaattg

SEQ ID NO: 90505 - DNA, 20 bp, Artificial Sequence
  Description of Artificial Sequence: Synthetic oligonucleotide
  Target: ATXN1; (-) strand; PAM type: NRG; PAM sequence: GAG
gagattgagttcttcaggta

SEQ ID NO: 90506 - DNA, 20 bp, Artificial Sequence
  Description of Artificial Sequence: Synthetic oligonucleotide
  Target: ATXN1; (-) strand; PAM type: NRG; PAM sequence: TAG
aggagattgagttcttcagg

SEQ ID NO: 90507 - DNA, 20 bp, Artificial Sequence
  Description of Artificial Sequence: Synthetic oligonucleotide
  Target: ATXN1; (-) strand; PAM type: NRG; PAM sequence: AGG
caaaggagattgagttcttc

SEQ ID NO: 90508 - DNA, 20 bp, Artificial Sequence
  Description of Artificial Sequence: Synthetic oligonucleotide
  Target: ATXN1; (-) strand; PAM type: NRG; PAM sequence: CAG
tcaaaggagattgagttctt

SEQ ID NO: 90509 - DNA, 20 bp, Artificial Sequence
  Description of Artificial Sequence: Synthetic oligonucleotide
  Target: ATXN1; (-) strand; PAM type: NRG; PAM sequence: GAG
gctctgtctcaaaggagatt

SEQ ID NO: 90510 - DNA, 20 bp, Artificial Sequence
  Description of Artificial Sequence: Synthetic oligonucleotide
  Target: ATXN1; (-) strand; PAM type: NRG; PAM sequence: GAG
gtttgagctctgtctcaaag

SEQ ID NO: 90511 - DNA, 20 bp, Artificial Sequence
  Description of Artificial Sequence: Synthetic oligonucleotide
  Target: ATXN1; (-) strand; PAM type: NRG; PAM sequence: AGG
atgtttgagctctgtctcaa

SEQ ID NO: 90512 - DNA, 20 bp, Artificial Sequence
  Description of Artificial Sequence: Synthetic oligonucleotide
  Target: ATXN1; (-) strand; PAM type: NRG; PAM sequence: AAG
gatgtttgagctctgtctca

SEQ ID NO: 90513 - DNA, 20 bp, Artificial Sequence
  Description of Artificial Sequence: Synthetic oligonucleotide
  Target: ATXN1; (-) strand; PAM type: NRG; PAM sequence: GAG
ccatagggttggagatgttt

SEQ ID NO: 90514 - DNA, 20 bp, Artificial Sequence
  Description of Artificial Sequence: Synthetic oligonucleotide
  Target: ATXN1; (-) strand; PAM type: NRG; PAM sequence: GAG
ggaatggctccatagggttg

SEQ ID NO: 90515 - DNA, 20 bp, Artificial Sequence
  Description of Artificial Sequence: Synthetic oligonucleotide
  Target: ATXN1; (-) strand; PAM type: NRG; PAM sequence: TGG
caggaatggctccatagggt

SEQ ID NO: 90516 - DNA, 20 bp, Artificial Sequence
  Description of Artificial Sequence: Synthetic oligonucleotide
  Target: ATXN1; (-) strand; PAM type: NRG; PAM sequence: GGG
ttgtcaggaatggctccata

SEQ ID NO: 90517 - DNA, 20 bp, Artificial Sequence
  Description of Artificial Sequence: Synthetic oligonucleotide
  Target: ATXN1; (-) strand; PAM type: NRG; PAM sequence: AGG
gttgtcaggaatggctccat

SEQ ID NO: 90518 - DNA, 20 bp, Artificial Sequence
  Description of Artificial Sequence: Synthetic oligonucleotide
  Target: ATXN1; (-) strand; PAM type: NRG; PAM sequence: TAG
tgttgtcaggaatggctcca

SEQ ID NO: 90519 - DNA, 20 bp, Artificial Sequence
  Description of Artificial Sequence: Synthetic oligonucleotide
  Target: ATXN1; (-) strand; PAM type: NRG; PAM sequence: TGG
ggtgggggtgttgtcaggaa

SEQ ID NO: 90520 - DNA, 20 bp, Artificial Sequence
  Description of Artificial Sequence: Synthetic oligonucleotide
  Target: ATXN1; (-) strand; PAM type: NRG; PAM sequence: AGG
gagtgggtgggggtgttgtc

SEQ ID NO: 90521 - DNA, 20 bp, Artificial Sequence
  Description of Artificial Sequence: Synthetic oligonucleotide
  Target: ATXN1; (-) strand; PAM type: NRG; PAM sequence: CAG
tgagtgggtgggggtgttgt

SEQ ID NO: 90522 - DNA, 20 bp, Artificial Sequence
  Description of Artificial Sequence: Synthetic oligonucleotide
  Target: ATXN1; (-) strand; PAM type: NRG; PAM sequence: GGG
atttagccttgagtgggtgg

SEQ ID NO: 90523 - DNA, 20 bp, Artificial Sequence
  Description of Artificial Sequence: Synthetic oligonucleotide
  Target: ATXN1; (-) strand; PAM type: NRG; PAM sequence: GGG
aatttagccttgagtgggtg

SEQ ID NO: 90524 - DNA, 20 bp, Artificial Sequence
  Description of Artificial Sequence: Synthetic oligonucleotide
  Target: ATXN1; (-) strand; PAM type: NRG; PAM sequence: GGG
taatttagccttgagtgggt

SEQ ID NO: 90525 - DNA, 20 bp, Artificial Sequence
  Description of Artificial Sequence: Synthetic oligonucleotide
  Target: ATXN1; (-) strand; PAM type: NRG; PAM sequence: TGG
ttaatttagccttgagtggg

SEQ ID NO: 90526 - DNA, 20 bp, Artificial Sequence
  Description of Artificial Sequence: Synthetic oligonucleotide
  Target: ATXN1; (-) strand; PAM type: NRG; PAM sequence: GGG
gcgttaatttagccttgagt

SEQ ID NO: 90527 - DNA, 20 bp, Artificial Sequence
  Description of Artificial Sequence: Synthetic oligonucleotide
  Target: ATXN1; (-) strand; PAM type: NRG; PAM sequence: TGG
tgcgttaatttagccttgag

SEQ ID NO: 90528 - DNA, 20 bp, Artificial Sequence
  Description of Artificial Sequence: Synthetic oligonucleotide
  Target: ATXN1; (-) strand; PAM type: NRG; PAM sequence: GAG
ggatgcgttaatttagcctt

SEQ ID NO: 90529 - DNA, 20 bp, Artificial Sequence
  Description of Artificial Sequence: Synthetic oligonucleotide
  Target: ATXN1; (-) strand; PAM type: NRG; PAM sequence: TAG
ggacgaaggatgcgttaatt

SEQ ID NO: 90530 - DNA, 20 bp, Artificial Sequence
  Description of Artificial Sequence: Synthetic oligonucleotide
  Target: ATXN1; (-) strand; PAM type: NRG; PAM sequence: AGG
gactgtgatcatatggacga

SEQ ID NO: 90531 - DNA, 20 bp, Artificial Sequence
  Description of Artificial Sequence: Synthetic oligonucleotide
  Target: ATXN1; (-) strand; PAM type: NRG; PAM sequence: AAG
ggactgtgatcatatggacg

SEQ ID NO: 90532 - DNA, 20 bp, Artificial Sequence
  Description of Artificial Sequence: Synthetic oligonucleotide
  Target: ATXN1; (-) strand; PAM type: NRG; PAM sequence: TGG
atcataggactgtgatcata

SEQ ID NO: 90533 - DNA, 20 bp, Artificial Sequence
  Description of Artificial Sequence: Synthetic oligonucleotide
  Target: ATXN1; (-) strand; PAM type: NRG; PAM sequence: AGG
agtgtgttacttatcatcat

SEQ ID NO: 90534 - DNA, 20 bp, Artificial Sequence
  Description of Artificial Sequence: Synthetic oligonucleotide
  Target: ATXN1; (-) strand; PAM type: NRG; PAM sequence: TAG
tagtgtgttacttatcatca

SEQ ID NO: 90535 - DNA, 20 bp, Artificial Sequence
  Description of Artificial Sequence: Synthetic oligonucleotide
  Target: ATXN1; (-) strand; PAM type: NRG; PAM sequence: TAG
gatgcatgtcattttatctg

SEQ ID NO: 90536 - DNA, 20 bp, Artificial Sequence
  Description of Artificial Sequence: Synthetic oligonucleotide
  Target: ATXN1; (-) strand; PAM type: NRG; PAM sequence: GAG
tggtcagatagctagataca

SEQ ID NO: 90537 - DNA, 20 bp, Artificial Sequence
  Description of Artificial Sequence: Synthetic oligonucleotide
  Target: ATXN1; (-) strand; PAM type: NRG; PAM sequence: CAG
agtggtcagatagctagata

SEQ ID NO: 90538 - DNA, 20 bp, Artificial Sequence
  Description of Artificial Sequence: Synthetic oligonucleotide
  Target: ATXN1; (-) strand; PAM type: NRG; PAM sequence: TAG
gagaagagtggtcagatagc

SEQ ID NO: 90539 - DNA, 20 bp, Artificial Sequence
  Description of Artificial Sequence: Synthetic oligonucleotide
  Target: ATXN1; (-) strand; PAM type: NRG; PAM sequence: TAG
ggatgagaagagtggtcaga

SEQ ID NO: 90540 - DNA, 20 bp, Artificial Sequence
  Description of Artificial Sequence: Synthetic oligonucleotide
  Target: ATXN1; (-) strand; PAM type: NRG; PAM sequence: CAG
gtttggatgagaagagtggt

SEQ ID NO: 90541 - DNA, 20 bp, Artificial Sequence
  Description of Artificial Sequence: Synthetic oligonucleotide
  Target: ATXN1; (-) strand; PAM type: NRG; PAM sequence: TGG
ggaagtttggatgagaagag

SEQ ID NO: 90542 - DNA, 20 bp, Artificial Sequence
  Description of Artificial Sequence: Synthetic oligonucleotide
  Target: ATXN1; (-) strand; PAM type: NRG; PAM sequence: GAG
ttgggaagtttggatgagaa

SEQ ID NO: 90543 - DNA, 20 bp, Artificial Sequence
  Description of Artificial Sequence: Synthetic oligonucleotide
  Target: ATXN1; (-) strand; PAM type: NRG; PAM sequence: AAG
ccttgggaagtttggatgag

SEQ ID NO: 90544 - DNA, 20 bp, Artificial Sequence
  Description of Artificial Sequence: Synthetic oligonucleotide
  Target: ATXN1; (-) strand; PAM type: NRG; PAM sequence: GAG
tgcccttgggaagtttggat

SEQ ID NO: 90545 - DNA, 20 bp, Artificial Sequence
  Description of Artificial Sequence: Synthetic oligonucleotide
  Target: ATXN1; (-) strand; PAM type: NRG; PAM sequence: TGG
atccctgcccttgggaagtt

SEQ ID NO: 90546 - DNA, 20 bp, Artificial Sequence
  Description of Artificial Sequence: Synthetic oligonucleotide
  Target: ATXN1; (-) strand; PAM type: NRG; PAM sequence: AAG
gcacaatccctgcccttggg

SEQ ID NO: 90547 - DNA, 20 bp, Artificial Sequence
  Description of Artificial Sequence: Synthetic oligonucleotide
  Target: ATXN1; (-) strand; PAM type: NRG; PAM sequence: GGG
gaagcacaatccctgccctt

SEQ ID NO: 90548 - DNA, 20 bp, Artificial Sequence
  Description of Artificial Sequence: Synthetic oligonucleotide
  Target: ATXN1; (-) strand; PAM type: NRG; PAM sequence: TGG
agaagcacaatccctgccct

SEQ ID NO: 90549 - DNA, 20 bp, Artificial Sequence
  Description of Artificial Sequence: Synthetic oligonucleotide
  Target: ATXN1; (-) strand; PAM type: NRG; PAM sequence: AAG
gggctaagacactgatgaag

SEQ ID NO: 90550 - DNA, 20 bp, Artificial Sequence
  Description of Artificial Sequence: Synthetic oligonucleotide
  Target: ATXN1; (-) strand; PAM type: NRG; PAM sequence: AAG
ctggggctaagacactgatg

SEQ ID NO: 90551 - DNA, 20 bp, Artificial Sequence
  Description of Artificial Sequence: Synthetic oligonucleotide
  Target: ATXN1; (-) strand; PAM type: NRG; PAM sequence: AAG
tcagggatggggctggggct

SEQ ID NO: 90552 - DNA, 20 bp, Artificial Sequence
  Description of Artificial Sequence: Synthetic oligonucleotide
  Target: ATXN1; (-) strand; PAM type: NRG; PAM sequence: GGG
atatttcagggatggggctg

SEQ ID NO: 90553 - DNA, 20 bp, Artificial Sequence
  Description of Artificial Sequence: Synthetic oligonucleotide
  Target: ATXN1; (-) strand; PAM type: NRG; PAM sequence: GGG
catatttcagggatggggct

SEQ ID NO: 90554 - DNA, 20 bp, Artificial Sequence
  Description of Artificial Sequence: Synthetic oligonucleotide
  Target: ATXN1; (-) strand; PAM type: NRG; PAM sequence: TGG
ccatatttcagggatggggc

SEQ ID NO: 90555 - DNA, 20 bp, Artificial Sequence
  Description of Artificial Sequence: Synthetic oligonucleotide
  Target: ATXN1; (-) strand; PAM type: NRG; PAM sequence: GGG
cctaccatatttcagggatg

SEQ ID NO: 90556 - DNA, 20 bp, Artificial Sequence
  Description of Artificial Sequence: Synthetic oligonucleotide
  Target: ATXN1; (-) strand; PAM type: NRG; PAM sequence: GGG
acctaccatatttcagggat

SEQ ID NO: 90557 - DNA, 20 bp, Artificial Sequence
  Description of Artificial Sequence: Synthetic oligonucleotide
  Target: ATXN1; (-) strand; PAM type: NRG; PAM sequence: TGG
tacctaccatatttcaggga

SEQ ID NO: 90558 - DNA, 20 bp, Artificial Sequence
  Description of Artificial Sequence: Synthetic oligonucleotide
  Target: ATXN1; (-) strand; PAM type: NRG; PAM sequence: GGG
acagtacctaccatatttca

SEQ ID NO: 90559 - DNA, 20 bp, Artificial Sequence
  Description of Artificial Sequence: Synthetic oligonucleotide
  Target: ATXN1; (-) strand; PAM type: NRG; PAM sequence: AGG
aacagtacctaccatatttc

SEQ ID NO: 90560 - DNA, 20 bp, Artificial Sequence
  Description of Artificial Sequence: Synthetic oligonucleotide
  Target: ATXN1; (-) strand; PAM type: NRG; PAM sequence: CAG
aaacagtacctaccatattt

SEQ ID NO: 90561 - DNA, 20 bp, Artificial Sequence
  Description of Artificial Sequence: Synthetic oligonucleotide
  Target: ATXN1; (-) strand; PAM type: NRG; PAM sequence: CAG
tcatttattaatcttacaaa

SEQ ID NO: 90562 - DNA, 20 bp, Artificial Sequence
  Description of Artificial Sequence: Synthetic oligonucleotide
  Target: ATXN1; (-) strand; PAM type: NRG; PAM sequence: TGG
ggcaaaatcactagccagct

SEQ ID NO: 90563 - DNA, 20 bp, Artificial Sequence
  Description of Artificial Sequence: Synthetic oligonucleotide
  Target: ATXN1; (-) strand; PAM type: NRG; PAM sequence: CAG
ccccaggcaaaatcactagc

SEQ ID NO: 90564 - DNA, 20 bp, Artificial Sequence
  Description of Artificial Sequence: Synthetic oligonucleotide
  Target: ATXN1; (-) strand; PAM type: NRG; PAM sequence: TAG
acttccccaggcaaaatcac

SEQ ID NO: 90565 - DNA, 20 bp, Artificial Sequence
  Description of Artificial Sequence: Synthetic oligonucleotide
  Target: ATXN1; (-) strand; PAM type: NRG; PAM sequence: AGG
ttttccaaactgacttcccc

SEQ ID NO: 90566 - DNA, 20 bp, Artificial Sequence
  Description of Artificial Sequence: Synthetic oligonucleotide
  Target: ATXN1; (-) strand; PAM type: NRG; PAM sequence: CAG
attttccaaactgacttccc

SEQ ID NO: 90567 - DNA, 20 bp, Artificial Sequence
  Description of Artificial Sequence: Synthetic oligonucleotide
  Target: ATXN1; (-) strand; PAM type: NRG; PAM sequence: GAG
gaaagcttctttagtggtca

SEQ ID NO: 90568 - DNA, 20 bp, Artificial Sequence
  Description of Artificial Sequence: Synthetic oligonucleotide
  Target: ATXN1; (-) strand; PAM type: NRG; PAM sequence: CAG
aagaaagcttctttagtggt

SEQ ID NO: 90569 - DNA, 20 bp, Artificial Sequence
  Description of Artificial Sequence: Synthetic oligonucleotide
  Target: ATXN1; (-) strand; PAM type: NRG; PAM sequence: TGG
ctgaaagaaagcttctttag

SEQ ID NO: 90570 - DNA, 20 bp, Artificial Sequence
  Description of Artificial Sequence: Synthetic oligonucleotide
  Target: ATXN1; (-) strand; PAM type: NRG; PAM sequence: TAG
atactgaaagaaagcttctt

SEQ ID NO: 90571 - DNA, 20 bp, Artificial Sequence
  Description of Artificial Sequence: Synthetic oligonucleotide
  Target: ATXN1; (-) strand; PAM type: NRG; PAM sequence: AAG
cattacaacatactgaaaga

SEQ ID NO: 90572 - DNA, 20 bp, Artificial Sequence
  Description of Artificial Sequence: Synthetic oligonucleotide
  Target: ATXN1; (-) strand; PAM type: NRG; PAM sequence: AAG
taaccattacaacatactga

SEQ ID NO: 90573 - DNA, 20 bp, Artificial Sequence
  Description of Artificial Sequence: Synthetic oligonucleotide
  Target: ATXN1; (-) strand; PAM type: NRG; PAM sequence: CAG
gttgtgagttttctggttta

SEQ ID NO: 90574 - DNA, 20 bp, Artificial Sequence
  Description of Artificial Sequence: Synthetic oligonucleotide
  Target: ATXN1; (-) strand; PAM type: NRG; PAM sequence: TGG
ggaggacgttgtgagttttc

SEQ ID NO: 90575 - DNA, 20 bp, Artificial Sequence
  Description of Artificial Sequence: Synthetic oligonucleotide
  Target: ATXN1; (-) strand; PAM type: NRG; PAM sequence: GAG
ctacttttggaggacgttgt

SEQ ID NO: 90576 - DNA, 20 bp, Artificial Sequence
  Description of Artificial Sequence: Synthetic oligonucleotide
  Target: ATXN1; (-) strand; PAM type: NRG; PAM sequence: AGG
tatttgtcttctacttttgg

SEQ ID NO: 90577 - DNA, 20 bp, Artificial Sequence
  Description of Artificial Sequence: Synthetic oligonucleotide
  Target: ATXN1; (-) strand; PAM type: NRG; PAM sequence: GAG
gtatttgtcttctacttttg

SEQ ID NO: 90578 - DNA, 20 bp, Artificial Sequence
  Description of Artificial Sequence: Synthetic oligonucleotide
  Target: ATXN1; (-) strand; PAM type: NRG; PAM sequence: TGG
gtgtatttgtcttctacttt

SEQ ID NO: 90579 - DNA, 20 bp, Artificial Sequence
  Description of Artificial Sequence: Synthetic oligonucleotide
  Target: ATXN1; (-) strand; PAM type: NRG; PAM sequence: TAG
agctcagatcttccagttcc

SEQ ID NO: 90580 - DNA, 20 bp, Artificial Sequence
  Description of Artificial Sequence: Synthetic oligonucleotide
  Target: ATXN1; (-) strand; PAM type: NRG; PAM sequence: CAG
ggacctgagctcagatcttc

SEQ ID NO: 90581 - DNA, 20 bp, Artificial Sequence
  Description of Artificial Sequence: Synthetic oligonucleotide
  Target: ATXN1; (-) strand; PAM type: NRG; PAM sequence: CAG
ggaaagccaggacctgagct

SEQ ID NO: 90582 - DNA, 20 bp, Artificial Sequence
  Description of Artificial Sequence: Synthetic oligonucleotide
  Target: ATXN1; (-) strand; PAM type: NRG; PAM sequence: GAG
tcataggaaagccaggacct

SEQ ID NO: 90583 - DNA, 20 bp, Artificial Sequence
  Description of Artificial Sequence: Synthetic oligonucleotide
  Target: ATXN1; (-) strand; PAM type: NRG; PAM sequence: AGG
agctggttcataggaaagcc

SEQ ID NO: 90584 - DNA, 20 bp, Artificial Sequence
  Description of Artificial Sequence: Synthetic oligonucleotide
  Target: ATXN1; (-) strand; PAM type: NRG; PAM sequence: CAG
cagctggttcataggaaagc

SEQ ID NO: 90585 - DNA, 20 bp, Artificial Sequence
  Description of Artificial Sequence: Synthetic oligonucleotide
  Target: ATXN1; (-) strand; PAM type: NRG; PAM sequence: AAG
cacacagctggttcatagga

SEQ ID NO: 90586 - DNA, 20 bp, Artificial Sequence
  Description of Artificial Sequence: Synthetic oligonucleotide
  Target: ATXN1; (-) strand; PAM type: NRG; PAM sequence: AGG
aagtcacacagctggttcat

SEQ ID NO: 90587 - DNA, 20 bp, Artificial Sequence
  Description of Artificial Sequence: Synthetic oligonucleotide
  Target: ATXN1; (-) strand; PAM type: NRG; PAM sequence: TAG
aaagtcacacagctggttca

SEQ ID NO: 90588 - DNA, 20 bp, Artificial Sequence
  Description of Artificial Sequence: Synthetic oligonucleotide
  Target: ATXN1; (-) strand; PAM type: NRG; PAM sequence: TGG
cttgaccaaagtcacacagc

SEQ ID NO: 90589 - DNA, 20 bp, Artificial Sequence
  Description of Artificial Sequence: Synthetic oligonucleotide
  Target: ATXN1; (-) strand; PAM type: NRG; PAM sequence: CAG
gtgacttgaccaaagtcaca

SEQ ID NO: 90590 - DNA, 20 bp, Artificial Sequence
  Description of Artificial Sequence: Synthetic oligonucleotide
  Target: ATXN1; (-) strand; PAM type: NRG; PAM sequence: AAG
gagggaatgtgacttgacca

SEQ ID NO: 90591 - DNA, 20 bp, Artificial Sequence
  Description of Artificial Sequence: Synthetic oligonucleotide
  Target: ATXN1; (-) strand; PAM type: NRG; PAM sequence: GGG
aacaaacagaagatcagaga

SEQ ID NO: 90592 - DNA, 20 bp, Artificial Sequence
  Description of Artificial Sequence: Synthetic oligonucleotide
  Target: ATXN1; (-) strand; PAM type: NRG; PAM sequence: AGG
gaacaaacagaagatcagag

SEQ ID NO: 90593 - DNA, 20 bp, Artificial Sequence
  Description of Artificial Sequence: Synthetic oligonucleotide
  Target: ATXN1; (-) strand; PAM type: NRG; PAM sequence: GAG
tgaacaaacagaagatcaga

SEQ ID NO: 90594 - DNA, 20 bp, Artificial Sequence
  Description of Artificial Sequence: Synthetic oligonucleotide
  Target: ATXN1; (-) strand; PAM type: NRG; PAM sequence: GAG
agtgaacaaacagaagatca

SEQ ID NO: 90595 - DNA, 20 bp, Artificial Sequence
  Description of Artificial Sequence: Synthetic oligonucleotide
  Target: ATXN1; (-) strand; PAM type: NRG; PAM sequence: CAG
tcagtgaacaaacagaagat

SEQ ID NO: 90596 - DNA, 20 bp, Artificial Sequence
  Description of Artificial Sequence: Synthetic oligonucleotide
  Target: ATXN1; (-) strand; PAM type: NRG; PAM sequence: AAG
acaattcagtgaacaaacag

SEQ ID NO: 90597 - DNA, 20 bp, Artificial Sequence
  Description of Artificial Sequence: Synthetic oligonucleotide
  Target: ATXN1; (-) strand; PAM type: NRG; PAM sequence: CAG
gccacaattcagtgaacaaa

SEQ ID NO: 90598 - DNA, 20 bp, Artificial Sequence
  Description of Artificial Sequence: Synthetic oligonucleotide
  Target: ATXN1; (-) strand; PAM type: NRG; PAM sequence: CAG
cccacaaccctgccacaatt

SEQ ID NO: 90599 - DNA, 20 bp, Artificial Sequence
  Description of Artificial Sequence: Synthetic oligonucleotide
  Target: ATXN1; (-) strand; PAM type: NRG; PAM sequence: AAG
ttgcatcagggaagaactag

SEQ ID NO: 90600 - DNA, 20 bp, Artificial Sequence
  Description of Artificial Sequence: Synthetic oligonucleotide
  Target: ATXN1; (-) strand; PAM type: NRG; PAM sequence: TAG
gaattgcatcagggaagaac

SEQ ID NO: 90601 - DNA, 20 bp, Artificial Sequence
  Description of Artificial Sequence: Synthetic oligonucleotide
  Target: ATXN1; (-) strand; PAM type: NRG; PAM sequence: AAG
gtcagagaattgcatcaggg

SEQ ID NO: 90602 - DNA, 20 bp, Artificial Sequence
  Description of Artificial Sequence: Synthetic oligonucleotide
  Target: ATXN1; (-) strand; PAM type: NRG; PAM sequence: GGG
cacgtcagagaattgcatca

SEQ ID NO: 90603 - DNA, 20 bp, Artificial Sequence
  Description of Artificial Sequence: Synthetic oligonucleotide
  Target: ATXN1; (-) strand; PAM type: NRG; PAM sequence: AGG
gcacgtcagagaattgcatc

SEQ ID NO: 90604 - DNA, 20 bp, Artificial Sequence
  Description of Artificial Sequence: Synthetic oligonucleotide
  Target: ATXN1; (-) strand; PAM type: NRG; PAM sequence: CAG
tgcacgtcagagaattgcat

SEQ ID NO: 90605 - DNA, 20 bp, Artificial Sequence
  Description of Artificial Sequence: Synthetic oligonucleotide
  Target: ATXN1; (-) strand; PAM type: NRG; PAM sequence: GAG
gtctatacctttgcacgtca

SEQ ID NO: 90606 - DNA, 20 bp, Artificial Sequence
  Description of Artificial Sequence: Synthetic oligonucleotide
  Target: ATXN1; (-) strand; PAM type: NRG; PAM sequence: CAG
tagtctatacctttgcacgt

SEQ ID NO: 90607 - DNA, 20 bp, Artificial Sequence
  Description of Artificial Sequence: Synthetic oligonucleotide
  Target: ATXN1; (-) strand; PAM type: NRG; PAM sequence: TAG
cagaaaatgtttgccaactg

SEQ ID NO: 90608 - DNA, 20 bp, Artificial Sequence
  Description of Artificial Sequence: Synthetic oligonucleotide
  Target: ATXN1; (-) strand; PAM type: NRG; PAM sequence: CAG
atctactatctgatcctcat

SEQ ID NO: 90609 - DNA, 20 bp, Artificial Sequence
  Description of Artificial Sequence: Synthetic oligonucleotide
  Target: ATXN1; (-) strand; PAM type: NRG; PAM sequence: AAG
aaagagaccatagtccaaga

SEQ ID NO: 90610 - DNA, 20 bp, Artificial Sequence
  Description of Artificial Sequence: Synthetic oligonucleotide
  Target: ATXN1; (-) strand; PAM type: NRG; PAM sequence: AAG
ggtgaaagagaccatagtcc

SEQ ID NO: 90611 - DNA, 20 bp, Artificial Sequence
  Description of Artificial Sequence: Synthetic oligonucleotide
  Target: ATXN1; (-) strand; PAM type: NRG; PAM sequence: TAG
agtcatggtgaaagagacca

SEQ ID NO: 90612 - DNA, 20 bp, Artificial Sequence
  Description of Artificial Sequence: Synthetic oligonucleotide
  Target: ATXN1; (-) strand; PAM type: NRG; PAM sequence: GAG
tgatttgagtcatggtgaaa

SEQ ID NO: 90613 - DNA, 20 bp, Artificial Sequence
  Description of Artificial Sequence: Synthetic oligonucleotide
  Target: ATXN1; (-) strand; PAM type: NRG; PAM sequence: AAG
tttgatttgagtcatggtga

SEQ ID NO: 90614 - DNA, 20 bp, Artificial Sequence
  Description of Artificial Sequence: Synthetic oligonucleotide
  Target: ATXN1; (-) strand; PAM type: NRG; PAM sequence: TGG
gcagaatttgatttgagtca

SEQ ID NO: 90615 - DNA, 20 bp, Artificial Sequence
  Description of Artificial Sequence: Synthetic oligonucleotide
  Target: ATXN1; (-) strand; PAM type: NRG; PAM sequence: GAG
acactggcagaatttgattt

SEQ ID NO: 90616 - DNA, 20 bp, Artificial Sequence
  Description of Artificial Sequence: Synthetic oligonucleotide
  Target: ATXN1; (-) strand; PAM type: NRG; PAM sequence: CAG
cagtttttgcactacactgg

SEQ ID NO: 90617 - DNA, 20 bp, Artificial Sequence
  Description of Artificial Sequence: Synthetic oligonucleotide
  Target: ATXN1; (-) strand; PAM type: NRG; PAM sequence: TGG
tagcagtttttgcactacac

SEQ ID NO: 90618 - DNA, 20 bp, Artificial Sequence
  Description of Artificial Sequence: Synthetic oligonucleotide
  Target: ATXN1; (-) strand; PAM type: NRG; PAM sequence: CAG
aatttgtctaatgtctatag

SEQ ID NO: 90619 - DNA, 20 bp, Artificial Sequence
  Description of Artificial Sequence: Synthetic oligonucleotide
  Target: ATXN1; (-) strand; PAM type: NRG; PAM sequence: TAG
aataatttgtctaatgtcta

SEQ ID NO: 90620 - DNA, 20 bp, Artificial Sequence
  Description of Artificial Sequence: Synthetic oligonucleotide
  Target: ATXN1; (-) strand; PAM type: NRG; PAM sequence: TAG
aataaagttttattagcaca

SEQ ID NO: 90621 - DNA, 20 bp, Artificial Sequence
  Description of Artificial Sequence: Synthetic oligonucleotide
  Target: ATXN1; (-) strand; PAM type: NRG; PAM sequence: TAG
tcttgtaaataaagttttat

SEQ ID NO: 90622 - DNA, 20 bp, Artificial Sequence
  Description of Artificial Sequence: Synthetic oligonucleotide
  Target: ATXN1; (-) strand; PAM type: NRG; PAM sequence: AAG
ccagcctgttcttgtaaata

SEQ ID NO: 90623 - DNA, 20 bp, Artificial Sequence
  Description of Artificial Sequence: Synthetic oligonucleotide
  Target: ATXN1; (-) strand; PAM type: NRG; PAM sequence: CAG
tatggtccatgggccaaatc

SEQ ID NO: 90624 - DNA, 20 bp, Artificial Sequence
  Description of Artificial Sequence: Synthetic oligonucleotide
  Target: ATXN1; (-) strand; PAM type: NRG; PAM sequence: GGG
gtaggcaaactatggtccat

SEQ ID NO: 90625 - DNA, 20 bp, Artificial Sequence
  Description of Artificial Sequence: Synthetic oligonucleotide
  Target: ATXN1; (-) strand; PAM type: NRG; PAM sequence: TGG
agtaggcaaactatggtcca

SEQ ID NO: 90626 - DNA, 20 bp, Artificial Sequence
  Description of Artificial Sequence: Synthetic oligonucleotide
  Target: ATXN1; (-) strand; PAM type: NRG; PAM sequence: TGG
gaccaggagtaggcaaacta

SEQ ID NO: 90627 - DNA, 20 bp, Artificial Sequence
  Description of Artificial Sequence: Synthetic oligonucleotide
  Target: ATXN1; (-) strand; PAM type: NRG; PAM sequence: AGG
cattcatccagaccaggagt

SEQ ID NO: 90628 - DNA, 20 bp, Artificial Sequence
  Description of Artificial Sequence: Synthetic oligonucleotide
  Target: ATXN1; (-) strand; PAM type: NRG; PAM sequence: TAG
gcattcatccagaccaggag

SEQ ID NO: 90629 - DNA, 20 bp, Artificial Sequence
  Description of Artificial Sequence: Synthetic oligonucleotide
  Target: ATXN1; (-) strand; PAM type: NRG; PAM sequence: GAG
gaggcattcatccagaccag

SEQ ID NO: 90630 - DNA, 20 bp, Artificial Sequence
  Description of Artificial Sequence: Synthetic oligonucleotide
  Target: ATXN1; (-) strand; PAM type: NRG; PAM sequence: AGG
aggaggcattcatccagacc

SEQ ID NO: 90631 - DNA, 20 bp, Artificial Sequence
  Description of Artificial Sequence: Synthetic oligonucleotide
  Target: ATXN1; (-) strand; PAM type: NRG; PAM sequence: CAG
aaggaggcattcatccagac

SEQ ID NO: 90632 - DNA, 20 bp, Artificial Sequence
  Description of Artificial Sequence: Synthetic oligonucleotide
  Target: ATXN1; (-) strand; PAM type: NRG; PAM sequence: CAG
gcaacaaggaggcattcatc

SEQ ID NO: 90633 - DNA, 20 bp, Artificial Sequence
  Description of Artificial Sequence: Synthetic oligonucleotide
  Target: ATXN1; (-) strand; PAM type: NRG; PAM sequence: AGG
tgaactgaatggcaacaagg

SEQ ID NO: 90634 - DNA, 20 bp, Artificial Sequence
  Description of Artificial Sequence: Synthetic oligonucleotide
  Target: ATXN1; (-) strand; PAM type: NRG; PAM sequence: GAG
gtgaactgaatggcaacaag

SEQ ID NO: 90635 - DNA, 20 bp, Artificial Sequence
  Description of Artificial Sequence: Synthetic oligonucleotide
  Target: ATXN1; (-) strand; PAM type: NRG; PAM sequence: AGG
ctgtgaactgaatggcaaca

SEQ ID NO: 90636 - DNA, 20 bp, Artificial Sequence
  Description of Artificial Sequence: Synthetic oligonucleotide
  Target: ATXN1; (-) strand; PAM type: NRG; PAM sequence: AAG
tctgtgaactgaatggcaac

SEQ ID NO: 90637 - DNA, 20 bp, Artificial Sequence
  Description of Artificial Sequence: Synthetic oligonucleotide
  Target: ATXN1; (-) strand; PAM type: NRG; PAM sequence: TGG
atcaagctctgtgaactgaa

SEQ ID NO: 90638 - DNA, 20 bp, Artificial Sequence
  Description of Artificial Sequence: Synthetic oligonucleotide
  Target: ATXN1; (-) strand; PAM type: NRG; PAM sequence: AAG
gtgaactgtatcttcatatc

SEQ ID NO: 90639 - DNA, 20 bp, Artificial Sequence
  Description of Artificial Sequence: Synthetic oligonucleotide
  Target: ATXN1; (-) strand; PAM type: NRG; PAM sequence: TGG
aatggatagaggctttggga

SEQ ID NO: 90640 - DNA, 20 bp, Artificial Sequence
  Description of Artificial Sequence: Synthetic oligonucleotide
  Target: ATXN1; (-) strand; PAM type: NRG; PAM sequence: GGG
ttggaatggatagaggcttt

SEQ ID NO: 90641 - DNA, 20 bp, Artificial Sequence
  Description of Artificial Sequence: Synthetic oligonucleotide
  Target: ATXN1; (-) strand; PAM type: NRG; PAM sequence: TGG
tttggaatggatagaggctt

SEQ ID NO: 90642 - DNA, 20 bp, Artificial Sequence
  Description of Artificial Sequence: Synthetic oligonucleotide
  Target: ATXN1; (-) strand; PAM type: NRG; PAM sequence: AGG
agtccctttggaatggatag

SEQ ID NO: 90643 - DNA, 20 bp, Artificial Sequence
  Description of Artificial Sequence: Synthetic oligonucleotide
  Target: ATXN1; (-) strand; PAM type: NRG; PAM sequence: GAG
aagtccctttggaatggata

SEQ ID NO: 90644 - DNA, 20 bp, Artificial Sequence
  Description of Artificial Sequence: Synthetic oligonucleotide
  Target: ATXN1; (-) strand; PAM type: NRG; PAM sequence: TAG
ataagtccctttggaatgga

SEQ ID NO: 90645 - DNA, 20 bp, Artificial Sequence
  Description of Artificial Sequence: Synthetic oligonucleotide
  Target: ATXN1; (-) strand; PAM type: NRG; PAM sequence: TGG
tcttataagtccctttggaa

SEQ ID NO: 90646 - DNA, 20 bp, Artificial Sequence
  Description of Artificial Sequence: Synthetic oligonucleotide
  Target: ATXN1; (-) strand; PAM type: NRG; PAM sequence: TGG
gtccttcttataagtccctt

SEQ ID NO: 90647 - DNA, 20 bp, Artificial Sequence
  Description of Artificial Sequence: Synthetic oligonucleotide
  Target: ATXN1; (-) strand; PAM type: NRG; PAM sequence: AAG
atctttattgtccttcttat

SEQ ID NO: 90648 - DNA, 20 bp, Artificial Sequence
  Description of Artificial Sequence: Synthetic oligonucleotide
  Target: ATXN1; (-) strand; PAM type: NRG; PAM sequence: TGG
tcaagttcttggttggggaa

SEQ ID NO: 90649 - DNA, 20 bp, Artificial Sequence
  Description of Artificial Sequence: Synthetic oligonucleotide
  Target: ATXN1; (-) strand; PAM type: NRG; PAM sequence: GGG
cgttgtcaagttcttggttg

SEQ ID NO: 90650 - DNA, 20 bp, Artificial Sequence
  Description of Artificial Sequence: Synthetic oligonucleotide
  Target: ATXN1; (-) strand; PAM type: NRG; PAM sequence: GGG
ccgttgtcaagttcttggtt

SEQ ID NO: 90651 - DNA, 20 bp, Artificial Sequence
  Description of Artificial Sequence: Synthetic oligonucleotide
  Target: ATXN1; (-) strand; PAM type: NRG; PAM sequence: TGG
cccgttgtcaagttcttggt

SEQ ID NO: 90652 - DNA, 20 bp, Artificial Sequence
  Description of Artificial Sequence: Synthetic oligonucleotide
  Target: ATXN1; (-) strand; PAM type: NRG; PAM sequence: TGG
cttccccgttgtcaagttct

SEQ ID NO: 90653 - DNA, 20 bp, Artificial Sequence
  Description of Artificial Sequence: Synthetic oligonucleotide
  Target: ATXN1; (-) strand; PAM type: NRG; PAM sequence: AAG
gcaatctcttccccgttgtc

SEQ ID NO: 90654 - DNA, 20 bp, Artificial Sequence
  Description of Artificial Sequence: Synthetic oligonucleotide
  Target: ATXN1; (-) strand; PAM type: NRG; PAM sequence: AGG
cttactataaaccgctaact

SEQ ID NO: 90655 - DNA, 20 bp, Artificial Sequence
  Description of Artificial Sequence: Synthetic oligonucleotide
  Target: ATXN1; (-) strand; PAM type: NRG; PAM sequence: TAG
tcttactataaaccgctaac

SEQ ID NO: 90656 - DNA, 20 bp, Artificial Sequence
  Description of Artificial Sequence: Synthetic oligonucleotide
  Target: ATXN1; (-) strand; PAM type: NRG; PAM sequence: TGG
agtaattatctttcttcagt

SEQ ID NO: 90657 - DNA, 20 bp, Artificial Sequence
  Description of Artificial Sequence: Synthetic oligonucleotide
  Target: ATXN1; (-) strand; PAM type: NRG; PAM sequence: CAG
tggtagtaattatctttctt

SEQ ID NO: 90658 - DNA, 20 bp, Artificial Sequence
  Description of Artificial Sequence: Synthetic oligonucleotide
  Target: ATXN1; (-) strand; PAM type: NRG; PAM sequence: TAG
ggcaggggtagtggtgatgg

SEQ ID NO: 90659 - DNA, 20 bp, Artificial Sequence
  Description of Artificial Sequence: Synthetic oligonucleotide
  Target: ATXN1; (-) strand; PAM type: NRG; PAM sequence: TGG
tggggcaggggtagtggtga

SEQ ID NO: 90660 - DNA, 20 bp, Artificial Sequence
  Description of Artificial Sequence: Synthetic oligonucleotide
  Target: ATXN1; (-) strand; PAM type: NRG; PAM sequence: TGG
gctggctggggcaggggtag

SEQ ID NO: 90661 - DNA, 20 bp, Artificial Sequence
  Description of Artificial Sequence: Synthetic oligonucleotide
  Target: ATXN1; (-) strand; PAM type: NRG; PAM sequence: TAG
ggtgctggctggggcagggg

SEQ ID NO: 90662 - DNA, 20 bp, Artificial Sequence
  Description of Artificial Sequence: Synthetic oligonucleotide
  Target: ATXN1; (-) strand; PAM type: NRG; PAM sequence: GGG
tcaggtgctggctggggcag

SEQ ID NO: 90663 - DNA, 20 bp, Artificial Sequence
  Description of Artificial Sequence: Synthetic oligonucleotide
  Target: ATXN1; (-) strand; PAM type: NRG; PAM sequence: GGG
atcaggtgctggctggggca

SEQ ID NO: 90664 - DNA, 20 bp, Artificial Sequence
  Description of Artificial Sequence: Synthetic oligonucleotide
  Target: ATXN1; (-) strand; PAM type: NRG; PAM sequence: AGG
catcaggtgctggctggggc

SEQ ID NO: 90665 - DNA, 20 bp, Artificial Sequence
  Description of Artificial Sequence: Synthetic oligonucleotide
  Target: ATXN1; (-) strand; PAM type: NRG; PAM sequence: CAG
tcatcaggtgctggctgggg

SEQ ID NO: 90666 - DNA, 20 bp, Artificial Sequence
  Description of Artificial Sequence: Synthetic oligonucleotide
  Target: ATXN1; (-) strand; PAM type: NRG; PAM sequence: GGG
atttcatcaggtgctggctg

SEQ ID NO: 90667 - DNA, 20 bp, Artificial Sequence
  Description of Artificial Sequence: Synthetic oligonucleotide
  Target: ATXN1; (-) strand; PAM type: NRG; PAM sequence: GGG
tatttcatcaggtgctggct

SEQ ID NO: 90668 - DNA, 20 bp, Artificial Sequence
  Description of Artificial Sequence: Synthetic oligonucleotide
  Target: ATXN1; (-) strand; PAM type: NRG; PAM sequence: TGG
atatttcatcaggtgctggc

SEQ ID NO: 90669 - DNA, 20 bp, Artificial Sequence
  Description of Artificial Sequence: Synthetic oligonucleotide
  Target: ATXN1; (-) strand; PAM type: NRG; PAM sequence: TGG
gactatatttcatcaggtgc

SEQ ID NO: 90670 - DNA, 20 bp, Artificial Sequence
  Description of Artificial Sequence: Synthetic oligonucleotide
  Target: ATXN1; (-) strand; PAM type: NRG; PAM sequence: AGG
attcatgactatatttcatc

SEQ ID NO: 90671 - DNA, 20 bp, Artificial Sequence
  Description of Artificial Sequence: Synthetic oligonucleotide
  Target: ATXN1; (-) strand; PAM type: NRG; PAM sequence: CAG
aattcatgactatatttcat

SEQ ID NO: 90672 - DNA, 20 bp, Artificial Sequence
  Description of Artificial Sequence: Synthetic oligonucleotide
  Target: ATXN1; (-) strand; PAM type: NRG; PAM sequence: CAG
ctggcgcccttttgaggaca

SEQ ID NO: 90673 - DNA, 20 bp, Artificial Sequence
  Description of Artificial Sequence: Synthetic oligonucleotide
  Target: ATXN1; (-) strand; PAM type: NRG; PAM sequence: AGG
ccagccctggcgcccttttg

SEQ ID NO: 90674 - DNA, 20 bp, Artificial Sequence
  Description of Artificial Sequence: Synthetic oligonucleotide
  Target: ATXN1; (-) strand; PAM type: NRG; PAM sequence: GAG
gccagccctggcgccctttt

SEQ ID NO: 90675 - DNA, 20 bp, Artificial Sequence
  Description of Artificial Sequence: Synthetic oligonucleotide
  Target: ATXN1; (-) strand; PAM type: NRG; PAM sequence: TGG
tttcctggctaagccagccc

SEQ ID NO: 90676 - DNA, 20 bp, Artificial Sequence
  Description of Artificial Sequence: Synthetic oligonucleotide
  Target: ATXN1; (-) strand; PAM type: NRG; PAM sequence: CAG
ctgtactttcctggctaagc

SEQ ID NO: 90677 - DNA, 20 bp, Artificial Sequence
  Description of Artificial Sequence: Synthetic oligonucleotide
  Target: ATXN1; (-) strand; PAM type: NRG; PAM sequence: AAG
gactctgtactttcctggct

SEQ ID NO: 90678 - DNA, 20 bp, Artificial Sequence
  Description of Artificial Sequence: Synthetic oligonucleotide
  Target: ATXN1; (-) strand; PAM type: NRG; PAM sequence: TGG
ttagtgactctgtactttcc

SEQ ID NO: 90679 - DNA, 20 bp, Artificial Sequence
  Description of Artificial Sequence: Synthetic oligonucleotide
  Target: ATXN1; (-) strand; PAM type: NRG; PAM sequence: TAG
ggcattgcctacatagactt

SEQ ID NO: 90680 - DNA, 20 bp, Artificial Sequence
  Description of Artificial Sequence: Synthetic oligonucleotide
  Target: ATXN1; (-) strand; PAM type: NRG; PAM sequence: TAG
caaccttggcattgcctaca

SEQ ID NO: 90681 - DNA, 20 bp, Artificial Sequence
  Description of Artificial Sequence: Synthetic oligonucleotide
  Target: ATXN1; (-) strand; PAM type: NRG; PAM sequence: TGG
tgtattctccccaacaacct

SEQ ID NO: 90682 - DNA, 20 bp, Artificial Sequence
  Description of Artificial Sequence: Synthetic oligonucleotide
  Target: ATXN1; (-) strand; PAM type: NRG; PAM sequence: AAG
ctagggtggccttgcctgtg

SEQ ID NO: 90683 - DNA, 20 bp, Artificial Sequence
  Description of Artificial Sequence: Synthetic oligonucleotide
  Target: ATXN1; (-) strand; PAM type: NRG; PAM sequence: TGG
ctacagtcatctcactaggg

SEQ ID NO: 90684 - DNA, 20 bp, Artificial Sequence
  Description of Artificial Sequence: Synthetic oligonucleotide
  Target: ATXN1; (-) strand; PAM type: NRG; PAM sequence: GGG
tccctacagtcatctcacta

SEQ ID NO: 90685 - DNA, 20 bp, Artificial Sequence
  Description of Artificial Sequence: Synthetic oligonucleotide
  Target: ATXN1; (-) strand; PAM type: NRG; PAM sequence: AGG
ctccctacagtcatctcact

SEQ ID NO: 90686 - DNA, 20 bp, Artificial Sequence
  Description of Artificial Sequence: Synthetic oligonucleotide
  Target: ATXN1; (-) strand; PAM type: NRG; PAM sequence: TAG
actccctacagtcatctcac

SEQ ID NO: 90687 - DNA, 20 bp, Artificial Sequence
  Description of Artificial Sequence: Synthetic oligonucleotide
  Target: ATXN1; (-) strand; PAM type: NRG; PAM sequence: CAG
tcattgcctgctactcccta

SEQ ID NO: 90688 - DNA, 20 bp, Artificial Sequence
  Description of Artificial Sequence: Synthetic oligonucleotide
  Target: ATXN1; (-) strand; PAM type: NRG; PAM sequence: CAG
tagtgggaccaggaacatgt

SEQ ID NO: 90689 - DNA, 20 bp, Artificial Sequence
  Description of Artificial Sequence: Synthetic oligonucleotide
  Target: ATXN1; (-) strand; PAM type: NRG; PAM sequence: AGG
gtggcttttctagtgggacc

SEQ ID NO: 90690 - DNA, 20 bp, Artificial Sequence
  Description of Artificial Sequence: Synthetic oligonucleotide
  Target: ATXN1; (-) strand; PAM type: NRG; PAM sequence: CAG
ggtggcttttctagtgggac

SEQ ID NO: 90691 - DNA, 20 bp, Artificial Sequence
  Description of Artificial Sequence: Synthetic oligonucleotide
  Target: ATXN1; (-) strand; PAM type: NRG; PAM sequence: GGG
agaagggtggcttttctagt

SEQ ID NO: 90692 - DNA, 20 bp, Artificial Sequence
  Description of Artificial Sequence: Synthetic oligonucleotide
  Target: ATXN1; (-) strand; PAM type: NRG; PAM sequence: TGG
gagaagggtggcttttctag

SEQ ID NO: 90693 - DNA, 20 bp, Artificial Sequence
  Description of Artificial Sequence: Synthetic oligonucleotide
  Target: ATXN1; (-) strand; PAM type: NRG; PAM sequence: TAG
caggagaagggtggcttttc

SEQ ID NO: 90694 - DNA, 20 bp, Artificial Sequence
  Description of Artificial Sequence: Synthetic oligonucleotide
  Target: ATXN1; (-) strand; PAM type: NRG; PAM sequence: TGG
tgttcatctcaggagaaggg

SEQ ID NO: 90695 - DNA, 20 bp, Artificial Sequence
  Description of Artificial Sequence: Synthetic oligonucleotide
  Target: ATXN1; (-) strand; PAM type: NRG; PAM sequence: GGG
ctctgttcatctcaggagaa

SEQ ID NO: 90696 - DNA, 20 bp, Artificial Sequence
  Description of Artificial Sequence: Synthetic oligonucleotide
  Target: ATXN1; (-) strand; PAM type: NRG; PAM sequence: AGG
tctctgttcatctcaggaga

SEQ ID NO: 90697 - DNA, 20 bp, Artificial Sequence
  Description of Artificial Sequence: Synthetic oligonucleotide
  Target: ATXN1; (-) strand; PAM type: NRG; PAM sequence: AAG
ctctctgttcatctcaggag

SEQ ID NO: 90698 - DNA, 20 bp, Artificial Sequence
  Description of Artificial Sequence: Synthetic oligonucleotide
  Target: ATXN1; (-) strand; PAM type: NRG; PAM sequence: GAG
tgcctctctgttcatctcag

SEQ ID NO: 90699 - DNA, 20 bp, Artificial Sequence
  Description of Artificial Sequence: Synthetic oligonucleotide
  Target: ATXN1; (-) strand; PAM type: NRG; PAM sequence: AGG
cctgcctctctgttcatctc

SEQ ID NO: 90700 - DNA, 20 bp, Artificial Sequence
  Description of Artificial Sequence: Synthetic oligonucleotide
  Target: ATXN1; (-) strand; PAM type: NRG; PAM sequence: CAG
gcctgcctctctgttcatct

SEQ ID NO: 90701 - DNA, 20 bp, Artificial Sequence
  Description of Artificial Sequence: Synthetic oligonucleotide
  Target: ATXN1; (-) strand; PAM type: NRG; PAM sequence: TAG
taagtggcaccaagcaaaca

SEQ ID NO: 90702 - DNA, 20 bp, Artificial Sequence
  Description of Artificial Sequence: Synthetic oligonucleotide
  Target: ATXN1; (-) strand; PAM type: NRG; PAM sequence: AAG
gttgactgttaagtggcacc

SEQ ID NO: 90703 - DNA, 20 bp, Artificial Sequence
  Description of Artificial Sequence: Synthetic oligonucleotide
  Target: ATXN1; (-) strand; PAM type: NRG; PAM sequence: TGG
gggatgagttgactgttaag

SEQ ID NO: 90704 - DNA, 20 bp, Artificial Sequence
  Description of Artificial Sequence: Synthetic oligonucleotide
  Target: ATXN1; (-) strand; PAM type: NRG; PAM sequence: AAG
agtgggatgagttgactgtt

SEQ ID NO: 90705 - DNA, 20 bp, Artificial Sequence
  Description of Artificial Sequence: Synthetic oligonucleotide
  Target: ATXN1; (-) strand; PAM type: NRG; PAM sequence: GAG
tcggaacaagggagtgggat

SEQ ID NO: 90706 - DNA, 20 bp, Artificial Sequence
  Description of Artificial Sequence: Synthetic oligonucleotide
  Target: ATXN1; (-) strand; PAM type: NRG; PAM sequence: GGG
gggaatcggaacaagggagt

SEQ ID NO: 90707 - DNA, 20 bp, Artificial Sequence
  Description of Artificial Sequence: Synthetic oligonucleotide
  Target: ATXN1; (-) strand; PAM type: NRG; PAM sequence: TGG
agggaatcggaacaagggag

SEQ ID NO: 90708 - DNA, 20 bp, Artificial Sequence
  Description of Artificial Sequence: Synthetic oligonucleotide
  Target: ATXN1; (-) strand; PAM type: NRG; PAM sequence: GAG
agcagggaatcggaacaagg

SEQ ID NO: 90709 - DNA, 20 bp, Artificial Sequence
  Description of Artificial Sequence: Synthetic oligonucleotide
  Target: ATXN1; (-) strand; PAM type: NRG; PAM sequence: GGG
tgagcagggaatcggaacaa

SEQ ID NO: 90710 - DNA, 20 bp, Artificial Sequence
  Description of Artificial Sequence: Synthetic oligonucleotide
  Target: ATXN1; (-) strand; PAM type: NRG; PAM sequence: AGG
gtgagcagggaatcggaaca

SEQ ID NO: 90711 - DNA, 20 bp, Artificial Sequence
  Description of Artificial Sequence: Synthetic oligonucleotide
  Target: ATXN1; (-) strand; PAM type: NRG; PAM sequence: AAG
ggtgagcagggaatcggaac

SEQ ID NO: 90712 - DNA, 20 bp, Artificial Sequence
  Description of Artificial Sequence: Synthetic oligonucleotide
  Target: ATXN1; (-) strand; PAM type: NRG; PAM sequence: CGG
ttgcttggtgagcagggaat

SEQ ID NO: 90713 - DNA, 20 bp, Artificial Sequence
  Description of Artificial Sequence: Synthetic oligonucleotide
  Target: ATXN1; (-) strand; PAM type: NRG; PAM sequence: GGG
aggtgtttgcttggtgagca

SEQ ID NO: 90714 - DNA, 20 bp, Artificial Sequence
  Description of Artificial Sequence: Synthetic oligonucleotide
  Target: ATXN1; (-) strand; PAM type: NRG; PAM sequence: AGG
caggtgtttgcttggtgagc

SEQ ID NO: 90715 - DNA, 20 bp, Artificial Sequence
  Description of Artificial Sequence: Synthetic oligonucleotide
  Target: ATXN1; (-) strand; PAM type: NRG; PAM sequence: CAG
tcaggtgtttgcttggtgag

SEQ ID NO: 90716 - DNA, 20 bp, Artificial Sequence
  Description of Artificial Sequence: Synthetic oligonucleotide
  Target: ATXN1; (-) strand; PAM type: NRG; PAM sequence: GAG
gagtcaggtgtttgcttggt

SEQ ID NO: 90717 - DNA, 20 bp, Artificial Sequence
  Description of Artificial Sequence: Synthetic oligonucleotide
  Target: ATXN1; (-) strand; PAM type: NRG; PAM sequence: TGG
tatggagtcaggtgtttgct

SEQ ID NO: 90718 - DNA, 20 bp, Artificial Sequence
  Description of Artificial Sequence: Synthetic oligonucleotide
  Target: ATXN1; (-) strand; PAM type: NRG; PAM sequence: AGG
aggaagatccatatggagtc

SEQ ID NO: 90719 - DNA, 20 bp, Artificial Sequence
  Description of Artificial Sequence: Synthetic oligonucleotide
  Target: ATXN1; (-) strand; PAM type: NRG; PAM sequence: CAG
aaggaagatccatatggagt

SEQ ID NO: 90720 - DNA, 20 bp, Artificial Sequence
  Description of Artificial Sequence: Synthetic oligonucleotide
  Target: ATXN1; (-) strand; PAM type: NRG; PAM sequence: GAG
ctctaaggaagatccatatg

SEQ ID NO: 90721 - DNA, 20 bp, Artificial Sequence
  Description of Artificial Sequence: Synthetic oligonucleotide
  Target: ATXN1; (-) strand; PAM type: NRG; PAM sequence: TGG
ctctctaaggaagatccata

SEQ ID NO: 90722 - DNA, 20 bp, Artificial Sequence
  Description of Artificial Sequence: Synthetic oligonucleotide
  Target: ATXN1; (-) strand; PAM type: NRG; PAM sequence: AAG
agtgcacatgctctctaagg

SEQ ID NO: 90723 - DNA, 20 bp, Artificial Sequence
  Description of Artificial Sequence: Synthetic oligonucleotide
  Target: ATXN1; (-) strand; PAM type: NRG; PAM sequence: AGG
cacagtgcacatgctctcta

SEQ ID NO: 90724 - DNA, 20 bp, Artificial Sequence
  Description of Artificial Sequence: Synthetic oligonucleotide
  Target: ATXN1; (-) strand; PAM type: NRG; PAM sequence: AAG
tcacagtgcacatgctctct

SEQ ID NO: 90725 - DNA, 20 bp, Artificial Sequence
  Description of Artificial Sequence: Synthetic oligonucleotide
  Target: ATXN1; (-) strand; PAM type: NRG; PAM sequence: CAG
gcaggtatcagcagcagtca

SEQ ID NO: 90726 - DNA, 20 bp, Artificial Sequence
  Description of Artificial Sequence: Synthetic oligonucleotide
  Target: ATXN1; (-) strand; PAM type: NRG; PAM sequence: CAG
ctggctgcaggtatcagcag

SEQ ID NO: 90727 - DNA, 20 bp, Artificial Sequence
  Description of Artificial Sequence: Synthetic oligonucleotide
  Target: ATXN1; (-) strand; PAM type: NRG; PAM sequence: CAG
tctctggctgcaggtatcag

SEQ ID NO: 90728 - DNA, 20 bp, Artificial Sequence
  Description of Artificial Sequence: Synthetic oligonucleotide
  Target: ATXN1; (-) strand; PAM type: NRG; PAM sequence: CAG
tgctctctggctgcaggtat

SEQ ID NO: 90729 - DNA, 20 bp, Artificial Sequence
  Description of Artificial Sequence: Synthetic oligonucleotide
  Target: ATXN1; (-) strand; PAM type: NRG; PAM sequence: AGG
aattgctgctctctggctgc

SEQ ID NO: 90730 - DNA, 20 bp, Artificial Sequence
  Description of Artificial Sequence: Synthetic oligonucleotide
  Target: ATXN1; (-) strand; PAM type: NRG; PAM sequence: CAG
aaattgctgctctctggctg

SEQ ID NO: 90731 - DNA, 20 bp, Artificial Sequence
  Description of Artificial Sequence: Synthetic oligonucleotide
  Target: ATXN1; (-) strand; PAM type: NRG; PAM sequence: TGG
cttgagaaattgctgctctc

SEQ ID NO: 90732 - DNA, 20 bp, Artificial Sequence
  Description of Artificial Sequence: Synthetic oligonucleotide
  Target: ATXN1; (-) strand; PAM type: NRG; PAM sequence: GAG
ctactttattgatgtgcctt

SEQ ID NO: 90733 - DNA, 20 bp, Artificial Sequence
  Description of Artificial Sequence: Synthetic oligonucleotide
  Target: ATXN1; (-) strand; PAM type: NRG; PAM sequence: AAG
ggaatgtaaatcctaactgg

SEQ ID NO: 90734 - DNA, 20 bp, Artificial Sequence
  Description of Artificial Sequence: Synthetic oligonucleotide
  Target: ATXN1; (-) strand; PAM type: NRG; PAM sequence: TGG
atgggaatgtaaatcctaac

SEQ ID NO: 90735 - DNA, 20 bp, Artificial Sequence
  Description of Artificial Sequence: Synthetic oligonucleotide
  Target: ATXN1; (-) strand; PAM type: NRG; PAM sequence: GGG
ctctctgtgttaagctgcat

SEQ ID NO: 90736 - DNA, 20 bp, Artificial Sequence
  Description of Artificial Sequence: Synthetic oligonucleotide
  Target: ATXN1; (-) strand; PAM type: NRG; PAM sequence: TGG
tctctctgtgttaagctgca

SEQ ID NO: 90737 - DNA, 20 bp, Artificial Sequence
  Description of Artificial Sequence: Synthetic oligonucleotide
  Target: ATXN1; (-) strand; PAM type: NRG; PAM sequence: AAG
gcacattctctctctgtgtt

SEQ ID NO: 90738 - DNA, 20 bp, Artificial Sequence
  Description of Artificial Sequence: Synthetic oligonucleotide
  Target: ATXN1; (-) strand; PAM type: NRG; PAM sequence: GAG
actctcaaggcccacatgat

SEQ ID NO: 90739 - DNA, 20 bp, Artificial Sequence
  Description of Artificial Sequence: Synthetic oligonucleotide
  Target: ATXN1; (-) strand; PAM type: NRG; PAM sequence: AGG
ccattactaacatactctca

SEQ ID NO: 90740 - DNA, 20 bp, Artificial Sequence
  Description of Artificial Sequence: Synthetic oligonucleotide
  Target: ATXN1; (-) strand; PAM type: NRG; PAM sequence: AAG
accattactaacatactctc

SEQ ID NO: 90741 - DNA, 20 bp, Artificial Sequence
  Description of Artificial Sequence: Synthetic oligonucleotide
  Target: ATXN1; (-) strand; PAM type: NRG; PAM sequence: TGG
gccagaatgttaatccgcag

SEQ ID NO: 90742 - DNA, 20 bp, Artificial Sequence
  Description of Artificial Sequence: Synthetic oligonucleotide
  Target: ATXN1; (-) strand; PAM type: NRG; PAM sequence: CAG
tatgccagaatgttaatccg

SEQ ID NO: 90743 - DNA, 20 bp, Artificial Sequence
  Description of Artificial Sequence: Synthetic oligonucleotide
  Target: ATXN1; (-) strand; PAM type: NRG; PAM sequence: CAG
gacccacgagatcgttatgc

SEQ ID NO: 90744 - DNA, 20 bp, Artificial Sequence
  Description of Artificial Sequence: Synthetic oligonucleotide
  Target: ATXN1; (-) strand; PAM type: NRG; PAM sequence: GAG
cagcatatcctcagacccac

SEQ ID NO: 90745 - DNA, 20 bp, Artificial Sequence
  Description of Artificial Sequence: Synthetic oligonucleotide
  Target: ATXN1; (-) strand; PAM type: NRG; PAM sequence: CAG
ccatgatgccagcatatcct

SEQ ID NO: 90746 - DNA, 20 bp, Artificial Sequence
  Description of Artificial Sequence: Synthetic oligonucleotide
  Target: ATXN1; (-) strand; PAM type: NRG; PAM sequence: CAG
ctgagttgagaccatgatgc

SEQ ID NO: 90747 - DNA, 20 bp, Artificial Sequence
  Description of Artificial Sequence: Synthetic oligonucleotide
  Target: ATXN1; (-) strand; PAM type: NRG; PAM sequence: GAG
gccacagatgagcctgagtt

SEQ ID NO: 90748 - DNA, 20 bp, Artificial Sequence
  Description of Artificial Sequence: Synthetic oligonucleotide
  Target: ATXN1; (-) strand; PAM type: NRG; PAM sequence: GAG
gctatgccacagatgagcct

SEQ ID NO: 90749 - DNA, 20 bp, Artificial Sequence
  Description of Artificial Sequence: Synthetic oligonucleotide
  Target: ATXN1; (-) strand; PAM type: NRG; PAM sequence: GAG
cagagagctatgccacagat

SEQ ID NO: 90750 - DNA, 20 bp, Artificial Sequence
  Description of Artificial Sequence: Synthetic oligonucleotide
  Target: ATXN1; (-) strand; PAM type: NRG; PAM sequence: CAG
tgattcagagagctatgcca

SEQ ID NO: 90751 - DNA, 20 bp, Artificial Sequence
  Description of Artificial Sequence: Synthetic oligonucleotide
  Target: ATXN1; (-) strand; PAM type: NRG; PAM sequence: GAG
gcttgccatgctgattcaga

SEQ ID NO: 90752 - DNA, 20 bp, Artificial Sequence
  Description of Artificial Sequence: Synthetic oligonucleotide
  Target: ATXN1; (-) strand; PAM type: NRG; PAM sequence: GAG
gggcttgccatgctgattca

SEQ ID NO: 90753 - DNA, 20 bp, Artificial Sequence
  Description of Artificial Sequence: Synthetic oligonucleotide
  Target: ATXN1; (-) strand; PAM type: NRG; PAM sequence: CAG
cagggcttgccatgctgatt

SEQ ID NO: 90754 - DNA, 20 bp, Artificial Sequence
  Description of Artificial Sequence: Synthetic oligonucleotide
  Target: ATXN1; (-) strand; PAM type: NRG; PAM sequence: GGG
tggcttctggtctgtgtcca

SEQ ID NO: 90755 - DNA, 20 bp, Artificial Sequence
  Description of Artificial Sequence: Synthetic oligonucleotide
  Target: ATXN1; (-) strand; PAM type: NRG; PAM sequence: AGG
atggcttctggtctgtgtcc

SEQ ID NO: 90756 - DNA, 20 bp, Artificial Sequence
  Description of Artificial Sequence: Synthetic oligonucleotide
  Target: ATXN1; (-) strand; PAM type: NRG; PAM sequence: CAG
gatggcttctggtctgtgtc

SEQ ID NO: 90757 - DNA, 20 bp, Artificial Sequence
  Description of Artificial Sequence: Synthetic oligonucleotide
  Target: ATXN1; (-) strand; PAM type: NRG; PAM sequence: TGG
tggagactagagatggcttc

SEQ ID NO: 90758 - DNA, 20 bp, Artificial Sequence
  Description of Artificial Sequence: Synthetic oligonucleotide
  Target: ATXN1; (-) strand; PAM type: NRG; PAM sequence: TGG
ctgcttttggagactagaga

SEQ ID NO: 90759 - DNA, 20 bp, Artificial Sequence
  Description of Artificial Sequence: Synthetic oligonucleotide
  Target: ATXN1; (-) strand; PAM type: NRG; PAM sequence: GAG
gcccctgcttttggagacta

SEQ ID NO: 90760 - DNA, 20 bp, Artificial Sequence
  Description of Artificial Sequence: Synthetic oligonucleotide
  Target: ATXN1; (-) strand; PAM type: NRG; PAM sequence: TAG
ctgcccctgcttttggagac

SEQ ID NO: 90761 - DNA, 20 bp, Artificial Sequence
  Description of Artificial Sequence: Synthetic oligonucleotide
  Target: ATXN1; (-) strand; PAM type: NRG; PAM sequence: GAG
gccttctgcccctgcttttg

SEQ ID NO: 90762 - DNA, 20 bp, Artificial Sequence
  Description of Artificial Sequence: Synthetic oligonucleotide
  Target: ATXN1; (-) strand; PAM type: NRG; PAM sequence: TGG
ccgccttctgcccctgcttt

SEQ ID NO: 90763 - DNA, 20 bp, Artificial Sequence
  Description of Artificial Sequence: Synthetic oligonucleotide
  Target: ATXN1; (-) strand; PAM type: NRG; PAM sequence: TGG
tgctgtcagcgagggctggc

SEQ ID NO: 90764 - DNA, 20 bp, Artificial Sequence
  Description of Artificial Sequence: Synthetic oligonucleotide
  Target: ATXN1; (-) strand; PAM type: NRG; PAM sequence: TGG
gccatgctgtcagcgagggc

SEQ ID NO: 90765 - DNA, 20 bp, Artificial Sequence
  Description of Artificial Sequence: Synthetic oligonucleotide
  Target: ATXN1; (-) strand; PAM type: NRG; PAM sequence: GGG
gtaagccatgctgtcagcga

SEQ ID NO: 90766 - DNA, 20 bp, Artificial Sequence
  Description of Artificial Sequence: Synthetic oligonucleotide
  Target: ATXN1; (-) strand; PAM type: NRG; PAM sequence: AGG
tgtaagccatgctgtcagcg

SEQ ID NO: 90767 - DNA, 20 bp, Artificial Sequence
  Description of Artificial Sequence: Synthetic oligonucleotide
  Target: ATXN1; (-) strand; PAM type: NRG; PAM sequence: GAG
gtgtaagccatgctgtcagc

SEQ ID NO: 90768 - DNA, 20 bp, Artificial Sequence
  Description of Artificial Sequence: Synthetic oligonucleotide
  Target: ATXN1; (-) strand; PAM type: NRG; PAM sequence: CAG
tggcgtgtaagccatgctgt

SEQ ID NO: 90769 - DNA, 20 bp, Artificial Sequence
  Description of Artificial Sequence: Synthetic oligonucleotide
  Target: ATXN1; (-) strand; PAM type: NRG; PAM sequence: AAG
tagagccagaagtggcgtgt

SEQ ID NO: 90770 - DNA, 20 bp, Artificial Sequence
  Description of Artificial Sequence: Synthetic oligonucleotide
  Target: ATXN1; (-) strand; PAM type: NRG; PAM sequence: TGG
aaagtgagtagagccagaag

SEQ ID NO: 90771 - DNA, 20 bp, Artificial Sequence
  Description of Artificial Sequence: Synthetic oligonucleotide
  Target: ATXN1; (-) strand; PAM type: NRG; PAM sequence: AAG
ttgaaagtgagtagagccag

SEQ ID NO: 90772 - DNA, 20 bp, Artificial Sequence
  Description of Artificial Sequence: Synthetic oligonucleotide
  Target: ATXN1; (-) strand; PAM type: NRG; PAM sequence: CAG
cagttgaaagtgagtagagc

SEQ ID NO: 90773 - DNA, 20 bp, Artificial Sequence
  Description of Artificial Sequence: Synthetic oligonucleotide
  Target: ATXN1; (-) strand; PAM type: NRG; PAM sequence: GAG
aaatcagttgaaagtgagta

SEQ ID NO: 90774 - DNA, 20 bp, Artificial Sequence
  Description of Artificial Sequence: Synthetic oligonucleotide
  Target: ATXN1; (-) strand; PAM type: NRG; PAM sequence: TAG
gaaaatcagttgaaagtgag

SEQ ID NO: 90775 - DNA, 20 bp, Artificial Sequence
  Description of Artificial Sequence: Synthetic oligonucleotide
  Target: ATXN1; (-) strand; PAM type: NRG; PAM sequence: GAG
tgtgaaaatcagttgaaagt

SEQ ID NO: 90776 - DNA, 20 bp, Artificial Sequence
  Description of Artificial Sequence: Synthetic oligonucleotide
  Target: ATXN1; (-) strand; PAM type: NRG; PAM sequence: AAG
gctctgtgaaaatcagttga

SEQ ID NO: 90777 - DNA, 20 bp, Artificial Sequence
  Description of Artificial Sequence: Synthetic oligonucleotide
  Target: ATXN1; (-) strand; PAM type: NRG; PAM sequence: CAG
ctaaacagctctgtgaaaat

SEQ ID NO: 90778 - DNA, 20 bp, Artificial Sequence
  Description of Artificial Sequence: Synthetic oligonucleotide
  Target: ATXN1; (-) strand; PAM type: NRG; PAM sequence: CAG
tttggcttcatcatcctaaa

SEQ ID NO: 90779 - DNA, 20 bp, Artificial Sequence
  Description of Artificial Sequence: Synthetic oligonucleotide
  Target: ATXN1; (-) strand; PAM type: NRG; PAM sequence: TGG
tcctgaagcaccaggttctt

SEQ ID NO: 90780 - DNA, 20 bp, Artificial Sequence
  Description of Artificial Sequence: Synthetic oligonucleotide
  Target: ATXN1; (-) strand; PAM type: NRG; PAM sequence: AGG
aaactttgtcctgaagcacc

SEQ ID NO: 90781 - DNA, 20 bp, Artificial Sequence
  Description of Artificial Sequence: Synthetic oligonucleotide
  Target: ATXN1; (-) strand; PAM type: NRG; PAM sequence: CAG
gaaactttgtcctgaagcac

SEQ ID NO: 90782 - DNA, 20 bp, Artificial Sequence
  Description of Artificial Sequence: Synthetic oligonucleotide
  Target: ATXN1; (-) strand; PAM type: NRG; PAM sequence: AAG
caaacagaaactttgtcctg

SEQ ID NO: 90783 - DNA, 20 bp, Artificial Sequence
  Description of Artificial Sequence: Synthetic oligonucleotide
  Target: ATXN1; (-) strand; PAM type: NRG; PAM sequence: CAG
tacatgtatagggaagcaaa

SEQ ID NO: 90784 - DNA, 20 bp, Artificial Sequence
  Description of Artificial Sequence: Synthetic oligonucleotide
  Target: ATXN1; (-) strand; PAM type: NRG; PAM sequence: AAG
cattctatacatgtataggg

SEQ ID NO: 90785 - DNA, 20 bp, Artificial Sequence
  Description of Artificial Sequence: Synthetic oligonucleotide
  Target: ATXN1; (-) strand; PAM type: NRG; PAM sequence: GGG
ttccattctatacatgtata

SEQ ID NO: 90786 - DNA, 20 bp, Artificial Sequence
  Description of Artificial Sequence: Synthetic oligonucleotide
  Target: ATXN1; (-) strand; PAM type: NRG; PAM sequence: AGG
tttccattctatacatgtat

SEQ ID NO: 90787 - DNA, 20 bp, Artificial Sequence
  Description of Artificial Sequence: Synthetic oligonucleotide
  Target: ATXN1; (-) strand; PAM type: NRG; PAM sequence: TAG
gtttccattctatacatgta

SEQ ID NO: 90788 - DNA, 20 bp, Artificial Sequence
  Description of Artificial Sequence: Synthetic oligonucleotide
  Target: ATXN1; (-) strand; PAM type: NRG; PAM sequence: CAG
cacttaattaaatcttgtgc

SEQ ID NO: 90789 - DNA, 20 bp, Artificial Sequence
  Description of Artificial Sequence: Synthetic oligonucleotide
  Target: ATXN1; (-) strand; PAM type: NRG; PAM sequence: TGG
tgctcttatttactttcctc

SEQ ID NO: 90790 - DNA, 20 bp, Artificial Sequence
  Description of Artificial Sequence: Synthetic oligonucleotide
  Target: ATXN1; (-) strand; PAM type: NRG; PAM sequence: TGG
taattggtactgtggatatt

SEQ ID NO: 90791 - DNA, 20 bp, Artificial Sequence
  Description of Artificial Sequence: Synthetic oligonucleotide
  Target: ATXN1; (-) strand; PAM type: NRG; PAM sequence: TGG
ccagtcactaattggtactg

SEQ ID NO: 90792 - DNA, 20 bp, Artificial Sequence
  Description of Artificial Sequence: Synthetic oligonucleotide
  Target: ATXN1; (-) strand; PAM type: NRG; PAM sequence: TGG
caactctgccagtcactaat

SEQ ID NO: 90793 - DNA, 20 bp, Artificial Sequence
  Description of Artificial Sequence: Synthetic oligonucleotide
  Target: ATXN1; (-) strand; PAM type: NRG; PAM sequence: CAG
ttgttgtgtggcaactctgc

SEQ ID NO: 90794 - DNA, 20 bp, Artificial Sequence
  Description of Artificial Sequence: Synthetic oligonucleotide
  Target: ATXN1; (-) strand; PAM type: NRG; PAM sequence: TGG
gttcattgcaccttgttgtg

SEQ ID NO: 90795 - DNA, 20 bp, Artificial Sequence
  Description of Artificial Sequence: Synthetic oligonucleotide
  Target: ATXN1; (-) strand; PAM type: NRG; PAM sequence: AAG
actatgatttagatttttta

SEQ ID NO: 90796 - DNA, 20 bp, Artificial Sequence
  Description of Artificial Sequence: Synthetic oligonucleotide
  Target: ATXN1; (-) strand; PAM type: NRG; PAM sequence: TAG
attgacccttcactatgatt

SEQ ID NO: 90797 - DNA, 20 bp, Artificial Sequence
  Description of Artificial Sequence: Synthetic oligonucleotide
  Target: ATXN1; (-) strand; PAM type: NRG; PAM sequence: GGG
caaaagagctggcattttct

SEQ ID NO: 90798 - DNA, 20 bp, Artificial Sequence
  Description of Artificial Sequence: Synthetic oligonucleotide
  Target: ATXN1; (-) strand; PAM type: NRG; PAM sequence: TGG
gcaaaagagctggcattttc

SEQ ID NO: 90799 - DNA, 20 bp, Artificial Sequence
  Description of Artificial Sequence: Synthetic oligonucleotide
  Target: ATXN1; (-) strand; PAM type: NRG; PAM sequence: TGG
gcttaatagggcaaaagagc

SEQ ID NO: 90800 - DNA, 20 bp, Artificial Sequence
  Description of Artificial Sequence: Synthetic oligonucleotide
  Target: ATXN1; (-) strand; PAM type: NRG; PAM sequence: GAG
ttctgcttaatagggcaaaa

SEQ ID NO: 90801 - DNA, 20 bp, Artificial Sequence
  Description of Artificial Sequence: Synthetic oligonucleotide
  Target: ATXN1; (-) strand; PAM type: NRG; PAM sequence: AAG
ttttctgcttaatagggcaa

SEQ ID NO: 90802 - DNA, 20 bp, Artificial Sequence
  Description of Artificial Sequence: Synthetic oligonucleotide
  Target: ATXN1; (-) strand; PAM type: NRG; PAM sequence: GGG
cctttgttttctgcttaata

SEQ ID NO: 90803 - DNA, 20 bp, Artificial Sequence
  Description of Artificial Sequence: Synthetic oligonucleotide
  Target: ATXN1; (-) strand; PAM type: NRG; PAM sequence: AGG
gcctttgttttctgcttaat

SEQ ID NO: 90804 - DNA, 20 bp, Artificial Sequence
  Description of Artificial Sequence: Synthetic oligonucleotide
  Target: ATXN1; (-) strand; PAM type: NRG; PAM sequence: TAG
agcctttgttttctgcttaa

SEQ ID NO: 90805 - DNA, 20 bp, Artificial Sequence
  Description of Artificial Sequence: Synthetic oligonucleotide
  Target: ATXN1; (-) strand; PAM type: NRG; PAM sequence: GAG
ttttctaacttctatacact

SEQ ID NO: 90806 - DNA, 20 bp, Artificial Sequence
  Description of Artificial Sequence: Synthetic oligonucleotide
  Target: ATXN1; (-) strand; PAM type: NRG; PAM sequence: AAG
tgtcatatttttgtggctaa

SEQ ID NO: 90807 - DNA, 20 bp, Artificial Sequence
  Description of Artificial Sequence: Synthetic oligonucleotide
  Target: ATXN1; (-) strand; PAM type: NRG; PAM sequence: TGG
aattcactgtcatatttttg

SEQ ID NO: 90808 - DNA, 20 bp, Artificial Sequence
  Description of Artificial Sequence: Synthetic oligonucleotide
  Target: ATXN1; (-) strand; PAM type: NRG; PAM sequence: AGG
gccccatgcatattattaag

SEQ ID NO: 90809 - DNA, 20 bp, Artificial Sequence
  Description of Artificial Sequence: Synthetic oligonucleotide
  Target: ATXN1; (-) strand; PAM type: NRG; PAM sequence: GAG
tgccccatgcatattattaa

SEQ ID NO: 90810 - DNA, 20 bp, Artificial Sequence
  Description of Artificial Sequence: Synthetic oligonucleotide
  Target: ATXN1; (-) strand; PAM type: NRG; PAM sequence: AAG
tttgccccatgcatattatt

SEQ ID NO: 90811 - DNA, 20 bp, Artificial Sequence
  Description of Artificial Sequence: Synthetic oligonucleotide
  Target: ATXN1; (-) strand; PAM type: NRG; PAM sequence: TGG
acaggcactgaccttctttc

SEQ ID NO: 90812 - DNA, 20 bp, Artificial Sequence
  Description of Artificial Sequence: Synthetic oligonucleotide
  Target: ATXN1; (-) strand; PAM type: NRG; PAM sequence: AGG
tggcaagatttaggcaaaac

SEQ ID NO: 90813 - DNA, 20 bp, Artificial Sequence
  Description of Artificial Sequence: Synthetic oligonucleotide
  Target: ATXN1; (-) strand; PAM type: NRG; PAM sequence: CAG
ctggcaagatttaggcaaaa

SEQ ID NO: 90814 - DNA, 20 bp, Artificial Sequence
  Description of Artificial Sequence: Synthetic oligonucleotide
  Target: ATXN1; (-) strand; PAM type: NRG; PAM sequence: AGG
tgcatatcctggcaagattt

SEQ ID NO: 90815 - DNA, 20 bp, Artificial Sequence
  Description of Artificial Sequence: Synthetic oligonucleotide
  Target: ATXN1; (-) strand; PAM type: NRG; PAM sequence: TAG
ttgcatatcctggcaagatt

SEQ ID NO: 90816 - DNA, 20 bp, Artificial Sequence
  Description of Artificial Sequence: Synthetic oligonucleotide
  Target: ATXN1; (-) strand; PAM type: NRG; PAM sequence: AAG
ttggccttgcatatcctggc

SEQ ID NO: 90817 - DNA, 20 bp, Artificial Sequence
  Description of Artificial Sequence: Synthetic oligonucleotide
  Target: ATXN1; (-) strand; PAM type: NRG; PAM sequence: TGG
gcatttggccttgcatatcc

SEQ ID NO: 90818 - DNA, 20 bp, Artificial Sequence
  Description of Artificial Sequence: Synthetic oligonucleotide
  Target: ATXN1; (-) strand; PAM type: NRG; PAM sequence: TGG
ttccttggtttgggggcatt

SEQ ID NO: 90819 - DNA, 20 bp, Artificial Sequence
  Description of Artificial Sequence: Synthetic oligonucleotide
  Target: ATXN1; (-) strand; PAM type: NRG; PAM sequence: GGG
gttttccttccttggtttgg

SEQ ID NO: 90820 - DNA, 20 bp, Artificial Sequence
  Description of Artificial Sequence: Synthetic oligonucleotide
  Target: ATXN1; (-) strand; PAM type: NRG; PAM sequence: GGG
tgttttccttccttggtttg

SEQ ID NO: 90821 - DNA, 20 bp, Artificial Sequence
  Description of Artificial Sequence: Synthetic oligonucleotide
  Target: ATXN1; (-) strand; PAM type: NRG; PAM sequence: GGG
ttgttttccttccttggttt

SEQ ID NO: 90822 - DNA, 20 bp, Artificial Sequence
  Description of Artificial Sequence: Synthetic oligonucleotide
  Target: ATXN1; (-) strand; PAM type: NRG; PAM sequence: TGG
tttgttttccttccttggtt

SEQ ID NO: 90823 - DNA, 20 bp, Artificial Sequence
  Description of Artificial Sequence: Synthetic oligonucleotide
  Target: ATXN1; (-) strand; PAM type: NRG; PAM sequence: TGG
ttagttttgttttccttcct

SEQ ID NO: 90824 - DNA, 20 bp, Artificial Sequence
  Description of Artificial Sequence: Synthetic oligonucleotide
  Target: ATXN1; (-) strand; PAM type: NRG; PAM sequence: TAG
cattcttgctccgttgcagt

SEQ ID NO: 90825 - DNA, 20 bp, Artificial Sequence
  Description of Artificial Sequence: Synthetic oligonucleotide
  Target: ATXN1; (-) strand; PAM type: NRG; PAM sequence: CAG
tttgcattcttgctccgttg

SEQ ID NO: 90826 - DNA, 20 bp, Artificial Sequence
  Description of Artificial Sequence: Synthetic oligonucleotide
  Target: ATXN1; (-) strand; PAM type: NRG; PAM sequence: AGG
gtcacagttaacaggaaagg

SEQ ID NO: 90827 - DNA, 20 bp, Artificial Sequence
  Description of Artificial Sequence: Synthetic oligonucleotide
  Target: ATXN1; (-) strand; PAM type: NRG; PAM sequence: GAG
tgtcacagttaacaggaaag

SEQ ID NO: 90828 - DNA, 20 bp, Artificial Sequence
  Description of Artificial Sequence: Synthetic oligonucleotide
  Target: ATXN1; (-) strand; PAM type: NRG; PAM sequence: AGG
tatgtcacagttaacaggaa

SEQ ID NO: 90829 - DNA, 20 bp, Artificial Sequence
  Description of Artificial Sequence: Synthetic oligonucleotide
  Target: ATXN1; (-) strand; PAM type: NRG; PAM sequence: AAG
ttatgtcacagttaacagga

SEQ ID NO: 90830 - DNA, 20 bp, Artificial Sequence
  Description of Artificial Sequence: Synthetic oligonucleotide
  Target: ATXN1; (-) strand; PAM type: NRG; PAM sequence: AGG
tgaattatgtcacagttaac

SEQ ID NO: 90831 - DNA, 20 bp, Artificial Sequence
  Description of Artificial Sequence: Synthetic oligonucleotide
  Target: ATXN1; (-) strand; PAM type: NRG; PAM sequence: CAG
atgaattatgtcacagttaa

SEQ ID NO: 90832 - DNA, 20 bp, Artificial Sequence
  Description of Artificial Sequence: Synthetic oligonucleotide
  Target: ATXN1; (-) strand; PAM type: NRG; PAM sequence: CAG
gagaaaaatgaattatgtca

SEQ ID NO: 90833 - DNA, 20 bp, Artificial Sequence
  Description of Artificial Sequence: Synthetic oligonucleotide
  Target: ATXN1; (-) strand; PAM type: NRG; PAM sequence: GAG
tagaagttctggaacagaag

SEQ ID NO: 90834 - DNA, 20 bp, Artificial Sequence
  Description of Artificial Sequence: Synthetic oligonucleotide
  Target: ATXN1; (-) strand; PAM type: NRG; PAM sequence: AGG
gttagaagttctggaacaga

SEQ ID NO: 90835 - DNA, 20 bp, Artificial Sequence
  Description of Artificial Sequence: Synthetic oligonucleotide
  Target: ATXN1; (-) strand; PAM type: NRG; PAM sequence: AAG
ggttagaagttctggaacag

SEQ ID NO: 90836 - DNA, 20 bp, Artificial Sequence
  Description of Artificial Sequence: Synthetic oligonucleotide
  Target: ATXN1; (-) strand; PAM type: NRG; PAM sequence: CAG
ataggttagaagttctggaa

SEQ ID NO: 90837 - DNA, 20 bp, Artificial Sequence
  Description of Artificial Sequence: Synthetic oligonucleotide
  Target: ATXN1; (-) strand; PAM type: NRG; PAM sequence: TGG
gacctataggttagaagttc

SEQ ID NO: 90838 - DNA, 20 bp, Artificial Sequence
  Description of Artificial Sequence: Synthetic oligonucleotide
  Target: ATXN1; (-) strand; PAM type: NRG; PAM sequence: AAG
aagcatgacctataggttag

SEQ ID NO: 90839 - DNA, 20 bp, Artificial Sequence
  Description of Artificial Sequence: Synthetic oligonucleotide
  Target: ATXN1; (-) strand; PAM type: NRG; PAM sequence: TAG
tataagcatgacctataggt

SEQ ID NO: 90840 - DNA, 20 bp, Artificial Sequence
  Description of Artificial Sequence: Synthetic oligonucleotide
  Target: ATXN1; (-) strand; PAM type: NRG; PAM sequence: AGG
tgggtataagcatgacctat

SEQ ID NO: 90841 - DNA, 20 bp, Artificial Sequence
  Description of Artificial Sequence: Synthetic oligonucleotide
  Target: ATXN1; (-) strand; PAM type: NRG; PAM sequence: TAG
gtgggtataagcatgaccta

SEQ ID NO: 90842 - DNA, 20 bp, Artificial Sequence
  Description of Artificial Sequence: Synthetic oligonucleotide
  Target: ATXN1; (-) strand; PAM type: NRG; PAM sequence: AAG
cttggttcttctgtgggtat

SEQ ID NO: 90843 - DNA, 20 bp, Artificial Sequence
  Description of Artificial Sequence: Synthetic oligonucleotide
  Target: ATXN1; (-) strand; PAM type: NRG; PAM sequence: GGG
tactcccttggttcttctgt

SEQ ID NO: 90844 - DNA, 20 bp, Artificial Sequence
  Description of Artificial Sequence: Synthetic oligonucleotide
  Target: ATXN1; (-) strand; PAM type: NRG; PAM sequence: TGG
ttactcccttggttcttctg

SEQ ID NO: 90845 - DNA, 20 bp, Artificial Sequence
  Description of Artificial Sequence: Synthetic oligonucleotide
  Target: ATXN1; (-) strand; PAM type: NRG; PAM sequence: TGG
cagcagcttccttactccct

SEQ ID NO: 90846 - DNA, 20 bp, Artificial Sequence
  Description of Artificial Sequence: Synthetic oligonucleotide
  Target: ATXN1; (-) strand; PAM type: NRG; PAM sequence: CAG
gcattttctttggaaaccag

SEQ ID NO: 90847 - DNA, 20 bp, Artificial Sequence
  Description of Artificial Sequence: Synthetic oligonucleotide
  Target: ATXN1; (-) strand; PAM type: NRG; PAM sequence: CAG
taagcattttctttggaaac

SEQ ID NO: 90848 - DNA, 20 bp, Artificial Sequence
  Description of Artificial Sequence: Synthetic oligonucleotide
  Target: ATXN1; (-) strand; PAM type: NRG; PAM sequence: TGG
tgggaagtaagcattttctt

SEQ ID NO: 90849 - DNA, 20 bp, Artificial Sequence
  Description of Artificial Sequence: Synthetic oligonucleotide
  Target: ATXN1; (-) strand; PAM type: NRG; PAM sequence: AAG
acgctttgcaaatgggaagt

SEQ ID NO: 90850 - DNA, 20 bp, Artificial Sequence
  Description of Artificial Sequence: Synthetic oligonucleotide
  Target: ATXN1; (-) strand; PAM type: NRG; PAM sequence: AAG
cgaaacgctttgcaaatggg

SEQ ID NO: 90851 - DNA, 20 bp, Artificial Sequence
  Description of Artificial Sequence: Synthetic oligonucleotide
  Target: ATXN1; (-) strand; PAM type: NRG; PAM sequence: GGG
cagcgaaacgctttgcaaat

SEQ ID NO: 90852 - DNA, 20 bp, Artificial Sequence
  Description of Artificial Sequence: Synthetic oligonucleotide
  Target: ATXN1; (-) strand; PAM type: NRG; PAM sequence: TGG
ccagcgaaacgctttgcaaa

SEQ ID NO: 90853 - DNA, 20 bp, Artificial Sequence
  Description of Artificial Sequence: Synthetic oligonucleotide
  Target: ATXN1; (-) strand; PAM type: NRG; PAM sequence: CAG
gtaactcaacacagcatttc

SEQ ID NO: 90854 - DNA, 20 bp, Artificial Sequence
  Description of Artificial Sequence: Synthetic oligonucleotide
  Target: ATXN1; (-) strand; PAM type: NRG; PAM sequence: CAG
ttggatggtgtaactcaaca

SEQ ID NO: 90855 - DNA, 20 bp, Artificial Sequence
  Description of Artificial Sequence: Synthetic oligonucleotide
  Target: ATXN1; (-) strand; PAM type: NRG; PAM sequence: TGG
atatttaattcctagttgga

SEQ ID NO: 90856 - DNA, 20 bp, Artificial Sequence
  Description of Artificial Sequence: Synthetic oligonucleotide
  Target: ATXN1; (-) strand; PAM type: NRG; PAM sequence: TGG
taatatatttaattcctagt

SEQ ID NO: 90857 - DNA, 20 bp, Artificial Sequence
  Description of Artificial Sequence: Synthetic oligonucleotide
  Target: ATXN1; (-) strand; PAM type: NRG; PAM sequence: TAG
agcataatatatttaattcc

SEQ ID NO: 90858 - DNA, 20 bp, Artificial Sequence
  Description of Artificial Sequence: Synthetic oligonucleotide
  Target: ATXN1; (-) strand; PAM type: NRG; PAM sequence: GAG
cattttgataatttaccaaa

SEQ ID NO: 90859 - DNA, 20 bp, Artificial Sequence
  Description of Artificial Sequence: Synthetic oligonucleotide
  Target: ATXN1; (-) strand; PAM type: NRG; PAM sequence: AAG
tacattttgataatttacca

SEQ ID NO: 90860 - DNA, 20 bp, Artificial Sequence
  Description of Artificial Sequence: Synthetic oligonucleotide
  Target: ATXN1; (-) strand; PAM type: NRG; PAM sequence: TGG
atggtctccactgtagctgt

SEQ ID NO: 90861 - DNA, 20 bp, Artificial Sequence
  Description of Artificial Sequence: Synthetic oligonucleotide
  Target: ATXN1; (-) strand; PAM type: NRG; PAM sequence: TAG
agttcagatggtctccactg

SEQ ID NO: 90862 - DNA, 20 bp, Artificial Sequence
  Description of Artificial Sequence: Synthetic oligonucleotide
  Target: ATXN1; (-) strand; PAM type: NRG; PAM sequence: TGG
aaaactcttggcagttcaga

SEQ ID NO: 90863 - DNA, 20 bp, Artificial Sequence
  Description of Artificial Sequence: Synthetic oligonucleotide
  Target: ATXN1; (-) strand; PAM type: NRG; PAM sequence: CAG
tgttaaaactcttggcagtt

SEQ ID NO: 90864 - DNA, 20 bp, Artificial Sequence
  Description of Artificial Sequence: Synthetic oligonucleotide
  Target: ATXN1; (-) strand; PAM type: NRG; PAM sequence: CAG
cacagtgttaaaactcttgg

SEQ ID NO: 90865 - DNA, 20 bp, Artificial Sequence
  Description of Artificial Sequence: Synthetic oligonucleotide
  Target: ATXN1; (-) strand; PAM type: NRG; PAM sequence: TGG
aatcacagtgttaaaactct

SEQ ID NO: 90866 - DNA, 20 bp, Artificial Sequence
  Description of Artificial Sequence: Synthetic oligonucleotide
  Target: ATXN1; (-) strand; PAM type: NRG; PAM sequence: CAG
gttctttctcactaaaatca

SEQ ID NO: 90867 - DNA, 20 bp, Artificial Sequence
  Description of Artificial Sequence: Synthetic oligonucleotide
  Target: ATXN1; (-) strand; PAM type: NRG; PAM sequence: GGG
agctgaaaactaaacagcag

SEQ ID NO: 90868 - DNA, 20 bp, Artificial Sequence
  Description of Artificial Sequence: Synthetic oligonucleotide
  Target: ATXN1; (-) strand; PAM type: NRG; PAM sequence: GGG
tagctgaaaactaaacagca

SEQ ID NO: 90869 - DNA, 20 bp, Artificial Sequence
  Description of Artificial Sequence: Synthetic oligonucleotide
  Target: ATXN1; (-) strand; PAM type: NRG; PAM sequence: AGG
ttagctgaaaactaaacagc

SEQ ID NO: 90870 - DNA, 20 bp, Artificial Sequence
  Description of Artificial Sequence: Synthetic oligonucleotide
  Target: ATXN1; (-) strand; PAM type: NRG; PAM sequence: CAG
cttagctgaaaactaaacag

SEQ ID NO: 90871 - DNA, 20 bp, Artificial Sequence
  Description of Artificial Sequence: Synthetic oligonucleotide
  Target: ATXN1; (-) strand; PAM type: NRG; PAM sequence: CAG
gaacttagctgaaaactaaa

SEQ ID NO: 90872 - DNA, 20 bp, Artificial Sequence
  Description of Artificial Sequence: Synthetic oligonucleotide
  Target: ATXN1; (-) strand; PAM type: NRG; PAM sequence: TAG
ctaaacagctaggctgaact

SEQ ID NO: 90873 - DNA, 20 bp, Artificial Sequence
  Description of Artificial Sequence: Synthetic oligonucleotide
  Target: ATXN1; (-) strand; PAM type: NRG; PAM sequence: AGG
tagctgaaaactaaacagct

SEQ ID NO: 90874 - DNA, 20 bp, Artificial Sequence
  Description of Artificial Sequence: Synthetic oligonucleotide
  Target: ATXN1; (-) strand; PAM type: NRG; PAM sequence: TAG
ctagctgaaaactaaacagc

SEQ ID NO: 90875 - DNA, 20 bp, Artificial Sequence
  Description of Artificial Sequence: Synthetic oligonucleotide
  Target: ATXN1; (-) strand; PAM type: NRG; PAM sequence: CAG
gaagctagctgaaaactaaa

SEQ ID NO: 90876 - DNA, 20 bp, Artificial Sequence
  Description of Artificial Sequence: Synthetic oligonucleotide
  Target: ATXN1; (-) strand; PAM type: NRG; PAM sequence: TAG
tgcacagctttgtatgaagc

SEQ ID NO: 90877 - DNA, 20 bp, Artificial Sequence
  Description of Artificial Sequence: Synthetic oligonucleotide
  Target: ATXN1; (-) strand; PAM type: NRG; PAM sequence: AAG
acaatgcacagctttgtatg

SEQ ID NO: 90878 - DNA, 20 bp, Artificial Sequence
  Description of Artificial Sequence: Synthetic oligonucleotide
  Target: ATXN1; (-) strand; PAM type: NRG; PAM sequence: CAG
acatctgtgcgtacaatgca

SEQ ID NO: 90879 - DNA, 20 bp, Artificial Sequence
  Description of Artificial Sequence: Synthetic oligonucleotide
  Target: ATXN1; (-) strand; PAM type: NRG; PAM sequence: TGG
aacctatgaacaaaagtgtg

SEQ ID NO: 90880 - DNA, 20 bp, Artificial Sequence
  Description of Artificial Sequence: Synthetic oligonucleotide
  Target: ATXN1; (-) strand; PAM type: NRG; PAM sequence: AAG
cagtaaaaacctatgaacaa

SEQ ID NO: 90881 - DNA, 20 bp, Artificial Sequence
  Description of Artificial Sequence: Synthetic oligonucleotide
  Target: ATXN1; (-) strand; PAM type: NRG; PAM sequence: CAG
gaatcctatgtgaaaattcc

SEQ ID NO: 90882 - DNA, 20 bp, Artificial Sequence
  Description of Artificial Sequence: Synthetic oligonucleotide
  Target: ATXN1; (-) strand; PAM type: NRG; PAM sequence: CAG
tagaaaaacttaggaaatga

SEQ ID NO: 90883 - DNA, 20 bp, Artificial Sequence
  Description of Artificial Sequence: Synthetic oligonucleotide
  Target: ATXN1; (-) strand; PAM type: NRG; PAM sequence: AGG
tatggtgggtagaaaaactt

SEQ ID NO: 90884 - DNA, 20 bp, Artificial Sequence
  Description of Artificial Sequence: Synthetic oligonucleotide
  Target: ATXN1; (-) strand; PAM type: NRG; PAM sequence: TAG
ttatggtgggtagaaaaact

SEQ ID NO: 90885 - DNA, 20 bp, Artificial Sequence
  Description of Artificial Sequence: Synthetic oligonucleotide
  Target: ATXN1; (-) strand; PAM type: NRG; PAM sequence: TAG
acttcccaaattatggtggg

SEQ ID NO: 90886 - DNA, 20 bp, Artificial Sequence
  Description of Artificial Sequence: Synthetic oligonucleotide
  Target: ATXN1; (-) strand; PAM type: NRG; PAM sequence: GGG
gccacttcccaaattatggt

SEQ ID NO: 90887 - DNA, 20 bp, Artificial Sequence
  Description of Artificial Sequence: Synthetic oligonucleotide
  Target: ATXN1; (-) strand; PAM type: NRG; PAM sequence: TGG
agccacttcccaaattatgg

SEQ ID NO: 90888 - DNA, 20 bp, Artificial Sequence
  Description of Artificial Sequence: Synthetic oligonucleotide
  Target: ATXN1; (-) strand; PAM type: NRG; PAM sequence: TGG
caaagccacttcccaaatta

SEQ ID NO: 90889 - DNA, 20 bp, Artificial Sequence
  Description of Artificial Sequence: Synthetic oligonucleotide
  Target: ATXN1; (-) strand; PAM type: NRG; PAM sequence: AAG
gtctagtagtcagagaaaca

SEQ ID NO: 90890 - DNA, 20 bp, Artificial Sequence
  Description of Artificial Sequence: Synthetic oligonucleotide
  Target: ATXN1; (-) strand; PAM type: NRG; PAM sequence: GAG
cccaggaagtctagtagtca

SEQ ID NO: 90891 - DNA, 20 bp, Artificial Sequence
  Description of Artificial Sequence: Synthetic oligonucleotide
  Target: ATXN1; (-) strand; PAM type: NRG; PAM sequence: CAG
tccccaggaagtctagtagt

SEQ ID NO: 90892 - DNA, 20 bp, Artificial Sequence
  Description of Artificial Sequence: Synthetic oligonucleotide
  Target: ATXN1; (-) strand; PAM type: NRG; PAM sequence: TAG
agagtccccaggaagtctag

SEQ ID NO: 90893 - DNA, 20 bp, Artificial Sequence
  Description of Artificial Sequence: Synthetic oligonucleotide
  Target: ATXN1; (-) strand; PAM type: NRG; PAM sequence: TAG
gacagagtccccaggaagtc

SEQ ID NO: 90894 - DNA, 20 bp, Artificial Sequence
  Description of Artificial Sequence: Synthetic oligonucleotide
  Target: ATXN1; (-) strand; PAM type: NRG; PAM sequence: AAG
ataaagacagagtccccagg

SEQ ID NO: 90895 - DNA, 20 bp, Artificial Sequence
  Description of Artificial Sequence: Synthetic oligonucleotide
  Target: ATXN1; (-) strand; PAM type: NRG; PAM sequence: AGG
gaaataaagacagagtcccc

SEQ ID NO: 90896 - DNA, 20 bp, Artificial Sequence
  Description of Artificial Sequence: Synthetic oligonucleotide
  Target: ATXN1; (-) strand; PAM type: NRG; PAM sequence: CAG
ggaaataaagacagagtccc

SEQ ID NO: 90897 - DNA, 20 bp, Artificial Sequence
  Description of Artificial Sequence: Synthetic oligonucleotide
  Target: ATXN1; (-) strand; PAM type: NRG; PAM sequence: GAG
gtccccgggaaataaagaca

SEQ ID NO: 90898 - DNA, 20 bp, Artificial Sequence
  Description of Artificial Sequence: Synthetic oligonucleotide
  Target: ATXN1; (-) strand; PAM type: NRG; PAM sequence: CAG
gagtccccgggaaataaaga

SEQ ID NO: 90899 - DNA, 20 bp, Artificial Sequence
  Description of Artificial Sequence: Synthetic oligonucleotide
  Target: ATXN1; (-) strand; PAM type: NRG; PAM sequence: AAG
gacagagtccccgggaaata

SEQ ID NO: 90900 - DNA, 20 bp, Artificial Sequence
  Description of Artificial Sequence: Synthetic oligonucleotide
  Target: ATXN1; (-) strand; PAM type: NRG; PAM sequence: GGG
gaaataaagacagagtcccc

SEQ ID NO: 90901 - DNA, 20 bp, Artificial Sequence
  Description of Artificial Sequence: Synthetic oligonucleotide
  Target: ATXN1; (-) strand; PAM type: NRG; PAM sequence: CGG
ggaaataaagacagagtccc

SEQ ID NO: 90902 - DNA, 20 bp, Artificial Sequence
  Description of Artificial Sequence: Synthetic oligonucleotide
  Target: ATXN1; (-) strand; PAM type: NRG; PAM sequence: GAG
tgttatgggaaataaagaca

SEQ ID NO: 90903 - DNA, 20 bp, Artificial Sequence
  Description of Artificial Sequence: Synthetic oligonucleotide
  Target: ATXN1; (-) strand; PAM type: NRG; PAM sequence: CAG
aatgttatgggaaataaaga

SEQ ID NO: 90904 - DNA, 20 bp, Artificial Sequence
  Description of Artificial Sequence: Synthetic oligonucleotide
  Target: ATXN1; (-) strand; PAM type: NRG; PAM sequence: AAG
tgcaaatgttatgggaaata

SEQ ID NO: 90905 - DNA, 20 bp, Artificial Sequence
  Description of Artificial Sequence: Synthetic oligonucleotide
  Target: ATXN1; (-) strand; PAM type: NRG; PAM sequence: GGG
tggcactctgcaaatgttat

SEQ ID NO: 90906 - DNA, 20 bp, Artificial Sequence
  Description of Artificial Sequence: Synthetic oligonucleotide
  Target: ATXN1; (-) strand; PAM type: NRG; PAM sequence: TGG
atggcactctgcaaatgtta

SEQ ID NO: 90907 - DNA, 20 bp, Artificial Sequence
  Description of Artificial Sequence: Synthetic oligonucleotide
  Target: ATXN1; (-) strand; PAM type: NRG; PAM sequence: TGG
ttaagtgctcattgtgtgca

SEQ ID NO: 90908 - DNA, 20 bp, Artificial Sequence
  Description of Artificial Sequence: Synthetic oligonucleotide
  Target: ATXN1; (-) strand; PAM type: NRG; PAM sequence: AAG
tcattcaacaaatgtttatt

SEQ ID NO: 90909 - DNA, 20 bp, Artificial Sequence
  Description of Artificial Sequence: Synthetic oligonucleotide
  Target: ATXN1; (-) strand; PAM type: NRG; PAM sequence: GAG
ttaattgcgttgatattgtg

SEQ ID NO: 90910 - DNA, 20 bp, Artificial Sequence
  Description of Artificial Sequence: Synthetic oligonucleotide
  Target: ATXN1; (-) strand; PAM type: NRG; PAM sequence: TGG
tcttaattgcgttgatattg

SEQ ID NO: 90911 - DNA, 20 bp, Artificial Sequence
  Description of Artificial Sequence: Synthetic oligonucleotide
  Target: ATXN1; (-) strand; PAM type: NRG; PAM sequence: CAG
cataaattcacgtgaaaggc

SEQ ID NO: 90912 - DNA, 20 bp, Artificial Sequence
  Description of Artificial Sequence: Synthetic oligonucleotide
  Target: ATXN1; (-) strand; PAM type: NRG; PAM sequence: AGG
gtatcataaattcacgtgaa

SEQ ID NO: 90913 - DNA, 20 bp, Artificial Sequence
  Description of Artificial Sequence: Synthetic oligonucleotide
  Target: ATXN1; (-) strand; PAM type: NRG; PAM sequence: AAG
tgtatcataaattcacgtga

SEQ ID NO: 90914 - DNA, 20 bp, Artificial Sequence
  Description of Artificial Sequence: Synthetic oligonucleotide
  Target: ATXN1; (-) strand; PAM type: NRG; PAM sequence: GAG
taagaagacagaggactaaa

SEQ ID NO: 90915 - DNA, 20 bp, Artificial Sequence
  Description of Artificial Sequence: Synthetic oligonucleotide
  Target: ATXN1; (-) strand; PAM type: NRG; PAM sequence: AAG
tataagaagacagaggacta

SEQ ID NO: 90916 - DNA, 20 bp, Artificial Sequence
  Description of Artificial Sequence: Synthetic oligonucleotide
  Target: ATXN1; (-) strand; PAM type: NRG; PAM sequence: AGG
ttttctatataagaagacag

SEQ ID NO: 90917 - DNA, 20 bp, Artificial Sequence
  Description of Artificial Sequence: Synthetic oligonucleotide
  Target: ATXN1; (-) strand; PAM type: NRG; PAM sequence: GAG
gttttctatataagaagaca

SEQ ID NO: 90918 - DNA, 20 bp, Artificial Sequence
  Description of Artificial Sequence: Synthetic oligonucleotide
  Target: ATXN1; (-) strand; PAM type: NRG; PAM sequence: CAG
tagttttctatataagaaga

SEQ ID NO: 90919 - DNA, 20 bp, Artificial Sequence
  Description of Artificial Sequence: Synthetic oligonucleotide
  Target: ATXN1; (-) strand; PAM type: NRG; PAM sequence: AAG
tgaatagttttctatataag

SEQ ID NO: 90920 - DNA, 20 bp, Artificial Sequence
  Description of Artificial Sequence: Synthetic oligonucleotide
  Target: ATXN1; (-) strand; PAM type: NRG; PAM sequence: AAG
tactgaatagttttctatat

SEQ ID NO: 90921 - DNA, 20 bp, Artificial Sequence
  Description of Artificial Sequence: Synthetic oligonucleotide
  Target: ATXN1; (-) strand; PAM type: NRG; PAM sequence: TAG
tttgatgtagaaatactgaa

SEQ ID NO: 90922 - DNA, 20 bp, Artificial Sequence
  Description of Artificial Sequence: Synthetic oligonucleotide
  Target: ATXN1; (-) strand; PAM type: NRG; PAM sequence: TAG
tccctggagaatttttgatg

SEQ ID NO: 90923 - DNA, 20 bp, Artificial Sequence
  Description of Artificial Sequence: Synthetic oligonucleotide
  Target: ATXN1; (-) strand; PAM type: NRG; PAM sequence: GAG
tgtatgtttatccttccctg

SEQ ID NO: 90924 - DNA, 20 bp, Artificial Sequence
  Description of Artificial Sequence: Synthetic oligonucleotide
  Target: ATXN1; (-) strand; PAM type: NRG; PAM sequence: TGG
aatgtatgtttatccttccc

SEQ ID NO: 90925 - DNA, 20 bp, Artificial Sequence
  Description of Artificial Sequence: Synthetic oligonucleotide
  Target: ATXN1; (-) strand; PAM type: NRG; PAM sequence: GGG
tctttcttcctgtgctttgg

SEQ ID NO: 90926 - DNA, 20 bp, Artificial Sequence
  Description of Artificial Sequence: Synthetic oligonucleotide
  Target: ATXN1; (-) strand; PAM type: NRG; PAM sequence: GGG
ctctttcttcctgtgctttg

SEQ ID NO: 90927 - DNA, 20 bp, Artificial Sequence
  Description of Artificial Sequence: Synthetic oligonucleotide
  Target: ATXN1; (-) strand; PAM type: NRG; PAM sequence: GGG
gctctttcttcctgtgcttt

SEQ ID NO: 90928 - DNA, 20 bp, Artificial Sequence
  Description of Artificial Sequence: Synthetic oligonucleotide
  Target: ATXN1; (-) strand; PAM type: NRG; PAM sequence: TGG
tgctctttcttcctgtgctt

SEQ ID NO: 90929 - DNA, 20 bp, Artificial Sequence
  Description of Artificial Sequence: Synthetic oligonucleotide
  Target: ATXN1; (-) strand; PAM type: NRG; PAM sequence: AAG
caatttgcacaaatgaaata

SEQ ID NO: 90930 - DNA, 20 bp, Artificial Sequence
  Description of Artificial Sequence: Synthetic oligonucleotide
  Target: ATXN1; (-) strand; PAM type: NRG; PAM sequence: AGG
ctgtttagcatgaattcaaa

SEQ ID NO: 90931 - DNA, 20 bp, Artificial Sequence
  Description of Artificial Sequence: Synthetic oligonucleotide
  Target: ATXN1; (-) strand; PAM type: NRG; PAM sequence: AAG
gctgtttagcatgaattcaa

SEQ ID NO: 90932 - DNA, 20 bp, Artificial Sequence
  Description of Artificial Sequence: Synthetic oligonucleotide
  Target: ATXN1; (-) strand; PAM type: NRG; PAM sequence: TAG
gcttgcgacatttagctgtt

SEQ ID NO: 90933 - DNA, 20 bp, Artificial Sequence
  Description of Artificial Sequence: Synthetic oligonucleotide
  Target: ATXN1; (-) strand; PAM type: NRG; PAM sequence: TAG
agcatgctgcttgcgacatt

SEQ ID NO: 90934 - DNA, 20 bp, Artificial Sequence
  Description of Artificial Sequence: Synthetic oligonucleotide
  Target: ATXN1; (-) strand; PAM type: NRG; PAM sequence: CAG
tttcacttgacagtttttga

SEQ ID NO: 90935 - DNA, 20 bp, Artificial Sequence
  Description of Artificial Sequence: Synthetic oligonucleotide
  Target: ATXN1; (-) strand; PAM type: NRG; PAM sequence: CAG
tcaataattatttcacttga

SEQ ID NO: 90936 - DNA, 20 bp, Artificial Sequence
  Description of Artificial Sequence: Synthetic oligonucleotide
  Target: ATXN1; (-) strand; PAM type: NRG; PAM sequence: AAG
agatgacatgctttttctta

SEQ ID NO: 90937 - DNA, 20 bp, Artificial Sequence
  Description of Artificial Sequence: Synthetic oligonucleotide
  Target: ATXN1; (-) strand; PAM type: NRG; PAM sequence: TAG
ctgtcgggtttttctagttg

SEQ ID NO: 90938 - DNA, 20 bp, Artificial Sequence
  Description of Artificial Sequence: Synthetic oligonucleotide
  Target: ATXN1; (-) strand; PAM type: NRG; PAM sequence: TAG
gattcgctgtcgggtttttc

SEQ ID NO: 90939 - DNA, 20 bp, Artificial Sequence
  Description of Artificial Sequence: Synthetic oligonucleotide
  Target: ATXN1; (-) strand; PAM type: NRG; PAM sequence: GGG
tgactggcagattcgctgtc

SEQ ID NO: 90940 - DNA, 20 bp, Artificial Sequence
  Description of Artificial Sequence: Synthetic oligonucleotide
  Target: ATXN1; (-) strand; PAM type: NRG; PAM sequence: CGG
ctgactggcagattcgctgt

SEQ ID NO: 90941 - DNA, 20 bp, Artificial Sequence
  Description of Artificial Sequence: Synthetic oligonucleotide
  Target: ATXN1; (-) strand; PAM type: NRG; PAM sequence: CAG
agccctatagccctgactgg

SEQ ID NO: 90942 - DNA, 20 bp, Artificial Sequence
  Description of Artificial Sequence: Synthetic oligonucleotide
  Target: ATXN1; (-) strand; PAM type: NRG; PAM sequence: TGG
ctaagccctatagccctgac

SEQ ID NO: 90943 - DNA, 20 bp, Artificial Sequence
  Description of Artificial Sequence: Synthetic oligonucleotide
  Target: ATXN1; (-) strand; PAM type: NRG; PAM sequence: TAG
atctttcattctaagcccta

SEQ ID NO: 90944 - DNA, 20 bp, Artificial Sequence
  Description of Artificial Sequence: Synthetic oligonucleotide
  Target: ATXN1; (-) strand; PAM type: NRG; PAM sequence: AAG
cctctttaatctttcattct

SEQ ID NO: 90945 - DNA, 20 bp, Artificial Sequence
  Description of Artificial Sequence: Synthetic oligonucleotide
  Target: ATXN1; (-) strand; PAM type: NRG; PAM sequence: TGG
ttgtcacaaaggccattgtg

SEQ ID NO: 90946 - DNA, 20 bp, Artificial Sequence
  Description of Artificial Sequence: Synthetic oligonucleotide
  Target: ATXN1; (-) strand; PAM type: NRG; PAM sequence: AGG
gctgtcatgggttgtcacaa

SEQ ID NO: 90947 - DNA, 20 bp, Artificial Sequence
  Description of Artificial Sequence: Synthetic oligonucleotide
  Target: ATXN1; (-) strand; PAM type: NRG; PAM sequence: AAG
agctgtcatgggttgtcaca

SEQ ID NO: 90948 - DNA, 20 bp, Artificial Sequence
  Description of Artificial Sequence: Synthetic oligonucleotide
  Target: ATXN1; (-) strand; PAM type: NRG; PAM sequence: GGG
gagcctatctcagctgtcat

SEQ ID NO: 90949 - DNA, 20 bp, Artificial Sequence
  Description of Artificial Sequence: Synthetic oligonucleotide
  Target: ATXN1; (-) strand; PAM type: NRG; PAM sequence: TGG
agagcctatctcagctgtca

SEQ ID NO: 90950 - DNA, 20 bp, Artificial Sequence
  Description of Artificial Sequence: Synthetic oligonucleotide
  Target: ATXN1; (-) strand; PAM type: NRG; PAM sequence: CAG
accatccggagagcctatct

SEQ ID NO: 90951 - DNA, 20 bp, Artificial Sequence
  Description of Artificial Sequence: Synthetic oligonucleotide
  Target: ATXN1; (-) strand; PAM type: NRG; PAM sequence: GAG
gtgggatgtgaccatccgga

SEQ ID NO: 90952 - DNA, 20 bp, Artificial Sequence
  Description of Artificial Sequence: Synthetic oligonucleotide
  Target: ATXN1; (-) strand; PAM type: NRG; PAM sequence: GAG
aggtgggatgtgaccatccg

SEQ ID NO: 90953 - DNA, 20 bp, Artificial Sequence
  Description of Artificial Sequence: Synthetic oligonucleotide
  Target: ATXN1; (-) strand; PAM type: NRG; PAM sequence: CGG
acaggtgggatgtgaccatc

SEQ ID NO: 90954 - DNA, 20 bp, Artificial Sequence
  Description of Artificial Sequence: Synthetic oligonucleotide
  Target: ATXN1; (-) strand; PAM type: NRG; PAM sequence: GGG
ctggaaaaggaaggacaggt

SEQ ID NO: 90955 - DNA, 20 bp, Artificial Sequence
  Description of Artificial Sequence: Synthetic oligonucleotide
  Target: ATXN1; (-) strand; PAM type: NRG; PAM sequence: TGG
gctggaaaaggaaggacagg

SEQ ID NO: 90956 - DNA, 20 bp, Artificial Sequence
  Description of Artificial Sequence: Synthetic oligonucleotide
  Target: ATXN1; (-) strand; PAM type: NRG; PAM sequence: AGG
ggggctggaaaaggaaggac

SEQ ID NO: 90957 - DNA, 20 bp, Artificial Sequence
  Description of Artificial Sequence: Synthetic oligonucleotide
  Target: ATXN1; (-) strand; PAM type: NRG; PAM sequence: CAG
aggggctggaaaaggaagga

SEQ ID NO: 90958 - DNA, 20 bp, Artificial Sequence
  Description of Artificial Sequence: Synthetic oligonucleotide
  Target: ATXN1; (-) strand; PAM type: NRG; PAM sequence: AGG
tgtcaggggctggaaaagga

SEQ ID NO: 90959 - DNA, 20 bp, Artificial Sequence
  Description of Artificial Sequence: Synthetic oligonucleotide
  Target: ATXN1; (-) strand; PAM type: NRG; PAM sequence: AAG
atgtcaggggctggaaaagg

SEQ ID NO: 90960 - DNA, 20 bp, Artificial Sequence
  Description of Artificial Sequence: Synthetic oligonucleotide
  Target: ATXN1; (-) strand; PAM type: NRG; PAM sequence: AGG
tttatgtcaggggctggaaa

SEQ ID NO: 90961 - DNA, 20 bp, Artificial Sequence
  Description of Artificial Sequence: Synthetic oligonucleotide
  Target: ATXN1; (-) strand; PAM type: NRG; PAM sequence: AAG
atttatgtcaggggctggaa

SEQ ID NO: 90962 - DNA, 20 bp, Artificial Sequence
  Description of Artificial Sequence: Synthetic oligonucleotide
  Target: ATXN1; (-) strand; PAM type: NRG; PAM sequence: TGG
atgacatttatgtcaggggc

SEQ ID NO: 90963 - DNA, 20 bp, Artificial Sequence
  Description of Artificial Sequence: Synthetic oligonucleotide
  Target: ATXN1; (-) strand; PAM type: NRG; PAM sequence: GGG
atccatgacatttatgtcag

SEQ ID NO: 90964 - DNA, 20 bp, Artificial Sequence
  Description of Artificial Sequence: Synthetic oligonucleotide
  Target: ATXN1; (-) strand; PAM type: NRG; PAM sequence: GGG
aatccatgacatttatgtca

SEQ ID NO: 90965 - DNA, 20 bp, Artificial Sequence
  Description of Artificial Sequence: Synthetic oligonucleotide
  Target: ATXN1; (-) strand; PAM type: NRG; PAM sequence: AGG
aaatccatgacatttatgtc

SEQ ID NO: 90966 - DNA, 20 bp, Artificial Sequence
  Description of Artificial Sequence: Synthetic oligonucleotide
  Target: ATXN1; (-) strand; PAM type: NRG; PAM sequence: CAG
gaaatccatgacatttatgt

SEQ ID NO: 90967 - DNA, 20 bp, Artificial Sequence
  Description of Artificial Sequence: Synthetic oligonucleotide
  Target: ATXN1; (-) strand; PAM type: NRG; PAM sequence: GGG
attggatttaggacccaccc

SEQ ID NO: 90968 - DNA, 20 bp, Artificial Sequence
  Description of Artificial Sequence: Synthetic oligonucleotide
  Target: ATXN1; (-) strand; PAM type: NRG; PAM sequence: CGG
cattggatttaggacccacc

SEQ ID NO: 90969 - DNA, 20 bp, Artificial Sequence
  Description of Artificial Sequence: Synthetic oligonucleotide
  Target: ATXN1; (-) strand; PAM type: NRG; PAM sequence: AGG
gaacagtggtcattggattt

SEQ ID NO: 90970 - DNA, 20 bp, Artificial Sequence
  Description of Artificial Sequence: Synthetic oligonucleotide
  Target: ATXN1; (-) strand; PAM type: NRG; PAM sequence: TAG
agaacagtggtcattggatt

SEQ ID NO: 90971 - DNA, 20 bp, Artificial Sequence
  Description of Artificial Sequence: Synthetic oligonucleotide
  Target: ATXN1; (-) strand; PAM type: NRG; PAM sequence: TGG
cttagaagaacagtggtcat

SEQ ID NO: 90972 - DNA, 20 bp, Artificial Sequence
  Description of Artificial Sequence: Synthetic oligonucleotide
  Target: ATXN1; (-) strand; PAM type: NRG; PAM sequence: TGG
cctgtctcttagaagaacag

SEQ ID NO: 90973 - DNA, 20 bp, Artificial Sequence
  Description of Artificial Sequence: Synthetic oligonucleotide
  Target: ATXN1; (-) strand; PAM type: NRG; PAM sequence: CAG
tctcctgtctcttagaagaa

SEQ ID NO: 90974 - DNA, 20 bp, Artificial Sequence
  Description of Artificial Sequence: Synthetic oligonucleotide
  Target: ATXN1; (-) strand; PAM type: NRG; PAM sequence: AAG
ggtcctctcctgtctcttag

SEQ ID NO: 90975 - DNA, 20 bp, Artificial Sequence
  Description of Artificial Sequence: Synthetic oligonucleotide
  Target: ATXN1; (-) strand; PAM type: NRG; PAM sequence: TAG
ccaggtcctctcctgtctct

SEQ ID NO: 90976 - DNA, 20 bp, Artificial Sequence
  Description of Artificial Sequence: Synthetic oligonucleotide
  Target: ATXN1; (-) strand; PAM type: NRG; PAM sequence: AGG
ttctcctctgtgtctgtacc

SEQ ID NO: 90977 - DNA, 20 bp, Artificial Sequence
  Description of Artificial Sequence: Synthetic oligonucleotide
  Target: ATXN1; (-) strand; PAM type: NRG; PAM sequence: CAG
cttctcctctgtgtctgtac

SEQ ID NO: 90978 - DNA, 20 bp, Artificial Sequence
  Description of Artificial Sequence: Synthetic oligonucleotide
  Target: ATXN1; (-) strand; PAM type: NRG; PAM sequence: TGG
tctctgcctctgttttcaca

SEQ ID NO: 90979 - DNA, 20 bp, Artificial Sequence
  Description of Artificial Sequence: Synthetic oligonucleotide
  Target: ATXN1; (-) strand; PAM type: NRG; PAM sequence: CAG
ggcttgtggcagcgtcactc

SEQ ID NO: 90980 - DNA, 20 bp, Artificial Sequence
  Description of Artificial Sequence: Synthetic oligonucleotide
  Target: ATXN1; (-) strand; PAM type: NRG; PAM sequence: CAG
aggcgttccttggcttgtgg

SEQ ID NO: 90981 - DNA, 20 bp, Artificial Sequence
  Description of Artificial Sequence: Synthetic oligonucleotide
  Target: ATXN1; (-) strand; PAM type: NRG; PAM sequence: TGG
tccaggcgttccttggcttg

SEQ ID NO: 90982 - DNA, 20 bp, Artificial Sequence
  Description of Artificial Sequence: Synthetic oligonucleotide
  Target: ATXN1; (-) strand; PAM type: NRG; PAM sequence: TGG
tggtggttccaggcgttcct

SEQ ID NO: 90983 - DNA, 20 bp, Artificial Sequence
  Description of Artificial Sequence: Synthetic oligonucleotide
  Target: ATXN1; (-) strand; PAM type: NRG; PAM sequence: AGG
tgtcatcctctggtggttcc

SEQ ID NO: 90984 - DNA, 20 bp, Artificial Sequence
  Description of Artificial Sequence: Synthetic oligonucleotide
  Target: ATXN1; (-) strand; PAM type: NRG; PAM sequence: CAG
ctgtcatcctctggtggttc

SEQ ID NO: 90985 - DNA, 20 bp, Artificial Sequence
  Description of Artificial Sequence: Synthetic oligonucleotide
  Target: ATXN1; (-) strand; PAM type: NRG; PAM sequence: TGG
ttgccgctgtcatcctctgg

SEQ ID NO: 90986 - DNA, 20 bp, Artificial Sequence
  Description of Artificial Sequence: Synthetic oligonucleotide
  Target: ATXN1; (-) strand; PAM type: NRG; PAM sequence: TGG
tccttgccgctgtcatcctc

SEQ ID NO: 90987 - DNA, 20 bp, Artificial Sequence
  Description of Artificial Sequence: Synthetic oligonucleotide
  Target: ATXN1; (-) strand; PAM type: NRG; PAM sequence: GAG
ccctcccgaagctctgttgg

SEQ ID NO: 90988 - DNA, 20 bp, Artificial Sequence
  Description of Artificial Sequence: Synthetic oligonucleotide
  Target: ATXN1; (-) strand; PAM type: NRG; PAM sequence: GGG
ctccctcccgaagctctgtt

SEQ ID NO: 90989 - DNA, 20 bp, Artificial Sequence
  Description of Artificial Sequence: Synthetic oligonucleotide
  Target: ATXN1; (-) strand; PAM type: NRG; PAM sequence: TGG
actccctcccgaagctctgt

SEQ ID NO: 90990 - DNA, 20 bp, Artificial Sequence
  Description of Artificial Sequence: Synthetic oligonucleotide
  Target: ATXN1; (-) strand; PAM type: NRG; PAM sequence: AAG
ccgggccacactccctcccg

SEQ ID NO: 90991 - DNA, 20 bp, Artificial Sequence
  Description of Artificial Sequence: Synthetic oligonucleotide
  Target: ATXN1; (-) strand; PAM type: NRG; PAM sequence: GGG
tctgaaatcaggtgtcagcc

SEQ ID NO: 90992 - DNA, 20 bp, Artificial Sequence
  Description of Artificial Sequence: Synthetic oligonucleotide
  Target: ATXN1; (-) strand; PAM type: NRG; PAM sequence: CGG
gtctgaaatcaggtgtcagc

SEQ ID NO: 90993 - DNA, 20 bp, Artificial Sequence
  Description of Artificial Sequence: Synthetic oligonucleotide
  Target: ATXN1; (-) strand; PAM type: NRG; PAM sequence: CAG
agacgtctgaaatcaggtgt

SEQ ID NO: 90994 - DNA, 20 bp, Artificial Sequence
  Description of Artificial Sequence: Synthetic oligonucleotide
  Target: ATXN1; (-) strand; PAM type: NRG; PAM sequence: AGG
gagggcagacgtctgaaatc

SEQ ID NO: 90995 - DNA, 20 bp, Artificial Sequence
  Description of Artificial Sequence: Synthetic oligonucleotide
  Target: ATXN1; (-) strand; PAM type: NRG; PAM sequence: CAG
ggagggcagacgtctgaaat

SEQ ID NO: 90996 - DNA, 20 bp, Artificial Sequence
  Description of Artificial Sequence: Synthetic oligonucleotide
  Target: ATXN1; (-) strand; PAM type: NRG; PAM sequence: CAG
tctctcaaagttctggaggg

SEQ ID NO: 90997 - DNA, 20 bp, Artificial Sequence
  Description of Artificial Sequence: Synthetic oligonucleotide
  Target: ATXN1; (-) strand; PAM type: NRG; PAM sequence: GGG
tgttctctcaaagttctgga

SEQ ID NO: 90998 - DNA, 20 bp, Artificial Sequence
  Description of Artificial Sequence: Synthetic oligonucleotide
  Target: ATXN1; (-) strand; PAM type: NRG; PAM sequence: AGG
ttgttctctcaaagttctgg

SEQ ID NO: 90999 - DNA, 20 bp, Artificial Sequence
  Description of Artificial Sequence: Synthetic oligonucleotide
  Target: ATXN1; (-) strand; PAM type: NRG; PAM sequence: GAG
tttgttctctcaaagttctg

SEQ ID NO: 91000 - DNA, 20 bp, Artificial Sequence
  Description of Artificial Sequence: Synthetic oligonucleotide
  Target: ATXN1; (-) strand; PAM type: NRG; PAM sequence: TGG
aatttgttctctcaaagttc

SEQ ID NO: 91001 - DNA, 20 bp, Artificial Sequence
  Description of Artificial Sequence: Synthetic oligonucleotide
  Target: ATXN1; (-) strand; PAM type: NRG; PAM sequence: AAG
aacaggaatttgttctctca

SEQ ID NO: 91002 - DNA, 20 bp, Artificial Sequence
  Description of Artificial Sequence: Synthetic oligonucleotide
  Target: ATXN1; (-) strand; PAM type: NRG; PAM sequence: AGG
acttggtgggttaaaacaac

SEQ ID NO: 91003 - DNA, 20 bp, Artificial Sequence
  Description of Artificial Sequence: Synthetic oligonucleotide
  Target: ATXN1; (-) strand; PAM type: NRG; PAM sequence: CAG
aacttggtgggttaaaacaa

SEQ ID NO: 91004 - DNA, 20 bp, Artificial Sequence
  Description of Artificial Sequence: Synthetic oligonucleotide
  Target: ATXN1; (-) strand; PAM type: NRG; PAM sequence: GGG
taaattaccagaaacttggt

SEQ ID NO: 91005 - DNA, 20 bp, Artificial Sequence
  Description of Artificial Sequence: Synthetic oligonucleotide
  Target: ATXN1; (-) strand; PAM type: NRG; PAM sequence: TGG
ataaattaccagaaacttgg

SEQ ID NO: 91006 - DNA, 20 bp, Artificial Sequence
  Description of Artificial Sequence: Synthetic oligonucleotide
  Target: ATXN1; (-) strand; PAM type: NRG; PAM sequence: TGG
ctaataaattaccagaaact

SEQ ID NO: 91007 - DNA, 20 bp, Artificial Sequence
  Description of Artificial Sequence: Synthetic oligonucleotide
  Target: ATXN1; (-) strand; PAM type: NRG; PAM sequence: CAG
gggctgctctaataaattac

SEQ ID NO: 91008 - DNA, 20 bp, Artificial Sequence
  Description of Artificial Sequence: Synthetic oligonucleotide
  Target: ATXN1; (-) strand; PAM type: NRG; PAM sequence: GGG
gaaactctgttagttttcca

SEQ ID NO: 91009 - DNA, 20 bp, Artificial Sequence
  Description of Artificial Sequence: Synthetic oligonucleotide
  Target: ATXN1; (-) strand; PAM type: NRG; PAM sequence: AGG
ggaaactctgttagttttcc

SEQ ID NO: 91010 - DNA, 20 bp, Artificial Sequence
  Description of Artificial Sequence: Synthetic oligonucleotide
  Target: ATXN1; (-) strand; PAM type: NRG; PAM sequence: CAG
gggaaactctgttagttttc

SEQ ID NO: 91011 - DNA, 20 bp, Artificial Sequence
  Description of Artificial Sequence: Synthetic oligonucleotide
  Target: ATXN1; (-) strand; PAM type: NRG; PAM sequence: TAG
aatgtgatgggaaactctgt

SEQ ID NO: 91012 - DNA, 20 bp, Artificial Sequence
  Description of Artificial Sequence: Synthetic oligonucleotide
  Target: ATXN1; (-) strand; PAM type: NRG; PAM sequence: GGG
gattttacgctaaatgtgat

SEQ ID NO: 91013 - DNA, 20 bp, Artificial Sequence
  Description of Artificial Sequence: Synthetic oligonucleotide
  Target: ATXN1; (-) strand; PAM type: NRG; PAM sequence: TGG
ggattttacgctaaatgtga

SEQ ID NO: 91014 - DNA, 20 bp, Artificial Sequence
  Description of Artificial Sequence: Synthetic oligonucleotide
  Target: ATXN1; (-) strand; PAM type: NRG; PAM sequence: TGG
atctagaggctgcaggagct

SEQ ID NO: 91015 - DNA, 20 bp, Artificial Sequence
  Description of Artificial Sequence: Synthetic oligonucleotide
  Target: ATXN1; (-) strand; PAM type: NRG; PAM sequence: GAG
aattgatctagaggctgcag

SEQ ID NO: 91016 - DNA, 20 bp, Artificial Sequence
  Description of Artificial Sequence: Synthetic oligonucleotide
  Target: ATXN1; (-) strand; PAM type: NRG; PAM sequence: AGG
tgaattgatctagaggctgc

SEQ ID NO: 91017 - DNA, 20 bp, Artificial Sequence
  Description of Artificial Sequence: Synthetic oligonucleotide
  Target: ATXN1; (-) strand; PAM type: NRG; PAM sequence: CAG
ttgaattgatctagaggctg

SEQ ID NO: 91018 - DNA, 20 bp, Artificial Sequence
  Description of Artificial Sequence: Synthetic oligonucleotide
  Target: ATXN1; (-) strand; PAM type: NRG; PAM sequence: AGG
gagcctttgaattgatctag

SEQ ID NO: 91019 - DNA, 20 bp, Artificial Sequence
  Description of Artificial Sequence: Synthetic oligonucleotide
  Target: ATXN1; (-) strand; PAM type: NRG; PAM sequence: GAG
ggagcctttgaattgatcta

SEQ ID NO: 91020 - DNA, 20 bp, Artificial Sequence
  Description of Artificial Sequence: Synthetic oligonucleotide
  Target: ATXN1; (-) strand; PAM type: NRG; PAM sequence: TAG
aaggagcctttgaattgatc

SEQ ID NO: 91021 - DNA, 20 bp, Artificial Sequence
  Description of Artificial Sequence: Synthetic oligonucleotide
  Target: ATXN1; (-) strand; PAM type: NRG; PAM sequence: GAG
gaaggctctgaggccagaag

SEQ ID NO: 91022 - DNA, 20 bp, Artificial Sequence
  Description of Artificial Sequence: Synthetic oligonucleotide
  Target: ATXN1; (-) strand; PAM type: NRG; PAM sequence: AGG
gtgaaggctctgaggccaga

SEQ ID NO: 91023 - DNA, 20 bp, Artificial Sequence
  Description of Artificial Sequence: Synthetic oligonucleotide
  Target: ATXN1; (-) strand; PAM type: NRG; PAM sequence: AAG
ggtgaaggctctgaggccag

SEQ ID NO: 91024 - DNA, 20 bp, Artificial Sequence
  Description of Artificial Sequence: Synthetic oligonucleotide
  Target: ATXN1; (-) strand; PAM type: NRG; PAM sequence: CAG
ccaggtgaaggctctgaggc

SEQ ID NO: 91025 - DNA, 20 bp, Artificial Sequence
  Description of Artificial Sequence: Synthetic oligonucleotide
  Target: ATXN1; (-) strand; PAM type: NRG; PAM sequence: AGG
atggccaggtgaaggctctg

SEQ ID NO: 91026 - DNA, 20 bp, Artificial Sequence
  Description of Artificial Sequence: Synthetic oligonucleotide
  Target: ATXN1; (-) strand; PAM type: NRG; PAM sequence: GAG
aatggccaggtgaaggctct

SEQ ID NO: 91027 - DNA, 20 bp, Artificial Sequence
  Description of Artificial Sequence: Synthetic oligonucleotide
  Target: ATXN1; (-) strand; PAM type: NRG; PAM sequence: AGG
ggaagagaatggccaggtga

SEQ ID NO: 91028 - DNA, 20 bp, Artificial Sequence
  Description of Artificial Sequence: Synthetic oligonucleotide
  Target: ATXN1; (-) strand; PAM type: NRG; PAM sequence: AAG
aggaagagaatggccaggtg

SEQ ID NO: 91029 - DNA, 20 bp, Artificial Sequence
  Description of Artificial Sequence: Synthetic oligonucleotide
  Target: ATXN1; (-) strand; PAM type: NRG; PAM sequence: AGG
tgtaaaggaagagaatggcc

SEQ ID NO: 91030 - DNA, 20 bp, Artificial Sequence
  Description of Artificial Sequence: Synthetic oligonucleotide
  Target: ATXN1; (-) strand; PAM type: NRG; PAM sequence: CAG
ctgtaaaggaagagaatggc

SEQ ID NO: 91031 - DNA, 20 bp, Artificial Sequence
  Description of Artificial Sequence: Synthetic oligonucleotide
  Target: ATXN1; (-) strand; PAM type: NRG; PAM sequence: TGG
agcactgtaaaggaagagaa

SEQ ID NO: 91032 - DNA, 20 bp, Artificial Sequence
  Description of Artificial Sequence: Synthetic oligonucleotide
  Target: ATXN1; (-) strand; PAM type: NRG; PAM sequence: GAG
ggatgagcactgtaaaggaa

SEQ ID NO: 91033 - DNA, 20 bp, Artificial Sequence
  Description of Artificial Sequence: Synthetic oligonucleotide
  Target: ATXN1; (-) strand; PAM type: NRG; PAM sequence: AAG
gaggatgagcactgtaaagg

SEQ ID NO: 91034 - DNA, 20 bp, Artificial Sequence
  Description of Artificial Sequence: Synthetic oligonucleotide
  Target: ATXN1; (-) strand; PAM type: NRG; PAM sequence: AGG
tctgaggatgagcactgtaa

SEQ ID NO: 91035 - DNA, 20 bp, Artificial Sequence
  Description of Artificial Sequence: Synthetic oligonucleotide
  Target: ATXN1; (-) strand; PAM type: NRG; PAM sequence: AAG
atctgaggatgagcactgta

SEQ ID NO: 91036 - DNA, 20 bp, Artificial Sequence
  Description of Artificial Sequence: Synthetic oligonucleotide
  Target: ATXN1; (-) strand; PAM type: NRG; PAM sequence: GAG
tgagatgagaatctgaggat

SEQ ID NO: 91037 - DNA, 20 bp, Artificial Sequence
  Description of Artificial Sequence: Synthetic oligonucleotide
  Target: ATXN1; (-) strand; PAM type: NRG; PAM sequence: AGG
aagggtgagatgagaatctg

SEQ ID NO: 91038 - DNA, 20 bp, Artificial Sequence
  Description of Artificial Sequence: Synthetic oligonucleotide
  Target: ATXN1; (-) strand; PAM type: NRG; PAM sequence: GAG
gaagggtgagatgagaatct

SEQ ID NO: 91039 - DNA, 20 bp, Artificial Sequence
  Description of Artificial Sequence: Synthetic oligonucleotide
  Target: ATXN1; (-) strand; PAM type: NRG; PAM sequence: GAG
ggagtggtgaagggtgagat

SEQ ID NO: 91040 - DNA, 20 bp, Artificial Sequence
  Description of Artificial Sequence: Synthetic oligonucleotide
  Target: ATXN1; (-) strand; PAM type: NRG; PAM sequence: GAG
agatgggagtggtgaagggt

SEQ ID NO: 91041 - DNA, 20 bp, Artificial Sequence
  Description of Artificial Sequence: Synthetic oligonucleotide
  Target: ATXN1; (-) strand; PAM type: NRG; PAM sequence: GGG
tggaagatgggagtggtgaa

SEQ ID NO: 91042 - DNA, 20 bp, Artificial Sequence
  Description of Artificial Sequence: Synthetic oligonucleotide
  Target: ATXN1; (-) strand; PAM type: NRG; PAM sequence: AGG
ctggaagatgggagtggtga

SEQ ID NO: 91043 - DNA, 20 bp, Artificial Sequence
  Description of Artificial Sequence: Synthetic oligonucleotide
  Target: ATXN1; (-) strand; PAM type: NRG; PAM sequence: AAG
cctggaagatgggagtggtg

SEQ ID NO: 91044 - DNA, 20 bp, Artificial Sequence
  Description of Artificial Sequence: Synthetic oligonucleotide
  Target: ATXN1; (-) strand; PAM type: NRG; PAM sequence: TGG
ccagccctggaagatgggag

SEQ ID NO: 91045 - DNA, 20 bp, Artificial Sequence
  Description of Artificial Sequence: Synthetic oligonucleotide
  Target: ATXN1; (-) strand; PAM type: NRG; PAM sequence: GAG
gagccagccctggaagatgg

SEQ ID NO: 91046 - DNA, 20 bp, Artificial Sequence
  Description of Artificial Sequence: Synthetic oligonucleotide
  Target: ATXN1; (-) strand; PAM type: NRG; PAM sequence: GGG
aggagccagccctggaagat

SEQ ID NO: 91047 - DNA, 20 bp, Artificial Sequence
  Description of Artificial Sequence: Synthetic oligonucleotide
  Target: ATXN1; (-) strand; PAM type: NRG; PAM sequence: TGG
taggagccagccctggaaga

SEQ ID NO: 91048 - DNA, 20 bp, Artificial Sequence
  Description of Artificial Sequence: Synthetic oligonucleotide
  Target: ATXN1; (-) strand; PAM type: NRG; PAM sequence: AAG
ggtataggagccagccctgg

SEQ ID NO: 91049 - DNA, 20 bp, Artificial Sequence
  Description of Artificial Sequence: Synthetic oligonucleotide
  Target: ATXN1; (-) strand; PAM type: NRG; PAM sequence: TGG
taaggtataggagccagccc

SEQ ID NO: 91050 - DNA, 20 bp, Artificial Sequence
  Description of Artificial Sequence: Synthetic oligonucleotide
  Target: ATXN1; (-) strand; PAM type: NRG; PAM sequence: CAG
ctgcagtaaggtataggagc

SEQ ID NO: 91051 - DNA, 20 bp, Artificial Sequence
  Description of Artificial Sequence: Synthetic oligonucleotide
  Target: ATXN1; (-) strand; PAM type: NRG; PAM sequence: GAG
gagactgcagtaaggtatag

SEQ ID NO: 91052 - DNA, 20 bp, Artificial Sequence
  Description of Artificial Sequence: Synthetic oligonucleotide
  Target: ATXN1; (-) strand; PAM type: NRG; PAM sequence: AGG
cagagactgcagtaaggtat

SEQ ID NO: 91053 - DNA, 20 bp, Artificial Sequence
  Description of Artificial Sequence: Synthetic oligonucleotide
  Target: ATXN1; (-) strand; PAM type: NRG; PAM sequence: TAG
acagagactgcagtaaggta

SEQ ID NO: 91054 - DNA, 20 bp, Artificial Sequence
  Description of Artificial Sequence: Synthetic oligonucleotide
  Target: ATXN1; (-) strand; PAM type: NRG; PAM sequence: AGG
tttgtacagagactgcagta

SEQ ID NO: 91055 - DNA, 20 bp, Artificial Sequence
  Description of Artificial Sequence: Synthetic oligonucleotide
  Target: ATXN1; (-) strand; PAM type: NRG; PAM sequence: AAG
ttttgtacagagactgcagt

SEQ ID NO: 91056 - DNA, 20 bp, Artificial Sequence
  Description of Artificial Sequence: Synthetic oligonucleotide
  Target: ATXN1; (-) strand; PAM type: NRG; PAM sequence: CAG
gggcttttgtacagagactg

SEQ ID NO: 91057 - DNA, 20 bp, Artificial Sequence
  Description of Artificial Sequence: Synthetic oligonucleotide
  Target: ATXN1; (-) strand; PAM type: NRG; PAM sequence: GAG
aggggatgggcttttgtaca

SEQ ID NO: 91058 - DNA, 20 bp, Artificial Sequence
  Description of Artificial Sequence: Synthetic oligonucleotide
  Target: ATXN1; (-) strand; PAM type: NRG; PAM sequence: CAG
ttaggggatgggcttttgta

SEQ ID NO: 91059 - DNA, 20 bp, Artificial Sequence
  Description of Artificial Sequence: Synthetic oligonucleotide
  Target: ATXN1; (-) strand; PAM type: NRG; PAM sequence: GGG
cagggaaagtcttaggggat

SEQ ID NO: 91060 - DNA, 20 bp, Artificial Sequence
  Description of Artificial Sequence: Synthetic oligonucleotide
  Target: ATXN1; (-) strand; PAM type: NRG; PAM sequence: TGG
tcagggaaagtcttagggga

SEQ ID NO: 91061 - DNA, 20 bp, Artificial Sequence
  Description of Artificial Sequence: Synthetic oligonucleotide
  Target: ATXN1; (-) strand; PAM type: NRG; PAM sequence: GGG
ggagtcagggaaagtcttag

SEQ ID NO: 91062 - DNA, 20 bp, Artificial Sequence
  Description of Artificial Sequence: Synthetic oligonucleotide
  Target: ATXN1; (-) strand; PAM type: NRG; PAM sequence: GGG
tggagtcagggaaagtctta

SEQ ID NO: 91063 - DNA, 20 bp, Artificial Sequence
  Description of Artificial Sequence: Synthetic oligonucleotide
  Target: ATXN1; (-) strand; PAM type: NRG; PAM sequence: AGG
gtggagtcagggaaagtctt

SEQ ID NO: 91064 - DNA, 20 bp, Artificial Sequence
  Description of Artificial Sequence: Synthetic oligonucleotide
  Target: ATXN1; (-) strand; PAM type: NRG; PAM sequence: TAG
ggtggagtcagggaaagtct

SEQ ID NO: 91065 - DNA, 20 bp, Artificial Sequence
  Description of Artificial Sequence: Synthetic oligonucleotide
  Target: ATXN1; (-) strand; PAM type: NRG; PAM sequence: AAG
ttgtttggtggagtcaggga

SEQ ID NO: 91066 - DNA, 20 bp, Artificial Sequence
  Description of Artificial Sequence: Synthetic oligonucleotide
  Target: ATXN1; (-) strand; PAM type: NRG; PAM sequence: GGG
tcttttgtttggtggagtca

SEQ ID NO: 91067 - DNA, 20 bp, Artificial Sequence
  Description of Artificial Sequence: Synthetic oligonucleotide
  Target: ATXN1; (-) strand; PAM type: NRG; PAM sequence: AGG
ttcttttgtttggtggagtc

SEQ ID NO: 91068 - DNA, 20 bp, Artificial Sequence
  Description of Artificial Sequence: Synthetic oligonucleotide
  Target: ATXN1; (-) strand; PAM type: NRG; PAM sequence: CAG
attcttttgtttggtggagt

SEQ ID NO: 91069 - DNA, 20 bp, Artificial Sequence
  Description of Artificial Sequence: Synthetic oligonucleotide
  Target: ATXN1; (-) strand; PAM type: NRG; PAM sequence: GAG
ggggattcttttgtttggtg

SEQ ID NO: 91070 - DNA, 20 bp, Artificial Sequence
  Description of Artificial Sequence: Synthetic oligonucleotide
  Target: ATXN1; (-) strand; PAM type: NRG; PAM sequence: TGG
aaggggattcttttgtttgg

SEQ ID NO: 91071 - DNA, 20 bp, Artificial Sequence
  Description of Artificial Sequence: Synthetic oligonucleotide
  Target: ATXN1; (-) strand; PAM type: NRG; PAM sequence: TGG
gcgaaggggattcttttgtt

SEQ ID NO: 91072 - DNA, 20 bp, Artificial Sequence
  Description of Artificial Sequence: Synthetic oligonucleotide
  Target: ATXN1; (-) strand; PAM type: NRG; PAM sequence: GGG
gagtgatggcaggggcgaag

SEQ ID NO: 91073 - DNA, 20 bp, Artificial Sequence
  Description of Artificial Sequence: Synthetic oligonucleotide
  Target: ATXN1; (-) strand; PAM type: NRG; PAM sequence: GGG
agagtgatggcaggggcgaa

SEQ ID NO: 91074 - DNA, 20 bp, Artificial Sequence
  Description of Artificial Sequence: Synthetic oligonucleotide
  Target: ATXN1; (-) strand; PAM type: NRG; PAM sequence: AGG
aagagtgatggcaggggcga

SEQ ID NO: 91075 - DNA, 20 bp, Artificial Sequence
  Description of Artificial Sequence: Synthetic oligonucleotide
  Target: ATXN1; (-) strand; PAM type: NRG; PAM sequence: AAG
aaagagtgatggcaggggcg

SEQ ID NO: 91076 - DNA, 20 bp, Artificial Sequence
  Description of Artificial Sequence: Synthetic oligonucleotide
  Target: ATXN1; (-) strand; PAM type: NRG; PAM sequence: GGG
aggagaaagagtgatggcag

SEQ ID NO: 91077 - DNA, 20 bp, Artificial Sequence
  Description of Artificial Sequence: Synthetic oligonucleotide
  Target: ATXN1; (-) strand; PAM type: NRG; PAM sequence: GGG
taggagaaagagtgatggca

SEQ ID NO: 91078 - DNA, 20 bp, Artificial Sequence
  Description of Artificial Sequence: Synthetic oligonucleotide
  Target: ATXN1; (-) strand; PAM type: NRG; PAM sequence: AGG
ttaggagaaagagtgatggc

SEQ ID NO: 91079 - DNA, 20 bp, Artificial Sequence
  Description of Artificial Sequence: Synthetic oligonucleotide
  Target: ATXN1; (-) strand; PAM type: NRG; PAM sequence: CAG
gttaggagaaagagtgatgg

SEQ ID NO: 91080 - DNA, 20 bp, Artificial Sequence
  Description of Artificial Sequence: Synthetic oligonucleotide
  Target: ATXN1; (-) strand; PAM type: NRG; PAM sequence: TGG
tatgttaggagaaagagtga

SEQ ID NO: 91081 - DNA, 20 bp, Artificial Sequence
  Description of Artificial Sequence: Synthetic oligonucleotide
  Target: ATXN1; (-) strand; PAM type: NRG; PAM sequence: GAG
gtaggatatgttaggagaaa

SEQ ID NO: 91082 - DNA, 20 bp, Artificial Sequence
  Description of Artificial Sequence: Synthetic oligonucleotide
  Target: ATXN1; (-) strand; PAM type: NRG; PAM sequence: AAG
gagtaggatatgttaggaga

SEQ ID NO: 91083 - DNA, 20 bp, Artificial Sequence
  Description of Artificial Sequence: Synthetic oligonucleotide
  Target: ATXN1; (-) strand; PAM type: NRG; PAM sequence: GAG
aatagagtaggatatgttag

SEQ ID NO: 91084 - DNA, 20 bp, Artificial Sequence
  Description of Artificial Sequence: Synthetic oligonucleotide
  Target: ATXN1; (-) strand; PAM type: NRG; PAM sequence: AGG
aaaatagagtaggatatgtt

SEQ ID NO: 91085 - DNA, 20 bp, Artificial Sequence
  Description of Artificial Sequence: Synthetic oligonucleotide
  Target: ATXN1; (-) strand; PAM type: NRG; PAM sequence: TAG
caaaatagagtaggatatgt

SEQ ID NO: 91086 - DNA, 20 bp, Artificial Sequence
  Description of Artificial Sequence: Synthetic oligonucleotide
  Target: ATXN1; (-) strand; PAM type: NRG; PAM sequence: AGG
cagaccccccaaaatagagt

SEQ ID NO: 91087 - DNA, 20 bp, Artificial Sequence
  Description of Artificial Sequence: Synthetic oligonucleotide
  Target: ATXN1; (-) strand; PAM type: NRG; PAM sequence: TAG
gcagaccccccaaaatagag

SEQ ID NO: 91088 - DNA, 20 bp, Artificial Sequence
  Description of Artificial Sequence: Synthetic oligonucleotide
  Target: ATXN1; (-) strand; PAM type: NRG; PAM sequence: GAG
tttgcagaccccccaaaata

SEQ ID NO: 91089 - DNA, 20 bp, Artificial Sequence
  Description of Artificial Sequence: Synthetic oligonucleotide
  Target: ATXN1; (-) strand; PAM type: NRG; PAM sequence: TAG
tatttgcagaccccccaaaa

SEQ ID NO: 91090 - DNA, 20 bp, Artificial Sequence
  Description of Artificial Sequence: Synthetic oligonucleotide
  Target: ATXN1; (-) strand; PAM type: NRG; PAM sequence: CAG
gcataagtagactctatttg

SEQ ID NO: 91091 - DNA, 20 bp, Artificial Sequence
  Description of Artificial Sequence: Synthetic oligonucleotide
  Target: ATXN1; (-) strand; PAM type: NRG; PAM sequence: TAG
ccacaagtaaattgcataag

SEQ ID NO: 91092 - DNA, 20 bp, Artificial Sequence
  Description of Artificial Sequence: Synthetic oligonucleotide
  Target: ATXN1; (-) strand; PAM type: NRG; PAM sequence: AAG
caaccacaagtaaattgcat

SEQ ID NO: 91093 - DNA, 20 bp, Artificial Sequence
  Description of Artificial Sequence: Synthetic oligonucleotide
  Target: ATXN1; (-) strand; PAM type: NRG; PAM sequence: AAG
ctcatagtggagacaaccac

SEQ ID NO: 91094 - DNA, 20 bp, Artificial Sequence
  Description of Artificial Sequence: Synthetic oligonucleotide
  Target: ATXN1; (-) strand; PAM type: NRG; PAM sequence: GAG
gagcttatgttctcatagtg

SEQ ID NO: 91095 - DNA, 20 bp, Artificial Sequence
  Description of Artificial Sequence: Synthetic oligonucleotide
  Target: ATXN1; (-) strand; PAM type: NRG; PAM sequence: TGG
gagagcttatgttctcatag

SEQ ID NO: 91096 - DNA, 20 bp, Artificial Sequence
  Description of Artificial Sequence: Synthetic oligonucleotide
  Target: ATXN1; (-) strand; PAM type: NRG; PAM sequence: TAG
tcagagagcttatgttctca

SEQ ID NO: 91097 - DNA, 20 bp, Artificial Sequence
  Description of Artificial Sequence: Synthetic oligonucleotide
  Target: ATXN1; (-) strand; PAM type: NRG; PAM sequence: GAG
tctaagtccctgccctcaga

SEQ ID NO: 91098 - DNA, 20 bp, Artificial Sequence
  Description of Artificial Sequence: Synthetic oligonucleotide
  Target: ATXN1; (-) strand; PAM type: NRG; PAM sequence: GAG
tgtctaagtccctgccctca

SEQ ID NO: 91099 - DNA, 20 bp, Artificial Sequence
  Description of Artificial Sequence: Synthetic oligonucleotide
  Target: ATXN1; (-) strand; PAM type: NRG; PAM sequence: CAG
gttgtctaagtccctgccct

SEQ ID NO: 91100 - DNA, 20 bp, Artificial Sequence
  Description of Artificial Sequence: Synthetic oligonucleotide
  Target: ATXN1; (-) strand; PAM type: NRG; PAM sequence: AAG
gagaacaaacaaggttgtct

SEQ ID NO: 91101 - DNA, 20 bp, Artificial Sequence
  Description of Artificial Sequence: Synthetic oligonucleotide
  Target: ATXN1; (-) strand; PAM type: NRG; PAM sequence: AGG
gacgtaacagagaacaaaca

SEQ ID NO: 91102 - DNA, 20 bp, Artificial Sequence
  Description of Artificial Sequence: Synthetic oligonucleotide
  Target: ATXN1; (-) strand; PAM type: NRG; PAM sequence: AAG
ggacgtaacagagaacaaac

SEQ ID NO: 91103 - DNA, 20 bp, Artificial Sequence
  Description of Artificial Sequence: Synthetic oligonucleotide
  Target: ATXN1; (-) strand; PAM type: NRG; PAM sequence: GAG
tatgcactgaggacgtaaca

SEQ ID NO: 91104 - DNA, 20 bp, Artificial Sequence
  Description of Artificial Sequence: Synthetic oligonucleotide
  Target: ATXN1; (-) strand; PAM type: NRG; PAM sequence: CAG
tgtatgcactgaggacgtaa

SEQ ID NO: 91105 - DNA, 20 bp, Artificial Sequence
  Description of Artificial Sequence: Synthetic oligonucleotide
  Target: ATXN1; (-) strand; PAM type: NRG; PAM sequence: AGG
agacatggttgtatgcactg

SEQ ID NO: 91106 - DNA, 20 bp, Artificial Sequence
  Description of Artificial Sequence: Synthetic oligonucleotide
  Target: ATXN1; (-) strand; PAM type: NRG; PAM sequence: GAG
cagacatggttgtatgcact

SEQ ID NO: 91107 - DNA, 20 bp, Artificial Sequence
  Description of Artificial Sequence: Synthetic oligonucleotide
  Target: ATXN1; (-) strand; PAM type: NRG; PAM sequence: TGG
tgtcttttctgcaccagaca

SEQ ID NO: 91108 - DNA, 20 bp, Artificial Sequence
  Description of Artificial Sequence: Synthetic oligonucleotide
  Target: ATXN1; (-) strand; PAM type: NRG; PAM sequence: CAG
attgaatgtcttttctgcac

SEQ ID NO: 91109 - DNA, 20 bp, Artificial Sequence
  Description of Artificial Sequence: Synthetic oligonucleotide
  Target: ATXN1; (-) strand; PAM type: NRG; PAM sequence: AAG
ttattcattcttatacaacc

SEQ ID NO: 91110 - DNA, 20 bp, Artificial Sequence
  Description of Artificial Sequence: Synthetic oligonucleotide
  Target: ATXN1; (-) strand; PAM type: NRG; PAM sequence: CAG
tttataattgagtgaaagca

SEQ ID NO: 91111 - DNA, 20 bp, Artificial Sequence
  Description of Artificial Sequence: Synthetic oligonucleotide
  Target: ATXN1; (-) strand; PAM type: NRG; PAM sequence: AAG
aggcttttataattgagtga

SEQ ID NO: 91112 - DNA, 20 bp, Artificial Sequence
  Description of Artificial Sequence: Synthetic oligonucleotide
  Target: ATXN1; (-) strand; PAM type: NRG; PAM sequence: GAG
caagtcaggcttttataatt

SEQ ID NO: 91113 - DNA, 20 bp, Artificial Sequence
  Description of Artificial Sequence: Synthetic oligonucleotide
  Target: ATXN1; (-) strand; PAM type: NRG; PAM sequence: AGG
ttgatggtgctaatcaagtc

SEQ ID NO: 91114 - DNA, 20 bp, Artificial Sequence
  Description of Artificial Sequence: Synthetic oligonucleotide
  Target: ATXN1; (-) strand; PAM type: NRG; PAM sequence: CAG
cttgatggtgctaatcaagt

SEQ ID NO: 91115 - DNA, 20 bp, Artificial Sequence
  Description of Artificial Sequence: Synthetic oligonucleotide
  Target: ATXN1; (-) strand; PAM type: NRG; PAM sequence: AAG
atgtcttgatggtgctaatc

SEQ ID NO: 91116 - DNA, 20 bp, Artificial Sequence
  Description of Artificial Sequence: Synthetic oligonucleotide
  Target: ATXN1; (-) strand; PAM type: NRG; PAM sequence: TGG
cttaagctcatatgtcttga

SEQ ID NO: 91117 - DNA, 20 bp, Artificial Sequence
  Description of Artificial Sequence: Synthetic oligonucleotide
  Target: ATXN1; (-) strand; PAM type: NRG; PAM sequence: AAG
tgcaatgcagagaatgtctt

SEQ ID NO: 91118 - DNA, 20 bp, Artificial Sequence
  Description of Artificial Sequence: Synthetic oligonucleotide
  Target: ATXN1; (-) strand; PAM type: NRG; PAM sequence: GAG
cattcttgacttgcaatgca

SEQ ID NO: 91119 - DNA, 20 bp, Artificial Sequence
  Description of Artificial Sequence: Synthetic oligonucleotide
  Target: ATXN1; (-) strand; PAM type: NRG; PAM sequence: CAG
agcattcttgacttgcaatg

SEQ ID NO: 91120 - DNA, 20 bp, Artificial Sequence
  Description of Artificial Sequence: Synthetic oligonucleotide
  Target: ATXN1; (-) strand; PAM type: NRG; PAM sequence: AAG
atattttcaaaaataatagt

SEQ ID NO: 91121 - DNA, 20 bp, Artificial Sequence
  Description of Artificial Sequence: Synthetic oligonucleotide
  Target: ATXN1; (-) strand; PAM type: NRG; PAM sequence: TAG
tcagatattttcaaaaataa

SEQ ID NO: 91122 - DNA, 20 bp, Artificial Sequence
  Description of Artificial Sequence: Synthetic oligonucleotide
  Target: ATXN1; (-) strand; PAM type: NRG; PAM sequence: CAG
ggagagaggttgtaaaccct

SEQ ID NO: 91123 - DNA, 20 bp, Artificial Sequence
  Description of Artificial Sequence: Synthetic oligonucleotide
  Target: ATXN1; (-) strand; PAM type: NRG; PAM sequence: AGG
aatagaagagcattggagag

SEQ ID NO: 91124 - DNA, 20 bp, Artificial Sequence
  Description of Artificial Sequence: Synthetic oligonucleotide
  Target: ATXN1; (-) strand; PAM type: NRG; PAM sequence: GAG
taatagaagagcattggaga

SEQ ID NO: 91125 - DNA, 20 bp, Artificial Sequence
  Description of Artificial Sequence: Synthetic oligonucleotide
  Target: ATXN1; (-) strand; PAM type: NRG; PAM sequence: GAG
tttaatagaagagcattgga

SEQ ID NO: 91126 - DNA, 20 bp, Artificial Sequence
  Description of Artificial Sequence: Synthetic oligonucleotide
  Target: ATXN1; (-) strand; PAM type: NRG; PAM sequence: GAG
gttttaatagaagagcattg

SEQ ID NO: 91127 - DNA, 20 bp, Artificial Sequence
  Description of Artificial Sequence: Synthetic oligonucleotide
  Target: ATXN1; (-) strand; PAM type: NRG; PAM sequence: TGG
gagttttaatagaagagcat

SEQ ID NO: 91128 - DNA, 20 bp, Artificial Sequence
  Description of Artificial Sequence: Synthetic oligonucleotide
  Target: ATXN1; (-) strand; PAM type: NRG; PAM sequence: GAG
tcaactgagttttaatagaa

SEQ ID NO: 91129 - DNA, 20 bp, Artificial Sequence
  Description of Artificial Sequence: Synthetic oligonucleotide
  Target: ATXN1; (-) strand; PAM type: NRG; PAM sequence: AAG
gatcaactgagttttaatag

SEQ ID NO: 91130 - DNA, 20 bp, Artificial Sequence
  Description of Artificial Sequence: Synthetic oligonucleotide
  Target: ATXN1; (-) strand; PAM type: NRG; PAM sequence: TAG
ttggatcaactgagttttaa

SEQ ID NO: 91131 - DNA, 20 bp, Artificial Sequence
  Description of Artificial Sequence: Synthetic oligonucleotide
  Target: ATXN1; (-) strand; PAM type: NRG; PAM sequence: GAG
aagccatgtttggatcaact

SEQ ID NO: 91132 - DNA, 20 bp, Artificial Sequence
  Description of Artificial Sequence: Synthetic oligonucleotide
  Target: ATXN1; (-) strand; PAM type: NRG; PAM sequence: TGG
aaaagcaaaaaagccatgtt

SEQ ID NO: 91133 - DNA, 20 bp, Artificial Sequence
  Description of Artificial Sequence: Synthetic oligonucleotide
  Target: ATXN1; (-) strand; PAM type: NRG; PAM sequence: AAG
cccaaataataaaagcaaaa

SEQ ID NO: 91134 - DNA, 20 bp, Artificial Sequence
  Description of Artificial Sequence: Synthetic oligonucleotide
  Target: ATXN1; (-) strand; PAM type: NRG; PAM sequence: AAG
tagctcgacccaaataataa

SEQ ID NO: 91135 - DNA, 20 bp, Artificial Sequence
  Description of Artificial Sequence: Synthetic oligonucleotide
  Target: ATXN1; (-) strand; PAM type: NRG; PAM sequence: TAG
ctctcctttataccatgctt

SEQ ID NO: 91136 - DNA, 20 bp, Artificial Sequence
  Description of Artificial Sequence: Synthetic oligonucleotide
  Target: ATXN1; (-) strand; PAM type: NRG; PAM sequence: AGG
agctggtaggaaaaggattt

SEQ ID NO: 91137 - DNA, 20 bp, Artificial Sequence
  Description of Artificial Sequence: Synthetic oligonucleotide
  Target: ATXN1; (-) strand; PAM type: NRG; PAM sequence: TAG
tagctggtaggaaaaggatt

SEQ ID NO: 91138 - DNA, 20 bp, Artificial Sequence
  Description of Artificial Sequence: Synthetic oligonucleotide
  Target: ATXN1; (-) strand; PAM type: NRG; PAM sequence: AGG
ctcacatagctggtaggaaa

SEQ ID NO: 91139 - DNA, 20 bp, Artificial Sequence
  Description of Artificial Sequence: Synthetic oligonucleotide
  Target: ATXN1; (-) strand; PAM type: NRG; PAM sequence: AAG
gctcacatagctggtaggaa

SEQ ID NO: 91140 - DNA, 20 bp, Artificial Sequence
  Description of Artificial Sequence: Synthetic oligonucleotide
  Target: ATXN1; (-) strand; PAM type: NRG; PAM sequence: AGG
ctcaggctcacatagctggt

SEQ ID NO: 91141 - DNA, 20 bp, Artificial Sequence
  Description of Artificial Sequence: Synthetic oligonucleotide
  Target: ATXN1; (-) strand; PAM type: NRG; PAM sequence: TAG
actcaggctcacatagctgg

SEQ ID NO: 91142 - DNA, 20 bp, Artificial Sequence
  Description of Artificial Sequence: Synthetic oligonucleotide
  Target: ATXN1; (-) strand; PAM type: NRG; PAM sequence: TGG
cttactcaggctcacatagc

SEQ ID NO: 91143 - DNA, 20 bp, Artificial Sequence
  Description of Artificial Sequence: Synthetic oligonucleotide
  Target: ATXN1; (-) strand; PAM type: NRG; PAM sequence: TAG
attacttactcaggctcaca

SEQ ID NO: 91144 - DNA, 20 bp, Artificial Sequence
  Description of Artificial Sequence: Synthetic oligonucleotide
  Target: ATXN1; (-) strand; PAM type: NRG; PAM sequence: AGG
aagagggtaattacttactc

SEQ ID NO: 91145 - DNA, 20 bp, Artificial Sequence
  Description of Artificial Sequence: Synthetic oligonucleotide
  Target: ATXN1; (-) strand; PAM type: NRG; PAM sequence: CAG
aaagagggtaattacttact

SEQ ID NO: 91146 - DNA, 20 bp, Artificial Sequence
  Description of Artificial Sequence: Synthetic oligonucleotide
  Target: ATXN1; (-) strand; PAM type: NRG; PAM sequence: GGG
cttttctacaggctcaaaga

SEQ ID NO: 91147 - DNA, 20 bp, Artificial Sequence
  Description of Artificial Sequence: Synthetic oligonucleotide
  Target: ATXN1; (-) strand; PAM type: NRG; PAM sequence: AGG
tcttttctacaggctcaaag

SEQ ID NO: 91148 - DNA, 20 bp, Artificial Sequence
  Description of Artificial Sequence: Synthetic oligonucleotide
  Target: ATXN1; (-) strand; PAM type: NRG; PAM sequence: GAG
ttcttttctacaggctcaaa

SEQ ID NO: 91149 - DNA, 20 bp, Artificial Sequence
  Description of Artificial Sequence: Synthetic oligonucleotide
  Target: ATXN1; (-) strand; PAM type: NRG; PAM sequence: AAG
cattcttttctacaggctca

SEQ ID NO: 91150 - DNA, 20 bp, Artificial Sequence
  Description of Artificial Sequence: Synthetic oligonucleotide
  Target: ATXN1; (-) strand; PAM type: NRG; PAM sequence: AGG
gttttatcattcttttctac

SEQ ID NO: 91151 - DNA, 20 bp, Artificial Sequence
  Description of Artificial Sequence: Synthetic oligonucleotide
  Target: ATXN1; (-) strand; PAM type: NRG; PAM sequence: CAG
tgttttatcattcttttcta

SEQ ID NO: 91152 - DNA, 20 bp, Artificial Sequence
  Description of Artificial Sequence: Synthetic oligonucleotide
  Target: ATXN1; (-) strand; PAM type: NRG; PAM sequence: CAG
cagccctgtggatatagaca

SEQ ID NO: 91153 - DNA, 20 bp, Artificial Sequence
  Description of Artificial Sequence: Synthetic oligonucleotide
  Target: ATXN1; (-) strand; PAM type: NRG; PAM sequence: TAG
tcatagcagccctgtggata

SEQ ID NO: 91154 - DNA, 20 bp, Artificial Sequence
  Description of Artificial Sequence: Synthetic oligonucleotide
  Target: ATXN1; (-) strand; PAM type: NRG; PAM sequence: TGG
gggttctcatagcagccctg

SEQ ID NO: 91155 - DNA, 20 bp, Artificial Sequence
  Description of Artificial Sequence: Synthetic oligonucleotide
  Target: ATXN1; (-) strand; PAM type: NRG; PAM sequence: CAG
acctcaatgggttctcatag

SEQ ID NO: 91156 - DNA, 20 bp, Artificial Sequence
  Description of Artificial Sequence: Synthetic oligonucleotide
  Target: ATXN1; (-) strand; PAM type: NRG; PAM sequence: TAG
gttacctcaatgggttctca

SEQ ID NO: 91157 - DNA, 20 bp, Artificial Sequence
  Description of Artificial Sequence: Synthetic oligonucleotide
  Target: ATXN1; (-) strand; PAM type: NRG; PAM sequence: GGG
gctggatgggttacctcaat

SEQ ID NO: 91158 - DNA, 20 bp, Artificial Sequence
  Description of Artificial Sequence: Synthetic oligonucleotide
  Target: ATXN1; (-) strand; PAM type: NRG; PAM sequence: TGG
tgctggatgggttacctcaa

SEQ ID NO: 91159 - DNA, 20 bp, Artificial Sequence
  Description of Artificial Sequence: Synthetic oligonucleotide
  Target: ATXN1; (-) strand; PAM type: NRG; PAM sequence: GGG
aaagaaatattttgctggat

SEQ ID NO: 91160 - DNA, 20 bp, Artificial Sequence
  Description of Artificial Sequence: Synthetic oligonucleotide
  Target: ATXN1; (-) strand; PAM type: NRG; PAM sequence: TGG
taaagaaatattttgctgga

SEQ ID NO: 91161 - DNA, 20 bp, Artificial Sequence
  Description of Artificial Sequence: Synthetic oligonucleotide
  Target: ATXN1; (-) strand; PAM type: NRG; PAM sequence: TGG
catctaaagaaatattttgc

SEQ ID NO: 91162 - DNA, 20 bp, Artificial Sequence
  Description of Artificial Sequence: Synthetic oligonucleotide
  Target: ATXN1; (-) strand; PAM type: NRG; PAM sequence: AAG
tctggcctgaacagcatcta

SEQ ID NO: 91163 - DNA, 20 bp, Artificial Sequence
  Description of Artificial Sequence: Synthetic oligonucleotide
  Target: ATXN1; (-) strand; PAM type: NRG; PAM sequence: CAG
agcacagtatctggcctgaa

SEQ ID NO: 91164 - DNA, 20 bp, Artificial Sequence
  Description of Artificial Sequence: Synthetic oligonucleotide
  Target: ATXN1; (-) strand; PAM type: NRG; PAM sequence: TGG
gtcactgctagcacagtatc

SEQ ID NO: 91165 - DNA, 20 bp, Artificial Sequence
  Description of Artificial Sequence: Synthetic oligonucleotide
  Target: ATXN1; (-) strand; PAM type: NRG; PAM sequence: CAG
taactgtgtcactgctagca

SEQ ID NO: 91166 - DNA, 20 bp, Artificial Sequence
  Description of Artificial Sequence: Synthetic oligonucleotide
  Target: ATXN1; (-) strand; PAM type: NRG; PAM sequence: TAG
ggttctaactgtgtcactgc

SEQ ID NO: 91167 - DNA, 20 bp, Artificial Sequence
  Description of Artificial Sequence: Synthetic oligonucleotide
  Target: ATXN1; (-) strand; PAM type: NRG; PAM sequence: GGG
aggacagacatttcttgcct

SEQ ID NO: 91168 - DNA, 20 bp, Artificial Sequence
  Description of Artificial Sequence: Synthetic oligonucleotide
  Target: ATXN1; (-) strand; PAM type: NRG; PAM sequence: TGG
aaggacagacatttcttgcc

SEQ ID NO: 91169 - DNA, 20 bp, Artificial Sequence
  Description of Artificial Sequence: Synthetic oligonucleotide
  Target: ATXN1; (-) strand; PAM type: NRG; PAM sequence: CAG
agaggtatgcttgataagga

SEQ ID NO: 91170 - DNA, 20 bp, Artificial Sequence
  Description of Artificial Sequence: Synthetic oligonucleotide
  Target: ATXN1; (-) strand; PAM type: NRG; PAM sequence: AGG
gcctagaggtatgcttgata

SEQ ID NO: 91171 - DNA, 20 bp, Artificial Sequence
  Description of Artificial Sequence: Synthetic oligonucleotide
  Target: ATXN1; (-) strand; PAM type: NRG; PAM sequence: AAG
tgcctagaggtatgcttgat

SEQ ID NO: 91172 - DNA, 20 bp, Artificial Sequence
  Description of Artificial Sequence: Synthetic oligonucleotide
  Target: ATXN1; (-) strand; PAM type: NRG; PAM sequence: AGG
agtttgcaaaatgtgcctag

SEQ ID NO: 91173 - DNA, 20 bp, Artificial Sequence
  Description of Artificial Sequence: Synthetic oligonucleotide
  Target: ATXN1; (-) strand; PAM type: NRG; PAM sequence: GAG
cagtttgcaaaatgtgccta

SEQ ID NO: 91174 - DNA, 20 bp, Artificial Sequence
  Description of Artificial Sequence: Synthetic oligonucleotide
  Target: ATXN1; (-) strand; PAM type: NRG; PAM sequence: TAG
gacagtttgcaaaatgtgcc

SEQ ID NO: 91175 - DNA, 20 bp, Artificial Sequence
  Description of Artificial Sequence: Synthetic oligonucleotide
  Target: ATXN1; (-) strand; PAM type: NRG; PAM sequence: CAG
tacatctgcacaagtcttga

SEQ ID NO: 91176 - DNA, 20 bp, Artificial Sequence
  Description of Artificial Sequence: Synthetic oligonucleotide
  Target: ATXN1; (-) strand; PAM type: NRG; PAM sequence: AAG
agattccattacatctgcac

SEQ ID NO: 91177 - DNA, 20 bp, Artificial Sequence
  Description of Artificial Sequence: Synthetic oligonucleotide
  Target: ATXN1; (-) strand; PAM type: NRG; PAM sequence: CAG
ggtgtgtcaagcacaaatct

SEQ ID NO: 91178 - DNA, 20 bp, Artificial Sequence
  Description of Artificial Sequence: Synthetic oligonucleotide
  Target: ATXN1; (-) strand; PAM type: NRG; PAM sequence: AAG
ggttatcctctgggtgtgtc

SEQ ID NO: 91179 - DNA, 20 bp, Artificial Sequence
  Description of Artificial Sequence: Synthetic oligonucleotide
  Target: ATXN1; (-) strand; PAM type: NRG; PAM sequence: GGG
gggggagctggttatcctct

SEQ ID NO: 91180 - DNA, 20 bp, Artificial Sequence
  Description of Artificial Sequence: Synthetic oligonucleotide
  Target: ATXN1; (-) strand; PAM type: NRG; PAM sequence: TGG
cgggggagctggttatcctc

SEQ ID NO: 91181 - DNA, 20 bp, Artificial Sequence
  Description of Artificial Sequence: Synthetic oligonucleotide
  Target: ATXN1; (-) strand; PAM type: NRG; PAM sequence: TGG
ataatttggaacgggggagc

SEQ ID NO: 91182 - DNA, 20 bp, Artificial Sequence
  Description of Artificial Sequence: Synthetic oligonucleotide
  Target: ATXN1; (-) strand; PAM type: NRG; PAM sequence: GAG
aggaataatttggaacgggg

SEQ ID NO: 91183 - DNA, 20 bp, Artificial Sequence
  Description of Artificial Sequence: Synthetic oligonucleotide
  Target: ATXN1; (-) strand; PAM type: NRG; PAM sequence: GGG
gcaggaataatttggaacgg

SEQ ID NO: 91184 - DNA, 20 bp, Artificial Sequence
  Description of Artificial Sequence: Synthetic oligonucleotide
  Target: ATXN1; (-) strand; PAM type: NRG; PAM sequence: GGG
agcaggaataatttggaacg

SEQ ID NO: 91185 - DNA, 20 bp, Artificial Sequence
  Description of Artificial Sequence: Synthetic oligonucleotide
  Target: ATXN1; (-) strand; PAM type: NRG; PAM sequence: GGG
gagcaggaataatttggaac

SEQ ID NO: 91186 - DNA, 20 bp, Artificial Sequence
  Description of Artificial Sequence: Synthetic oligonucleotide
  Target: ATXN1; (-) strand; PAM type: NRG; PAM sequence: CGG
agagcaggaataatttggaa

SEQ ID NO: 91187 - DNA, 20 bp, Artificial Sequence
  Description of Artificial Sequence: Synthetic oligonucleotide
  Target: ATXN1; (-) strand; PAM type: NRG; PAM sequence: TGG
tatgcagagcaggaataatt

SEQ ID NO: 91188 - DNA, 20 bp, Artificial Sequence
  Description of Artificial Sequence: Synthetic oligonucleotide
  Target: ATXN1; (-) strand; PAM type: NRG; PAM sequence: AGG
tattaataggtatgcagagc

SEQ ID NO: 91189 - DNA, 20 bp, Artificial Sequence
  Description of Artificial Sequence: Synthetic oligonucleotide
  Target: ATXN1; (-) strand; PAM type: NRG; PAM sequence: CAG
gtattaataggtatgcagag

SEQ ID NO: 91190 - DNA, 20 bp, Artificial Sequence
  Description of Artificial Sequence: Synthetic oligonucleotide
  Target: ATXN1; (-) strand; PAM type: NRG; PAM sequence: GAG
tttgtattaataggtatgca

SEQ ID NO: 91191 - DNA, 20 bp, Artificial Sequence
  Description of Artificial Sequence: Synthetic oligonucleotide
  Target: ATXN1; (-) strand; PAM type: NRG; PAM sequence: CAG
catttgtattaataggtatg

SEQ ID NO: 91192 - DNA, 20 bp, Artificial Sequence
  Description of Artificial Sequence: Synthetic oligonucleotide
  Target: ATXN1; (-) strand; PAM type: NRG; PAM sequence: AGG
tggtttgcatttgtattaat

SEQ ID NO: 91193 - DNA, 20 bp, Artificial Sequence
  Description of Artificial Sequence: Synthetic oligonucleotide
  Target: ATXN1; (-) strand; PAM type: NRG; PAM sequence: TAG
ctggtttgcatttgtattaa

SEQ ID NO: 91194 - DNA, 20 bp, Artificial Sequence
  Description of Artificial Sequence: Synthetic oligonucleotide
  Target: ATXN1; (-) strand; PAM type: NRG; PAM sequence: TGG
gtcttaagggaaccatcttc

SEQ ID NO: 91195 - DNA, 20 bp, Artificial Sequence
  Description of Artificial Sequence: Synthetic oligonucleotide
  Target: ATXN1; (-) strand; PAM type: NRG; PAM sequence: GGG
aaaactaatagctgtcttaa

SEQ ID NO: 91196 - DNA, 20 bp, Artificial Sequence
  Description of Artificial Sequence: Synthetic oligonucleotide
  Target: ATXN1; (-) strand; PAM type: NRG; PAM sequence: AGG
aaaaactaatagctgtctta

SEQ ID NO: 91197 - DNA, 20 bp, Artificial Sequence
  Description of Artificial Sequence: Synthetic oligonucleotide
  Target: ATXN1; (-) strand; PAM type: NRG; PAM sequence: AAG
taaaaactaatagctgtctt

SEQ ID NO: 91198 - DNA, 20 bp, Artificial Sequence
  Description of Artificial Sequence: Synthetic oligonucleotide
  Target: ATXN1; (-) strand; PAM type: NRG; PAM sequence: TAG
agtaattgagtaaaaactaa

SEQ ID NO: 91199 - DNA, 20 bp, Artificial Sequence
  Description of Artificial Sequence: Synthetic oligonucleotide
  Target: ATXN1; (-) strand; PAM type: NRG; PAM sequence: GAG
ggggaaatgtgtgagtaatt

SEQ ID NO: 91200 - DNA, 20 bp, Artificial Sequence
  Description of Artificial Sequence: Synthetic oligonucleotide
  Target: ATXN1; (-) strand; PAM type: NRG; PAM sequence: GAG
gaacatttggggaaatgtgt

SEQ ID NO: 91201 - DNA, 20 bp, Artificial Sequence
  Description of Artificial Sequence: Synthetic oligonucleotide
  Target: ATXN1; (-) strand; PAM type: NRG; PAM sequence: GGG
agacaaatgaggaacatttg

SEQ ID NO: 91202 - DNA, 20 bp, Artificial Sequence
  Description of Artificial Sequence: Synthetic oligonucleotide
  Target: ATXN1; (-) strand; PAM type: NRG; PAM sequence: GGG
gagacaaatgaggaacattt

SEQ ID NO: 91203 - DNA, 20 bp, Artificial Sequence
  Description of Artificial Sequence: Synthetic oligonucleotide
  Target: ATXN1; (-) strand; PAM type: NRG; PAM sequence: TGG
tgagacaaatgaggaacatt

SEQ ID NO: 91204 - DNA, 20 bp, Artificial Sequence
  Description of Artificial Sequence: Synthetic oligonucleotide
  Target: ATXN1; (-) strand; PAM type: NRG; PAM sequence: AGG
tgctcggcatgagacaaatg

SEQ ID NO: 91205 - DNA, 20 bp, Artificial Sequence
  Description of Artificial Sequence: Synthetic oligonucleotide
  Target: ATXN1; (-) strand; PAM type: NRG; PAM sequence: GAG
ttgctcggcatgagacaaat

SEQ ID NO: 91206 - DNA, 20 bp, Artificial Sequence
  Description of Artificial Sequence: Synthetic oligonucleotide
  Target: ATXN1; (-) strand; PAM type: NRG; PAM sequence: GAG
tattagaaattgctcggcat

SEQ ID NO: 91207 - DNA, 20 bp, Artificial Sequence
  Description of Artificial Sequence: Synthetic oligonucleotide
  Target: ATXN1; (-) strand; PAM type: NRG; PAM sequence: CGG
tatctgtattagaaattgct

SEQ ID NO: 91208 - DNA, 20 bp, Artificial Sequence
  Description of Artificial Sequence: Synthetic oligonucleotide
  Target: ATXN1; (-) strand; PAM type: NRG; PAM sequence: TAG
ctcctgatttttatctgtat

SEQ ID NO: 91209 - DNA, 20 bp, Artificial Sequence
  Description of Artificial Sequence: Synthetic oligonucleotide
  Target: ATXN1; (-) strand; PAM type: NRG; PAM sequence: TAG
tgccgtaaccttgttcgtag

SEQ ID NO: 91210 - DNA, 20 bp, Artificial Sequence
  Description of Artificial Sequence: Synthetic oligonucleotide
  Target: ATXN1; (-) strand; PAM type: NRG; PAM sequence: TAG
acatgccgtaaccttgttcg

SEQ ID NO: 91211 - DNA, 20 bp, Artificial Sequence
  Description of Artificial Sequence: Synthetic oligonucleotide
  Target: ATXN1; (-) strand; PAM type: NRG; PAM sequence: TGG
gtggcatccacattttggga

SEQ ID NO: 91212 - DNA, 20 bp, Artificial Sequence
  Description of Artificial Sequence: Synthetic oligonucleotide
  Target: ATXN1; (-) strand; PAM type: NRG; PAM sequence: GGG
gtttgtggcatccacatttt

SEQ ID NO: 91213 - DNA, 20 bp, Artificial Sequence
  Description of Artificial Sequence: Synthetic oligonucleotide
  Target: ATXN1; (-) strand; PAM type: NRG; PAM sequence: TGG
ggtttgtggcatccacattt

SEQ ID NO: 91214 - DNA, 20 bp, Artificial Sequence
  Description of Artificial Sequence: Synthetic oligonucleotide
  Target: ATXN1; (-) strand; PAM type: NRG; PAM sequence: TGG
gaataatgtttcagggtttg

SEQ ID NO: 91215 - DNA, 20 bp, Artificial Sequence
  Description of Artificial Sequence: Synthetic oligonucleotide
  Target: ATXN1; (-) strand; PAM type: NRG; PAM sequence: GGG
tgaaaaggaataatgtttca

SEQ ID NO: 91216 - DNA, 20 bp, Artificial Sequence
  Description of Artificial Sequence: Synthetic oligonucleotide
  Target: ATXN1; (-) strand; PAM type: NRG; PAM sequence: AGG
atgaaaaggaataatgtttc

SEQ ID NO: 91217 - DNA, 20 bp, Artificial Sequence
  Description of Artificial Sequence: Synthetic oligonucleotide
  Target: ATXN1; (-) strand; PAM type: NRG; PAM sequence: CAG
aatgaaaaggaataatgttt

SEQ ID NO: 91218 - DNA, 20 bp, Artificial Sequence
  Description of Artificial Sequence: Synthetic oligonucleotide
  Target: ATXN1; (-) strand; PAM type: NRG; PAM sequence: AGG
tttcttttgaaataatgaaa

SEQ ID NO: 91219 - DNA, 20 bp, Artificial Sequence
  Description of Artificial Sequence: Synthetic oligonucleotide
  Target: ATXN1; (-) strand; PAM type: NRG; PAM sequence: AAG
gtttcttttgaaataatgaa

SEQ ID NO: 91220 - DNA, 20 bp, Artificial Sequence
  Description of Artificial Sequence: Synthetic oligonucleotide
  Target: ATXN1; (-) strand; PAM type: NRG; PAM sequence: TGG
cttggtacatatttcaaatg

SEQ ID NO: 91221 - DNA, 20 bp, Artificial Sequence
  Description of Artificial Sequence: Synthetic oligonucleotide
  Target: ATXN1; (-) strand; PAM type: NRG; PAM sequence: TGG
aacaaccacccccagccact

SEQ ID NO: 91222 - DNA, 20 bp, Artificial Sequence
  Description of Artificial Sequence: Synthetic oligonucleotide
  Target: ATXN1; (-) strand; PAM type: NRG; PAM sequence: CAG
taggcatgaacaaccacccc

SEQ ID NO: 91223 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattat

SEQ ID NO: 91224 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtgctgggatta

SEQ ID NO: 91225 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 91226 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaaagtgc

SEQ ID NO: 91227 - DNA, 20 bp, Artificial Sequence
  Description of Artificial Sequence: Synthetic oligonucleotide
  Target: ATXN1; (-) strand; PAM type: NRG; PAM sequence: AAG
cctcccacctcagcctccca

SEQ ID NO: 91228 - DNA, 20 bp, Artificial Sequence
  Description of Artificial Sequence: Synthetic oligonucleotide
  Target: ATXN1; (-) strand; PAM type: NRG; PAM sequence: CAG
ctcaagcagtcctcccacct

SEQ ID NO: 91229 - DNA, 20 bp, Artificial Sequence
  Description of Artificial Sequence: Synthetic oligonucleotide
  Target: ATXN1; (-) strand; PAM type: NRG; PAM sequence: CAG
tcgaactccctggcctcaag

SEQ ID NO: 91230 - DNA, 20 bp, Artificial Sequence
  Description of Artificial Sequence: Synthetic oligonucleotide
  Target: ATXN1; (-) strand; PAM type: NRG; PAM sequence: AAG
gtctcgaactccctggcctc

SEQ ID NO: 91231 - DNA, 20 bp, Artificial Sequence
  Description of Artificial Sequence: Synthetic oligonucleotide
  Target: ATXN1; (-) strand; PAM type: NRG; PAM sequence: TGG
caggctggtctcgaactccc

SEQ ID NO: 91232 - DNA, 20 bp, Artificial Sequence
  Description of Artificial Sequence: Synthetic oligonucleotide
  Target: ATXN1; (-) strand; PAM type: NRG; PAM sequence: TGG
tctcactatgttgcccaggc

SEQ ID NO: 91233 - DNA, 20 bp, Artificial Sequence
  Description of Artificial Sequence: Synthetic oligonucleotide
  Target: ATXN1; (-) strand; PAM type: NRG; PAM sequence: AGG
gaggtctcactatgttgccc

SEQ ID NO: 91234 - DNA, 20 bp, Artificial Sequence
  Description of Artificial Sequence: Synthetic oligonucleotide
  Target: ATXN1; (-) strand; PAM type: NRG; PAM sequence: CAG
cgaggtctcactatgttgcc

SEQ ID NO: 91235 - DNA, 20 bp, Artificial Sequence
  Description of Artificial Sequence: Synthetic oligonucleotide
  Target: ATXN1; (-) strand; PAM type: NRG; PAM sequence: AGG
tcaaattttttgtagagacg

SEQ ID NO: 91236 - DNA, 20 bp, Artificial Sequence
  Description of Artificial Sequence: Synthetic oligonucleotide
  Target: ATXN1; (-) strand; PAM type: NRG; PAM sequence: GAG
ttcaaattttttgtagagac

SEQ ID NO: 91237 - DNA, 20 bp, Artificial Sequence
  Description of Artificial Sequence: Synthetic oligonucleotide
  Target: ATXN1; (-) strand; PAM type: NRG; PAM sequence: GAG
tcattttcaaattttttgta

SEQ ID NO: 91238 - DNA, 20 bp, Artificial Sequence
  Description of Artificial Sequence: Synthetic oligonucleotide
  Target: ATXN1; (-) strand; PAM type: NRG; PAM sequence: TAG
gctcattttcaaattttttg

SEQ ID NO: 91239 - DNA, 20 bp, Artificial Sequence
  Description of Artificial Sequence: Synthetic oligonucleotide
  Target: ATXN1; (-) strand; PAM type: NRG; PAM sequence: TGG
caaggacgtgccaccatagc

SEQ ID NO: 91240 - DNA, 20 bp, Artificial Sequence
  Description of Artificial Sequence: Synthetic oligonucleotide
  Target: ATXN1; (-) strand; PAM type: NRG; PAM sequence: TAG
actacaaggacgtgccacca

SEQ ID NO: 91241 - DNA, 20 bp, Artificial Sequence
  Description of Artificial Sequence: Synthetic oligonucleotide
  Target: ATXN1; (-) strand; PAM type: NRG; PAM sequence: AGG
cccgaatatctagaactaca

SEQ ID NO: 91242 - DNA, 20 bp, Artificial Sequence
  Description of Artificial Sequence: Synthetic oligonucleotide
  Target: ATXN1; (-) strand; PAM type: NRG; PAM sequence: AAG
tcccgaatatctagaactac

SEQ ID NO: 91243 - DNA, 20 bp, Artificial Sequence
  Description of Artificial Sequence: Synthetic oligonucleotide
  Target: ATXN1; (-) strand; PAM type: NRG; PAM sequence: TAG
gttccagcctcccgaatatc

SEQ ID NO: 91244 - DNA, 20 bp, Artificial Sequence
  Description of Artificial Sequence: Synthetic oligonucleotide
  Target: ATXN1; (-) strand; PAM type: NRG; PAM sequence: CAG
ctcaagcagtcctcttgttc

SEQ ID NO: 91245 - DNA, 20 bp, Artificial Sequence
  Description of Artificial Sequence: Synthetic oligonucleotide
  Target: ATXN1; (-) strand; PAM type: NRG; PAM sequence: CAG
ctcaaatacccgggctcaag

SEQ ID NO: 91246 - DNA, 20 bp, Artificial Sequence
  Description of Artificial Sequence: Synthetic oligonucleotide
  Target: ATXN1; (-) strand; PAM type: NRG; PAM sequence: AAG
agcctcaaatacccgggctc

SEQ ID NO: 91247 - DNA, 20 bp, Artificial Sequence
  Description of Artificial Sequence: Synthetic oligonucleotide
  Target: ATXN1; (-) strand; PAM type: NRG; PAM sequence: GGG
cactgcagcctcaaataccc

SEQ ID NO: 91248 - DNA, 20 bp, Artificial Sequence
  Description of Artificial Sequence: Synthetic oligonucleotide
  Target: ATXN1; (-) strand; PAM type: NRG; PAM sequence: CGG
tcactgcagcctcaaatacc

SEQ ID NO: 91249 - DNA, 20 bp, Artificial Sequence
  Description of Artificial Sequence: Synthetic oligonucleotide
  Target: ATXN1; (-) strand; PAM type: NRG; PAM sequence: CAG
ggcatgatcatagctcactg

SEQ ID NO: 91250 - DNA, 20 bp, Artificial Sequence
  Description of Artificial Sequence: Synthetic oligonucleotide
  Target: ATXN1; (-) strand; PAM type: NRG; PAM sequence: TAG
ggagtgcagtggcatgatca

SEQ ID NO: 91251 - DNA, 20 bp, Artificial Sequence
  Description of Artificial Sequence: Synthetic oligonucleotide
  Target: ATXN1; (-) strand; PAM type: NRG; PAM sequence: TGG
tcaccctggctggagtgcag

SEQ ID NO: 91252 - DNA, 20 bp, Artificial Sequence
  Description of Artificial Sequence: Synthetic oligonucleotide
  Target: ATXN1; (-) strand; PAM type: NRG; PAM sequence: CAG
ctatcaccctggctggagtg

SEQ ID NO: 91253 - DNA, 20 bp, Artificial Sequence
  Description of Artificial Sequence: Synthetic oligonucleotide
  Target: ATXN1; (-) strand; PAM type: NRG; PAM sequence: GAG
tccctctatcaccctggctg

SEQ ID NO: 91254 - DNA, 20 bp, Artificial Sequence
  Description of Artificial Sequence: Synthetic oligonucleotide
  Target: ATXN1; (-) strand; PAM type: NRG; PAM sequence: TGG
tctccctctatcaccctggc

SEQ ID NO: 91255 - DNA, 20 bp, Artificial Sequence
  Description of Artificial Sequence: Synthetic oligonucleotide
  Target: ATXN1; (-) strand; PAM type: NRG; PAM sequence: TGG
agggtctccctctatcaccc

SEQ ID NO: 91256 - DNA, 20 bp, Artificial Sequence
  Description of Artificial Sequence: Synthetic oligonucleotide
  Target: ATXN1; (-) strand; PAM type: NRG; PAM sequence: GGG
tatttattttttaagaggca

SEQ ID NO: 91257 - DNA, 20 bp, Artificial Sequence
  Description of Artificial Sequence: Synthetic oligonucleotide
  Target: ATXN1; (-) strand; PAM type: NRG; PAM sequence: AGG
ttatttattttttaagaggc

SEQ ID NO: 91258 - DNA, 20 bp, Artificial Sequence
  Description of Artificial Sequence: Synthetic oligonucleotide
  Target: ATXN1; (-) strand; PAM type: NRG; PAM sequence: CAG
tttatttattttttaagagg

SEQ ID NO: 91259 - DNA, 20 bp, Artificial Sequence
  Description of Artificial Sequence: Synthetic oligonucleotide
  Target: ATXN1; (-) strand; PAM type: NRG; PAM sequence: AGG
ttatttatttattttttaag

SEQ ID NO: 91260 - DNA, 20 bp, Artificial Sequence
  Description of Artificial Sequence: Synthetic oligonucleotide
  Target: ATXN1; (-) strand; PAM type: NRG; PAM sequence: GAG
tttatttatttattttttaa

SEQ ID NO: 91261 - DNA, 20 bp, Artificial Sequence
  Description of Artificial Sequence: Synthetic oligonucleotide
  Target: ATXN1; (-) strand; PAM type: NRG; PAM sequence: AAG
tatttatttatttatttttt

SEQ ID NO: 91262 - DNA, 20 bp, Artificial Sequence
  Description of Artificial Sequence: Synthetic oligonucleotide
  Target: ATXN1; (-) strand; PAM type: NRG; PAM sequence: TGG
atctgcattgcagacatacc

SEQ ID NO: 91263 - DNA, 20 bp, Artificial Sequence
  Description of Artificial Sequence: Synthetic oligonucleotide
  Target: ATXN1; (-) strand; PAM type: NRG; PAM sequence: CAG
attacattaaatctgcattg

SEQ ID NO: 91264 - DNA, 20 bp, Artificial Sequence
  Description of Artificial Sequence: Synthetic oligonucleotide
  Target: ATXN1; (-) strand; PAM type: NRG; PAM sequence: TGG
aattaaaaataaccatgaca

SEQ ID NO: 91265 - DNA, 20 bp, Artificial Sequence
  Description of Artificial Sequence: Synthetic oligonucleotide
  Target: ATXN1; (-) strand; PAM type: NRG; PAM sequence: AAG
agttacagaaaacaagccat

SEQ ID NO: 91266 - DNA, 20 bp, Artificial Sequence
  Description of Artificial Sequence: Synthetic oligonucleotide
  Target: ATXN1; (-) strand; PAM type: NRG; PAM sequence: AAG
aaggctgagttacagaaaac

SEQ ID NO: 91267 - DNA, 20 bp, Artificial Sequence
  Description of Artificial Sequence: Synthetic oligonucleotide
  Target: ATXN1; (-) strand; PAM type: NRG; PAM sequence: CAG
aaaatgttaaggctgagtta

SEQ ID NO: 91268 - DNA, 20 bp, Artificial Sequence
  Description of Artificial Sequence: Synthetic oligonucleotide
  Target: ATXN1; (-) strand; PAM type: NRG; PAM sequence: GAG
cttaacaaaatgttaaggct

SEQ ID NO: 91269 - DNA, 20 bp, Artificial Sequence
  Description of Artificial Sequence: Synthetic oligonucleotide
  Target: ATXN1; (-) strand; PAM type: NRG; PAM sequence: AGG
aaaggcttaacaaaatgtta

SEQ ID NO: 91270 - DNA, 20 bp, Artificial Sequence
  Description of Artificial Sequence: Synthetic oligonucleotide
  Target: ATXN1; (-) strand; PAM type: NRG; PAM sequence: AAG
gaaaggcttaacaaaatgtt

SEQ ID NO: 91271 - DNA, 20 bp, Artificial Sequence
  Description of Artificial Sequence: Synthetic oligonucleotide
  Target: ATXN1; (-) strand; PAM type: NRG; PAM sequence: AGG
ttctgaggaaaacaaatgaa

SEQ ID NO: 91272 - DNA, 20 bp, Artificial Sequence
  Description of Artificial Sequence: Synthetic oligonucleotide
  Target: ATXN1; (-) strand; PAM type: NRG; PAM sequence: AAG
cttctgaggaaaacaaatga

SEQ ID NO: 91273 - DNA, 20 bp, Artificial Sequence
  Description of Artificial Sequence: Synthetic oligonucleotide
  Target: ATXN1; (-) strand; PAM type: NRG; PAM sequence: AGG
aaagataggcacatcttctg

SEQ ID NO: 91274 - DNA, 20 bp, Artificial Sequence
  Description of Artificial Sequence: Synthetic oligonucleotide
  Target: ATXN1; (-) strand; PAM type: NRG; PAM sequence: GAG
gaaagataggcacatcttct

SEQ ID NO: 91275 - DNA, 20 bp, Artificial Sequence
  Description of Artificial Sequence: Synthetic oligonucleotide
  Target: ATXN1; (-) strand; PAM type: NRG; PAM sequence: AGG
tttatttagaattgaaagat

SEQ ID NO: 91276 - DNA, 20 bp, Artificial Sequence
  Description of Artificial Sequence: Synthetic oligonucleotide
  Target: ATXN1; (-) strand; PAM type: NRG; PAM sequence: TAG
atttatttagaattgaaaga

SEQ ID NO: 91277 - DNA, 20 bp, Artificial Sequence
  Description of Artificial Sequence: Synthetic oligonucleotide
  Target: ATXN1; (-) strand; PAM type: NRG; PAM sequence: AAG
aaccatttatttagaattga

SEQ ID NO: 91278 - DNA, 20 bp, Artificial Sequence
  Description of Artificial Sequence: Synthetic oligonucleotide
  Target: ATXN1; (-) strand; PAM type: NRG; PAM sequence: TAG
gttcataggaaccatttatt

SEQ ID NO: 91279 - DNA, 20 bp, Artificial Sequence
  Description of Artificial Sequence: Synthetic oligonucleotide
  Target: ATXN1; (-) strand; PAM type: NRG; PAM sequence: AGG
ctgtttctcaaaaggttcat

SEQ ID NO: 91280 - DNA, 20 bp, Artificial Sequence
  Description of Artificial Sequence: Synthetic oligonucleotide
  Target: ATXN1; (-) strand; PAM type: NRG; PAM sequence: TAG
tctgtttctcaaaaggttca

SEQ ID NO: 91281 - DNA, 20 bp, Artificial Sequence
  Description of Artificial Sequence: Synthetic oligonucleotide
  Target: ATXN1; (-) strand; PAM type: NRG; PAM sequence: AGG
caagaattctgtttctcaaa

SEQ ID NO: 91282 - DNA, 20 bp, Artificial Sequence
  Description of Artificial Sequence: Synthetic oligonucleotide
  Target: ATXN1; (-) strand; PAM type: NRG; PAM sequence: AAG
ccaagaattctgtttctcaa

SEQ ID NO: 91283 - DNA, 20 bp, Artificial Sequence
  Description of Artificial Sequence: Synthetic oligonucleotide
  Target: ATXN1; (-) strand; PAM type: NRG; PAM sequence: AAG
agctttcaatcagatcctcc

SEQ ID NO: 91284 - DNA, 20 bp, Artificial Sequence
  Description of Artificial Sequence: Synthetic oligonucleotide
  Target: ATXN1; (-) strand; PAM type: NRG; PAM sequence: CAG
agaggattgtagctttcaat

SEQ ID NO: 91285 - DNA, 20 bp, Artificial Sequence
  Description of Artificial Sequence: Synthetic oligonucleotide
  Target: ATXN1; (-) strand; PAM type: NRG; PAM sequence: TAG
gtttttctgggagaggattg

SEQ ID NO: 91286 - DNA, 20 bp, Artificial Sequence
  Description of Artificial Sequence: Synthetic oligonucleotide
  Target: ATXN1; (-) strand; PAM type: NRG; PAM sequence: AGG
tatgtgggtttttctgggag

SEQ ID NO: 91287 - DNA, 20 bp, Artificial Sequence
  Description of Artificial Sequence: Synthetic oligonucleotide
  Target: ATXN1; (-) strand; PAM type: NRG; PAM sequence: GAG
gtatgtgggtttttctggga

SEQ ID NO: 91288 - DNA, 20 bp, Artificial Sequence
  Description of Artificial Sequence: Synthetic oligonucleotide
  Target: ATXN1; (-) strand; PAM type: NRG; PAM sequence: GAG
gtgtatgtgggtttttctgg

SEQ ID NO: 91289 - DNA, 20 bp, Artificial Sequence
  Description of Artificial Sequence: Synthetic oligonucleotide
  Target: ATXN1; (-) strand; PAM type: NRG; PAM sequence: GGG
ctgtgtatgtgggtttttct

SEQ ID NO: 91290 - DNA, 20 bp, Artificial Sequence
  Description of Artificial Sequence: Synthetic oligonucleotide
  Target: ATXN1; (-) strand; PAM type: NRG; PAM sequence: TGG
tctgtgtatgtgggtttttc

SEQ ID NO: 91291 - DNA, 20 bp, Artificial Sequence
  Description of Artificial Sequence: Synthetic oligonucleotide
  Target: ATXN1; (-) strand; PAM type: NRG; PAM sequence: GGG
gcatgacattctgtgtatgt

SEQ ID NO: 91292 - DNA, 20 bp, Artificial Sequence
  Description of Artificial Sequence: Synthetic oligonucleotide
  Target: ATXN1; (-) strand; PAM type: NRG; PAM sequence: TGG
agcatgacattctgtgtatg

SEQ ID NO: 91293 - DNA, 20 bp, Artificial Sequence
  Description of Artificial Sequence: Synthetic oligonucleotide
  Target: ATXN1; (-) strand; PAM type: NRG; PAM sequence: CAG
ctcccccaggaactgtatta

SEQ ID NO: 91294 - DNA, 20 bp, Artificial Sequence
  Description of Artificial Sequence: Synthetic oligonucleotide
  Target: ATXN1; (-) strand; PAM type: NRG; PAM sequence: AGG
gaacgtcccaaggctccccc

SEQ ID NO: 91295 - DNA, 20 bp, Artificial Sequence
  Description of Artificial Sequence: Synthetic oligonucleotide
  Target: ATXN1; (-) strand; PAM type: NRG; PAM sequence: CAG
agaacgtcccaaggctcccc

SEQ ID NO: 91296 - DNA, 20 bp, Artificial Sequence
  Description of Artificial Sequence: Synthetic oligonucleotide
  Target: ATXN1; (-) strand; PAM type: NRG; PAM sequence: AGG
aacttttccagaacgtccca

SEQ ID NO: 91297 - DNA, 20 bp, Artificial Sequence
  Description of Artificial Sequence: Synthetic oligonucleotide
  Target: ATXN1; (-) strand; PAM type: NRG; PAM sequence: AAG
gaacttttccagaacgtccc

SEQ ID NO: 91298 - DNA, 20 bp, Artificial Sequence
  Description of Artificial Sequence: Synthetic oligonucleotide
  Target: ATXN1; (-) strand; PAM type: NRG; PAM sequence: CAG
ttctgatcactgaacttttc

SEQ ID NO: 91299 - DNA, 20 bp, Artificial Sequence
  Description of Artificial Sequence: Synthetic oligonucleotide
  Target: ATXN1; (-) strand; PAM type: NRG; PAM sequence: GGG
gccactgcaataaggtggtt

SEQ ID NO: 91300 - DNA, 20 bp, Artificial Sequence
  Description of Artificial Sequence: Synthetic oligonucleotide
  Target: ATXN1; (-) strand; PAM type: NRG; PAM sequence: TGG
ggccactgcaataaggtggt

SEQ ID NO: 91301 - DNA, 20 bp, Artificial Sequence
  Description of Artificial Sequence: Synthetic oligonucleotide
  Target: ATXN1; (-) strand; PAM type: NRG; PAM sequence: TGG
ttgcggccactgcaataagg

SEQ ID NO: 91302 - DNA, 20 bp, Artificial Sequence
  Description of Artificial Sequence: Synthetic oligonucleotide
  Target: ATXN1; (-) strand; PAM type: NRG; PAM sequence: AGG
cctttgcggccactgcaata

SEQ ID NO: 91303 - DNA, 20 bp, Artificial Sequence
  Description of Artificial Sequence: Synthetic oligonucleotide
  Target: ATXN1; (-) strand; PAM type: NRG; PAM sequence: AAG
ccctttgcggccactgcaat

SEQ ID NO: 91304 - DNA, 20 bp, Artificial Sequence
  Description of Artificial Sequence: Synthetic oligonucleotide
  Target: ATXN1; (-) strand; PAM type: NRG; PAM sequence: CGG
ccactgagtgtgcccctttg

SEQ ID NO: 91305 - DNA, 20 bp, Artificial Sequence
  Description of Artificial Sequence: Synthetic oligonucleotide
  Target: ATXN1; (-) strand; PAM type: NRG; PAM sequence: GAG
agtggtcaggtgaggccact

SEQ ID NO: 91306 - DNA, 20 bp, Artificial Sequence
  Description of Artificial Sequence: Synthetic oligonucleotide
  Target: ATXN1; (-) strand; PAM type: NRG; PAM sequence: AGG
atctttgcagtggtcaggtg

SEQ ID NO: 91307 - DNA, 20 bp, Artificial Sequence
  Description of Artificial Sequence: Synthetic oligonucleotide
  Target: ATXN1; (-) strand; PAM type: NRG; PAM sequence: GAG
aatctttgcagtggtcaggt

SEQ ID NO: 91308 - DNA, 20 bp, Artificial Sequence
  Description of Artificial Sequence: Synthetic oligonucleotide
  Target: ATXN1; (-) strand; PAM type: NRG; PAM sequence: AGG
aacgaatctttgcagtggtc

SEQ ID NO: 91309 - DNA, 20 bp, Artificial Sequence
  Description of Artificial Sequence: Synthetic oligonucleotide
  Target: ATXN1; (-) strand; PAM type: NRG; PAM sequence: CAG
gaacgaatctttgcagtggt

SEQ ID NO: 91310 - DNA, 20 bp, Artificial Sequence
  Description of Artificial Sequence: Synthetic oligonucleotide
  Target: ATXN1; (-) strand; PAM type: NRG; PAM sequence: TGG
agaagaacgaatctttgcag

SEQ ID NO: 91311 - DNA, 20 bp, Artificial Sequence
  Description of Artificial Sequence: Synthetic oligonucleotide
  Target: ATXN1; (-) strand; PAM type: NRG; PAM sequence: CAG
gctagaagaacgaatctttg

SEQ ID NO: 91312 - DNA, 20 bp, Artificial Sequence
  Description of Artificial Sequence: Synthetic oligonucleotide
  Target: ATXN1; (-) strand; PAM type: NRG; PAM sequence: AAG
taattgtgtaggctggctag

SEQ ID NO: 91313 - DNA, 20 bp, Artificial Sequence
  Description of Artificial Sequence: Synthetic oligonucleotide
  Target: ATXN1; (-) strand; PAM type: NRG; PAM sequence: TAG
gcctaattgtgtaggctggc

SEQ ID NO: 91314 - DNA, 20 bp, Artificial Sequence
  Description of Artificial Sequence: Synthetic oligonucleotide
  Target: ATXN1; (-) strand; PAM type: NRG; PAM sequence: TGG
tggtgcctaattgtgtaggc

SEQ ID NO: 91315 - DNA, 20 bp, Artificial Sequence
  Description of Artificial Sequence: Synthetic oligonucleotide
  Target: ATXN1; (-) strand; PAM type: NRG; PAM sequence: AGG
gagttggtgcctaattgtgt

SEQ ID NO: 91316 - DNA, 20 bp, Artificial Sequence
  Description of Artificial Sequence: Synthetic oligonucleotide
  Target: ATXN1; (-) strand; PAM type: NRG; PAM sequence: TAG
tgagttggtgcctaattgtg

SEQ ID NO: 91317 - DNA, 20 bp, Artificial Sequence
  Description of Artificial Sequence: Synthetic oligonucleotide
  Target: ATXN1; (-) strand; PAM type: NRG; PAM sequence: TGG
aacatgatattgctttgagt

SEQ ID NO: 91318 - DNA, 20 bp, Artificial Sequence
  Description of Artificial Sequence: Synthetic oligonucleotide
  Target: ATXN1; (-) strand; PAM type: NRG; PAM sequence: GAG
ttgcaacatgatattgcttt

SEQ ID NO: 91319 - DNA, 20 bp, Artificial Sequence
  Description of Artificial Sequence: Synthetic oligonucleotide
  Target: ATXN1; (-) strand; PAM type: NRG; PAM sequence: TAG
caacatcagttaatgctgca

SEQ ID NO: 91320 - DNA, 20 bp, Artificial Sequence
  Description of Artificial Sequence: Synthetic oligonucleotide
  Target: ATXN1; (-) strand; PAM type: NRG; PAM sequence: CAG
tcctttcatttcctcaacat

SEQ ID NO: 91321 - DNA, 20 bp, Artificial Sequence
  Description of Artificial Sequence: Synthetic oligonucleotide
  Target: ATXN1; (-) strand; PAM type: NRG; PAM sequence: TGG
aagtgtgtaatgtgcgtgct

SEQ ID NO: 91322 - DNA, 20 bp, Artificial Sequence
  Description of Artificial Sequence: Synthetic oligonucleotide
  Target: ATXN1; (-) strand; PAM type: NRG; PAM sequence: AAG
gctgcagtgccatttgggag

SEQ ID NO: 91323 - DNA, 20 bp, Artificial Sequence
  Description of Artificial Sequence: Synthetic oligonucleotide
  Target: ATXN1; (-) strand; PAM type: NRG; PAM sequence: GAG
cctgctgcagtgccatttgg

SEQ ID NO: 91324 - DNA, 20 bp, Artificial Sequence
  Description of Artificial Sequence: Synthetic oligonucleotide
  Target: ATXN1; (-) strand; PAM type: NRG; PAM sequence: GGG
cccctgctgcagtgccattt

SEQ ID NO: 91325 - DNA, 20 bp, Artificial Sequence
  Description of Artificial Sequence: Synthetic oligonucleotide
  Target: ATXN1; (-) strand; PAM type: NRG; PAM sequence: TGG
ccccctgctgcagtgccatt

SEQ ID NO: 91326 - DNA, 20 bp, Artificial Sequence
  Description of Artificial Sequence: Synthetic oligonucleotide
  Target: ATXN1; (-) strand; PAM type: NRG; PAM sequence: CAG
cttacagccgccccctgctg

SEQ ID NO: 91327 - DNA, 20 bp, Artificial Sequence
  Description of Artificial Sequence: Synthetic oligonucleotide
  Target: ATXN1; (-) strand; PAM type: NRG; PAM sequence: CAG
atctcctgttgcctggctta

SEQ ID NO: 91328 - DNA, 20 bp, Artificial Sequence
  Description of Artificial Sequence: Synthetic oligonucleotide
  Target: ATXN1; (-) strand; PAM type: NRG; PAM sequence: TGG
tgaatgcatctcctgttgcc

SEQ ID NO: 91329 - DNA, 20 bp, Artificial Sequence
  Description of Artificial Sequence: Synthetic oligonucleotide
  Target: ATXN1; (-) strand; PAM type: NRG; PAM sequence: TGG
ttcttggcattgggaggtca

SEQ ID NO: 91330 - DNA, 20 bp, Artificial Sequence
  Description of Artificial Sequence: Synthetic oligonucleotide
  Target: ATXN1; (-) strand; PAM type: NRG; PAM sequence: AGG
ggccctttcttggcattggg

SEQ ID NO: 91331 - DNA, 20 bp, Artificial Sequence
  Description of Artificial Sequence: Synthetic oligonucleotide
  Target: ATXN1; (-) strand; PAM type: NRG; PAM sequence: GAG
gggccctttcttggcattgg

SEQ ID NO: 91332 - DNA, 20 bp, Artificial Sequence
  Description of Artificial Sequence: Synthetic oligonucleotide
  Target: ATXN1; (-) strand; PAM type: NRG; PAM sequence: GGG
ttgggccctttcttggcatt

SEQ ID NO: 91333 - DNA, 20 bp, Artificial Sequence
  Description of Artificial Sequence: Synthetic oligonucleotide
  Target: ATXN1; (-) strand; PAM type: NRG; PAM sequence: TGG
tttgggccctttcttggcat

SEQ ID NO: 91334 - DNA, 20 bp, Artificial Sequence
  Description of Artificial Sequence: Synthetic oligonucleotide
  Target: ATXN1; (-) strand; PAM type: NRG; PAM sequence: TGG
ctgaactttgggccctttct

SEQ ID NO: 91335 - DNA, 20 bp, Artificial Sequence
  Description of Artificial Sequence: Synthetic oligonucleotide
  Target: ATXN1; (-) strand; PAM type: NRG; PAM sequence: GGG
atccccatttgctgaacttt

SEQ ID NO: 91336 - DNA, 20 bp, Artificial Sequence
  Description of Artificial Sequence: Synthetic oligonucleotide
  Target: ATXN1; (-) strand; PAM type: NRG; PAM sequence: TGG
catccccatttgctgaactt

SEQ ID NO: 91337 - DNA, 20 bp, Artificial Sequence
  Description of Artificial Sequence: Synthetic oligonucleotide
  Target: ATXN1; (-) strand; PAM type: NRG; PAM sequence: AAG
ttcagtaaaattaaaagctc

SEQ ID NO: 91338 - DNA, 20 bp, Artificial Sequence
  Description of Artificial Sequence: Synthetic oligonucleotide
  Target: ATXN1; (-) strand; PAM type: NRG; PAM sequence: AAG
tcacatttcagtaaaattaa

SEQ ID NO: 91339 - DNA, 20 bp, Artificial Sequence
  Description of Artificial Sequence: Synthetic oligonucleotide
  Target: ATXN1; (-) strand; PAM type: NRG; PAM sequence: CAG
gaaagcagaaaatcacattt

SEQ ID NO: 91340 - DNA, 20 bp, Artificial Sequence
  Description of Artificial Sequence: Synthetic oligonucleotide
  Target: ATXN1; (-) strand; PAM type: NRG; PAM sequence: CAG
aatgcattttgagttgaaag

SEQ ID NO: 91341 - DNA, 20 bp, Artificial Sequence
  Description of Artificial Sequence: Synthetic oligonucleotide
  Target: ATXN1; (-) strand; PAM type: NRG; PAM sequence: AAG
gtaaatgcattttgagttga

SEQ ID NO: 91342 - DNA, 20 bp, Artificial Sequence
  Description of Artificial Sequence: Synthetic oligonucleotide
  Target: ATXN1; (-) strand; PAM type: NRG; PAM sequence: GAG
ggaacatgtaaatgcatttt

SEQ ID NO: 91343 - DNA, 20 bp, Artificial Sequence
  Description of Artificial Sequence: Synthetic oligonucleotide
  Target: ATXN1; (-) strand; PAM type: NRG; PAM sequence: TGG
ctttataacttcacaggacg

SEQ ID NO: 91344 - DNA, 20 bp, Artificial Sequence
  Description of Artificial Sequence: Synthetic oligonucleotide
  Target: ATXN1; (-) strand; PAM type: NRG; PAM sequence: AGG
tcttttctttataacttcac

SEQ ID NO: 91345 - DNA, 20 bp, Artificial Sequence
  Description of Artificial Sequence: Synthetic oligonucleotide
  Target: ATXN1; (-) strand; PAM type: NRG; PAM sequence: CAG
atcttttctttataacttca

SEQ ID NO: 91346 - DNA, 20 bp, Artificial Sequence
  Description of Artificial Sequence: Synthetic oligonucleotide
  Target: ATXN1; (-) strand; PAM type: NRG; PAM sequence: TGG
ttattagtgagcacttcctt

SEQ ID NO: 91347 - DNA, 20 bp, Artificial Sequence
  Description of Artificial Sequence: Synthetic oligonucleotide
  Target: ATXN1; (-) strand; PAM type: NRG; PAM sequence: GAG
gtaattagactattattagt

SEQ ID NO: 91348 - DNA, 20 bp, Artificial Sequence
  Description of Artificial Sequence: Synthetic oligonucleotide
  Target: ATXN1; (-) strand; PAM type: NRG; PAM sequence: TAG
ttttgtaattagactattat

SEQ ID NO: 91349 - DNA, 20 bp, Artificial Sequence
  Description of Artificial Sequence: Synthetic oligonucleotide
  Target: ATXN1; (-) strand; PAM type: NRG; PAM sequence: TAG
gggagatacttttttgtaat

SEQ ID NO: 91350 - DNA, 20 bp, Artificial Sequence
  Description of Artificial Sequence: Synthetic oligonucleotide
  Target: ATXN1; (-) strand; PAM type: NRG; PAM sequence: GAG
aacagtggggcaggtggggg

SEQ ID NO: 91351 - DNA, 20 bp, Artificial Sequence
  Description of Artificial Sequence: Synthetic oligonucleotide
  Target: ATXN1; (-) strand; PAM type: NRG; PAM sequence: GGG
caaacagtggggcaggtggg

SEQ ID NO: 91352 - DNA, 20 bp, Artificial Sequence
  Description of Artificial Sequence: Synthetic oligonucleotide
  Target: ATXN1; (-) strand; PAM type: NRG; PAM sequence: GGG
acaaacagtggggcaggtgg

SEQ ID NO: 91353 - DNA, 20 bp, Artificial Sequence
  Description of Artificial Sequence: Synthetic oligonucleotide
  Target: ATXN1; (-) strand; PAM type: NRG; PAM sequence: GGG
aacaaacagtggggcaggtg

SEQ ID NO: 91354 - DNA, 20 bp, Artificial Sequence
  Description of Artificial Sequence: Synthetic oligonucleotide
  Target: ATXN1; (-) strand; PAM type: NRG; PAM sequence: GGG
gaacaaacagtggggcaggt

SEQ ID NO: 91355 - DNA, 20 bp, Artificial Sequence
  Description of Artificial Sequence: Synthetic oligonucleotide
  Target: ATXN1; (-) strand; PAM type: NRG; PAM sequence: TGG
tgaacaaacagtggggcagg

SEQ ID NO: 91356 - DNA, 20 bp, Artificial Sequence
  Description of Artificial Sequence: Synthetic oligonucleotide
  Target: ATXN1; (-) strand; PAM type: NRG; PAM sequence: AGG
tattgaacaaacagtggggc

SEQ ID NO: 91357 - DNA, 20 bp, Artificial Sequence
  Description of Artificial Sequence: Synthetic oligonucleotide
  Target: ATXN1; (-) strand; PAM type: NRG; PAM sequence: CAG
ttattgaacaaacagtgggg

SEQ ID NO: 91358 - DNA, 20 bp, Artificial Sequence
  Description of Artificial Sequence: Synthetic oligonucleotide
  Target: ATXN1; (-) strand; PAM type: NRG; PAM sequence: GGG
gttttattgaacaaacagtg

SEQ ID NO: 91359 - DNA, 20 bp, Artificial Sequence
  Description of Artificial Sequence: Synthetic oligonucleotide
  Target: ATXN1; (-) strand; PAM type: NRG; PAM sequence: GGG
agttttattgaacaaacagt

SEQ ID NO: 91360 - DNA, 20 bp, Artificial Sequence
  Description of Artificial Sequence: Synthetic oligonucleotide
  Target: ATXN1; (-) strand; PAM type: NRG; PAM sequence: TGG
cagttttattgaacaaacag

SEQ ID NO: 91361 - DNA, 20 bp, Artificial Sequence
  Description of Artificial Sequence: Synthetic oligonucleotide
  Target: ATXN1; (-) strand; PAM type: NRG; PAM sequence: CAG
aatcagttttattgaacaaa

SEQ ID NO: 91362 - DNA, 20 bp, Artificial Sequence
  Description of Artificial Sequence: Synthetic oligonucleotide
  Target: ATXN1; (-) strand; PAM type: NRG; PAM sequence: CAG
gatggttcagtgtatggaat

SEQ ID NO: 91363 - DNA, 20 bp, Artificial Sequence
  Description of Artificial Sequence: Synthetic oligonucleotide
  Target: ATXN1; (-) strand; PAM type: NRG; PAM sequence: TGG
tagtgagatggttcagtgta

SEQ ID NO: 91364 - DNA, 20 bp, Artificial Sequence
  Description of Artificial Sequence: Synthetic oligonucleotide
  Target: ATXN1; (-) strand; PAM type: NRG; PAM sequence: CAG
aaagcgatagtgagatggtt

SEQ ID NO: 91365 - DNA, 20 bp, Artificial Sequence
  Description of Artificial Sequence: Synthetic oligonucleotide
  Target: ATXN1; (-) strand; PAM type: NRG; PAM sequence: TGG
ccagaaaagcgatagtgaga

SEQ ID NO: 91366 - DNA, 20 bp, Artificial Sequence
  Description of Artificial Sequence: Synthetic oligonucleotide
  Target: ATXN1; (-) strand; PAM type: NRG; PAM sequence: GAG
tagcccagaaaagcgatagt

SEQ ID NO: 91367 - DNA, 20 bp, Artificial Sequence
  Description of Artificial Sequence: Synthetic oligonucleotide
  Target: ATXN1; (-) strand; PAM type: NRG; PAM sequence: TAG
catgtagcccagaaaagcga

SEQ ID NO: 91368 - DNA, 20 bp, Artificial Sequence
  Description of Artificial Sequence: Synthetic oligonucleotide
  Target: ATXN1; (-) strand; PAM type: NRG; PAM sequence: AAG
catatacatgtagcccagaa

SEQ ID NO: 91369 - DNA, 20 bp, Artificial Sequence
  Description of Artificial Sequence: Synthetic oligonucleotide
  Target: ATXN1; (-) strand; PAM type: NRG; PAM sequence: CAG
gcgctcatatacatgtagcc

SEQ ID NO: 91370 - DNA, 20 bp, Artificial Sequence
  Description of Artificial Sequence: Synthetic oligonucleotide
  Target: ATXN1; (-) strand; PAM type: NRG; PAM sequence: TAG
gttttgcgctcatatacatg

SEQ ID NO: 91371 - DNA, 20 bp, Artificial Sequence
  Description of Artificial Sequence: Synthetic oligonucleotide
  Target: ATXN1; (-) strand; PAM type: NRG; PAM sequence: GAG
ttattatcgttatttactgt

SEQ ID NO: 91372 - DNA, 20 bp, Artificial Sequence
  Description of Artificial Sequence: Synthetic oligonucleotide
  Target: ATXN1; (-) strand; PAM type: NRG; PAM sequence: TGG
gtagatgtttcctgttattt

SEQ ID NO: 91373 - DNA, 20 bp, Artificial Sequence
  Description of Artificial Sequence: Synthetic oligonucleotide
  Target: ATXN1; (-) strand; PAM type: NRG; PAM sequence: TAG
atattttctctggataattg

SEQ ID NO: 91374 - DNA, 20 bp, Artificial Sequence
  Description of Artificial Sequence: Synthetic oligonucleotide
  Target: ATXN1; (-) strand; PAM type: NRG; PAM sequence: TGG
ataatttgacatattttctc

SEQ ID NO: 91375 - DNA, 20 bp, Artificial Sequence
  Description of Artificial Sequence: Synthetic oligonucleotide
  Target: ATXN1; (-) strand; PAM type: NRG; PAM sequence: GAG
ttgattactatcatgactca

SEQ ID NO: 91376 - DNA, 20 bp, Artificial Sequence
  Description of Artificial Sequence: Synthetic oligonucleotide
  Target: ATXN1; (-) strand; PAM type: NRG; PAM sequence: CAG
gtttgattactatcatgact

SEQ ID NO: 91377 - DNA, 20 bp, Artificial Sequence
  Description of Artificial Sequence: Synthetic oligonucleotide
  Target: ATXN1; (-) strand; PAM type: NRG; PAM sequence: AGG
tgtaaagccaatagagactc

SEQ ID NO: 91378 - DNA, 20 bp, Artificial Sequence
  Description of Artificial Sequence: Synthetic oligonucleotide
  Target: ATXN1; (-) strand; PAM type: NRG; PAM sequence: CAG
ttgtaaagccaatagagact

SEQ ID NO: 91379 - DNA, 20 bp, Artificial Sequence
  Description of Artificial Sequence: Synthetic oligonucleotide
  Target: ATXN1; (-) strand; PAM type: NRG; PAM sequence: GAG
agtgttttgtaaagccaata

SEQ ID NO: 91380 - DNA, 20 bp, Artificial Sequence
  Description of Artificial Sequence: Synthetic oligonucleotide
  Target: ATXN1; (-) strand; PAM type: NRG; PAM sequence: TAG
atagtgttttgtaaagccaa

SEQ ID NO: 91381 - DNA, 20 bp, Artificial Sequence
  Description of Artificial Sequence: Synthetic oligonucleotide
  Target: ATXN1; (-) strand; PAM type: NRG; PAM sequence: AAG
aatattaatagtgttttgta

SEQ ID NO: 91382 - DNA, 20 bp, Artificial Sequence
  Description of Artificial Sequence: Synthetic oligonucleotide
  Target: ATXN1; (-) strand; PAM type: NRG; PAM sequence: TAG
tttattacaggaaatattaa

SEQ ID NO: 91383 - DNA, 20 bp, Artificial Sequence
  Description of Artificial Sequence: Synthetic oligonucleotide
  Target: ATXN1; (-) strand; PAM type: NRG; PAM sequence: AGG
tacacctcagtttttattac

SEQ ID NO: 91384 - DNA, 20 bp, Artificial Sequence
  Description of Artificial Sequence: Synthetic oligonucleotide
  Target: ATXN1; (-) strand; PAM type: NRG; PAM sequence: CAG
ctacacctcagtttttatta

SEQ ID NO: 91385 - DNA, 20 bp, Artificial Sequence
  Description of Artificial Sequence: Synthetic oligonucleotide
  Target: ATXN1; (-) strand; PAM type: NRG; PAM sequence: CAG
gaacctgagtaactacacct

SEQ ID NO: 91386 - DNA, 20 bp, Artificial Sequence
  Description of Artificial Sequence: Synthetic oligonucleotide
  Target: ATXN1; (-) strand; PAM type: NRG; PAM sequence: GAG
gttgactcactaaagaacct

SEQ ID NO: 91387 - DNA, 20 bp, Artificial Sequence
  Description of Artificial Sequence: Synthetic oligonucleotide
  Target: ATXN1; (-) strand; PAM type: NRG; PAM sequence: AAG
ttacatgtgttgactcacta

SEQ ID NO: 91388 - DNA, 20 bp, Artificial Sequence
  Description of Artificial Sequence: Synthetic oligonucleotide
  Target: ATXN1; (-) strand; PAM type: NRG; PAM sequence: TAG
gcaacagtgtgtttcagctt

SEQ ID NO: 91389 - DNA, 20 bp, Artificial Sequence
  Description of Artificial Sequence: Synthetic oligonucleotide
  Target: ATXN1; (-) strand; PAM type: NRG; PAM sequence: CAG
gggaaagcaacagtgtgttt

SEQ ID NO: 91390 - DNA, 20 bp, Artificial Sequence
  Description of Artificial Sequence: Synthetic oligonucleotide
  Target: ATXN1; (-) strand; PAM type: NRG; PAM sequence: CAG
ctcagccatggggaaagcaa

SEQ ID NO: 91391 - DNA, 20 bp, Artificial Sequence
  Description of Artificial Sequence: Synthetic oligonucleotide
  Target: ATXN1; (-) strand; PAM type: NRG; PAM sequence: AAG
tgcattctcagccatgggga

SEQ ID NO: 91392 - DNA, 20 bp, Artificial Sequence
  Description of Artificial Sequence: Synthetic oligonucleotide
  Target: ATXN1; (-) strand; PAM type: NRG; PAM sequence: GGG
acactgcattctcagccatg

SEQ ID NO: 91393 - DNA, 20 bp, Artificial Sequence
  Description of Artificial Sequence: Synthetic oligonucleotide
  Target: ATXN1; (-) strand; PAM type: NRG; PAM sequence: GGG
gacactgcattctcagccat

SEQ ID NO: 91394 - DNA, 20 bp, Artificial Sequence
  Description of Artificial Sequence: Synthetic oligonucleotide
  Target: ATXN1; (-) strand; PAM type: NRG; PAM sequence: TGG
tgacactgcattctcagcca

SEQ ID NO: 91395 - DNA, 20 bp, Artificial Sequence
  Description of Artificial Sequence: Synthetic oligonucleotide
  Target: ATXN1; (-) strand; PAM type: NRG; PAM sequence: CAG
tgttactgacactgcattct

SEQ ID NO: 91396 - DNA, 20 bp, Artificial Sequence
  Description of Artificial Sequence: Synthetic oligonucleotide
  Target: ATXN1; (-) strand; PAM type: NRG; PAM sequence: CAG
acagatcttttgaagcagag

SEQ ID NO: 91397 - DNA, 20 bp, Artificial Sequence
  Description of Artificial Sequence: Synthetic oligonucleotide
  Target: ATXN1; (-) strand; PAM type: NRG; PAM sequence: GAG
ataacagatcttttgaagca

SEQ ID NO: 91398 - DNA, 20 bp, Artificial Sequence
  Description of Artificial Sequence: Synthetic oligonucleotide
  Target: ATXN1; (-) strand; PAM type: NRG; PAM sequence: CAG
acataacagatcttttgaag

SEQ ID NO: 91399 - DNA, 20 bp, Artificial Sequence
  Description of Artificial Sequence: Synthetic oligonucleotide
  Target: ATXN1; (-) strand; PAM type: NRG; PAM sequence: AAG
taaacataacagatcttttg

SEQ ID NO: 91400 - DNA, 20 bp, Artificial Sequence
  Description of Artificial Sequence: Synthetic oligonucleotide
  Target: ATXN1; (-) strand; PAM type: NRG; PAM sequence: CAG
ttttaaattcttaaacataa

SEQ ID NO: 91401 - DNA, 20 bp, Artificial Sequence
  Description of Artificial Sequence: Synthetic oligonucleotide
  Target: ATXN1; (-) strand; PAM type: NRG; PAM sequence: GAG
atttgcgtgtgtgtgagaga

SEQ ID NO: 91402 - DNA, 20 bp, Artificial Sequence
  Description of Artificial Sequence: Synthetic oligonucleotide
  Target: ATXN1; (-) strand; PAM type: NRG; PAM sequence: GAG
gtatttgcgtgtgtgtgaga

SEQ ID NO: 91403 - DNA, 20 bp, Artificial Sequence
  Description of Artificial Sequence: Synthetic oligonucleotide
  Target: ATXN1; (-) strand; PAM type: NRG; PAM sequence: GAG
ctgtatttgcgtgtgtgtga

SEQ ID NO: 91404 - DNA, 20 bp, Artificial Sequence
  Description of Artificial Sequence: Synthetic oligonucleotide
  Target: ATXN1; (-) strand; PAM type: NRG; PAM sequence: GAG
ttctgtatttgcgtgtgtgt

SEQ ID NO: 91405 - DNA, 20 bp, Artificial Sequence
  Description of Artificial Sequence: Synthetic oligonucleotide
  Target: ATXN1; (-) strand; PAM type: NRG; PAM sequence: TAG
acaccttgtaccttctttgg

SEQ ID NO: 91406 - DNA, 20 bp, Artificial Sequence
  Description of Artificial Sequence: Synthetic oligonucleotide
  Target: ATXN1; (-) strand; PAM type: NRG; PAM sequence: TGG
aaaacaccttgtaccttctt

SEQ ID NO: 91407 - DNA, 20 bp, Artificial Sequence
  Description of Artificial Sequence: Synthetic oligonucleotide
  Target: ATXN1; (-) strand; PAM type: NRG; PAM sequence: GGG
cacacacattcagagttgtt

SEQ ID NO: 91408 - DNA, 20 bp, Artificial Sequence
  Description of Artificial Sequence: Synthetic oligonucleotide
  Target: ATXN1; (-) strand; PAM type: NRG; PAM sequence: TGG
tcacacacattcagagttgt

SEQ ID NO: 91409 - DNA, 20 bp, Artificial Sequence
  Description of Artificial Sequence: Synthetic oligonucleotide
  Target: ATXN1; (-) strand; PAM type: NRG; PAM sequence: GAG
cgcatgatcacacacattca

SEQ ID NO: 91410 - DNA, 20 bp, Artificial Sequence
  Description of Artificial Sequence: Synthetic oligonucleotide
  Target: ATXN1; (-) strand; PAM type: NRG; PAM sequence: CAG
tacgcatgatcacacacatt

SEQ ID NO: 91411 - DNA, 20 bp, Artificial Sequence
  Description of Artificial Sequence: Synthetic oligonucleotide
  Target: ATXN1; (-) strand; PAM type: NRG; PAM sequence: GAG
gcataccaatagtacttaaa

SEQ ID NO: 91412 - DNA, 20 bp, Artificial Sequence
  Description of Artificial Sequence: Synthetic oligonucleotide
  Target: ATXN1; (-) strand; PAM type: NRG; PAM sequence: AAG
tagcataccaatagtactta

SEQ ID NO: 91413 - DNA, 20 bp, Artificial Sequence
  Description of Artificial Sequence: Synthetic oligonucleotide
  Target: ATXN1; (-) strand; PAM type: NRG; PAM sequence: TAG
ttttaaatgtagcataccaa

SEQ ID NO: 91414 - DNA, 20 bp, Artificial Sequence
  Description of Artificial Sequence: Synthetic oligonucleotide
  Target: ATXN1; (-) strand; PAM type: NRG; PAM sequence: TAG
agtctgaaatattttaaatg

SEQ ID NO: 91415 - DNA, 20 bp, Artificial Sequence
  Description of Artificial Sequence: Synthetic oligonucleotide
  Target: ATXN1; (-) strand; PAM type: NRG; PAM sequence: CAG
tataaatgtttatggaaaca

SEQ ID NO: 91416 - DNA, 20 bp, Artificial Sequence
  Description of Artificial Sequence: Synthetic oligonucleotide
  Target: ATXN1; (-) strand; PAM type: NRG; PAM sequence: TGG
gaagtctgtataaatgttta

SEQ ID NO: 91417 - DNA, 20 bp, Artificial Sequence
  Description of Artificial Sequence: Synthetic oligonucleotide
  Target: ATXN1; (-) strand; PAM type: NRG; PAM sequence: AAG
aattctcctttatttctgag

SEQ ID NO: 91418 - DNA, 20 bp, Artificial Sequence
  Description of Artificial Sequence: Synthetic oligonucleotide
  Target: ATXN1; (-) strand; PAM type: NRG; PAM sequence: GAG
tagaattctcctttatttct

SEQ ID NO: 91419 - DNA, 20 bp, Artificial Sequence
  Description of Artificial Sequence: Synthetic oligonucleotide
  Target: ATXN1; (-) strand; PAM type: NRG; PAM sequence: TAG
cagtgacttttaatccttag

SEQ ID NO: 91420 - DNA, 20 bp, Artificial Sequence
  Description of Artificial Sequence: Synthetic oligonucleotide
  Target: ATXN1; (-) strand; PAM type: NRG; PAM sequence: TAG
cggcagtgacttttaatcct

SEQ ID NO: 91421 - DNA, 20 bp, Artificial Sequence
  Description of Artificial Sequence: Synthetic oligonucleotide
  Target: ATXN1; (-) strand; PAM type: NRG; PAM sequence: CAG
aaatagcttataaatcacgg

SEQ ID NO: 91422 - DNA, 20 bp, Artificial Sequence
  Description of Artificial Sequence: Synthetic oligonucleotide
  Target: ATXN1; (-) strand; PAM type: NRG; PAM sequence: CGG
ttgaaatagcttataaatca

SEQ ID NO: 91423 - DNA, 20 bp, Artificial Sequence
  Description of Artificial Sequence: Synthetic oligonucleotide
  Target: ATXN1; (-) strand; PAM type: NRG; PAM sequence: TAG
tttacaatgtttagttgaaa

SEQ ID NO: 91424 - DNA, 20 bp, Artificial Sequence
  Description of Artificial Sequence: Synthetic oligonucleotide
  Target: ATXN1; (-) strand; PAM type: NRG; PAM sequence: TAG
agtccaaagtttacaatgtt

SEQ ID NO: 91425 - DNA, 20 bp, Artificial Sequence
  Description of Artificial Sequence: Synthetic oligonucleotide
  Target: ATXN1; (-) strand; PAM type: NRG; PAM sequence: AAG
actgaaaagtaaatagtcca

SEQ ID NO: 91426 - DNA, 20 bp, Artificial Sequence
  Description of Artificial Sequence: Synthetic oligonucleotide
  Target: ATXN1; (-) strand; PAM type: NRG; PAM sequence: TAG
ctctcccactgaaaagtaaa

SEQ ID NO: 91427 - DNA, 20 bp, Artificial Sequence
  Description of Artificial Sequence: Synthetic oligonucleotide
  Target: ATXN1; (-) strand; PAM type: NRG; PAM sequence: AAG
gaatgatctctcccactgaa

SEQ ID NO: 91428 - DNA, 20 bp, Artificial Sequence
  Description of Artificial Sequence: Synthetic oligonucleotide
  Target: ATXN1; (-) strand; PAM type: NRG; PAM sequence: AGG
tatgttactctatctctgga

SEQ ID NO: 91429 - DNA, 20 bp, Artificial Sequence
  Description of Artificial Sequence: Synthetic oligonucleotide
  Target: ATXN1; (-) strand; PAM type: NRG; PAM sequence: AAG
gtatgttactctatctctgg

SEQ ID NO: 91430 - DNA, 20 bp, Artificial Sequence
  Description of Artificial Sequence: Synthetic oligonucleotide
  Target: ATXN1; (-) strand; PAM type: NRG; PAM sequence: TGG
atagtatgttactctatctc

SEQ ID NO: 91431 - DNA, 20 bp, Artificial Sequence
  Description of Artificial Sequence: Synthetic oligonucleotide
  Target: ATXN1; (-) strand; PAM type: NRG; PAM sequence: TAG
aagtaggaaaaatgataata

SEQ ID NO: 91432 - DNA, 20 bp, Artificial Sequence
  Description of Artificial Sequence: Synthetic oligonucleotide
  Target: ATXN1; (-) strand; PAM type: NRG; PAM sequence: AGG
acacctggaaacttaaaagt

SEQ ID NO: 91433 - DNA, 20 bp, Artificial Sequence
  Description of Artificial Sequence: Synthetic oligonucleotide
  Target: ATXN1; (-) strand; PAM type: NRG; PAM sequence: TAG
tacacctggaaacttaaaag

SEQ ID NO: 91434 - DNA, 20 bp, Artificial Sequence
  Description of Artificial Sequence: Synthetic oligonucleotide
  Target: ATXN1; (-) strand; PAM type: NRG; PAM sequence: AAG
tgttacacctggaaacttaa

SEQ ID NO: 91435 - DNA, 20 bp, Artificial Sequence
  Description of Artificial Sequence: Synthetic oligonucleotide
  Target: ATXN1; (-) strand; PAM type: NRG; PAM sequence: TGG
gtccccagagatgttacacc

SEQ ID NO: 91436 - DNA, 20 bp, Artificial Sequence
  Description of Artificial Sequence: Synthetic oligonucleotide
  Target: ATXN1; (-) strand; PAM type: NRG; PAM sequence: GAG
ataaaatgaaaatgtcccca

SEQ ID NO: 91437 - DNA, 20 bp, Artificial Sequence
  Description of Artificial Sequence: Synthetic oligonucleotide
  Target: ATXN1; (-) strand; PAM type: NRG; PAM sequence: CAG
taataaaatgaaaatgtccc

SEQ ID NO: 91438 - DNA, 20 bp, Artificial Sequence
  Description of Artificial Sequence: Synthetic oligonucleotide
  Target: ATXN1; (-) strand; PAM type: NRG; PAM sequence: AGG
aaggatagattgttgtttaa

SEQ ID NO: 91439 - DNA, 20 bp, Artificial Sequence
  Description of Artificial Sequence: Synthetic oligonucleotide
  Target: ATXN1; (-) strand; PAM type: NRG; PAM sequence: AAG
gaaggatagattgttgttta

SEQ ID NO: 91440 - DNA, 20 bp, Artificial Sequence
  Description of Artificial Sequence: Synthetic oligonucleotide
  Target: ATXN1; (-) strand; PAM type: NRG; PAM sequence: TAG
tcatttcaactgcagaagga

SEQ ID NO: 91441 - DNA, 20 bp, Artificial Sequence
  Description of Artificial Sequence: Synthetic oligonucleotide
  Target: ATXN1; (-) strand; PAM type: NRG; PAM sequence: AGG
gaactcatttcaactgcaga

SEQ ID NO: 91442 - DNA, 20 bp, Artificial Sequence
  Description of Artificial Sequence: Synthetic oligonucleotide
  Target: ATXN1; (-) strand; PAM type: NRG; PAM sequence: AAG
tgaactcatttcaactgcag

SEQ ID NO: 91443 - DNA, 20 bp, Artificial Sequence
  Description of Artificial Sequence: Synthetic oligonucleotide
  Target: ATXN1; (-) strand; PAM type: NRG; PAM sequence: CAG
agttgaactcatttcaactg

SEQ ID NO: 91444 - DNA, 20 bp, Artificial Sequence
  Description of Artificial Sequence: Synthetic oligonucleotide
  Target: ATXN1; (-) strand; PAM type: NRG; PAM sequence: TAG
atgtgtaagctgactgtggg

SEQ ID NO: 91445 - DNA, 20 bp, Artificial Sequence
  Description of Artificial Sequence: Synthetic oligonucleotide
  Target: ATXN1; (-) strand; PAM type: NRG; PAM sequence: GGG
gttatgtgtaagctgactgt

SEQ ID NO: 91446 - DNA, 20 bp, Artificial Sequence
  Description of Artificial Sequence: Synthetic oligonucleotide
  Target: ATXN1; (-) strand; PAM type: NRG; PAM sequence: TGG
agttatgtgtaagctgactg

SEQ ID NO: 91447 - DNA, 20 bp, Artificial Sequence
  Description of Artificial Sequence: Synthetic oligonucleotide
  Target: ATXN1; (-) strand; PAM type: NRG; PAM sequence: AAG
tatagtaataagttatgtgt

SEQ ID NO: 91448 - DNA, 20 bp, Artificial Sequence
  Description of Artificial Sequence: Synthetic oligonucleotide
  Target: ATXN1; (-) strand; PAM type: NRG; PAM sequence: AAG
tatagttgatttatagtaat

SEQ ID NO: 91449 - DNA, 20 bp, Artificial Sequence
  Description of Artificial Sequence: Synthetic oligonucleotide
  Target: ATXN1; (-) strand; PAM type: NRG; PAM sequence: TAG
tagtttttatagttgattta

SEQ ID NO: 91450 - DNA, 20 bp, Artificial Sequence
  Description of Artificial Sequence: Synthetic oligonucleotide
  Target: ATXN1; (-) strand; PAM type: NRG; PAM sequence: TAG
tgattgtagcttagttttta

SEQ ID NO: 91451 - DNA, 20 bp, Artificial Sequence
  Description of Artificial Sequence: Synthetic oligonucleotide
  Target: ATXN1; (-) strand; PAM type: NRG; PAM sequence: TAG
attaagtaatgattgtagct

SEQ ID NO: 91452 - DNA, 20 bp, Artificial Sequence
  Description of Artificial Sequence: Synthetic oligonucleotide
  Target: ATXN1; (-) strand; PAM type: NRG; PAM sequence: TAG
ttaggattaagtaatgattg

SEQ ID NO: 91453 - DNA, 20 bp, Artificial Sequence
  Description of Artificial Sequence: Synthetic oligonucleotide
  Target: ATXN1; (-) strand; PAM type: NRG; PAM sequence: AAG
ttcctcctccttttaggatt

SEQ ID NO: 91454 - DNA, 20 bp, Artificial Sequence
  Description of Artificial Sequence: Synthetic oligonucleotide
  Target: ATXN1; (-) strand; PAM type: NRG; PAM sequence: AGG
tgtctcttcctcctcctttt

SEQ ID NO: 91455 - DNA, 20 bp, Artificial Sequence
  Description of Artificial Sequence: Synthetic oligonucleotide
  Target: ATXN1; (-) strand; PAM type: NRG; PAM sequence: TAG
ttgtctcttcctcctccttt

SEQ ID NO: 91456 - DNA, 20 bp, Artificial Sequence
  Description of Artificial Sequence: Synthetic oligonucleotide
  Target: ATXN1; (-) strand; PAM type: NRG; PAM sequence: GAG
atctataaaagattgtactt

SEQ ID NO: 91457 - DNA, 20 bp, Artificial Sequence
  Description of Artificial Sequence: Synthetic oligonucleotide
  Target: ATXN1; (-) strand; PAM type: NRG; PAM sequence: AAG
gaacatgattttatctataa

SEQ ID NO: 91458 - DNA, 20 bp, Artificial Sequence
  Description of Artificial Sequence: Synthetic oligonucleotide
  Target: ATXN1; (-) strand; PAM type: NRG; PAM sequence: TAG
gtttatccaaaggggtgata

SEQ ID NO: 91459 - DNA, 20 bp, Artificial Sequence
  Description of Artificial Sequence: Synthetic oligonucleotide
  Target: ATXN1; (-) strand; PAM type: NRG; PAM sequence: GGG
aataaaaggtttatccaaag

SEQ ID NO: 91460 - DNA, 20 bp, Artificial Sequence
  Description of Artificial Sequence: Synthetic oligonucleotide
  Target: ATXN1; (-) strand; PAM type: NRG; PAM sequence: GGG
aaataaaaggtttatccaaa

SEQ ID NO: 91461 - DNA, 20 bp, Artificial Sequence
  Description of Artificial Sequence: Synthetic oligonucleotide
  Target: ATXN1; (-) strand; PAM type: NRG; PAM sequence: AGG
taaataaaaggtttatccaa

SEQ ID NO: 91462 - DNA, 20 bp, Artificial Sequence
  Description of Artificial Sequence: Synthetic oligonucleotide
  Target: ATXN1; (-) strand; PAM type: NRG; PAM sequence: AAG
ataaataaaaggtttatcca

SEQ ID NO: 91463 - DNA, 20 bp, Artificial Sequence
  Description of Artificial Sequence: Synthetic oligonucleotide
  Target: ATXN1; (-) strand; PAM type: NRG; PAM sequence: AGG
gcgctagattcataaataaa

SEQ ID NO: 91464 - DNA, 20 bp, Artificial Sequence
  Description of Artificial Sequence: Synthetic oligonucleotide
  Target: ATXN1; (-) strand; PAM type: NRG; PAM sequence: AAG
tgcgctagattcataaataa

SEQ ID NO: 91465 - DNA, 20 bp, Artificial Sequence
  Description of Artificial Sequence: Synthetic oligonucleotide
  Target: ATXN1; (-) strand; PAM type: NRG; PAM sequence: TAG
gcctacgaggggaaatgcgc

SEQ ID NO: 91466 - DNA, 20 bp, Artificial Sequence
  Description of Artificial Sequence: Synthetic oligonucleotide
  Target: ATXN1; (-) strand; PAM type: NRG; PAM sequence: GGG
aaggaaatttagcctacgag

SEQ ID NO: 91467 - DNA, 20 bp, Artificial Sequence
  Description of Artificial Sequence: Synthetic oligonucleotide
  Target: ATXN1; (-) strand; PAM type: NRG; PAM sequence: GGG
taaggaaatttagcctacga

SEQ ID NO: 91468 - DNA, 20 bp, Artificial Sequence
  Description of Artificial Sequence: Synthetic oligonucleotide
  Target: ATXN1; (-) strand; PAM type: NRG; PAM sequence: AGG
ttaaggaaatttagcctacg

SEQ ID NO: 91469 - DNA, 20 bp, Artificial Sequence
  Description of Artificial Sequence: Synthetic oligonucleotide
  Target: ATXN1; (-) strand; PAM type: NRG; PAM sequence: GAG
cttaaggaaatttagcctac

SEQ ID NO: 91470 - DNA, 20 bp, Artificial Sequence
  Description of Artificial Sequence: Synthetic oligonucleotide
  Target: ATXN1; (-) strand; PAM type: NRG; PAM sequence: TAG
cagaaaagcttaaggaaatt

SEQ ID NO: 91471 - DNA, 20 bp, Artificial Sequence
  Description of Artificial Sequence: Synthetic oligonucleotide
  Target: ATXN1; (-) strand; PAM type: NRG; PAM sequence: AGG
aatttgtccagaaaagctta

SEQ ID NO: 91472 - DNA, 20 bp, Artificial Sequence
  Description of Artificial Sequence: Synthetic oligonucleotide
  Target: ATXN1; (-) strand; PAM type: NRG; PAM sequence: AAG
gaatttgtccagaaaagctt

SEQ ID NO: 91473 - DNA, 20 bp, Artificial Sequence
  Description of Artificial Sequence: Synthetic oligonucleotide
  Target: ATXN1; (-) strand; PAM type: NRG; PAM sequence: AAG
tgcagggaatttgtccagaa

SEQ ID NO: 91474 - DNA, 20 bp, Artificial Sequence
  Description of Artificial Sequence: Synthetic oligonucleotide
  Target: ATXN1; (-) strand; PAM type: NRG; PAM sequence: CAG
ttgaatgcagggaatttgtc

SEQ ID NO: 91475 - DNA, 20 bp, Artificial Sequence
  Description of Artificial Sequence: Synthetic oligonucleotide
  Target: ATXN1; (-) strand; PAM type: NRG; PAM sequence: GGG
aacttattctgttgaatgca

SEQ ID NO: 91476 - DNA, 20 bp, Artificial Sequence
  Description of Artificial Sequence: Synthetic oligonucleotide
  Target: ATXN1; (-) strand; PAM type: NRG; PAM sequence: AGG
gaacttattctgttgaatgc

SEQ ID NO: 91477 - DNA, 20 bp, Artificial Sequence
  Description of Artificial Sequence: Synthetic oligonucleotide
  Target: ATXN1; (-) strand; PAM type: NRG; PAM sequence: CAG
ggaacttattctgttgaatg

SEQ ID NO: 91478 - DNA, 20 bp, Artificial Sequence
  Description of Artificial Sequence: Synthetic oligonucleotide
  Target: ATXN1; (-) strand; PAM type: NRG; PAM sequence: TGG
tctcttttctgactaaacat

SEQ ID NO: 91479 - DNA, 20 bp, Artificial Sequence
  Description of Artificial Sequence: Synthetic oligonucleotide
  Target: ATXN1; (-) strand; PAM type: NRG; PAM sequence: GAG
gtaattatcttaatgctcca

SEQ ID NO: 91480 - DNA, 20 bp, Artificial Sequence
  Description of Artificial Sequence: Synthetic oligonucleotide
  Target: ATXN1; (-) strand; PAM type: NRG; PAM sequence: CAG
gtgtaattatcttaatgctc

SEQ ID NO: 91481 - DNA, 20 bp, Artificial Sequence
  Description of Artificial Sequence: Synthetic oligonucleotide
  Target: ATXN1; (-) strand; PAM type: NRG; PAM sequence: AAG
ttaaaaatatatatacttag

SEQ ID NO: 91482 - DNA, 20 bp, Artificial Sequence
  Description of Artificial Sequence: Synthetic oligonucleotide
  Target: ATXN1; (-) strand; PAM type: NRG; PAM sequence: TAG
attttaaaaatatatatact

SEQ ID NO: 91483 - DNA, 20 bp, Artificial Sequence
  Description of Artificial Sequence: Synthetic oligonucleotide
  Target: ATXN1; (-) strand; PAM type: NRG; PAM sequence: AAG
aaatttccttctaagtaagg

SEQ ID NO: 91484 - DNA, 20 bp, Artificial Sequence
  Description of Artificial Sequence: Synthetic oligonucleotide
  Target: ATXN1; (-) strand; PAM type: NRG; PAM sequence: AGG
tttaaatttccttctaagta

SEQ ID NO: 91485 - DNA, 20 bp, Artificial Sequence
  Description of Artificial Sequence: Synthetic oligonucleotide
  Target: ATXN1; (-) strand; PAM type: NRG; PAM sequence: AAG
atttaaatttccttctaagt

SEQ ID NO: 91486 - DNA, 20 bp, Artificial Sequence
  Description of Artificial Sequence: Synthetic oligonucleotide
  Target: ATXN1; (-) strand; PAM type: NRG; PAM sequence: AAG
tgtaatttaaatttccttct

SEQ ID NO: 91487 - DNA, 20 bp, Artificial Sequence
  Description of Artificial Sequence: Synthetic oligonucleotide
  Target: ATXN1; (-) strand; PAM type: NRG; PAM sequence: CAG
gttcagaaatttcaaaatgt

SEQ ID NO: 91488 - DNA, 20 bp, Artificial Sequence
  Description of Artificial Sequence: Synthetic oligonucleotide
  Target: ATXN1; (-) strand; PAM type: NRG; PAM sequence: CAG
tttttaatggcttttgggtt

SEQ ID NO: 91489 - DNA, 20 bp, Artificial Sequence
  Description of Artificial Sequence: Synthetic oligonucleotide
  Target: ATXN1; (-) strand; PAM type: NRG; PAM sequence: GGG
ctatttttttaatggctttt

SEQ ID NO: 91490 - DNA, 20 bp, Artificial Sequence
  Description of Artificial Sequence: Synthetic oligonucleotide
  Target: ATXN1; (-) strand; PAM type: NRG; PAM sequence: TGG
gctatttttttaatggcttt

SEQ ID NO: 91491 - DNA, 20 bp, Artificial Sequence
  Description of Artificial Sequence: Synthetic oligonucleotide
  Target: ATXN1; (-) strand; PAM type: NRG; PAM sequence: TGG
ctcatgggctatttttttaa

SEQ ID NO: 91492 - DNA, 20 bp, Artificial Sequence
  Description of Artificial Sequence: Synthetic oligonucleotide
  Target: ATXN1; (-) strand; PAM type: NRG; PAM sequence: GGG
agtgaagctgcttggctcat

SEQ ID NO: 91493 - DNA, 20 bp, Artificial Sequence
  Description of Artificial Sequence: Synthetic oligonucleotide
  Target: ATXN1; (-) strand; PAM type: NRG; PAM sequence: TGG
tagtgaagctgcttggctca

SEQ ID NO: 91494 - DNA, 20 bp, Artificial Sequence
  Description of Artificial Sequence: Synthetic oligonucleotide
  Target: ATXN1; (-) strand; PAM type: NRG; PAM sequence: TGG
aaacatttagtgaagctgct

SEQ ID NO: 91495 - DNA, 20 bp, Artificial Sequence
  Description of Artificial Sequence: Synthetic oligonucleotide
  Target: ATXN1; (-) strand; PAM type: NRG; PAM sequence: AAG
actgtgataaacatttagtg

SEQ ID NO: 91496 - DNA, 20 bp, Artificial Sequence
  Description of Artificial Sequence: Synthetic oligonucleotide
  Target: ATXN1; (-) strand; PAM type: NRG; PAM sequence: TAG
gttacactgtgataaacatt

SEQ ID NO: 91497 - DNA, 20 bp, Artificial Sequence
  Description of Artificial Sequence: Synthetic oligonucleotide
  Target: ATXN1; (-) strand; PAM type: NRG; PAM sequence: TGG
gccagaaacttttcatactg

SEQ ID NO: 91498 - DNA, 20 bp, Artificial Sequence
  Description of Artificial Sequence: Synthetic oligonucleotide
  Target: ATXN1; (-) strand; PAM type: NRG; PAM sequence: CAG
atttaaaattgcatgatagc

SEQ ID NO: 91499 - DNA, 20 bp, Artificial Sequence
  Description of Artificial Sequence: Synthetic oligonucleotide
  Target: ATXN1; (-) strand; PAM type: NRG; PAM sequence: TAG
atgaatttaaaattgcatga

SEQ ID NO: 91500 - DNA, 20 bp, Artificial Sequence
  Description of Artificial Sequence: Synthetic oligonucleotide
  Target: ATXN1; (-) strand; PAM type: NRG; PAM sequence: TGG
aaaacacagtcgagtgaaaa

SEQ ID NO: 91501 - DNA, 20 bp, Artificial Sequence
  Description of Artificial Sequence: Synthetic oligonucleotide
  Target: ATXN1; (-) strand; PAM type: NRG; PAM sequence: GAG
tatgttaaaaaaacacagtc

SEQ ID NO: 91502 - DNA, 20 bp, Artificial Sequence
  Description of Artificial Sequence: Synthetic oligonucleotide
  Target: ATXN1; (-) strand; PAM type: NRG; PAM sequence: CAG
agtcttatgttaaaaaaaca

SEQ ID NO: 91503 - DNA, 20 bp, Artificial Sequence
  Description of Artificial Sequence: Synthetic oligonucleotide
  Target: ATXN1; (-) strand; PAM type: NRG; PAM sequence: TAG
gtgtaagaatcaacatgctt

SEQ ID NO: 91504 - DNA, 20 bp, Artificial Sequence
  Description of Artificial Sequence: Synthetic oligonucleotide
  Target: ATXN1; (-) strand; PAM type: NRG; PAM sequence: AAG
gtctcttttatgatttgtgt

SEQ ID NO: 91505 - DNA, 20 bp, Artificial Sequence
  Description of Artificial Sequence: Synthetic oligonucleotide
  Target: ATXN1; (-) strand; PAM type: NRG; PAM sequence: TAG
gttactttgaactttcctca

SEQ ID NO: 91506 - DNA, 20 bp, Artificial Sequence
  Description of Artificial Sequence: Synthetic oligonucleotide
  Target: ATXN1; (-) strand; PAM type: NRG; PAM sequence: AGG
acgtgaagtcatcatgcttg

SEQ ID NO: 91507 - DNA, 20 bp, Artificial Sequence
  Description of Artificial Sequence: Synthetic oligonucleotide
  Target: ATXN1; (-) strand; PAM type: NRG; PAM sequence: GAG
aacgtgaagtcatcatgctt

SEQ ID NO: 91508 - DNA, 20 bp, Artificial Sequence
  Description of Artificial Sequence: Synthetic oligonucleotide
  Target: ATXN1; (-) strand; PAM type: NRG; PAM sequence: AAG
agaaagatcttttgaacgtg

SEQ ID NO: 91509 - DNA, 20 bp, Artificial Sequence
  Description of Artificial Sequence: Synthetic oligonucleotide
  Target: ATXN1; (-) strand; PAM type: NRG; PAM sequence: AAG
taaatgttattaacatgaga

SEQ ID NO: 91510 - DNA, 20 bp, Artificial Sequence
  Description of Artificial Sequence: Synthetic oligonucleotide
  Target: ATXN1; (-) strand; PAM type: NRG; PAM sequence: GAG
gatttaaatgttattaacat

SEQ ID NO: 91511 - DNA, 20 bp, Artificial Sequence
  Description of Artificial Sequence: Synthetic oligonucleotide
  Target: ATXN1; (-) strand; PAM type: NRG; PAM sequence: GAG
atgtgagtcacacacaggca

SEQ ID NO: 91512 - DNA, 20 bp, Artificial Sequence
  Description of Artificial Sequence: Synthetic oligonucleotide
  Target: ATXN1; (-) strand; PAM type: NRG; PAM sequence: CAG
gcatgtgagtcacacacagg

SEQ ID NO: 91513 - DNA, 20 bp, Artificial Sequence
  Description of Artificial Sequence: Synthetic oligonucleotide
  Target: ATXN1; (-) strand; PAM type: NRG; PAM sequence: AGG
gaggcatgtgagtcacacac

SEQ ID NO: 91514 - DNA, 20 bp, Artificial Sequence
  Description of Artificial Sequence: Synthetic oligonucleotide
  Target: ATXN1; (-) strand; PAM type: NRG; PAM sequence: CAG
tgaggcatgtgagtcacaca

SEQ ID NO: 91515 - DNA, 20 bp, Artificial Sequence
  Description of Artificial Sequence: Synthetic oligonucleotide
  Target: ATXN1; (-) strand; PAM type: NRG; PAM sequence: GAG
acttccagtctgaggcatgt

SEQ ID NO: 91516 - DNA, 20 bp, Artificial Sequence
  Description of Artificial Sequence: Synthetic oligonucleotide
  Target: ATXN1; (-) strand; PAM type: NRG; PAM sequence: AGG
tgggctgaacttccagtctg

SEQ ID NO: 91517 - DNA, 20 bp, Artificial Sequence
  Description of Artificial Sequence: Synthetic oligonucleotide
  Target: ATXN1; (-) strand; PAM type: NRG; PAM sequence: GAG
ttgggctgaacttccagtct

SEQ ID NO: 91518 - DNA, 20 bp, Artificial Sequence
  Description of Artificial Sequence: Synthetic oligonucleotide
  Target: ATXN1; (-) strand; PAM type: NRG; PAM sequence: CAG
agctgattgggctgaacttc

SEQ ID NO: 91519 - DNA, 20 bp, Artificial Sequence
  Description of Artificial Sequence: Synthetic oligonucleotide
  Target: ATXN1; (-) strand; PAM type: NRG; PAM sequence: GGG
atcagttgggagagctgatt

SEQ ID NO: 91520 - DNA, 20 bp, Artificial Sequence
  Description of Artificial Sequence: Synthetic oligonucleotide
  Target: ATXN1; (-) strand; PAM type: NRG; PAM sequence: TGG
aatcagttgggagagctgat

SEQ ID NO: 91521 - DNA, 20 bp, Artificial Sequence
  Description of Artificial Sequence: Synthetic oligonucleotide
  Target: ATXN1; (-) strand; PAM type: NRG; PAM sequence: GAG
ccctcaccaatcagttggga

SEQ ID NO: 91522 - DNA, 20 bp, Artificial Sequence
  Description of Artificial Sequence: Synthetic oligonucleotide
  Target: ATXN1; (-) strand; PAM type: NRG; PAM sequence: GAG
ttccctcaccaatcagttgg

SEQ ID NO: 91523 - DNA, 20 bp, Artificial Sequence
  Description of Artificial Sequence: Synthetic oligonucleotide
  Target: ATXN1; (-) strand; PAM type: NRG; PAM sequence: GGG
acttccctcaccaatcagtt

SEQ ID NO: 91524 - DNA, 20 bp, Artificial Sequence
  Description of Artificial Sequence: Synthetic oligonucleotide
  Target: ATXN1; (-) strand; PAM type: NRG; PAM sequence: TGG
tacttccctcaccaatcagt

SEQ ID NO: 91525 - DNA, 20 bp, Artificial Sequence
  Description of Artificial Sequence: Synthetic oligonucleotide
  Target: ATXN1; (-) strand; PAM type: NRG; PAM sequence: CAG
tatgtacttccctcaccaat

SEQ ID NO: 91526 - DNA, 20 bp, Artificial Sequence
  Description of Artificial Sequence: Synthetic oligonucleotide
  Target: ATXN1; (-) strand; PAM type: NRG; PAM sequence: AAG
actcggggtttaagacaatg

SEQ ID NO: 91527 - DNA, 20 bp, Artificial Sequence
  Description of Artificial Sequence: Synthetic oligonucleotide
  Target: ATXN1; (-) strand; PAM type: NRG; PAM sequence: AAG
atgccagtcactcggggttt

SEQ ID NO: 91528 - DNA, 20 bp, Artificial Sequence
  Description of Artificial Sequence: Synthetic oligonucleotide
  Target: ATXN1; (-) strand; PAM type: NRG; PAM sequence: GGG
aagggaatgccagtcactcg

SEQ ID NO: 91529 - DNA, 20 bp, Artificial Sequence
  Description of Artificial Sequence: Synthetic oligonucleotide
  Target: ATXN1; (-) strand; PAM type: NRG; PAM sequence: GGG
aaagggaatgccagtcactc

SEQ ID NO: 91530 - DNA, 20 bp, Artificial Sequence
  Description of Artificial Sequence: Synthetic oligonucleotide
  Target: ATXN1; (-) strand; PAM type: NRG; PAM sequence: CGG
taaagggaatgccagtcact

SEQ ID NO: 91531 - DNA, 20 bp, Artificial Sequence
  Description of Artificial Sequence: Synthetic oligonucleotide
  Target: ATXN1; (-) strand; PAM type: NRG; PAM sequence: CAG
tgcccagttaaagggaatgc

SEQ ID NO: 91532 - DNA, 20 bp, Artificial Sequence
  Description of Artificial Sequence: Synthetic oligonucleotide
  Target: ATXN1; (-) strand; PAM type: NRG; PAM sequence: GGG
agacacactgcccagttaaa

SEQ ID NO: 91533 - DNA, 20 bp, Artificial Sequence
  Description of Artificial Sequence: Synthetic oligonucleotide
  Target: ATXN1; (-) strand; PAM type: NRG; PAM sequence: AGG
tagacacactgcccagttaa

SEQ ID NO: 91534 - DNA, 20 bp, Artificial Sequence
  Description of Artificial Sequence: Synthetic oligonucleotide
  Target: ATXN1; (-) strand; PAM type: NRG; PAM sequence: AAG
ttagacacactgcccagtta

SEQ ID NO: 91535 - DNA, 20 bp, Artificial Sequence
  Description of Artificial Sequence: Synthetic oligonucleotide
  Target: ATXN1; (-) strand; PAM type: NRG; PAM sequence: CAG
ccatatttagacacactgcc

SEQ ID NO: 91536 - DNA, 20 bp, Artificial Sequence
  Description of Artificial Sequence: Synthetic oligonucleotide
  Target: ATXN1; (-) strand; PAM type: NRG; PAM sequence: TAG
tcatgaagtttttccatatt

SEQ ID NO: 91537 - DNA, 20 bp, Artificial Sequence
  Description of Artificial Sequence: Synthetic oligonucleotide
  Target: ATXN1; (-) strand; PAM type: NRG; PAM sequence: AAG
gcctgtttcagtttctcatg

SEQ ID NO: 91538 - DNA, 20 bp, Artificial Sequence
  Description of Artificial Sequence: Synthetic oligonucleotide
  Target: ATXN1; (-) strand; PAM type: NRG; PAM sequence: CAG
tttttcctctttgcctgttt

SEQ ID NO: 91539 - DNA, 20 bp, Artificial Sequence
  Description of Artificial Sequence: Synthetic oligonucleotide
  Target: ATXN1; (-) strand; PAM type: NRG; PAM sequence: CAG
tcatactgaaggactggtgc

SEQ ID NO: 91540 - DNA, 20 bp, Artificial Sequence
  Description of Artificial Sequence: Synthetic oligonucleotide
  Target: ATXN1; (-) strand; PAM type: NRG; PAM sequence: TGG
ctcgattcatactgaaggac

SEQ ID NO: 91541 - DNA, 20 bp, Artificial Sequence
  Description of Artificial Sequence: Synthetic oligonucleotide
  Target: ATXN1; (-) strand; PAM type: NRG; PAM sequence: AGG
tttctctcgattcatactga

SEQ ID NO: 91542 - DNA, 20 bp, Artificial Sequence
  Description of Artificial Sequence: Synthetic oligonucleotide
  Target: ATXN1; (-) strand; PAM type: NRG; PAM sequence: AAG
ttttctctcgattcatactg

SEQ ID NO: 91543 - DNA, 20 bp, Artificial Sequence
  Description of Artificial Sequence: Synthetic oligonucleotide
  Target: ATXN1; (-) strand; PAM type: NRG; PAM sequence: GAG
acacctaaaaaattcttttg

SEQ ID NO: 91544 - DNA, 20 bp, Artificial Sequence
  Description of Artificial Sequence: Synthetic oligonucleotide
  Target: ATXN1; (-) strand; PAM type: NRG; PAM sequence: TGG
agacacctaaaaaattcttt

SEQ ID NO: 91545 - DNA, 20 bp, Artificial Sequence
  Description of Artificial Sequence: Synthetic oligonucleotide
  Target: ATXN1; (-) strand; PAM type: NRG; PAM sequence: AAG
tggaattcctgctcatcaaa

SEQ ID NO: 91546 - DNA, 20 bp, Artificial Sequence
  Description of Artificial Sequence: Synthetic oligonucleotide
  Target: ATXN1; (-) strand; PAM type: NRG; PAM sequence: TGG
gaactgaaagccctaggcac

SEQ ID NO: 91547 - DNA, 20 bp, Artificial Sequence
  Description of Artificial Sequence: Synthetic oligonucleotide
  Target: ATXN1; (-) strand; PAM type: NRG; PAM sequence: AGG
cacaaagaactgaaagccct

SEQ ID NO: 91548 - DNA, 20 bp, Artificial Sequence
  Description of Artificial Sequence: Synthetic oligonucleotide
  Target: ATXN1; (-) strand; PAM type: NRG; PAM sequence: TAG
gcacaaagaactgaaagccc

SEQ ID NO: 91549 - DNA, 20 bp, Artificial Sequence
  Description of Artificial Sequence: Synthetic oligonucleotide
  Target: ATXN1; (-) strand; PAM type: NRG; PAM sequence: AAG
tttgatgcacaaagaactga

SEQ ID NO: 91550 - DNA, 20 bp, Artificial Sequence
  Description of Artificial Sequence: Synthetic oligonucleotide
  Target: ATXN1; (-) strand; PAM type: NRG; PAM sequence: AAG
gaagaaaactttgatgcaca

SEQ ID NO: 91551 - DNA, 20 bp, Artificial Sequence
  Description of Artificial Sequence: Synthetic oligonucleotide
  Target: ATXN1; (-) strand; PAM type: NRG; PAM sequence: AAG
ccatgaccatacatgcttag

SEQ ID NO: 91552 - DNA, 20 bp, Artificial Sequence
  Description of Artificial Sequence: Synthetic oligonucleotide
  Target: ATXN1; (-) strand; PAM type: NRG; PAM sequence: TAG
cttccatgaccatacatgct

SEQ ID NO: 91553 - DNA, 20 bp, Artificial Sequence
  Description of Artificial Sequence: Synthetic oligonucleotide
  Target: ATXN1; (-) strand; PAM type: NRG; PAM sequence: CAG
cattgtcatgaaagatactc

SEQ ID NO: 91554 - DNA, 20 bp, Artificial Sequence
  Description of Artificial Sequence: Synthetic oligonucleotide
  Target: ATXN1; (-) strand; PAM type: NRG; PAM sequence: AAG
attagaggccattgtcatga

SEQ ID NO: 91555 - DNA, 20 bp, Artificial Sequence
  Description of Artificial Sequence: Synthetic oligonucleotide
  Target: ATXN1; (-) strand; PAM type: NRG; PAM sequence: AGG
tgaacactgggtttgattag

SEQ ID NO: 91556 - DNA, 20 bp, Artificial Sequence
  Description of Artificial Sequence: Synthetic oligonucleotide
  Target: ATXN1; (-) strand; PAM type: NRG; PAM sequence: GAG
gtgaacactgggtttgatta

SEQ ID NO: 91557 - DNA, 20 bp, Artificial Sequence
  Description of Artificial Sequence: Synthetic oligonucleotide
  Target: ATXN1; (-) strand; PAM type: NRG; PAM sequence: TAG
gggtgaacactgggtttgat

SEQ ID NO: 91558 - DNA, 20 bp, Artificial Sequence
  Description of Artificial Sequence: Synthetic oligonucleotide
  Target: ATXN1; (-) strand; PAM type: NRG; PAM sequence: GGG
gtctctcaggggtgaacact

SEQ ID NO: 91559 - DNA, 20 bp, Artificial Sequence
  Description of Artificial Sequence: Synthetic oligonucleotide
  Target: ATXN1; (-) strand; PAM type: NRG; PAM sequence: TGG
cgtctctcaggggtgaacac

SEQ ID NO: 91560 - DNA, 20 bp, Artificial Sequence
  Description of Artificial Sequence: Synthetic oligonucleotide
  Target: ATXN1; (-) strand; PAM type: NRG; PAM sequence: GGG
gtgcacaggtcgtctctcag

SEQ ID NO: 91561 - DNA, 20 bp, Artificial Sequence
  Description of Artificial Sequence: Synthetic oligonucleotide
  Target: ATXN1; (-) strand; PAM type: NRG; PAM sequence: GGG
agtgcacaggtcgtctctca

SEQ ID NO: 91562 - DNA, 20 bp, Artificial Sequence
  Description of Artificial Sequence: Synthetic oligonucleotide
  Target: ATXN1; (-) strand; PAM type: NRG; PAM sequence: AGG
aagtgcacaggtcgtctctc

SEQ ID NO: 91563 - DNA, 20 bp, Artificial Sequence
  Description of Artificial Sequence: Synthetic oligonucleotide
  Target: ATXN1; (-) strand; PAM type: NRG; PAM sequence: CAG
gaagtgcacaggtcgtctct

SEQ ID NO: 91564 - DNA, 20 bp, Artificial Sequence
  Description of Artificial Sequence: Synthetic oligonucleotide
  Target: ATXN1; (-) strand; PAM type: NRG; PAM sequence: AGG
atggatggagtgaagtgcac

SEQ ID NO: 91565 - DNA, 20 bp, Artificial Sequence
  Description of Artificial Sequence: Synthetic oligonucleotide
  Target: ATXN1; (-) strand; PAM type: NRG; PAM sequence: CAG
gatggatggagtgaagtgca

SEQ ID NO: 91566 - DNA, 20 bp, Artificial Sequence
  Description of Artificial Sequence: Synthetic oligonucleotide
  Target: ATXN1; (-) strand; PAM type: NRG; PAM sequence: AAG
tgcctgtgatggatggagtg

SEQ ID NO: 91567 - DNA, 20 bp, Artificial Sequence
  Description of Artificial Sequence: Synthetic oligonucleotide
  Target: ATXN1; (-) strand; PAM type: NRG; PAM sequence: GAG
ttagttgcctgtgatggatg

SEQ ID NO: 91568 - DNA, 20 bp, Artificial Sequence
  Description of Artificial Sequence: Synthetic oligonucleotide
  Target: ATXN1; (-) strand; PAM type: NRG; PAM sequence: TGG
atttagttgcctgtgatgga

SEQ ID NO: 91569 - DNA, 20 bp, Artificial Sequence
  Description of Artificial Sequence: Synthetic oligonucleotide
  Target: ATXN1; (-) strand; PAM type: NRG; PAM sequence: TGG
gtatatttagttgcctgtga

SEQ ID NO: 91570 - DNA, 20 bp, Artificial Sequence
  Description of Artificial Sequence: Synthetic oligonucleotide
  Target: ATXN1; (-) strand; PAM type: NRG; PAM sequence: TAG
gcttgccctggttgtatatt

SEQ ID NO: 91571 - DNA, 20 bp, Artificial Sequence
  Description of Artificial Sequence: Synthetic oligonucleotide
  Target: ATXN1; (-) strand; PAM type: NRG; PAM sequence: TGG
tgttcatgggttgcttgccc

SEQ ID NO: 91572 - DNA, 20 bp, Artificial Sequence
  Description of Artificial Sequence: Synthetic oligonucleotide
  Target: ATXN1; (-) strand; PAM type: NRG; PAM sequence: GGG
ctgtttttcaccctgttcat

SEQ ID NO: 91573 - DNA, 20 bp, Artificial Sequence
  Description of Artificial Sequence: Synthetic oligonucleotide
  Target: ATXN1; (-) strand; PAM type: NRG; PAM sequence: TGG
gctgtttttcaccctgttca

SEQ ID NO: 91574 - DNA, 20 bp, Artificial Sequence
  Description of Artificial Sequence: Synthetic oligonucleotide
  Target: ATXN1; (-) strand; PAM type: NRG; PAM sequence: TGG
ttgtaaatagccagctccag

SEQ ID NO: 91575 - DNA, 20 bp, Artificial Sequence
  Description of Artificial Sequence: Synthetic oligonucleotide
  Target: ATXN1; (-) strand; PAM type: NRG; PAM sequence: CAG
aggttgtaaatagccagctc

SEQ ID NO: 91576 - DNA, 20 bp, Artificial Sequence
  Description of Artificial Sequence: Synthetic oligonucleotide
  Target: ATXN1; (-) strand; PAM type: NRG; PAM sequence: CAG
agagcaaggttgtaaatagc

SEQ ID NO: 91577 - DNA, 20 bp, Artificial Sequence
  Description of Artificial Sequence: Synthetic oligonucleotide
  Target: ATXN1; (-) strand; PAM type: NRG; PAM sequence: TAG
gagcagagcaaggttgtaaa

SEQ ID NO: 91578 - DNA, 20 bp, Artificial Sequence
  Description of Artificial Sequence: Synthetic oligonucleotide
  Target: ATXN1; (-) strand; PAM type: NRG; PAM sequence: AGG
gaaagttttagagcagagca

SEQ ID NO: 91579 - DNA, 20 bp, Artificial Sequence
  Description of Artificial Sequence: Synthetic oligonucleotide
  Target: ATXN1; (-) strand; PAM type: NRG; PAM sequence: AAG
agaaagttttagagcagagc

SEQ ID NO: 91580 - DNA, 20 bp, Artificial Sequence
  Description of Artificial Sequence: Synthetic oligonucleotide
  Target: ATXN1; (-) strand; PAM type: NRG; PAM sequence: GAG
ccgtagaaagttttagagca

SEQ ID NO: 91581 - DNA, 20 bp, Artificial Sequence
  Description of Artificial Sequence: Synthetic oligonucleotide
  Target: ATXN1; (-) strand; PAM type: NRG; PAM sequence: CAG
tcccgtagaaagttttagag

SEQ ID NO: 91582 - DNA, 20 bp, Artificial Sequence
  Description of Artificial Sequence: Synthetic oligonucleotide
  Target: ATXN1; (-) strand; PAM type: NRG; PAM sequence: GAG
ttgtcccgtagaaagtttta

SEQ ID NO: 91583 - DNA, 20 bp, Artificial Sequence
  Description of Artificial Sequence: Synthetic oligonucleotide
  Target: ATXN1; (-) strand; PAM type: NRG; PAM sequence: TAG
ggttgtcccgtagaaagttt

SEQ ID NO: 91584 - DNA, 20 bp, Artificial Sequence
  Description of Artificial Sequence: Synthetic oligonucleotide
  Target: ATXN1; (-) strand; PAM type: NRG; PAM sequence: AAG
ctgaatggttgtcccgtaga

SEQ ID NO: 91585 - DNA, 20 bp, Artificial Sequence
  Description of Artificial Sequence: Synthetic oligonucleotide
  Target: ATXN1; (-) strand; PAM type: NRG; PAM sequence: TAG
gggtctgaatggttgtcccg

SEQ ID NO: 91586 - DNA, 20 bp, Artificial Sequence
  Description of Artificial Sequence: Synthetic oligonucleotide
  Target: ATXN1; (-) strand; PAM type: NRG; PAM sequence: TGG
acatagaactcgggtctgaa

SEQ ID NO: 91587 - DNA, 20 bp, Artificial Sequence
  Description of Artificial Sequence: Synthetic oligonucleotide
  Target: ATXN1; (-) strand; PAM type: NRG; PAM sequence: GGG
acctattgtacatagaactc

SEQ ID NO: 91588 - DNA, 20 bp, Artificial Sequence
  Description of Artificial Sequence: Synthetic oligonucleotide
  Target: ATXN1; (-) strand; PAM type: NRG; PAM sequence: CGG
aacctattgtacatagaact

SEQ ID NO: 91589 - DNA, 20 bp, Artificial Sequence
  Description of Artificial Sequence: Synthetic oligonucleotide
  Target: ATXN1; (-) strand; PAM type: NRG; PAM sequence: TAG
aggctgaaacctattgtaca

SEQ ID NO: 91590 - DNA, 20 bp, Artificial Sequence
  Description of Artificial Sequence: Synthetic oligonucleotide
  Target: ATXN1; (-) strand; PAM type: NRG; PAM sequence: AGG
tgcatctatctaatttgcta

SEQ ID NO: 91591 - DNA, 20 bp, Artificial Sequence
  Description of Artificial Sequence: Synthetic oligonucleotide
  Target: ATXN1; (-) strand; PAM type: NRG; PAM sequence: AAG
gtgcatctatctaatttgct

SEQ ID NO: 91592 - DNA, 20 bp, Artificial Sequence
  Description of Artificial Sequence: Synthetic oligonucleotide
  Target: ATXN1; (-) strand; PAM type: NRG; PAM sequence: CAG
aggttctttagcaagtaagt

SEQ ID NO: 91593 - DNA, 20 bp, Artificial Sequence
  Description of Artificial Sequence: Synthetic oligonucleotide
  Target: ATXN1; (-) strand; PAM type: NRG; PAM sequence: AAG
cctcaggttctttagcaagt

SEQ ID NO: 91594 - DNA, 20 bp, Artificial Sequence
  Description of Artificial Sequence: Synthetic oligonucleotide
  Target: ATXN1; (-) strand; PAM type: NRG; PAM sequence: AAG
cattcctcaggttctttagc

SEQ ID NO: 91595 - DNA, 20 bp, Artificial Sequence
  Description of Artificial Sequence: Synthetic oligonucleotide
  Target: ATXN1; (-) strand; PAM type: NRG; PAM sequence: TAG
gcgtcattcctcaggttctt

SEQ ID NO: 91596 - DNA, 20 bp, Artificial Sequence
  Description of Artificial Sequence: Synthetic oligonucleotide
  Target: ATXN1; (-) strand; PAM type: NRG; PAM sequence: AGG
aaattaaggcgtcattcctc

SEQ ID NO: 91597 - DNA, 20 bp, Artificial Sequence
  Description of Artificial Sequence: Synthetic oligonucleotide
  Target: ATXN1; (-) strand; PAM type: NRG; PAM sequence: CAG
aaaattaaggcgtcattcct

SEQ ID NO: 91598 - DNA, 20 bp, Artificial Sequence
  Description of Artificial Sequence: Synthetic oligonucleotide
  Target: ATXN1; (-) strand; PAM type: NRG; PAM sequence: AGG
atatcctataataaaaatta

SEQ ID NO: 91599 - DNA, 20 bp, Artificial Sequence
  Description of Artificial Sequence: Synthetic oligonucleotide
  Target: ATXN1; (-) strand; PAM type: NRG; PAM sequence: AAG
tatatcctataataaaaatt

SEQ ID NO: 91600 - DNA, 20 bp, Artificial Sequence
  Description of Artificial Sequence: Synthetic oligonucleotide
  Target: ATXN1; (-) strand; PAM type: NRG; PAM sequence: CAG
aatcaaacctgactctatat

SEQ ID NO: 91601 - DNA, 20 bp, Artificial Sequence
  Description of Artificial Sequence: Synthetic oligonucleotide
  Target: ATXN1; (-) strand; PAM type: NRG; PAM sequence: CAG
aatcaaacctgattctatat

SEQ ID NO: 91602 - DNA, 20 bp, Artificial Sequence
  Description of Artificial Sequence: Synthetic oligonucleotide
  Target: ATXN1; (-) strand; PAM type: NRG; PAM sequence: CAG
ataaagcctctgagtcatga

SEQ ID NO: 91603 - DNA, 20 bp, Artificial Sequence
  Description of Artificial Sequence: Synthetic oligonucleotide
  Target: ATXN1; (-) strand; PAM type: NRG; PAM sequence: GAG
tgtcaaattataaagcctct

SEQ ID NO: 91604 - DNA, 20 bp, Artificial Sequence
  Description of Artificial Sequence: Synthetic oligonucleotide
  Target: ATXN1; (-) strand; PAM type: NRG; PAM sequence: AAG
ataaaatatgtcaaattata

SEQ ID NO: 91605 - DNA, 20 bp, Artificial Sequence
  Description of Artificial Sequence: Synthetic oligonucleotide
  Target: ATXN1; (-) strand; PAM type: NRG; PAM sequence: CAG
aggaaaaatctaaagttatc

SEQ ID NO: 91606 - DNA, 20 bp, Artificial Sequence
  Description of Artificial Sequence: Synthetic oligonucleotide
  Target: ATXN1; (-) strand; PAM type: NRG; PAM sequence: AAG
aaaataacaggaaaaatcta

SEQ ID NO: 91607 - DNA, 20 bp, Artificial Sequence
  Description of Artificial Sequence: Synthetic oligonucleotide
  Target: ATXN1; (-) strand; PAM type: NRG; PAM sequence: AGG
caacccagtaccaaaataac

SEQ ID NO: 91608 - DNA, 20 bp, Artificial Sequence
  Description of Artificial Sequence: Synthetic oligonucleotide
  Target: ATXN1; (-) strand; PAM type: NRG; PAM sequence: CAG
gcaacccagtaccaaaataa

SEQ ID NO: 91609 - DNA, 20 bp, Artificial Sequence
  Description of Artificial Sequence: Synthetic oligonucleotide
  Target: ATXN1; (-) strand; PAM type: NRG; PAM sequence: CAG
gccacctgtgtgctgcaacc

SEQ ID NO: 91610 - DNA, 20 bp, Artificial Sequence
  Description of Artificial Sequence: Synthetic oligonucleotide
  Target: ATXN1; (-) strand; PAM type: NRG; PAM sequence: AGG
atcctcacagccctaagact

SEQ ID NO: 91611 - DNA, 20 bp, Artificial Sequence
  Description of Artificial Sequence: Synthetic oligonucleotide
  Target: ATXN1; (-) strand; PAM type: NRG; PAM sequence: TAG
gatcctcacagccctaagac

SEQ ID NO: 91612 - DNA, 20 bp, Artificial Sequence
  Description of Artificial Sequence: Synthetic oligonucleotide
  Target: ATXN1; (-) strand; PAM type: NRG; PAM sequence: AAG
ggcgggatcctcacagccct

SEQ ID NO: 91613 - DNA, 20 bp, Artificial Sequence
  Description of Artificial Sequence: Synthetic oligonucleotide
  Target: ATXN1; (-) strand; PAM type: NRG; PAM sequence: CAG
aggccatggcgggatcctca

SEQ ID NO: 91614 - DNA, 20 bp, Artificial Sequence
  Description of Artificial Sequence: Synthetic oligonucleotide
  Target: ATXN1; (-) strand; PAM type: NRG; PAM sequence: GGG
gactgagctcaggccatggc

SEQ ID NO: 91615 - DNA, 20 bp, Artificial Sequence
  Description of Artificial Sequence: Synthetic oligonucleotide
  Target: ATXN1; (-) strand; PAM type: NRG; PAM sequence: CGG
tgactgagctcaggccatgg

SEQ ID NO: 91616 - DNA, 20 bp, Artificial Sequence
  Description of Artificial Sequence: Synthetic oligonucleotide
  Target: ATXN1; (-) strand; PAM type: NRG; PAM sequence: TGG
tagtgactgagctcaggcca

SEQ ID NO: 91617 - DNA, 20 bp, Artificial Sequence
  Description of Artificial Sequence: Synthetic oligonucleotide
  Target: ATXN1; (-) strand; PAM type: NRG; PAM sequence: AGG
tggtaatagtgactgagctc

SEQ ID NO: 91618 - DNA, 20 bp, Artificial Sequence
  Description of Artificial Sequence: Synthetic oligonucleotide
  Target: ATXN1; (-) strand; PAM type: NRG; PAM sequence: CAG
ctggtaatagtgactgagct

SEQ ID NO: 91619 - DNA, 20 bp, Artificial Sequence
  Description of Artificial Sequence: Synthetic oligonucleotide
  Target: ATXN1; (-) strand; PAM type: NRG; PAM sequence: GAG
tgaagctggtaatagtgact

SEQ ID NO: 91620 - DNA, 20 bp, Artificial Sequence
  Description of Artificial Sequence: Synthetic oligonucleotide
  Target: ATXN1; (-) strand; PAM type: NRG; PAM sequence: TAG
ttctctggtgaagctggtaa

SEQ ID NO: 91621 - DNA, 20 bp, Artificial Sequence
  Description of Artificial Sequence: Synthetic oligonucleotide
  Target: ATXN1; (-) strand; PAM type: NRG; PAM sequence: TGG
ctgtctttctctggtgaagc

SEQ ID NO: 91622 - DNA, 20 bp, Artificial Sequence
  Description of Artificial Sequence: Synthetic oligonucleotide
  Target: ATXN1; (-) strand; PAM type: NRG; PAM sequence: AAG
cttcctgtctttctctggtg

SEQ ID NO: 91623 - DNA, 20 bp, Artificial Sequence
  Description of Artificial Sequence: Synthetic oligonucleotide
  Target: ATXN1; (-) strand; PAM type: NRG; PAM sequence: TGG
ctccacttcctgtctttctc

SEQ ID NO: 91624 - DNA, 20 bp, Artificial Sequence
  Description of Artificial Sequence: Synthetic oligonucleotide
  Target: ATXN1; (-) strand; PAM type: NRG; PAM sequence: TGG
ctgggaaactcatgttagcc

SEQ ID NO: 91625 - DNA, 20 bp, Artificial Sequence
  Description of Artificial Sequence: Synthetic oligonucleotide
  Target: ATXN1; (-) strand; PAM type: NRG; PAM sequence: TAG
tttctctgggaaactcatgt

SEQ ID NO: 91626 - DNA, 20 bp, Artificial Sequence
  Description of Artificial Sequence: Synthetic oligonucleotide
  Target: ATXN1; (-) strand; PAM type: NRG; PAM sequence: GGG
aaaataagttgtgtttctct

SEQ ID NO: 91627 - DNA, 20 bp, Artificial Sequence
  Description of Artificial Sequence: Synthetic oligonucleotide
  Target: ATXN1; (-) strand; PAM type: NRG; PAM sequence: TGG
taaaataagttgtgtttctc

SEQ ID NO: 91628 - DNA, 20 bp, Artificial Sequence
  Description of Artificial Sequence: Synthetic oligonucleotide
  Target: ATXN1; (-) strand; PAM type: NRG; PAM sequence: AAG
aacaggtttgacattaaaat

SEQ ID NO: 91629 - DNA, 20 bp, Artificial Sequence
  Description of Artificial Sequence: Synthetic oligonucleotide
  Target: ATXN1; (-) strand; PAM type: NRG; PAM sequence: AGG
ggatcataatttagtttaac

SEQ ID NO: 91630 - DNA, 20 bp, Artificial Sequence
  Description of Artificial Sequence: Synthetic oligonucleotide
  Target: ATXN1; (-) strand; PAM type: NRG; PAM sequence: CAG
tggatcataatttagtttaa

SEQ ID NO: 91631 - DNA, 20 bp, Artificial Sequence
  Description of Artificial Sequence: Synthetic oligonucleotide
  Target: ATXN1; (-) strand; PAM type: NRG; PAM sequence: TAG
ctctcaaatggatcataatt

SEQ ID NO: 91632 - DNA, 20 bp, Artificial Sequence
  Description of Artificial Sequence: Synthetic oligonucleotide
  Target: ATXN1; (-) strand; PAM type: NRG; PAM sequence: TGG
ctgacctgccttctctcaaa

SEQ ID NO: 91633 - DNA, 20 bp, Artificial Sequence
  Description of Artificial Sequence: Synthetic oligonucleotide
  Target: ATXN1; (-) strand; PAM type: NRG; PAM sequence: TAG
acttaataaacggttagttt

SEQ ID NO: 91634 - DNA, 20 bp, Artificial Sequence
  Description of Artificial Sequence: Synthetic oligonucleotide
  Target: ATXN1; (-) strand; PAM type: NRG; PAM sequence: TAG
ttcaaaacttaataaacggt

SEQ ID NO: 91635 - DNA, 20 bp, Artificial Sequence
  Description of Artificial Sequence: Synthetic oligonucleotide
  Target: ATXN1; (-) strand; PAM type: NRG; PAM sequence: CGG
attcttcaaaacttaataaa

SEQ ID NO: 91636 - DNA, 20 bp, Artificial Sequence
  Description of Artificial Sequence: Synthetic oligonucleotide
  Target: ATXN1; (-) strand; PAM type: NRG; PAM sequence: TAG
gatcatgttataaaaccata

SEQ ID NO: 91637 - DNA, 20 bp, Artificial Sequence
  Description of Artificial Sequence: Synthetic oligonucleotide
  Target: ATXN1; (-) strand; PAM type: NRG; PAM sequence: GGG
ctttcattttaattttccaa

SEQ ID NO: 91638 - DNA, 20 bp, Artificial Sequence
  Description of Artificial Sequence: Synthetic oligonucleotide
  Target: ATXN1; (-) strand; PAM type: NRG; PAM sequence: AGG
actttcattttaattttcca

SEQ ID NO: 91639 - DNA, 20 bp, Artificial Sequence
  Description of Artificial Sequence: Synthetic oligonucleotide
  Target: ATXN1; (-) strand; PAM type: NRG; PAM sequence: AAG
tactttcattttaattttcc

SEQ ID NO: 91640 - DNA, 20 bp, Artificial Sequence
  Description of Artificial Sequence: Synthetic oligonucleotide
  Target: ATXN1; (-) strand; PAM type: NRG; PAM sequence: AAG
acaccatttaaagccatagg

SEQ ID NO: 91641 - DNA, 20 bp, Artificial Sequence
  Description of Artificial Sequence: Synthetic oligonucleotide
  Target: ATXN1; (-) strand; PAM type: NRG; PAM sequence: AGG
gacacaccatttaaagccat

SEQ ID NO: 91642 - DNA, 20 bp, Artificial Sequence
  Description of Artificial Sequence: Synthetic oligonucleotide
  Target: ATXN1; (-) strand; PAM type: NRG; PAM sequence: TAG
agacacaccatttaaagcca

SEQ ID NO: 91643 - DNA, 20 bp, Artificial Sequence
  Description of Artificial Sequence: Synthetic oligonucleotide
  Target: ATXN1; (-) strand; PAM type: NRG; PAM sequence: AAG
caagcaagacacaccattta

SEQ ID NO: 91644 - DNA, 20 bp, Artificial Sequence
  Description of Artificial Sequence: Synthetic oligonucleotide
  Target: ATXN1; (-) strand; PAM type: NRG; PAM sequence: AAG
cagtgtccaacattacaagc

SEQ ID NO: 91645 - DNA, 20 bp, Artificial Sequence
  Description of Artificial Sequence: Synthetic oligonucleotide
  Target: ATXN1; (-) strand; PAM type: NRG; PAM sequence: AAG
agtccagtgtccaacattac

SEQ ID NO: 91646 - DNA, 20 bp, Artificial Sequence
  Description of Artificial Sequence: Synthetic oligonucleotide
  Target: ATXN1; (-) strand; PAM type: NRG; PAM sequence: CAG
aagaaggctctagaggagtc

SEQ ID NO: 91647 - DNA, 20 bp, Artificial Sequence
  Description of Artificial Sequence: Synthetic oligonucleotide
  Target: ATXN1; (-) strand; PAM type: NRG; PAM sequence: GAG
tacttaagaaggctctagag

SEQ ID NO: 91648 - DNA, 20 bp, Artificial Sequence
  Description of Artificial Sequence: Synthetic oligonucleotide
  Target: ATXN1; (-) strand; PAM type: NRG; PAM sequence: AGG
cgtacttaagaaggctctag

SEQ ID NO: 91649 - DNA, 20 bp, Artificial Sequence
  Description of Artificial Sequence: Synthetic oligonucleotide
  Target: ATXN1; (-) strand; PAM type: NRG; PAM sequence: GAG
tcgtacttaagaaggctcta

SEQ ID NO: 91650 - DNA, 20 bp, Artificial Sequence
  Description of Artificial Sequence: Synthetic oligonucleotide
  Target: ATXN1; (-) strand; PAM type: NRG; PAM sequence: TAG
tctcgtacttaagaaggctc

SEQ ID NO: 91651 - DNA, 20 bp, Artificial Sequence
  Description of Artificial Sequence: Synthetic oligonucleotide
  Target: ATXN1; (-) strand; PAM type: NRG; PAM sequence: AGG
ctcagctctcgtacttaaga

SEQ ID NO: 91652 - DNA, 20 bp, Artificial Sequence
  Description of Artificial Sequence: Synthetic oligonucleotide
  Target: ATXN1; (-) strand; PAM type: NRG; PAM sequence: AAG
actcagctctcgtacttaag

SEQ ID NO: 91653 - DNA, 20 bp, Artificial Sequence
  Description of Artificial Sequence: Synthetic oligonucleotide
  Target: ATXN1; (-) strand; PAM type: NRG; PAM sequence: AAG
aaaactcagctctcgtactt

SEQ ID NO: 91654 - DNA, 20 bp, Artificial Sequence
  Description of Artificial Sequence: Synthetic oligonucleotide
  Target: ATXN1; (-) strand; PAM type: NRG; PAM sequence: CAG
ctaaataaacacagaaaact

SEQ ID NO: 91655 - DNA, 20 bp, Artificial Sequence
  Description of Artificial Sequence: Synthetic oligonucleotide
  Target: ATXN1; (-) strand; PAM type: NRG; PAM sequence: CAG
tctcgaaacctaaataaaca

SEQ ID NO: 91656 - DNA, 20 bp, Artificial Sequence
  Description of Artificial Sequence: Synthetic oligonucleotide
  Target: ATXN1; (-) strand; PAM type: NRG; PAM sequence: CAG
agtatcggagtaataaatag

SEQ ID NO: 91657 - DNA, 20 bp, Artificial Sequence
  Description of Artificial Sequence: Synthetic oligonucleotide
  Target: ATXN1; (-) strand; PAM type: NRG; PAM sequence: TAG
cgcagtatcggagtaataaa

SEQ ID NO: 91658 - DNA, 20 bp, Artificial Sequence
  Description of Artificial Sequence: Synthetic oligonucleotide
  Target: ATXN1; (-) strand; PAM type: NRG; PAM sequence: GAG
aatgaaaacacgcagtatcg

SEQ ID NO: 91659 - DNA, 20 bp, Artificial Sequence
  Description of Artificial Sequence: Synthetic oligonucleotide
  Target: ATXN1; (-) strand; PAM type: NRG; PAM sequence: CGG
ggaatgaaaacacgcagtat

SEQ ID NO: 91660 - DNA, 20 bp, Artificial Sequence
  Description of Artificial Sequence: Synthetic oligonucleotide
  Target: ATXN1; (-) strand; PAM type: NRG; PAM sequence: CAG
tcctctggaatgaaaacacg

SEQ ID NO: 91661 - DNA, 20 bp, Artificial Sequence
  Description of Artificial Sequence: Synthetic oligonucleotide
  Target: ATXN1; (-) strand; PAM type: NRG; PAM sequence: TGG
aattaacaatcacactcctc

SEQ ID NO: 91662 - DNA, 20 bp, Artificial Sequence
  Description of Artificial Sequence: Synthetic oligonucleotide
  Target: ATXN1; (-) strand; PAM type: NRG; PAM sequence: AGG
ctggatgttttgactcctta

SEQ ID NO: 91663 - DNA, 20 bp, Artificial Sequence
  Description of Artificial Sequence: Synthetic oligonucleotide
  Target: ATXN1; (-) strand; PAM type: NRG; PAM sequence: AAG
tctggatgttttgactcctt

SEQ ID NO: 91664 - DNA, 20 bp, Artificial Sequence
  Description of Artificial Sequence: Synthetic oligonucleotide
  Target: ATXN1; (-) strand; PAM type: NRG; PAM sequence: TGG
gtgtagttcatgcttttctc

SEQ ID NO: 91665 - DNA, 20 bp, Artificial Sequence
  Description of Artificial Sequence: Synthetic oligonucleotide
  Target: ATXN1; (-) strand; PAM type: NRG; PAM sequence: TAG
ctagcctttattgctgtgtg

SEQ ID NO: 91666 - DNA, 20 bp, Artificial Sequence
  Description of Artificial Sequence: Synthetic oligonucleotide
  Target: ATXN1; (-) strand; PAM type: NRG; PAM sequence: TAG
catgttgttgagacattttc

SEQ ID NO: 91667 - DNA, 20 bp, Artificial Sequence
  Description of Artificial Sequence: Synthetic oligonucleotide
  Target: ATXN1; (-) strand; PAM type: NRG; PAM sequence: GAG
tgagtcatttccatgttgtt

SEQ ID NO: 91668 - DNA, 20 bp, Artificial Sequence
  Description of Artificial Sequence: Synthetic oligonucleotide
  Target: ATXN1; (-) strand; PAM type: NRG; PAM sequence: GAG
tcccccatgtctttagcagt

SEQ ID NO: 91669 - DNA, 20 bp, Artificial Sequence
  Description of Artificial Sequence: Synthetic oligonucleotide
  Target: ATXN1; (-) strand; PAM type: NRG; PAM sequence: CAG
ttaatcccccatgtctttag

SEQ ID NO: 91670 - DNA, 20 bp, Artificial Sequence
  Description of Artificial Sequence: Synthetic oligonucleotide
  Target: ATXN1; (-) strand; PAM type: NRG; PAM sequence: TAG
ttcttaatcccccatgtctt

SEQ ID NO: 91671 - DNA, 20 bp, Artificial Sequence
  Description of Artificial Sequence: Synthetic oligonucleotide
  Target: ATXN1; (-) strand; PAM type: NRG; PAM sequence: GAG
ttaccctgaattgaatggga

SEQ ID NO: 91672 - DNA, 20 bp, Artificial Sequence
  Description of Artificial Sequence: Synthetic oligonucleotide
  Target: ATXN1; (-) strand; PAM type: NRG; PAM sequence: GAG
atttaccctgaattgaatgg

SEQ ID NO: 91673 - DNA, 20 bp, Artificial Sequence
  Description of Artificial Sequence: Synthetic oligonucleotide
  Target: ATXN1; (-) strand; PAM type: NRG; PAM sequence: GGG
aaatttaccctgaattgaat

SEQ ID NO: 91674 - DNA, 20 bp, Artificial Sequence
  Description of Artificial Sequence: Synthetic oligonucleotide
  Target: ATXN1; (-) strand; PAM type: NRG; PAM sequence: TGG
caaatttaccctgaattgaa

SEQ ID NO: 91675 - DNA, 20 bp, Artificial Sequence
  Description of Artificial Sequence: Synthetic oligonucleotide
  Target: ATXN1; (-) strand; PAM type: NRG; PAM sequence: TAG
tctgattcaaaaactggatt

SEQ ID NO: 91676 - DNA, 20 bp, Artificial Sequence
  Description of Artificial Sequence: Synthetic oligonucleotide
  Target: ATXN1; (-) strand; PAM type: NRG; PAM sequence: TGG
tcggtttctgattcaaaaac

SEQ ID NO: 91677 - DNA, 20 bp, Artificial Sequence
  Description of Artificial Sequence: Synthetic oligonucleotide
  Target: ATXN1; (-) strand; PAM type: NRG; PAM sequence: CGG
ccaagatgtttttctaaatt

SEQ ID NO: 91678 - DNA, 20 bp, Artificial Sequence
  Description of Artificial Sequence: Synthetic oligonucleotide
  Target: ATXN1; (-) strand; PAM type: NRG; PAM sequence: AAG
tttcacagggcatttcaacc

SEQ ID NO: 91679 - DNA, 20 bp, Artificial Sequence
  Description of Artificial Sequence: Synthetic oligonucleotide
  Target: ATXN1; (-) strand; PAM type: NRG; PAM sequence: GGG
actttaaaactattttcaca

SEQ ID NO: 91680 - DNA, 20 bp, Artificial Sequence
  Description of Artificial Sequence: Synthetic oligonucleotide
  Target: ATXN1; (-) strand; PAM type: NRG; PAM sequence: AGG
tactttaaaactattttcac

SEQ ID NO: 91681 - DNA, 20 bp, Artificial Sequence
  Description of Artificial Sequence: Synthetic oligonucleotide
  Target: ATXN1; (-) strand; PAM type: NRG; PAM sequence: CAG
atactttaaaactattttca

SEQ ID NO: 91682 - DNA, 20 bp, Artificial Sequence
  Description of Artificial Sequence: Synthetic oligonucleotide
  Target: ATXN1; (-) strand; PAM type: NRG; PAM sequence: GAG
ttactgatgagaggaaggaa

SEQ ID NO: 91683 - DNA, 20 bp, Artificial Sequence
  Description of Artificial Sequence: Synthetic oligonucleotide
  Target: ATXN1; (-) strand; PAM type: NRG; PAM sequence: AAG
ccttactgatgagaggaagg

SEQ ID NO: 91684 - DNA, 20 bp, Artificial Sequence
  Description of Artificial Sequence: Synthetic oligonucleotide
  Target: ATXN1; (-) strand; PAM type: NRG; PAM sequence: AGG
tgaccttactgatgagagga

SEQ ID NO: 91685 - DNA, 20 bp, Artificial Sequence
  Description of Artificial Sequence: Synthetic oligonucleotide
  Target: ATXN1; (-) strand; PAM type: NRG; PAM sequence: AAG
ttgaccttactgatgagagg

SEQ ID NO: 91686 - DNA, 20 bp, Artificial Sequence
  Description of Artificial Sequence: Synthetic oligonucleotide
  Target: ATXN1; (-) strand; PAM type: NRG; PAM sequence: AGG
ttattgaccttactgatgag

SEQ ID NO: 91687 - DNA, 20 bp, Artificial Sequence
  Description of Artificial Sequence: Synthetic oligonucleotide
  Target: ATXN1; (-) strand; PAM type: NRG; PAM sequence: GAG
attattgaccttactgatga

SEQ ID NO: 91688 - DNA, 20 bp, Artificial Sequence
  Description of Artificial Sequence: Synthetic oligonucleotide
  Target: ATXN1; (-) strand; PAM type: NRG; PAM sequence: GAG
tgattattgaccttactgat

SEQ ID NO: 91689 - DNA, 20 bp, Artificial Sequence
  Description of Artificial Sequence: Synthetic oligonucleotide
  Target: ATXN1; (-) strand; PAM type: NRG; PAM sequence: AAG
caaatatgcacaatgagtgc

SEQ ID NO: 91690 - DNA, 20 bp, Artificial Sequence
  Description of Artificial Sequence: Synthetic oligonucleotide
  Target: ATXN1; (-) strand; PAM type: NRG; PAM sequence: GAG
ctgggccaaatatgcacaat

SEQ ID NO: 91691 - DNA, 20 bp, Artificial Sequence
  Description of Artificial Sequence: Synthetic oligonucleotide
  Target: ATXN1; (-) strand; PAM type: NRG; PAM sequence: GGG
agaatgtgggagtagctact

SEQ ID NO: 91692 - DNA, 20 bp, Artificial Sequence
  Description of Artificial Sequence: Synthetic oligonucleotide
  Target: ATXN1; (-) strand; PAM type: NRG; PAM sequence: TGG
gagaatgtgggagtagctac

SEQ ID NO: 91693 - DNA, 20 bp, Artificial Sequence
  Description of Artificial Sequence: Synthetic oligonucleotide
  Target: ATXN1; (-) strand; PAM type: NRG; PAM sequence: TAG
tgaatgtgagaatgtgggag

SEQ ID NO: 91694 - DNA, 20 bp, Artificial Sequence
  Description of Artificial Sequence: Synthetic oligonucleotide
  Target: ATXN1; (-) strand; PAM type: NRG; PAM sequence: GAG
tgttgaatgtgagaatgtgg

SEQ ID NO: 91695 - DNA, 20 bp, Artificial Sequence
  Description of Artificial Sequence: Synthetic oligonucleotide
  Target: ATXN1; (-) strand; PAM type: NRG; PAM sequence: GGG
attgttgaatgtgagaatgt

SEQ ID NO: 91696 - DNA, 20 bp, Artificial Sequence
  Description of Artificial Sequence: Synthetic oligonucleotide
  Target: ATXN1; (-) strand; PAM type: NRG; PAM sequence: TGG
tattgttgaatgtgagaatg

SEQ ID NO: 91697 - DNA, 20 bp, Artificial Sequence
  Description of Artificial Sequence: Synthetic oligonucleotide
  Target: ATXN1; (-) strand; PAM type: NRG; PAM sequence: GAG
gcataaatattgttgaatgt

SEQ ID NO: 91698 - DNA, 20 bp, Artificial Sequence
  Description of Artificial Sequence: Synthetic oligonucleotide
  Target: ATXN1; (-) strand; PAM type: NRG; PAM sequence: GGG
gatgattctctcccttatct

SEQ ID NO: 91699 - DNA, 20 bp, Artificial Sequence
  Description of Artificial Sequence: Synthetic oligonucleotide
  Target: ATXN1; (-) strand; PAM type: NRG; PAM sequence: TGG
ggatgattctctcccttatc

SEQ ID NO: 91700 - DNA, 20 bp, Artificial Sequence
  Description of Artificial Sequence: Synthetic oligonucleotide
  Target: ATXN1; (-) strand; PAM type: NRG; PAM sequence: AGG
aaacatagtcagcttgtgaa

SEQ ID NO: 91701 - DNA, 20 bp, Artificial Sequence
  Description of Artificial Sequence: Synthetic oligonucleotide
  Target: ATXN1; (-) strand; PAM type: NRG; PAM sequence: AAG
taaacatagtcagcttgtga

SEQ ID NO: 91702 - DNA, 20 bp, Artificial Sequence
  Description of Artificial Sequence: Synthetic oligonucleotide
  Target: ATXN1; (-) strand; PAM type: NRG; PAM sequence: CAG
aatgttggaataaacatagt

SEQ ID NO: 91703 - DNA, 20 bp, Artificial Sequence
  Description of Artificial Sequence: Synthetic oligonucleotide
  Target: ATXN1; (-) strand; PAM type: NRG; PAM sequence: TAG
ggaaaatgttggaataaaca

SEQ ID NO: 91704 - DNA, 20 bp, Artificial Sequence
  Description of Artificial Sequence: Synthetic oligonucleotide
  Target: ATXN1; (-) strand; PAM type: NRG; PAM sequence: TGG
aaaatggtgcaggaaaatgt

SEQ ID NO: 91705 - DNA, 20 bp, Artificial Sequence
  Description of Artificial Sequence: Synthetic oligonucleotide
  Target: ATXN1; (-) strand; PAM type: NRG; PAM sequence: AGG
ctcttcctttaaaatggtgc

SEQ ID NO: 91706 - DNA, 20 bp, Artificial Sequence
  Description of Artificial Sequence: Synthetic oligonucleotide
  Target: ATXN1; (-) strand; PAM type: NRG; PAM sequence: CAG
tctcttcctttaaaatggtg

SEQ ID NO: 91707 - DNA, 20 bp, Artificial Sequence
  Description of Artificial Sequence: Synthetic oligonucleotide
  Target: ATXN1; (-) strand; PAM type: NRG; PAM sequence: TGG
ttttttctcttcctttaaaa

SEQ ID NO: 91708 - DNA, 20 bp, Artificial Sequence
  Description of Artificial Sequence: Synthetic oligonucleotide
  Target: ATXN1; (-) strand; PAM type: NRG; PAM sequence: AAG
cttttcccttaggagcgctt

SEQ ID NO: 91709 - DNA, 20 bp, Artificial Sequence
  Description of Artificial Sequence: Synthetic oligonucleotide
  Target: ATXN1; (-) strand; PAM type: NRG; PAM sequence: GAG
tattgagtcttttcccttag

SEQ ID NO: 91710 - DNA, 20 bp, Artificial Sequence
  Description of Artificial Sequence: Synthetic oligonucleotide
  Target: ATXN1; (-) strand; PAM type: NRG; PAM sequence: AGG
tgtattgagtcttttccctt

SEQ ID NO: 91711 - DNA, 20 bp, Artificial Sequence
  Description of Artificial Sequence: Synthetic oligonucleotide
  Target: ATXN1; (-) strand; PAM type: NRG; PAM sequence: TAG
atgtattgagtcttttccct

SEQ ID NO: 91712 - DNA, 20 bp, Artificial Sequence
  Description of Artificial Sequence: Synthetic oligonucleotide
  Target: ATXN1; (-) strand; PAM type: NRG; PAM sequence: GAG
taaaaaggtctgtatgtatt

SEQ ID NO: 91713 - DNA, 20 bp, Artificial Sequence
  Description of Artificial Sequence: Synthetic oligonucleotide
  Target: ATXN1; (-) strand; PAM type: NRG; PAM sequence: AGG
tggatctgaattgattaaaa

SEQ ID NO: 91714 - DNA, 20 bp, Artificial Sequence
  Description of Artificial Sequence: Synthetic oligonucleotide
  Target: ATXN1; (-) strand; PAM type: NRG; PAM sequence: AAG
ttggatctgaattgattaaa

SEQ ID NO: 91715 - DNA, 20 bp, Artificial Sequence
  Description of Artificial Sequence: Synthetic oligonucleotide
  Target: ATXN1; (-) strand; PAM type: NRG; PAM sequence: TGG
gcacttgttccttgtgtact

SEQ ID NO: 91716 - DNA, 20 bp, Artificial Sequence
  Description of Artificial Sequence: Synthetic oligonucleotide
  Target: ATXN1; (-) strand; PAM type: NRG; PAM sequence: CAG
tttatttagcaaatatttac

SEQ ID NO: 91717 - DNA, 20 bp, Artificial Sequence
  Description of Artificial Sequence: Synthetic oligonucleotide
  Target: ATXN1; (-) strand; PAM type: NRG; PAM sequence: TAG
aaatatcagctgcctttatt

SEQ ID NO: 91718 - DNA, 20 bp, Artificial Sequence
  Description of Artificial Sequence: Synthetic oligonucleotide
  Target: ATXN1; (-) strand; PAM type: NRG; PAM sequence: CAG
caaagcgggcagagaaatat

SEQ ID NO: 91719 - DNA, 20 bp, Artificial Sequence
  Description of Artificial Sequence: Synthetic oligonucleotide
  Target: ATXN1; (-) strand; PAM type: NRG; PAM sequence: GAG
ggctaggggcaaagcgggca

SEQ ID NO: 91720 - DNA, 20 bp, Artificial Sequence
  Description of Artificial Sequence: Synthetic oligonucleotide
  Target: ATXN1; (-) strand; PAM type: NRG; PAM sequence: CAG
agggctaggggcaaagcggg

SEQ ID NO: 91721 - DNA, 20 bp, Artificial Sequence
  Description of Artificial Sequence: Synthetic oligonucleotide
  Target: ATXN1; (-) strand; PAM type: NRG; PAM sequence: GGG
cagagggctaggggcaaagc

SEQ ID NO: 91722 - DNA, 20 bp, Artificial Sequence
  Description of Artificial Sequence: Synthetic oligonucleotide
  Target: ATXN1; (-) strand; PAM type: NRG; PAM sequence: CGG
tcagagggctaggggcaaag

SEQ ID NO: 91723 - DNA, 20 bp, Artificial Sequence
  Description of Artificial Sequence: Synthetic oligonucleotide
  Target: ATXN1; (-) strand; PAM type: NRG; PAM sequence: AAG
gagtcagagggctaggggca

SEQ ID NO: 91724 - DNA, 20 bp, Artificial Sequence
  Description of Artificial Sequence: Synthetic oligonucleotide
  Target: ATXN1; (-) strand; PAM type: NRG; PAM sequence: GGG
aggaggagtcagagggctag

SEQ ID NO: 91725 - DNA, 20 bp, Artificial Sequence
  Description of Artificial Sequence: Synthetic oligonucleotide
  Target: ATXN1; (-) strand; PAM type: NRG; PAM sequence: GGG
gaggaggagtcagagggcta

SEQ ID NO: 91726 - DNA, 20 bp, Artificial Sequence
  Description of Artificial Sequence: Synthetic oligonucleotide
  Target: ATXN1; (-) strand; PAM type: NRG; PAM sequence: AGG
ggaggaggagtcagagggct

SEQ ID NO: 91727 - DNA, 20 bp, Artificial Sequence
  Description of Artificial Sequence: Synthetic oligonucleotide
  Target: ATXN1; (-) strand; PAM type: NRG; PAM sequence: TAG
gggaggaggagtcagagggc

SEQ ID NO: 91728 - DNA, 20 bp, Artificial Sequence
  Description of Artificial Sequence: Synthetic oligonucleotide
  Target: ATXN1; (-) strand; PAM type: NRG; PAM sequence: GGG
tgtggggaggaggagtcaga

SEQ ID NO: 91729 - DNA, 20 bp, Artificial Sequence
  Description of Artificial Sequence: Synthetic oligonucleotide
  Target: ATXN1; (-) strand; PAM type: NRG; PAM sequence: AGG
ttgtggggaggaggagtcag

SEQ ID NO: 91730 - DNA, 20 bp, Artificial Sequence
  Description of Artificial Sequence: Synthetic oligonucleotide
  Target: ATXN1; (-) strand; PAM type: NRG; PAM sequence: GAG
attgtggggaggaggagtca

SEQ ID NO: 91731 - DNA, 20 bp, Artificial Sequence
  Description of Artificial Sequence: Synthetic oligonucleotide
  Target: ATXN1; (-) strand; PAM type: NRG; PAM sequence: CAG
gtattgtggggaggaggagt

SEQ ID NO: 91732 - DNA, 20 bp, Artificial Sequence
  Description of Artificial Sequence: Synthetic oligonucleotide
  Target: ATXN1; (-) strand; PAM type: NRG; PAM sequence: GAG
gtgggtattgtggggaggag

SEQ ID NO: 91733 - DNA, 20 bp, Artificial Sequence
  Description of Artificial Sequence: Synthetic oligonucleotide
  Target: ATXN1; (-) strand; PAM type: NRG; PAM sequence: AGG
atgtgggtattgtggggagg

SEQ ID NO: 91734 - DNA, 20 bp, Artificial Sequence
  Description of Artificial Sequence: Synthetic oligonucleotide
  Target: ATXN1; (-) strand; PAM type: NRG; PAM sequence: GAG
tatgtgggtattgtggggag

SEQ ID NO: 91735 - DNA, 20 bp, Artificial Sequence
  Description of Artificial Sequence: Synthetic oligonucleotide
  Target: ATXN1; (-) strand; PAM type: NRG; PAM sequence: AGG
attatgtgggtattgtgggg

SEQ ID NO: 91736 - DNA, 20 bp, Artificial Sequence
  Description of Artificial Sequence: Synthetic oligonucleotide
  Target: ATXN1; (-) strand; PAM type: NRG; PAM sequence: GAG
aattatgtgggtattgtggg

SEQ ID NO: 91737 - DNA, 20 bp, Artificial Sequence
  Description of Artificial Sequence: Synthetic oligonucleotide
  Target: ATXN1; (-) strand; PAM type: NRG; PAM sequence: GGG
aaaattatgtgggtattgtg

SEQ ID NO: 91738 - DNA, 20 bp, Artificial Sequence
  Description of Artificial Sequence: Synthetic oligonucleotide
  Target: ATXN1; (-) strand; PAM type: NRG; PAM sequence: GGG
gaaaattatgtgggtattgt

SEQ ID NO: 91739 - DNA, 20 bp, Artificial Sequence
  Description of Artificial Sequence: Synthetic oligonucleotide
  Target: ATXN1; (-) strand; PAM type: NRG; PAM sequence: TGG
ggaaaattatgtgggtattg

SEQ ID NO: 91740 - DNA, 20 bp, Artificial Sequence
  Description of Artificial Sequence: Synthetic oligonucleotide
  Target: ATXN1; (-) strand; PAM type: NRG; PAM sequence: GGG
ggccaaaaggaaaattatgt

SEQ ID NO: 91741 - DNA, 20 bp, Artificial Sequence
  Description of Artificial Sequence: Synthetic oligonucleotide
  Target: ATXN1; (-) strand; PAM type: NRG; PAM sequence: TGG
tggccaaaaggaaaattatg

SEQ ID NO: 91742 - DNA, 20 bp, Artificial Sequence
  Description of Artificial Sequence: Synthetic oligonucleotide
  Target: ATXN1; (-) strand; PAM type: NRG; PAM sequence: AGG
agttctatattatggccaaa

SEQ ID NO: 91743 - DNA, 20 bp, Artificial Sequence
  Description of Artificial Sequence: Synthetic oligonucleotide
  Target: ATXN1; (-) strand; PAM type: NRG; PAM sequence: AAG
gagttctatattatggccaa

SEQ ID NO: 91744 - DNA, 20 bp, Artificial Sequence
  Description of Artificial Sequence: Synthetic oligonucleotide
  Target: ATXN1; (-) strand; PAM type: NRG; PAM sequence: TGG
ggtgattgagttctatatta

SEQ ID NO: 91745 - DNA, 20 bp, Artificial Sequence
  Description of Artificial Sequence: Synthetic oligonucleotide
  Target: ATXN1; (-) strand; PAM type: NRG; PAM sequence: GAG
ttcatcttaatatggtgatt

SEQ ID NO: 91746 - DNA, 20 bp, Artificial Sequence
  Description of Artificial Sequence: Synthetic oligonucleotide
  Target: ATXN1; (-) strand; PAM type: NRG; PAM sequence: TGG
tctagggcttcatcttaata

SEQ ID NO: 91747 - DNA, 20 bp, Artificial Sequence
  Description of Artificial Sequence: Synthetic oligonucleotide
  Target: ATXN1; (-) strand; PAM type: NRG; PAM sequence: GGG
gtataagaagctactttcta

SEQ ID NO: 91748 - DNA, 20 bp, Artificial Sequence
  Description of Artificial Sequence: Synthetic oligonucleotide
  Target: ATXN1; (-) strand; PAM type: NRG; PAM sequence: AGG
ggtataagaagctactttct

SEQ ID NO: 91749 - DNA, 20 bp, Artificial Sequence
  Description of Artificial Sequence: Synthetic oligonucleotide
  Target: ATXN1; (-) strand; PAM type: NRG; PAM sequence: TAG
gggtataagaagctactttc

SEQ ID NO: 91750 - DNA, 20 bp, Artificial Sequence
  Description of Artificial Sequence: Synthetic oligonucleotide
  Target: ATXN1; (-) strand; PAM type: NRG; PAM sequence: AAG
tacagttcacagggtataag

SEQ ID NO: 91751 - DNA, 20 bp, Artificial Sequence
  Description of Artificial Sequence: Synthetic oligonucleotide
  Target: ATXN1; (-) strand; PAM type: NRG; PAM sequence: AAG
tcttacagttcacagggtat

SEQ ID NO: 91752 - DNA, 20 bp, Artificial Sequence
  Description of Artificial Sequence: Synthetic oligonucleotide
  Target: ATXN1; (-) strand; PAM type: NRG; PAM sequence: GGG
cctccctcttacagttcaca

SEQ ID NO: 91753 - DNA, 20 bp, Artificial Sequence
  Description of Artificial Sequence: Synthetic oligonucleotide
  Target: ATXN1; (-) strand; PAM type: NRG; PAM sequence: AGG
ccctccctcttacagttcac

SEQ ID NO: 91754 - DNA, 20 bp, Artificial Sequence
  Description of Artificial Sequence: Synthetic oligonucleotide
  Target: ATXN1; (-) strand; PAM type: NRG; PAM sequence: CAG
cccctccctcttacagttca

SEQ ID NO: 91755 - DNA, 20 bp, Artificial Sequence
  Description of Artificial Sequence: Synthetic oligonucleotide
  Target: ATXN1; (-) strand; PAM type: NRG; PAM sequence: CAG
gctggaacccctccctctta

SEQ ID NO: 91756 - DNA, 20 bp, Artificial Sequence
  Description of Artificial Sequence: Synthetic oligonucleotide
  Target: ATXN1; (-) strand; PAM type: NRG; PAM sequence: TGG
catgagccactgtgcccggc

SEQ ID NO: 91757 - DNA, 20 bp, Artificial Sequence
  Description of Artificial Sequence: Synthetic oligonucleotide
  Target: ATXN1; (-) strand; PAM type: NRG; PAM sequence: CGG
caggcatgagccactgtgcc

SEQ ID NO: 91758 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 91759 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 91760 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 91761 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 91762 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 91763 - DNA, 20 bp, Artificial Sequence
  Description of Artificial Sequence: Synthetic oligonucleotide
  Target: ATXN1; (-) strand; PAM type: NRG; PAM sequence: AAG
ccgcctgccttggcctccca

SEQ ID NO: 91764 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatccgcctgcct

SEQ ID NO: 91765 - DNA, 20 bp, Artificial Sequence
  Description of Artificial Sequence: Synthetic oligonucleotide
  Target: ATXN1; (-) strand; PAM type: NRG; PAM sequence: AGG
ggtcttgaactcctgacctc

SEQ ID NO: 91766 - DNA, 20 bp, Artificial Sequence
  Description of Artificial Sequence: Synthetic oligonucleotide
  Target: ATXN1; (-) strand; PAM type: NRG; PAM sequence: CAG
tggtcttgaactcctgacct

SEQ ID NO: 91767 - DNA, 20 bp, Artificial Sequence
  Description of Artificial Sequence: Synthetic oligonucleotide
  Target: ATXN1; (-) strand; PAM type: NRG; PAM sequence: TGG
ttttgccatgttggccaggc

SEQ ID NO: 91768 - DNA, 20 bp, Artificial Sequence
  Description of Artificial Sequence: Synthetic oligonucleotide
  Target: ATXN1; (-) strand; PAM type: NRG; PAM sequence: AGG
ggggttttgccatgttggcc

SEQ ID NO: 91769 - DNA, 20 bp, Artificial Sequence
  Description of Artificial Sequence: Synthetic oligonucleotide
  Target: ATXN1; (-) strand; PAM type: NRG; PAM sequence: CAG
tggggttttgccatgttggc

SEQ ID NO: 91770 - DNA, 20 bp, Artificial Sequence
  Description of Artificial Sequence: Synthetic oligonucleotide
  Target: ATXN1; (-) strand; PAM type: NRG; PAM sequence: TGG
gagatggggttttgccatgt

SEQ ID NO: 91771 - DNA, 20 bp, Artificial Sequence
  Description of Artificial Sequence: Synthetic oligonucleotide
  Target: ATXN1; (-) strand; PAM type: NRG; PAM sequence: GGG
tttgtattttagtagagatg

SEQ ID NO: 91772 - DNA, 20 bp, Artificial Sequence
  Description of Artificial Sequence: Synthetic oligonucleotide
  Target: ATXN1; (-) strand; PAM type: NRG; PAM sequence: GGG
ttttgtattttagtagagat

SEQ ID NO: 91773 - DNA, 20 bp, Artificial Sequence
  Description of Artificial Sequence: Synthetic oligonucleotide
  Target: ATXN1; (-) strand; PAM type: NRG; PAM sequence: TGG
tttttgtattttagtagaga

SEQ ID NO: 91774 - DNA, 20 bp, Artificial Sequence
  Description of Artificial Sequence: Synthetic oligonucleotide
  Target: ATXN1; (-) strand; PAM type: NRG; PAM sequence: GAG
ctaatttttgtattttagta

SEQ ID NO: 91775 - DNA, 20 bp, Artificial Sequence
  Description of Artificial Sequence: Synthetic oligonucleotide
  Target: ATXN1; (-) strand; PAM type: NRG; PAM sequence: TAG
agctaatttttgtattttag

SEQ ID NO: 91776 - DNA, 20 bp, Artificial Sequence
  Description of Artificial Sequence: Synthetic oligonucleotide
  Target: ATXN1; (-) strand; PAM type: NRG; PAM sequence: TAG
cccagctaatttttgtattt

SEQ ID NO: 91777 - DNA, 20 bp, Artificial Sequence
  Description of Artificial Sequence: Synthetic oligonucleotide
  Target: ATXN1; (-) strand; PAM type: NRG; PAM sequence: CAG
caggcacacgccaccacgcc

SEQ ID NO: 91778 - DNA, 20 bp, Artificial Sequence
  Description of Artificial Sequence: Synthetic oligonucleotide
  Target: ATXN1; (-) strand; PAM type: NRG; PAM sequence: AGG
acctgtgtagctgggattac

SEQ ID NO: 91779 - DNA, 20 bp, Artificial Sequence
  Description of Artificial Sequence: Synthetic oligonucleotide
  Target: ATXN1; (-) strand; PAM type: NRG; PAM sequence: CAG
cacctgtgtagctgggatta

SEQ ID NO: 91780 - DNA, 20 bp, Artificial Sequence
  Description of Artificial Sequence: Synthetic oligonucleotide
  Target: ATXN1; (-) strand; PAM type: NRG; PAM sequence: GGG
cctcagccacctgtgtagct

SEQ ID NO: 91781 - DNA, 20 bp, Artificial Sequence
  Description of Artificial Sequence: Synthetic oligonucleotide
  Target: ATXN1; (-) strand; PAM type: NRG; PAM sequence: TGG
gcctcagccacctgtgtagc

SEQ ID NO: 91782 - DNA, 20 bp, Artificial Sequence
  Description of Artificial Sequence: Synthetic oligonucleotide
  Target: ATXN1; (-) strand; PAM type: NRG; PAM sequence: TAG
tcttgcctcagccacctgtg

SEQ ID NO: 91783 - DNA, 20 bp, Artificial Sequence
  Description of Artificial Sequence: Synthetic oligonucleotide
  Target: ATXN1; (-) strand; PAM type: NRG; PAM sequence: CAG
ttccagcgattctcttgcct

SEQ ID NO: 91784 - DNA, 20 bp, Artificial Sequence
  Description of Artificial Sequence: Synthetic oligonucleotide
  Target: ATXN1; (-) strand; PAM type: NRG; PAM sequence: CAG
gcctctgctcccccgggttc

SEQ ID NO: 91785 - DNA, 20 bp, Artificial Sequence
  Description of Artificial Sequence: Synthetic oligonucleotide
  Target: ATXN1; (-) strand; PAM type: NRG; PAM sequence: GGG
actgcagcctctgctccccc

SEQ ID NO: 91786 - DNA, 20 bp, Artificial Sequence
  Description of Artificial Sequence: Synthetic oligonucleotide
  Target: ATXN1; (-) strand; PAM type: NRG; PAM sequence: CGG
cactgcagcctctgctcccc

SEQ ID NO: 91787 - DNA, 20 bp, Artificial Sequence
  Description of Artificial Sequence: Synthetic oligonucleotide
  Target: ATXN1; (-) strand; PAM type: NRG; PAM sequence: CAG
gatgcaatcttgactcactg

SEQ ID NO: 91788 - DNA, 20 bp, Artificial Sequence
  Description of Artificial Sequence: Synthetic oligonucleotide
  Target: ATXN1; (-) strand; PAM type: NRG; PAM sequence: CAG
ctgccacccagactggagtg

SEQ ID NO: 91789 - DNA, 20 bp, Artificial Sequence
  Description of Artificial Sequence: Synthetic oligonucleotide
  Target: ATXN1; (-) strand; PAM type: NRG; PAM sequence: GAG
ttgctctgccacccagactg

SEQ ID NO: 91790 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgccacccagac

SEQ ID NO: 91791 - DNA, 20 bp, Artificial Sequence
  Description of Artificial Sequence: Synthetic oligonucleotide
  Target: ATXN1; (-) strand; PAM type: NRG; PAM sequence: CAG
cagagtcttgctctgccacc

SEQ ID NO: 91792 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 91793 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaga

SEQ ID NO: 91794 - DNA, 20 bp, Artificial Sequence
  Description of Artificial Sequence: Synthetic oligonucleotide
  Target: ATXN1; (-) strand; PAM type: NRG; PAM sequence: GAG
cccttttttttttttttttt

SEQ ID NO: 91795 - DNA, 20 bp, Artificial Sequence
  Description of Artificial Sequence: Synthetic oligonucleotide
  Target: ATXN1; (-) strand; PAM type: NRG; PAM sequence: GGG
taatgttagtgggcagaact

SEQ ID NO: 91796 - DNA, 20 bp, Artificial Sequence
  Description of Artificial Sequence: Synthetic oligonucleotide
  Target: ATXN1; (-) strand; PAM type: NRG; PAM sequence: TGG
ttaatgttagtgggcagaac

SEQ ID NO: 91797 - DNA, 20 bp, Artificial Sequence
  Description of Artificial Sequence: Synthetic oligonucleotide
  Target: ATXN1; (-) strand; PAM type: NRG; PAM sequence: CAG
aatctcttaatgttagtggg

SEQ ID NO: 91798 - DNA, 20 bp, Artificial Sequence
  Description of Artificial Sequence: Synthetic oligonucleotide
  Target: ATXN1; (-) strand; PAM type: NRG; PAM sequence: GGG
gaaaatctcttaatgttagt

SEQ ID NO: 91799 - DNA, 20 bp, Artificial Sequence
  Description of Artificial Sequence: Synthetic oligonucleotide
  Target: ATXN1; (-) strand; PAM type: NRG; PAM sequence: TGG
tgaaaatctcttaatgttag

SEQ ID NO: 91800 - DNA, 20 bp, Artificial Sequence
  Description of Artificial Sequence: Synthetic oligonucleotide
  Target: ATXN1; (-) strand; PAM type: NRG; PAM sequence: TAG
atatgaaaatctcttaatgt

SEQ ID NO: 91801 - DNA, 20 bp, Artificial Sequence
  Description of Artificial Sequence: Synthetic oligonucleotide
  Target: ATXN1; (-) strand; PAM type: NRG; PAM sequence: AAG
tttagtttagcagtgacact

SEQ ID NO: 91802 - DNA, 20 bp, Artificial Sequence
  Description of Artificial Sequence: Synthetic oligonucleotide
  Target: ATXN1; (-) strand; PAM type: NRG; PAM sequence: CAG
accttagtgttttagtttag

SEQ ID NO: 91803 - DNA, 20 bp, Artificial Sequence
  Description of Artificial Sequence: Synthetic oligonucleotide
  Target: ATXN1; (-) strand; PAM type: NRG; PAM sequence: TAG
tctaccttagtgttttagtt

SEQ ID NO: 91804 - DNA, 20 bp, Artificial Sequence
  Description of Artificial Sequence: Synthetic oligonucleotide
  Target: ATXN1; (-) strand; PAM type: NRG; PAM sequence: TAG
gaagttctaccttagtgttt

SEQ ID NO: 91805 - DNA, 20 bp, Artificial Sequence
  Description of Artificial Sequence: Synthetic oligonucleotide
  Target: ATXN1; (-) strand; PAM type: NRG; PAM sequence: TAG
tacgaagagaagttctacct

SEQ ID NO: 91806 - DNA, 20 bp, Artificial Sequence
  Description of Artificial Sequence: Synthetic oligonucleotide
  Target: ATXN1; (-) strand; PAM type: NRG; PAM sequence: AAG
ttggtatcatctacgaagag

SEQ ID NO: 91807 - DNA, 20 bp, Artificial Sequence
  Description of Artificial Sequence: Synthetic oligonucleotide
  Target: ATXN1; (-) strand; PAM type: NRG; PAM sequence: GAG
taattggtatcatctacgaa

SEQ ID NO: 91808 - DNA, 20 bp, Artificial Sequence
  Description of Artificial Sequence: Synthetic oligonucleotide
  Target: ATXN1; (-) strand; PAM type: NRG; PAM sequence: AAG
gataattggtatcatctacg

SEQ ID NO: 91809 - DNA, 20 bp, Artificial Sequence
  Description of Artificial Sequence: Synthetic oligonucleotide
  Target: ATXN1; (-) strand; PAM type: NRG; PAM sequence: TGG
ttgcattttaaaatgataat

SEQ ID NO: 91810 - DNA, 20 bp, Artificial Sequence
  Description of Artificial Sequence: Synthetic oligonucleotide
  Target: ATXN1; (-) strand; PAM type: NRG; PAM sequence: TAG
taattgggtgcaagaggtct

SEQ ID NO: 91811 - DNA, 20 bp, Artificial Sequence
  Description of Artificial Sequence: Synthetic oligonucleotide
  Target: ATXN1; (-) strand; PAM type: NRG; PAM sequence: AGG
catacataattgggtgcaag

SEQ ID NO: 91812 - DNA, 20 bp, Artificial Sequence
  Description of Artificial Sequence: Synthetic oligonucleotide
  Target: ATXN1; (-) strand; PAM type: NRG; PAM sequence: GAG
tcatacataattgggtgcaa

SEQ ID NO: 91813 - DNA, 20 bp, Artificial Sequence
  Description of Artificial Sequence: Synthetic oligonucleotide
  Target: ATXN1; (-) strand; PAM type: NRG; PAM sequence: AAG
tgtcatacataattgggtgc

SEQ ID NO: 91814 - DNA, 20 bp, Artificial Sequence
  Description of Artificial Sequence: Synthetic oligonucleotide
  Target: ATXN1; (-) strand; PAM type: NRG; PAM sequence: GGG
attctatgtcatacataatt

SEQ ID NO: 91815 - DNA, 20 bp, Artificial Sequence
  Description of Artificial Sequence: Synthetic oligonucleotide
  Target: ATXN1; (-) strand; PAM type: NRG; PAM sequence: TGG
tattctatgtcatacataat

SEQ ID NO: 91816 - DNA, 20 bp, Artificial Sequence
  Description of Artificial Sequence: Synthetic oligonucleotide
  Target: ATXN1; (-) strand; PAM type: NRG; PAM sequence: AAG
gtgagctaccgggcccggcc

SEQ ID NO: 91817 - DNA, 20 bp, Artificial Sequence
  Description of Artificial Sequence: Synthetic oligonucleotide
  Target: ATXN1; (-) strand; PAM type: NRG; PAM sequence: CGG
taggtgtgagctaccgggcc

SEQ ID NO: 91818 - DNA, 20 bp, Artificial Sequence
  Description of Artificial Sequence: Synthetic oligonucleotide
  Target: ATXN1; (-) strand; PAM type: NRG; PAM sequence: GGG
gactataggtgtgagctacc

SEQ ID NO: 91819 - DNA, 20 bp, Artificial Sequence
  Description of Artificial Sequence: Synthetic oligonucleotide
  Target: ATXN1; (-) strand; PAM type: NRG; PAM sequence: CGG
ggactataggtgtgagctac

SEQ ID NO: 91820 - DNA, 20 bp, Artificial Sequence
  Description of Artificial Sequence: Synthetic oligonucleotide
  Target: ATXN1; (-) strand; PAM type: NRG; PAM sequence: GAG
agtgctgggactataggtgt

SEQ ID NO: 91821 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggactat

SEQ ID NO: 91822 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtgctgggacta

SEQ ID NO: 91823 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 91824 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 91825 - DNA, 20 bp, Artificial Sequence
  Description of Artificial Sequence: Synthetic oligonucleotide
  Target: ATXN1; (-) strand; PAM type: NRG; PAM sequence: AAG
ccacccgcctcggcctccca

SEQ ID NO: 91826 - DNA, 20 bp, Artificial Sequence
  Description of Artificial Sequence: Synthetic oligonucleotide
  Target: ATXN1; (-) strand; PAM type: NRG; PAM sequence: CGG
ctcaagtgatccacccgcct

SEQ ID NO: 91827 - DNA, 20 bp, Artificial Sequence
  Description of Artificial Sequence: Synthetic oligonucleotide
  Target: ATXN1; (-) strand; PAM type: NRG; PAM sequence: AAG
agtcttgaactcctgacctc

SEQ ID NO: 91828 - DNA, 20 bp, Artificial Sequence
  Description of Artificial Sequence: Synthetic oligonucleotide
  Target: ATXN1; (-) strand; PAM type: NRG; PAM sequence: TAG
tttcaccgtgttggccaggc

SEQ ID NO: 91829 - DNA, 20 bp, Artificial Sequence
  Description of Artificial Sequence: Synthetic oligonucleotide
  Target: ATXN1; (-) strand; PAM type: NRG; PAM sequence: AGG
ggagtttcaccgtgttggcc

SEQ ID NO: 91830 - DNA, 20 bp, Artificial Sequence
  Description of Artificial Sequence: Synthetic oligonucleotide
  Target: ATXN1; (-) strand; PAM type: NRG; PAM sequence: CAG
tggagtttcaccgtgttggc

SEQ ID NO: 91831 - DNA, 20 bp, Artificial Sequence
  Description of Artificial Sequence: Synthetic oligonucleotide
  Target: ATXN1; (-) strand; PAM type: NRG; PAM sequence: TGG
gagatggagtttcaccgtgt

SEQ ID NO: 91832 - DNA, 20 bp, Artificial Sequence
  Description of Artificial Sequence: Synthetic oligonucleotide
  Target: ATXN1; (-) strand; PAM type: NRG; PAM sequence: GAG
ttgtctttttagtagagatg

SEQ ID NO: 91833 - DNA, 20 bp, Artificial Sequence
  Description of Artificial Sequence: Synthetic oligonucleotide
  Target: ATXN1; (-) strand; PAM type: NRG; PAM sequence: TGG
ttttgtctttttagtagaga

SEQ ID NO: 91834 - DNA, 20 bp, Artificial Sequence
  Description of Artificial Sequence: Synthetic oligonucleotide
  Target: ATXN1; (-) strand; PAM type: NRG; PAM sequence: GAG
tgttttttgtctttttagta

SEQ ID NO: 91835 - DNA, 20 bp, Artificial Sequence
  Description of Artificial Sequence: Synthetic oligonucleotide
  Target: ATXN1; (-) strand; PAM type: NRG; PAM sequence: TAG
gctgttttttgtctttttag

SEQ ID NO: 91836 - DNA, 20 bp, Artificial Sequence
  Description of Artificial Sequence: Synthetic oligonucleotide
  Target: ATXN1; (-) strand; PAM type: NRG; PAM sequence: TAG
ccagctgttttttgtctttt

SEQ ID NO: 91837 - DNA, 20 bp, Artificial Sequence
  Description of Artificial Sequence: Synthetic oligonucleotide
  Target: ATXN1; (-) strand; PAM type: NRG; PAM sequence: CAG
tagctgggattacaggcacc

SEQ ID NO: 91838 - DNA, 20 bp, Artificial Sequence
  Description of Artificial Sequence: Synthetic oligonucleotide
  Target: ATXN1; (-) strand; PAM type: NRG; PAM sequence: AGG
agtagagtagctgggattac

SEQ ID NO: 91839 - DNA, 20 bp, Artificial Sequence
  Description of Artificial Sequence: Synthetic oligonucleotide
  Target: ATXN1; (-) strand; PAM type: NRG; PAM sequence: CAG
gagtagagtagctgggatta

SEQ ID NO: 91840 - DNA, 20 bp, Artificial Sequence
  Description of Artificial Sequence: Synthetic oligonucleotide
  Target: ATXN1; (-) strand; PAM type: NRG; PAM sequence: GGG
gcctcctgagtagagtagct

SEQ ID NO: 91841 - DNA, 20 bp, Artificial Sequence
  Description of Artificial Sequence: Synthetic oligonucleotide
  Target: ATXN1; (-) strand; PAM type: NRG; PAM sequence: TGG
agcctcctgagtagagtagc

SEQ ID NO: 91842 - DNA, 20 bp, Artificial Sequence
  Description of Artificial Sequence: Synthetic oligonucleotide
  Target: ATXN1; (-) strand; PAM type: NRG; PAM sequence: TAG
cctcagcctcctgagtagag

SEQ ID NO: 91843 - DNA, 20 bp, Artificial Sequence
  Description of Artificial Sequence: Synthetic oligonucleotide
  Target: ATXN1; (-) strand; PAM type: NRG; PAM sequence: GAG
ctgcctcagcctcctgagta

SEQ ID NO: 91844 - DNA, 20 bp, Artificial Sequence
  Description of Artificial Sequence: Synthetic oligonucleotide
  Target: ATXN1; (-) strand; PAM type: NRG; PAM sequence: TAG
ttctgcctcagcctcctgag

SEQ ID NO: 91845 - DNA, 20 bp, Artificial Sequence
  Description of Artificial Sequence: Synthetic oligonucleotide
  Target: ATXN1; (-) strand; PAM type: NRG; PAM sequence: GAG
ttcttctgcctcagcctcct

SEQ ID NO: 91846 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattcttctgcct

SEQ ID NO: 91847 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccggcttc

SEQ ID NO: 91848 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctccacctcc

SEQ ID NO: 91849 - DNA, 20 bp, Artificial Sequence
  Description of Artificial Sequence: Synthetic oligonucleotide
  Target: ATXN1; (-) strand; PAM type: NRG; PAM sequence: TGG
ggagtgcaatggcatgatct

SEQ ID NO: 91850 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcaa

SEQ ID NO: 91851 - DNA, 20 bp, Artificial Sequence
  Description of Artificial Sequence: Synthetic oligonucleotide
  Target: ATXN1; (-) strand; PAM type: NRG; PAM sequence: GAG
cgctcttgtcgcccaggctg

SEQ ID NO: 91852 - DNA, 20 bp, Artificial Sequence
  Description of Artificial Sequence: Synthetic oligonucleotide
  Target: ATXN1; (-) strand; PAM type: NRG; PAM sequence: TGG
ttcgctcttgtcgcccaggc

SEQ ID NO: 91853 - DNA, 20 bp, Artificial Sequence
  Description of Artificial Sequence: Synthetic oligonucleotide
  Target: ATXN1; (-) strand; PAM type: NRG; PAM sequence: AGG
aagtttcgctcttgtcgccc

SEQ ID NO: 91854 - DNA, 20 bp, Artificial Sequence
  Description of Artificial Sequence: Synthetic oligonucleotide
  Target: ATXN1; (-) strand; PAM type: NRG; PAM sequence: CAG
gaagtttcgctcttgtcgcc

SEQ ID NO: 91855 - DNA, 20 bp, Artificial Sequence
  Description of Artificial Sequence: Synthetic oligonucleotide
  Target: ATXN1; (-) strand; PAM type: NRG; PAM sequence: AAG
ctttgtttttttttgagatg

SEQ ID NO: 91856 - DNA, 20 bp, Artificial Sequence
  Description of Artificial Sequence: Synthetic oligonucleotide
  Target: ATXN1; (-) strand; PAM type: NRG; PAM sequence: GAG
attattctttgttttttttt

SEQ ID NO: 91857 - DNA, 20 bp, Artificial Sequence
  Description of Artificial Sequence: Synthetic oligonucleotide
  Target: ATXN1; (-) strand; PAM type: NRG; PAM sequence: AAG
atctgaagtaggaccctgtt

SEQ ID NO: 91858 - DNA, 20 bp, Artificial Sequence
  Description of Artificial Sequence: Synthetic oligonucleotide
  Target: ATXN1; (-) strand; PAM type: NRG; PAM sequence: AGG
ttgagcaatccatctgaagt

SEQ ID NO: 91859 - DNA, 20 bp, Artificial Sequence
  Description of Artificial Sequence: Synthetic oligonucleotide
  Target: ATXN1; (-) strand; PAM type: NRG; PAM sequence: TAG
cttgagcaatccatctgaag

SEQ ID NO: 91860 - DNA, 20 bp, Artificial Sequence
  Description of Artificial Sequence: Synthetic oligonucleotide
  Target: ATXN1; (-) strand; PAM type: NRG; PAM sequence: AAG
actcttgagcaatccatctg

SEQ ID NO: 91861 - DNA, 20 bp, Artificial Sequence
  Description of Artificial Sequence: Synthetic oligonucleotide
  Target: ATXN1; (-) strand; PAM type: NRG; PAM sequence: GAG
tccatatggcctgaactctt

SEQ ID NO: 91862 - DNA, 20 bp, Artificial Sequence
  Description of Artificial Sequence: Synthetic oligonucleotide
  Target: ATXN1; (-) strand; PAM type: NRG; PAM sequence: TGG
gtgtctaattgtactccata

SEQ ID NO: 91863 - DNA, 20 bp, Artificial Sequence
  Description of Artificial Sequence: Synthetic oligonucleotide
  Target: ATXN1; (-) strand; PAM type: NRG; PAM sequence: CAG
gatccagaaagtagtatgtt

SEQ ID NO: 91864 - DNA, 20 bp, Artificial Sequence
  Description of Artificial Sequence: Synthetic oligonucleotide
  Target: ATXN1; (-) strand; PAM type: NRG; PAM sequence: TAG
actggcccagatccagaaag

SEQ ID NO: 91865 - DNA, 20 bp, Artificial Sequence
  Description of Artificial Sequence: Synthetic oligonucleotide
  Target: ATXN1; (-) strand; PAM type: NRG; PAM sequence: AAG
catactggcccagatccaga

SEQ ID NO: 91866 - DNA, 20 bp, Artificial Sequence
  Description of Artificial Sequence: Synthetic oligonucleotide
  Target: ATXN1; (-) strand; PAM type: NRG; PAM sequence: CAG
ttgtcatactggcccagatc

SEQ ID NO: 91867 - DNA, 20 bp, Artificial Sequence
  Description of Artificial Sequence: Synthetic oligonucleotide
  Target: ATXN1; (-) strand; PAM type: NRG; PAM sequence: CAG
taatatttgtcatactggcc

SEQ ID NO: 91868 - DNA, 20 bp, Artificial Sequence
  Description of Artificial Sequence: Synthetic oligonucleotide
  Target: ATXN1; (-) strand; PAM type: NRG; PAM sequence: TGG
ttttgtaatatttgtcatac

SEQ ID NO: 91869 - DNA, 20 bp, Artificial Sequence
  Description of Artificial Sequence: Synthetic oligonucleotide
  Target: ATXN1; (-) strand; PAM type: NRG; PAM sequence: TAG
tgatgactttctggaaaaaa

SEQ ID NO: 91870 - DNA, 20 bp, Artificial Sequence
  Description of Artificial Sequence: Synthetic oligonucleotide
  Target: ATXN1; (-) strand; PAM type: NRG; PAM sequence: TGG
ttcaaactgtgatgactttc

SEQ ID NO: 91871 - DNA, 20 bp, Artificial Sequence
  Description of Artificial Sequence: Synthetic oligonucleotide
  Target: ATXN1; (-) strand; PAM type: NRG; PAM sequence: AAG
tgaaaaggctttagggtaat

SEQ ID NO: 91872 - DNA, 20 bp, Artificial Sequence
  Description of Artificial Sequence: Synthetic oligonucleotide
  Target: ATXN1; (-) strand; PAM type: NRG; PAM sequence: GGG
tcataattgaaaaggcttta

SEQ ID NO: 91873 - DNA, 20 bp, Artificial Sequence
  Description of Artificial Sequence: Synthetic oligonucleotide
  Target: ATXN1; (-) strand; PAM type: NRG; PAM sequence: AGG
ttcataattgaaaaggcttt

SEQ ID NO: 91874 - DNA, 20 bp, Artificial Sequence
  Description of Artificial Sequence: Synthetic oligonucleotide
  Target: ATXN1; (-) strand; PAM type: NRG; PAM sequence: TAG
cttcataattgaaaaggctt

SEQ ID NO: 91875 - DNA, 20 bp, Artificial Sequence
  Description of Artificial Sequence: Synthetic oligonucleotide
  Target: ATXN1; (-) strand; PAM type: NRG; PAM sequence: AGG
caggcacttcataattgaaa

SEQ ID NO: 91876 - DNA, 20 bp, Artificial Sequence
  Description of Artificial Sequence: Synthetic oligonucleotide
  Target: ATXN1; (-) strand; PAM type: NRG; PAM sequence: AAG
gcaggcacttcataattgaa

SEQ ID NO: 91877 - DNA, 20 bp, Artificial Sequence
  Description of Artificial Sequence: Synthetic oligonucleotide
  Target: ATXN1; (-) strand; PAM type: NRG; PAM sequence: AGG
atatgtagtaacaccagagc

SEQ ID NO: 91878 - DNA, 20 bp, Artificial Sequence
  Description of Artificial Sequence: Synthetic oligonucleotide
  Target: ATXN1; (-) strand; PAM type: NRG; PAM sequence: CAG
tatatgtagtaacaccagag

SEQ ID NO: 91879 - DNA, 20 bp, Artificial Sequence
  Description of Artificial Sequence: Synthetic oligonucleotide
  Target: ATXN1; (-) strand; PAM type: NRG; PAM sequence: GAG
ttgtatatgtagtaacacca

SEQ ID NO: 91880 - DNA, 20 bp, Artificial Sequence
  Description of Artificial Sequence: Synthetic oligonucleotide
  Target: ATXN1; (-) strand; PAM type: NRG; PAM sequence: CAG
ctttgtatatgtagtaacac

SEQ ID NO: 91881 - DNA, 20 bp, Artificial Sequence
  Description of Artificial Sequence: Synthetic oligonucleotide
  Target: ATXN1; (-) strand; PAM type: NRG; PAM sequence: TAG
tgtaaccacctttgtatatg

SEQ ID NO: 91882 - DNA, 20 bp, Artificial Sequence
  Description of Artificial Sequence: Synthetic oligonucleotide
  Target: ATXN1; (-) strand; PAM type: NRG; PAM sequence: TGG
agagaaagagaaaacagact

SEQ ID NO: 91883 - DNA, 20 bp, Artificial Sequence
  Description of Artificial Sequence: Synthetic oligonucleotide
  Target: ATXN1; (-) strand; PAM type: NRG; PAM sequence: CAG
tagaggagagaaagagaaaa

SEQ ID NO: 91884 - DNA, 20 bp, Artificial Sequence
  Description of Artificial Sequence: Synthetic oligonucleotide
  Target: ATXN1; (-) strand; PAM type: NRG; PAM sequence: GAG
aatttactagaggagagaaa

SEQ ID NO: 91885 - DNA, 20 bp, Artificial Sequence
  Description of Artificial Sequence: Synthetic oligonucleotide
  Target: ATXN1; (-) strand; PAM type: NRG; PAM sequence: AAG
ataatttactagaggagaga

SEQ ID NO: 91886 - DNA, 20 bp, Artificial Sequence
  Description of Artificial Sequence: Synthetic oligonucleotide
  Target: ATXN1; (-) strand; PAM type: NRG; PAM sequence: GAG
taacataatttactagagga

SEQ ID NO: 91887 - DNA, 20 bp, Artificial Sequence
  Description of Artificial Sequence: Synthetic oligonucleotide
  Target: ATXN1; (-) strand; PAM type: NRG; PAM sequence: GAG
attaacataatttactagag

SEQ ID NO: 91888 - DNA, 20 bp, Artificial Sequence
  Description of Artificial Sequence: Synthetic oligonucleotide
  Target: ATXN1; (-) strand; PAM type: NRG; PAM sequence: AGG
taattaacataatttactag

SEQ ID NO: 91889 - DNA, 20 bp, Artificial Sequence
  Description of Artificial Sequence: Synthetic oligonucleotide
  Target: ATXN1; (-) strand; PAM type: NRG; PAM sequence: GAG
ttaattaacataatttacta

SEQ ID NO: 91890 - DNA, 20 bp, Artificial Sequence
  Description of Artificial Sequence: Synthetic oligonucleotide
  Target: ATXN1; (-) strand; PAM type: NRG; PAM sequence: TAG
gcttaattaacataatttac

SEQ ID NO: 91891 - DNA, 20 bp, Artificial Sequence
  Description of Artificial Sequence: Synthetic oligonucleotide
  Target: ATXN1; (-) strand; PAM type: NRG; PAM sequence: AAG
aaaattgtaaacaattatga

SEQ ID NO: 91892 - DNA, 20 bp, Artificial Sequence
  Description of Artificial Sequence: Synthetic oligonucleotide
  Target: ATXN1; (-) strand; PAM type: NRG; PAM sequence: TGG
taatacatctatttgctttg

SEQ ID NO: 91893 - DNA, 20 bp, Artificial Sequence
  Description of Artificial Sequence: Synthetic oligonucleotide
  Target: ATXN1; (-) strand; PAM type: NRG; PAM sequence: TGG
ctcttacctactagtatata

SEQ ID NO: 91894 - DNA, 20 bp, Artificial Sequence
  Description of Artificial Sequence: Synthetic oligonucleotide
  Target: ATXN1; (-) strand; PAM type: NRG; PAM sequence: TAG
ccattttttctcttacctac

SEQ ID NO: 91895 - DNA, 20 bp, Artificial Sequence
  Description of Artificial Sequence: Synthetic oligonucleotide
  Target: ATXN1; (-) strand; PAM type: NRG; PAM sequence: TGG
ttcagcatcaaacctcactt

SEQ ID NO: 91896 - DNA, 20 bp, Artificial Sequence
  Description of Artificial Sequence: Synthetic oligonucleotide
  Target: ATXN1; (-) strand; PAM type: NRG; PAM sequence: CAG
gagacggtggttcaaatttt

SEQ ID NO: 91897 - DNA, 20 bp, Artificial Sequence
  Description of Artificial Sequence: Synthetic oligonucleotide
  Target: ATXN1; (-) strand; PAM type: NRG; PAM sequence: TGG
acaataattgacagagacgg

SEQ ID NO: 91898 - DNA, 20 bp, Artificial Sequence
  Description of Artificial Sequence: Synthetic oligonucleotide
  Target: ATXN1; (-) strand; PAM type: NRG; PAM sequence: CGG
gttacaataattgacagaga

SEQ ID NO: 91899 - DNA, 20 bp, Artificial Sequence
  Description of Artificial Sequence: Synthetic oligonucleotide
  Target: ATXN1; (-) strand; PAM type: NRG; PAM sequence: GAG
gtgtgttacaataattgaca

SEQ ID NO: 91900 - DNA, 20 bp, Artificial Sequence
  Description of Artificial Sequence: Synthetic oligonucleotide
  Target: ATXN1; (-) strand; PAM type: NRG; PAM sequence: CAG
ttgtgtgttacaataattga

SEQ ID NO: 91901 - DNA, 20 bp, Artificial Sequence
  Description of Artificial Sequence: Synthetic oligonucleotide
  Target: ATXN1; (-) strand; PAM type: NRG; PAM sequence: TAG
gagcccagttactgagtatg

SEQ ID NO: 91902 - DNA, 20 bp, Artificial Sequence
  Description of Artificial Sequence: Synthetic oligonucleotide
  Target: ATXN1; (-) strand; PAM type: NRG; PAM sequence: GAG
cttctctgagcccagttact

SEQ ID NO: 91903 - DNA, 20 bp, Artificial Sequence
  Description of Artificial Sequence: Synthetic oligonucleotide
  Target: ATXN1; (-) strand; PAM type: NRG; PAM sequence: CAG
ttagatgtcttctctgagcc

SEQ ID NO: 91904 - DNA, 20 bp, Artificial Sequence
  Description of Artificial Sequence: Synthetic oligonucleotide
  Target: ATXN1; (-) strand; PAM type: NRG; PAM sequence: GAG
tcatattagatgtcttctct

SEQ ID NO: 91905 - DNA, 20 bp, Artificial Sequence
  Description of Artificial Sequence: Synthetic oligonucleotide
  Target: ATXN1; (-) strand; PAM type: NRG; PAM sequence: TAG
acttgttttcttattcatat

SEQ ID NO: 91906 - DNA, 20 bp, Artificial Sequence
  Description of Artificial Sequence: Synthetic oligonucleotide
  Target: ATXN1; (-) strand; PAM type: NRG; PAM sequence: TGG
cttcttgaaacattgtaatt

SEQ ID NO: 91907 - DNA, 20 bp, Artificial Sequence
  Description of Artificial Sequence: Synthetic oligonucleotide
  Target: ATXN1; (-) strand; PAM type: NRG; PAM sequence: GAG
ttttttataagtacttaaga

SEQ ID NO: 91908 - DNA, 20 bp, Artificial Sequence
  Description of Artificial Sequence: Synthetic oligonucleotide
  Target: ATXN1; (-) strand; PAM type: NRG; PAM sequence: GAG
atttttttataagtacttaa

SEQ ID NO: 91909 - DNA, 20 bp, Artificial Sequence
  Description of Artificial Sequence: Synthetic oligonucleotide
  Target: ATXN1; (-) strand; PAM type: NRG; PAM sequence: AAG
aaatttttttataagtactt

SEQ ID NO: 91910 - DNA, 20 bp, Artificial Sequence
  Description of Artificial Sequence: Synthetic oligonucleotide
  Target: ATXN1; (-) strand; PAM type: NRG; PAM sequence: AAG
tcattttgaaatttttttat

SEQ ID NO: 91911 - DNA, 20 bp, Artificial Sequence
  Description of Artificial Sequence: Synthetic oligonucleotide
  Target: ATXN1; (-) strand; PAM type: NRG; PAM sequence: AAG
gctctcttagtctattcatt

SEQ ID NO: 91912 - DNA, 20 bp, Artificial Sequence
  Description of Artificial Sequence: Synthetic oligonucleotide
  Target: ATXN1; (-) strand; PAM type: NRG; PAM sequence: TAG
cattattatataagctctct

SEQ ID NO: 91913 - DNA, 20 bp, Artificial Sequence
  Description of Artificial Sequence: Synthetic oligonucleotide
  Target: ATXN1; (-) strand; PAM type: NRG; PAM sequence: AAG
tttgtattacattattatat

SEQ ID NO: 91914 - DNA, 20 bp, Artificial Sequence
  Description of Artificial Sequence: Synthetic oligonucleotide
  Target: ATXN1; (-) strand; PAM type: NRG; PAM sequence: AAG
tttgtttttaagcactttgg

SEQ ID NO: 91915 - DNA, 20 bp, Artificial Sequence
  Description of Artificial Sequence: Synthetic oligonucleotide
  Target: ATXN1; (-) strand; PAM type: NRG; PAM sequence: TGG
aaatttgtttttaagcactt

SEQ ID NO: 91916 - DNA, 20 bp, Artificial Sequence
  Description of Artificial Sequence: Synthetic oligonucleotide
  Target: ATXN1; (-) strand; PAM type: NRG; PAM sequence: AAG
aataaaggaaatttgttttt

SEQ ID NO: 91917 - DNA, 20 bp, Artificial Sequence
  Description of Artificial Sequence: Synthetic oligonucleotide
  Target: ATXN1; (-) strand; PAM type: NRG; PAM sequence: AGG
cagctaagagtcagtaataa

SEQ ID NO: 91918 - DNA, 20 bp, Artificial Sequence
  Description of Artificial Sequence: Synthetic oligonucleotide
  Target: ATXN1; (-) strand; PAM type: NRG; PAM sequence: AAG
acagctaagagtcagtaata

SEQ ID NO: 91919 - DNA, 20 bp, Artificial Sequence
  Description of Artificial Sequence: Synthetic oligonucleotide
  Target: ATXN1; (-) strand; PAM type: NRG; PAM sequence: CAG
gactaataacagctaagagt

SEQ ID NO: 91920 - DNA, 20 bp, Artificial Sequence
  Description of Artificial Sequence: Synthetic oligonucleotide
  Target: ATXN1; (-) strand; PAM type: NRG; PAM sequence: GAG
cacagactaataacagctaa

SEQ ID NO: 91921 - DNA, 20 bp, Artificial Sequence
  Description of Artificial Sequence: Synthetic oligonucleotide
  Target: ATXN1; (-) strand; PAM type: NRG; PAM sequence: AAG
gtcacagactaataacagct

SEQ ID NO: 91922 - DNA, 20 bp, Artificial Sequence
  Description of Artificial Sequence: Synthetic oligonucleotide
  Target: ATXN1; (-) strand; PAM type: NRG; PAM sequence: CAG
ataatgtcacagactaataa

SEQ ID NO: 91923 - DNA, 20 bp, Artificial Sequence
  Description of Artificial Sequence: Synthetic oligonucleotide
  Target: ATXN1; (-) strand; PAM type: NRG; PAM sequence: CAG
aaataatataaataatgtca

SEQ ID NO: 91924 - DNA, 20 bp, Artificial Sequence
  Description of Artificial Sequence: Synthetic oligonucleotide
  Target: ATXN1; (-) strand; PAM type: NRG; PAM sequence: AAG
agtaatatgtctaagaagaa

SEQ ID NO: 91925 - DNA, 20 bp, Artificial Sequence
  Description of Artificial Sequence: Synthetic oligonucleotide
  Target: ATXN1; (-) strand; PAM type: NRG; PAM sequence: AAG
atattagtaatatgtctaag

SEQ ID NO: 91926 - DNA, 20 bp, Artificial Sequence
  Description of Artificial Sequence: Synthetic oligonucleotide
  Target: ATXN1; (-) strand; PAM type: NRG; PAM sequence: AAG
tttatattagtaatatgtct

SEQ ID NO: 91927 - DNA, 20 bp, Artificial Sequence
  Description of Artificial Sequence: Synthetic oligonucleotide
  Target: ATXN1; (-) strand; PAM type: NRG; PAM sequence: TAG
cattgaattaatatttatat

SEQ ID NO: 91928 - DNA, 20 bp, Artificial Sequence
  Description of Artificial Sequence: Synthetic oligonucleotide
  Target: ATXN1; (-) strand; PAM type: NRG; PAM sequence: TGG
cattttatagtccgaatttg

SEQ ID NO: 91929 - DNA, 20 bp, Artificial Sequence
  Description of Artificial Sequence: Synthetic oligonucleotide
  Target: ATXN1; (-) strand; PAM type: NRG; PAM sequence: TAG
tgttaattttgatcatttta

SEQ ID NO: 91930 - DNA, 20 bp, Artificial Sequence
  Description of Artificial Sequence: Synthetic oligonucleotide
  Target: ATXN1; (-) strand; PAM type: NRG; PAM sequence: CAG
gaattttcactttcagtaga

SEQ ID NO: 91931 - DNA, 20 bp, Artificial Sequence
  Description of Artificial Sequence: Synthetic oligonucleotide
  Target: ATXN1; (-) strand; PAM type: NRG; PAM sequence: TAG
tgacgaattttcactttcag

SEQ ID NO: 91932 - DNA, 20 bp, Artificial Sequence
  Description of Artificial Sequence: Synthetic oligonucleotide
  Target: ATXN1; (-) strand; PAM type: NRG; PAM sequence: CAG
ctctgacgaattttcacttt

SEQ ID NO: 91933 - DNA, 20 bp, Artificial Sequence
  Description of Artificial Sequence: Synthetic oligonucleotide
  Target: ATXN1; (-) strand; PAM type: NRG; PAM sequence: CGG
ggcttggtaaatggaggaaa

SEQ ID NO: 91934 - DNA, 20 bp, Artificial Sequence
  Description of Artificial Sequence: Synthetic oligonucleotide
  Target: ATXN1; (-) strand; PAM type: NRG; PAM sequence: AGG
catctcggcttggtaaatgg

SEQ ID NO: 91935 - DNA, 20 bp, Artificial Sequence
  Description of Artificial Sequence: Synthetic oligonucleotide
  Target: ATXN1; (-) strand; PAM type: NRG; PAM sequence: GAG
gcatctcggcttggtaaatg

SEQ ID NO: 91936 - DNA, 20 bp, Artificial Sequence
  Description of Artificial Sequence: Synthetic oligonucleotide
  Target: ATXN1; (-) strand; PAM type: NRG; PAM sequence: TGG
tggcatctcggcttggtaaa

SEQ ID NO: 91937 - DNA, 20 bp, Artificial Sequence
  Description of Artificial Sequence: Synthetic oligonucleotide
  Target: ATXN1; (-) strand; PAM type: NRG; PAM sequence: TGG
tgcccactggcatctcggct

SEQ ID NO: 91938 - DNA, 20 bp, Artificial Sequence
  Description of Artificial Sequence: Synthetic oligonucleotide
  Target: ATXN1; (-) strand; PAM type: NRG; PAM sequence: CGG
ttttgtgcccactggcatct

SEQ ID NO: 91939 - DNA, 20 bp, Artificial Sequence
  Description of Artificial Sequence: Synthetic oligonucleotide
  Target: ATXN1; (-) strand; PAM type: NRG; PAM sequence: TGG
taaattatttttgtgcccac

SEQ ID NO: 91940 - DNA, 20 bp, Artificial Sequence
  Description of Artificial Sequence: Synthetic oligonucleotide
  Target: ATXN1; (-) strand; PAM type: NRG; PAM sequence: TGG
agtctcaagttggtcagttg

SEQ ID NO: 91941 - DNA, 20 bp, Artificial Sequence
  Description of Artificial Sequence: Synthetic oligonucleotide
  Target: ATXN1; (-) strand; PAM type: NRG; PAM sequence: CAG
atgtgcagtctcaagttggt

SEQ ID NO: 91942 - DNA, 20 bp, Artificial Sequence
  Description of Artificial Sequence: Synthetic oligonucleotide
  Target: ATXN1; (-) strand; PAM type: NRG; PAM sequence: TGG
acaaatgtgcagtctcaagt

SEQ ID NO: 91943 - DNA, 20 bp, Artificial Sequence
  Description of Artificial Sequence: Synthetic oligonucleotide
  Target: ATXN1; (-) strand; PAM type: NRG; PAM sequence: AAG
atgaacaaatgtgcagtctc

SEQ ID NO: 91944 - DNA, 20 bp, Artificial Sequence
  Description of Artificial Sequence: Synthetic oligonucleotide
  Target: ATXN1; (-) strand; PAM type: NRG; PAM sequence: CAG
cgaatgaatgaacaaatgtg

SEQ ID NO: 91945 - DNA, 20 bp, Artificial Sequence
  Description of Artificial Sequence: Synthetic oligonucleotide
  Target: ATXN1; (-) strand; PAM type: NRG; PAM sequence: TGG
tagtagatggtgaataagta

SEQ ID NO: 91946 - DNA, 20 bp, Artificial Sequence
  Description of Artificial Sequence: Synthetic oligonucleotide
  Target: ATXN1; (-) strand; PAM type: NRG; PAM sequence: AAG
tagagtagtagatggtgaat

SEQ ID NO: 91947 - DNA, 20 bp, Artificial Sequence
  Description of Artificial Sequence: Synthetic oligonucleotide
  Target: ATXN1; (-) strand; PAM type: NRG; PAM sequence: TGG
ccccattttagagtagtaga

SEQ ID NO: 91948 - DNA, 20 bp, Artificial Sequence
  Description of Artificial Sequence: Synthetic oligonucleotide
  Target: ATXN1; (-) strand; PAM type: NRG; PAM sequence: TAG
gcttccccattttagagtag

SEQ ID NO: 91949 - DNA, 20 bp, Artificial Sequence
  Description of Artificial Sequence: Synthetic oligonucleotide
  Target: ATXN1; (-) strand; PAM type: NRG; PAM sequence: TAG
gcagcttccccattttagag

SEQ ID NO: 91950 - DNA, 20 bp, Artificial Sequence
  Description of Artificial Sequence: Synthetic oligonucleotide
  Target: ATXN1; (-) strand; PAM type: NRG; PAM sequence: GAG
cttgcagcttccccatttta

SEQ ID NO: 91951 - DNA, 20 bp, Artificial Sequence
  Description of Artificial Sequence: Synthetic oligonucleotide
  Target: ATXN1; (-) strand; PAM type: NRG; PAM sequence: TAG
cccttgcagcttccccattt

SEQ ID NO: 91952 - DNA, 20 bp, Artificial Sequence
  Description of Artificial Sequence: Synthetic oligonucleotide
  Target: ATXN1; (-) strand; PAM type: NRG; PAM sequence: CAG
gacctctacagctgcccttg

SEQ ID NO: 91953 - DNA, 20 bp, Artificial Sequence
  Description of Artificial Sequence: Synthetic oligonucleotide
  Target: ATXN1; (-) strand; PAM type: NRG; PAM sequence: CAG
tctagaccaagtgacctcta

SEQ ID NO: 91954 - DNA, 20 bp, Artificial Sequence
  Description of Artificial Sequence: Synthetic oligonucleotide
  Target: ATXN1; (-) strand; PAM type: NRG; PAM sequence: AAG
gcaaaatgagggtctagacc

SEQ ID NO: 91955 - DNA, 20 bp, Artificial Sequence
  Description of Artificial Sequence: Synthetic oligonucleotide
  Target: ATXN1; (-) strand; PAM type: NRG; PAM sequence: TAG
cctcatgcaaaatgagggtc

SEQ ID NO: 91956 - DNA, 20 bp, Artificial Sequence
  Description of Artificial Sequence: Synthetic oligonucleotide
  Target: ATXN1; (-) strand; PAM type: NRG; PAM sequence: GGG
agcctcctcatgcaaaatga

SEQ ID NO: 91957 - DNA, 20 bp, Artificial Sequence
  Description of Artificial Sequence: Synthetic oligonucleotide
  Target: ATXN1; (-) strand; PAM type: NRG; PAM sequence: AGG
cagcctcctcatgcaaaatg

SEQ ID NO: 91958 - DNA, 20 bp, Artificial Sequence
  Description of Artificial Sequence: Synthetic oligonucleotide
  Target: ATXN1; (-) strand; PAM type: NRG; PAM sequence: GAG
acagcctcctcatgcaaaat

SEQ ID NO: 91959 - DNA, 20 bp, Artificial Sequence
  Description of Artificial Sequence: Synthetic oligonucleotide
  Target: ATXN1; (-) strand; PAM type: NRG; PAM sequence: CAG
tttaatctctgtaatcctca

SEQ ID NO: 91960 - DNA, 20 bp, Artificial Sequence
  Description of Artificial Sequence: Synthetic oligonucleotide
  Target: ATXN1; (-) strand; PAM type: NRG; PAM sequence: AGG
tgataaactcagcatgctcc

SEQ ID NO: 91961 - DNA, 20 bp, Artificial Sequence
  Description of Artificial Sequence: Synthetic oligonucleotide
  Target: ATXN1; (-) strand; PAM type: NRG; PAM sequence: CAG
gtgataaactcagcatgctc

SEQ ID NO: 91962 - DNA, 20 bp, Artificial Sequence
  Description of Artificial Sequence: Synthetic oligonucleotide
  Target: ATXN1; (-) strand; PAM type: NRG; PAM sequence: CAG
ccctttctctgtgataaact

SEQ ID NO: 91963 - DNA, 20 bp, Artificial Sequence
  Description of Artificial Sequence: Synthetic oligonucleotide
  Target: ATXN1; (-) strand; PAM type: NRG; PAM sequence: CAG
aagggacctgctctcttctc

SEQ ID NO: 91964 - DNA, 20 bp, Artificial Sequence
  Description of Artificial Sequence: Synthetic oligonucleotide
  Target: ATXN1; (-) strand; PAM type: NRG; PAM sequence: GGG
agcaaggagcagggagggaa

SEQ ID NO: 91965 - DNA, 20 bp, Artificial Sequence
  Description of Artificial Sequence: Synthetic oligonucleotide
  Target: ATXN1; (-) strand; PAM type: NRG; PAM sequence: AGG
gagcaaggagcagggaggga

SEQ ID NO: 91966 - DNA, 20 bp, Artificial Sequence
  Description of Artificial Sequence: Synthetic oligonucleotide
  Target: ATXN1; (-) strand; PAM type: NRG; PAM sequence: AAG
agagcaaggagcagggaggg

SEQ ID NO: 91967 - DNA, 20 bp, Artificial Sequence
  Description of Artificial Sequence: Synthetic oligonucleotide
  Target: ATXN1; (-) strand; PAM type: NRG; PAM sequence: GGG
gaaagagcaaggagcaggga

SEQ ID NO: 91968 - DNA, 20 bp, Artificial Sequence
  Description of Artificial Sequence: Synthetic oligonucleotide
  Target: ATXN1; (-) strand; PAM type: NRG; PAM sequence: AGG
agaaagagcaaggagcaggg

SEQ ID NO: 91969 - DNA, 20 bp, Artificial Sequence
  Description of Artificial Sequence: Synthetic oligonucleotide
  Target: ATXN1; (-) strand; PAM type: NRG; PAM sequence: GAG
cagaaagagcaaggagcagg

SEQ ID NO: 91970 - DNA, 20 bp, Artificial Sequence
  Description of Artificial Sequence: Synthetic oligonucleotide
  Target: ATXN1; (-) strand; PAM type: NRG; PAM sequence: GGG
ggcagaaagagcaaggagca

SEQ ID NO: 91971 - DNA, 20 bp, Artificial Sequence
  Description of Artificial Sequence: Synthetic oligonucleotide
  Target: ATXN1; (-) strand; PAM type: NRG; PAM sequence: AGG
tggcagaaagagcaaggagc

SEQ ID NO: 91972 - DNA, 20 bp, Artificial Sequence
  Description of Artificial Sequence: Synthetic oligonucleotide
  Target: ATXN1; (-) strand; PAM type: NRG; PAM sequence: CAG
gtggcagaaagagcaaggag

SEQ ID NO: 91973 - DNA, 20 bp, Artificial Sequence
  Description of Artificial Sequence: Synthetic oligonucleotide
  Target: ATXN1; (-) strand; PAM type: NRG; PAM sequence: GAG
agtgtggcagaaagagcaag

SEQ ID NO: 91974 - DNA, 20 bp, Artificial Sequence
  Description of Artificial Sequence: Synthetic oligonucleotide
  Target: ATXN1; (-) strand; PAM type: NRG; PAM sequence: AGG
gtagtgtggcagaaagagca

SEQ ID NO: 91975 - DNA, 20 bp, Artificial Sequence
  Description of Artificial Sequence: Synthetic oligonucleotide
  Target: ATXN1; (-) strand; PAM type: NRG; PAM sequence: AAG
ggtagtgtggcagaaagagc

SEQ ID NO: 91976 - DNA, 20 bp, Artificial Sequence
  Description of Artificial Sequence: Synthetic oligonucleotide
  Target: ATXN1; (-) strand; PAM type: NRG; PAM sequence: GAG
ccagggtagtgtggcagaaa

SEQ ID NO: 91977 - DNA, 20 bp, Artificial Sequence
  Description of Artificial Sequence: Synthetic oligonucleotide
  Target: ATXN1; (-) strand; PAM type: NRG; PAM sequence: AAG
ctccagggtagtgtggcaga

SEQ ID NO: 91978 - DNA, 20 bp, Artificial Sequence
  Description of Artificial Sequence: Synthetic oligonucleotide
  Target: ATXN1; (-) strand; PAM type: NRG; PAM sequence: CAG
tcagctccagggtagtgtgg

SEQ ID NO: 91979 - DNA, 20 bp, Artificial Sequence
  Description of Artificial Sequence: Synthetic oligonucleotide
  Target: ATXN1; (-) strand; PAM type: NRG; PAM sequence: TGG
ctttcagctccagggtagtg

SEQ ID NO: 91980 - DNA, 20 bp, Artificial Sequence
  Description of Artificial Sequence: Synthetic oligonucleotide
  Target: ATXN1; (-) strand; PAM type: NRG; PAM sequence: TAG
gcctcctttcagctccaggg

SEQ ID NO: 91981 - DNA, 20 bp, Artificial Sequence
  Description of Artificial Sequence: Synthetic oligonucleotide
  Target: ATXN1; (-) strand; PAM type: NRG; PAM sequence: GGG
tttgcctcctttcagctcca

SEQ ID NO: 91982 - DNA, 20 bp, Artificial Sequence
  Description of Artificial Sequence: Synthetic oligonucleotide
  Target: ATXN1; (-) strand; PAM type: NRG; PAM sequence: AGG
ctttgcctcctttcagctcc

SEQ ID NO: 91983 - DNA, 20 bp, Artificial Sequence
  Description of Artificial Sequence: Synthetic oligonucleotide
  Target: ATXN1; (-) strand; PAM type: NRG; PAM sequence: CAG
cctttgcctcctttcagctc

SEQ ID NO: 91984 - DNA, 20 bp, Artificial Sequence
  Description of Artificial Sequence: Synthetic oligonucleotide
  Target: ATXN1; (-) strand; PAM type: NRG; PAM sequence: CAG
tggaggcctttgcctccttt

SEQ ID NO: 91985 - DNA, 20 bp, Artificial Sequence
  Description of Artificial Sequence: Synthetic oligonucleotide
  Target: ATXN1; (-) strand; PAM type: NRG; PAM sequence: AGG
gtcagactccatgtgactgg

SEQ ID NO: 91986 - DNA, 20 bp, Artificial Sequence
  Description of Artificial Sequence: Synthetic oligonucleotide
  Target: ATXN1; (-) strand; PAM type: NRG; PAM sequence: GAG
agtcagactccatgtgactg

SEQ ID NO: 91987 - DNA, 20 bp, Artificial Sequence
  Description of Artificial Sequence: Synthetic oligonucleotide
  Target: ATXN1; (-) strand; PAM type: NRG; PAM sequence: TGG
ccagtcagactccatgtgac

SEQ ID NO: 91988 - DNA, 20 bp, Artificial Sequence
  Description of Artificial Sequence: Synthetic oligonucleotide
  Target: ATXN1; (-) strand; PAM type: NRG; PAM sequence: CAG
tagatgtcttgcgtcccagt

SEQ ID NO: 91989 - DNA, 20 bp, Artificial Sequence
  Description of Artificial Sequence: Synthetic oligonucleotide
  Target: ATXN1; (-) strand; PAM type: NRG; PAM sequence: CAG
ggcttagatgtcttgcgtcc

SEQ ID NO: 91990 - DNA, 20 bp, Artificial Sequence
  Description of Artificial Sequence: Synthetic oligonucleotide
  Target: ATXN1; (-) strand; PAM type: NRG; PAM sequence: TAG
tattgcttcattttgtggct

SEQ ID NO: 91991 - DNA, 20 bp, Artificial Sequence
  Description of Artificial Sequence: Synthetic oligonucleotide
  Target: ATXN1; (-) strand; PAM type: NRG; PAM sequence: TGG
tcatttattgcttcattttg

SEQ ID NO: 91992 - DNA, 20 bp, Artificial Sequence
  Description of Artificial Sequence: Synthetic oligonucleotide
  Target: ATXN1; (-) strand; PAM type: NRG; PAM sequence: CAG
tccccactgccctgtgcgca

SEQ ID NO: 91993 - DNA, 20 bp, Artificial Sequence
  Description of Artificial Sequence: Synthetic oligonucleotide
  Target: ATXN1; (-) strand; PAM type: NRG; PAM sequence: CAG
aaagttttccccagctgctt

SEQ ID NO: 91994 - DNA, 20 bp, Artificial Sequence
  Description of Artificial Sequence: Synthetic oligonucleotide
  Target: ATXN1; (-) strand; PAM type: NRG; PAM sequence: CAG
ccgggacggaaagttttccc

SEQ ID NO: 91995 - DNA, 20 bp, Artificial Sequence
  Description of Artificial Sequence: Synthetic oligonucleotide
  Target: ATXN1; (-) strand; PAM type: NRG; PAM sequence: AAG
ctccacttctccgggacgga

SEQ ID NO: 91996 - DNA, 20 bp, Artificial Sequence
  Description of Artificial Sequence: Synthetic oligonucleotide
  Target: ATXN1; (-) strand; PAM type: NRG; PAM sequence: CGG
gaatctccacttctccggga

SEQ ID NO: 91997 - DNA, 20 bp, Artificial Sequence
  Description of Artificial Sequence: Synthetic oligonucleotide
  Target: ATXN1; (-) strand; PAM type: NRG; PAM sequence: GGG
gcatgaatctccacttctcc

SEQ ID NO: 91998 - DNA, 20 bp, Artificial Sequence
  Description of Artificial Sequence: Synthetic oligonucleotide
  Target: ATXN1; (-) strand; PAM type: NRG; PAM sequence: CGG
agcatgaatctccacttctc

SEQ ID NO: 91999 - DNA, 20 bp, Artificial Sequence
  Description of Artificial Sequence: Synthetic oligonucleotide
  Target: ATXN1; (-) strand; PAM type: NRG; PAM sequence: CAG
tctgccccactgtccatgcc

SEQ ID NO: 92000 - DNA, 20 bp, Artificial Sequence
  Description of Artificial Sequence: Synthetic oligonucleotide
  Target: ATXN1; (-) strand; PAM type: NRG; PAM sequence: CAG
tgctttgctgtgagggttcc

SEQ ID NO: 92001 - DNA, 20 bp, Artificial Sequence
  Description of Artificial Sequence: Synthetic oligonucleotide
  Target: ATXN1; (-) strand; PAM type: NRG; PAM sequence: GGG
accaccctgctttgctgtga

SEQ ID NO: 92002 - DNA, 20 bp, Artificial Sequence
  Description of Artificial Sequence: Synthetic oligonucleotide
  Target: ATXN1; (-) strand; PAM type: NRG; PAM sequence: AGG
gaccaccctgctttgctgtg

SEQ ID NO: 92003 - DNA, 20 bp, Artificial Sequence
  Description of Artificial Sequence: Synthetic oligonucleotide
  Target: ATXN1; (-) strand; PAM type: NRG; PAM sequence: GAG
tgaccaccctgctttgctgt

SEQ ID NO: 92004 - DNA, 20 bp, Artificial Sequence
  Description of Artificial Sequence: Synthetic oligonucleotide
  Target: ATXN1; (-) strand; PAM type: NRG; PAM sequence: CAG
ctggtttctgtcctacatcc

SEQ ID NO: 92005 - DNA, 20 bp, Artificial Sequence
  Description of Artificial Sequence: Synthetic oligonucleotide
  Target: ATXN1; (-) strand; PAM type: NRG; PAM sequence: TGG
tagaaagggtgggcagaacc

SEQ ID NO: 92006 - DNA, 20 bp, Artificial Sequence
  Description of Artificial Sequence: Synthetic oligonucleotide
  Target: ATXN1; (-) strand; PAM type: NRG; PAM sequence: CAG
tgagttgtagaaagggtggg

SEQ ID NO: 92007 - DNA, 20 bp, Artificial Sequence
  Description of Artificial Sequence: Synthetic oligonucleotide
  Target: ATXN1; (-) strand; PAM type: NRG; PAM sequence: GGG
ccttgagttgtagaaagggt

SEQ ID NO: 92008 - DNA, 20 bp, Artificial Sequence
  Description of Artificial Sequence: Synthetic oligonucleotide
  Target: ATXN1; (-) strand; PAM type: NRG; PAM sequence: TGG
accttgagttgtagaaaggg

SEQ ID NO: 92009 - DNA, 20 bp, Artificial Sequence
  Description of Artificial Sequence: Synthetic oligonucleotide
  Target: ATXN1; (-) strand; PAM type: NRG; PAM sequence: GGG
gagaccttgagttgtagaaa

SEQ ID NO: 92010 - DNA, 20 bp, Artificial Sequence
  Description of Artificial Sequence: Synthetic oligonucleotide
  Target: ATXN1; (-) strand; PAM type: NRG; PAM sequence: AGG
ggagaccttgagttgtagaa

SEQ ID NO: 92011 - DNA, 20 bp, Artificial Sequence
  Description of Artificial Sequence: Synthetic oligonucleotide
  Target: ATXN1; (-) strand; PAM type: NRG; PAM sequence: AAG
gggagaccttgagttgtaga

SEQ ID NO: 92012 - DNA, 20 bp, Artificial Sequence
  Description of Artificial Sequence: Synthetic oligonucleotide
  Target: ATXN1; (-) strand; PAM type: NRG; PAM sequence: TAG
gagagggagaccttgagttg

SEQ ID NO: 92013 - DNA, 20 bp, Artificial Sequence
  Description of Artificial Sequence: Synthetic oligonucleotide
  Target: ATXN1; (-) strand; PAM type: NRG; PAM sequence: GAG
gttggtgagagggagacctt

SEQ ID NO: 92014 - DNA, 20 bp, Artificial Sequence
  Description of Artificial Sequence: Synthetic oligonucleotide
  Target: ATXN1; (-) strand; PAM type: NRG; PAM sequence: GAG
gtagtggagttggtgagagg

SEQ ID NO: 92015 - DNA, 20 bp, Artificial Sequence
  Description of Artificial Sequence: Synthetic oligonucleotide
  Target: ATXN1; (-) strand; PAM type: NRG; PAM sequence: GGG
gtgtagtggagttggtgaga

SEQ ID NO: 92016 - DNA, 20 bp, Artificial Sequence
  Description of Artificial Sequence: Synthetic oligonucleotide
  Target: ATXN1; (-) strand; PAM type: NRG; PAM sequence: AGG
cgtgtagtggagttggtgag

SEQ ID NO: 92017 - DNA, 20 bp, Artificial Sequence
  Description of Artificial Sequence: Synthetic oligonucleotide
  Target: ATXN1; (-) strand; PAM type: NRG; PAM sequence: GAG
gcgtgtagtggagttggtga

SEQ ID NO: 92018 - DNA, 20 bp, Artificial Sequence
  Description of Artificial Sequence: Synthetic oligonucleotide
  Target: ATXN1; (-) strand; PAM type: NRG; PAM sequence: GAG
tggcgtgtagtggagttggt

SEQ ID NO: 92019 - DNA, 20 bp, Artificial Sequence
  Description of Artificial Sequence: Synthetic oligonucleotide
  Target: ATXN1; (-) strand; PAM type: NRG; PAM sequence: TGG
gtgatggcgtgtagtggagt

SEQ ID NO: 92020 - DNA, 20 bp, Artificial Sequence
  Description of Artificial Sequence: Synthetic oligonucleotide
  Target: ATXN1; (-) strand; PAM type: NRG; PAM sequence: GAG
atgggtgatggcgtgtagtg

SEQ ID NO: 92021 - DNA, 20 bp, Artificial Sequence
  Description of Artificial Sequence: Synthetic oligonucleotide
  Target: ATXN1; (-) strand; PAM type: NRG; PAM sequence: TGG
atatgggtgatggcgtgtag

SEQ ID NO: 92022 - DNA, 20 bp, Artificial Sequence
  Description of Artificial Sequence: Synthetic oligonucleotide
  Target: ATXN1; (-) strand; PAM type: NRG; PAM sequence: TAG
ggcatatgggtgatggcgtg

SEQ ID NO: 92023 - DNA, 20 bp, Artificial Sequence
  Description of Artificial Sequence: Synthetic oligonucleotide
  Target: ATXN1; (-) strand; PAM type: NRG; PAM sequence: TGG
aataccaggcatatgggtga

SEQ ID NO: 92024 - DNA, 20 bp, Artificial Sequence
  Description of Artificial Sequence: Synthetic oligonucleotide
  Target: ATXN1; (-) strand; PAM type: NRG; PAM sequence: GGG
gggcaaaataccaggcatat

SEQ ID NO: 92025 - DNA, 20 bp, Artificial Sequence
  Description of Artificial Sequence: Synthetic oligonucleotide
  Target: ATXN1; (-) strand; PAM type: NRG; PAM sequence: TGG
agggcaaaataccaggcata

SEQ ID NO: 92026 - DNA, 20 bp, Artificial Sequence
  Description of Artificial Sequence: Synthetic oligonucleotide
  Target: ATXN1; (-) strand; PAM type: NRG; PAM sequence: AGG
agcatttagggcaaaatacc

SEQ ID NO: 92027 - DNA, 20 bp, Artificial Sequence
  Description of Artificial Sequence: Synthetic oligonucleotide
  Target: ATXN1; (-) strand; PAM type: NRG; PAM sequence: CAG
tagcatttagggcaaaatac

SEQ ID NO: 92028 - DNA, 20 bp, Artificial Sequence
  Description of Artificial Sequence: Synthetic oligonucleotide
  Target: ATXN1; (-) strand; PAM type: NRG; PAM sequence: GGG
acttatttgtgtagcattta

SEQ ID NO: 92029 - DNA, 20 bp, Artificial Sequence
  Description of Artificial Sequence: Synthetic oligonucleotide
  Target: ATXN1; (-) strand; PAM type: NRG; PAM sequence: AGG
aacttatttgtgtagcattt

SEQ ID NO: 92030 - DNA, 20 bp, Artificial Sequence
  Description of Artificial Sequence: Synthetic oligonucleotide
  Target: ATXN1; (-) strand; PAM type: NRG; PAM sequence: TAG
taacttatttgtgtagcatt

SEQ ID NO: 92031 - DNA, 20 bp, Artificial Sequence
  Description of Artificial Sequence: Synthetic oligonucleotide
  Target: ATXN1; (-) strand; PAM type: NRG; PAM sequence: TAG
agttttctaacttatttgtg

SEQ ID NO: 92032 - DNA, 20 bp, Artificial Sequence
  Description of Artificial Sequence: Synthetic oligonucleotide
  Target: ATXN1; (-) strand; PAM type: NRG; PAM sequence: GAG
gatattaccattctcctttg

SEQ ID NO: 92033 - DNA, 20 bp, Artificial Sequence
  Description of Artificial Sequence: Synthetic oligonucleotide
  Target: ATXN1; (-) strand; PAM type: NRG; PAM sequence: TGG
atgatattaccattctcctt

SEQ ID NO: 92034 - DNA, 20 bp, Artificial Sequence
  Description of Artificial Sequence: Synthetic oligonucleotide
  Target: ATXN1; (-) strand; PAM type: NRG; PAM sequence: TAG
atcaatatacgtaatacccc

SEQ ID NO: 92035 - DNA, 20 bp, Artificial Sequence
  Description of Artificial Sequence: Synthetic oligonucleotide
  Target: ATXN1; (-) strand; PAM type: NRG; PAM sequence: AAG
ttatagtcaatgtaaggact

SEQ ID NO: 92036 - DNA, 20 bp, Artificial Sequence
  Description of Artificial Sequence: Synthetic oligonucleotide
  Target: ATXN1; (-) strand; PAM type: NRG; PAM sequence: AGG
tggggattatagtcaatgta

SEQ ID NO: 92037 - DNA, 20 bp, Artificial Sequence
  Description of Artificial Sequence: Synthetic oligonucleotide
  Target: ATXN1; (-) strand; PAM type: NRG; PAM sequence: AAG
gtggggattatagtcaatgt

SEQ ID NO: 92038 - DNA, 20 bp, Artificial Sequence
  Description of Artificial Sequence: Synthetic oligonucleotide
  Target: ATXN1; (-) strand; PAM type: NRG; PAM sequence: TAG
catctgaagagtggggatta

SEQ ID NO: 92039 - DNA, 20 bp, Artificial Sequence
  Description of Artificial Sequence: Synthetic oligonucleotide
  Target: ATXN1; (-) strand; PAM type: NRG; PAM sequence: GGG
gtttcttcatctgaagagtg

SEQ ID NO: 92040 - DNA, 20 bp, Artificial Sequence
  Description of Artificial Sequence: Synthetic oligonucleotide
  Target: ATXN1; (-) strand; PAM type: NRG; PAM sequence: GGG
agtttcttcatctgaagagt

SEQ ID NO: 92041 - DNA, 20 bp, Artificial Sequence
  Description of Artificial Sequence: Synthetic oligonucleotide
  Target: ATXN1; (-) strand; PAM type: NRG; PAM sequence: TGG
cagtttcttcatctgaagag

SEQ ID NO: 92042 - DNA, 20 bp, Artificial Sequence
  Description of Artificial Sequence: Synthetic oligonucleotide
  Target: ATXN1; (-) strand; PAM type: NRG; PAM sequence: GAG
cctcagtttcttcatctgaa

SEQ ID NO: 92043 - DNA, 20 bp, Artificial Sequence
  Description of Artificial Sequence: Synthetic oligonucleotide
  Target: ATXN1; (-) strand; PAM type: NRG; PAM sequence: AAG
tgcctcagtttcttcatctg

SEQ ID NO: 92044 - DNA, 20 bp, Artificial Sequence
  Description of Artificial Sequence: Synthetic oligonucleotide
  Target: ATXN1; (-) strand; PAM type: NRG; PAM sequence: CAG
ccctgaacctatctgtgcct

SEQ ID NO: 92045 - DNA, 20 bp, Artificial Sequence
  Description of Artificial Sequence: Synthetic oligonucleotide
  Target: ATXN1; (-) strand; PAM type: NRG; PAM sequence: AAG
tgacatttaccaccttggcc

SEQ ID NO: 92046 - DNA, 20 bp, Artificial Sequence
  Description of Artificial Sequence: Synthetic oligonucleotide
  Target: ATXN1; (-) strand; PAM type: NRG; PAM sequence: TGG
agccttgacatttaccacct

SEQ ID NO: 92047 - DNA, 20 bp, Artificial Sequence
  Description of Artificial Sequence: Synthetic oligonucleotide
  Target: ATXN1; (-) strand; PAM type: NRG; PAM sequence: CAG
tatctctctagttcgaatac

SEQ ID NO: 92048 - DNA, 20 bp, Artificial Sequence
  Description of Artificial Sequence: Synthetic oligonucleotide
  Target: ATXN1; (-) strand; PAM type: NRG; PAM sequence: TAG
ccagaattttgatatctctc

SEQ ID NO: 92049 - DNA, 20 bp, Artificial Sequence
  Description of Artificial Sequence: Synthetic oligonucleotide
  Target: ATXN1; (-) strand; PAM type: NRG; PAM sequence: CAG
tcatctgtggttgggtatac

SEQ ID NO: 92050 - DNA, 20 bp, Artificial Sequence
  Description of Artificial Sequence: Synthetic oligonucleotide
  Target: ATXN1; (-) strand; PAM type: NRG; PAM sequence: GGG
tgcgtccctcatctgtggtt

SEQ ID NO: 92051 - DNA, 20 bp, Artificial Sequence
  Description of Artificial Sequence: Synthetic oligonucleotide
  Target: ATXN1; (-) strand; PAM type: NRG; PAM sequence: TGG
ctgcgtccctcatctgtggt

SEQ ID NO: 92052 - DNA, 20 bp, Artificial Sequence
  Description of Artificial Sequence: Synthetic oligonucleotide
  Target: ATXN1; (-) strand; PAM type: NRG; PAM sequence: TGG
gtgcctgcgtccctcatctg

SEQ ID NO: 92053 - DNA, 20 bp, Artificial Sequence
  Description of Artificial Sequence: Synthetic oligonucleotide
  Target: ATXN1; (-) strand; PAM type: NRG; PAM sequence: AGG
ctgggatccacacttggtga

SEQ ID NO: 92054 - DNA, 20 bp, Artificial Sequence
  Description of Artificial Sequence: Synthetic oligonucleotide
  Target: ATXN1; (-) strand; PAM type: NRG; PAM sequence: AAG
gctgggatccacacttggtg

SEQ ID NO: 92055 - DNA, 20 bp, Artificial Sequence
  Description of Artificial Sequence: Synthetic oligonucleotide
  Target: ATXN1; (-) strand; PAM type: NRG; PAM sequence: TGG
ctgcagctgggatccacact

SEQ ID NO: 92056 - DNA, 20 bp, Artificial Sequence
  Description of Artificial Sequence: Synthetic oligonucleotide
  Target: ATXN1; (-) strand; PAM type: NRG; PAM sequence: GGG
tgccaagctgtcctgcagct

SEQ ID NO: 92057 - DNA, 20 bp, Artificial Sequence
  Description of Artificial Sequence: Synthetic oligonucleotide
  Target: ATXN1; (-) strand; PAM type: NRG; PAM sequence: TGG
atgccaagctgtcctgcagc

SEQ ID NO: 92058 - DNA, 20 bp, Artificial Sequence
  Description of Artificial Sequence: Synthetic oligonucleotide
  Target: ATXN1; (-) strand; PAM type: NRG; PAM sequence: CAG
gggaatgccaagctgtcctg

SEQ ID NO: 92059 - DNA, 20 bp, Artificial Sequence
  Description of Artificial Sequence: Synthetic oligonucleotide
  Target: ATXN1; (-) strand; PAM type: NRG; PAM sequence: AAG
gtgacggggaagggaatgcc

SEQ ID NO: 92060 - DNA, 20 bp, Artificial Sequence
  Description of Artificial Sequence: Synthetic oligonucleotide
  Target: ATXN1; (-) strand; PAM type: NRG; PAM sequence: GGG
agaagctgggtgacggggaa

SEQ ID NO: 92061 - DNA, 20 bp, Artificial Sequence
  Description of Artificial Sequence: Synthetic oligonucleotide
  Target: ATXN1; (-) strand; PAM type: NRG; PAM sequence: AGG
tagaagctgggtgacgggga

SEQ ID NO: 92062 - DNA, 20 bp, Artificial Sequence
  Description of Artificial Sequence: Synthetic oligonucleotide
  Target: ATXN1; (-) strand; PAM type: NRG; PAM sequence: AAG
atagaagctgggtgacgggg

SEQ ID NO: 92063 - DNA, 20 bp, Artificial Sequence
  Description of Artificial Sequence: Synthetic oligonucleotide
  Target: ATXN1; (-) strand; PAM type: NRG; PAM sequence: GGG
ggaatagaagctgggtgacg

SEQ ID NO: 92064 - DNA, 20 bp, Artificial Sequence
  Description of Artificial Sequence: Synthetic oligonucleotide
  Target: ATXN1; (-) strand; PAM type: NRG; PAM sequence: GGG
aggaatagaagctgggtgac

SEQ ID NO: 92065 - DNA, 20 bp, Artificial Sequence
  Description of Artificial Sequence: Synthetic oligonucleotide
  Target: ATXN1; (-) strand; PAM type: NRG; PAM sequence: CGG
aaggaatagaagctgggtga

SEQ ID NO: 92066 - DNA, 20 bp, Artificial Sequence
  Description of Artificial Sequence: Synthetic oligonucleotide
  Target: ATXN1; (-) strand; PAM type: NRG; PAM sequence: GGG
aatgggaaggaatagaagct

SEQ ID NO: 92067 - DNA, 20 bp, Artificial Sequence
  Description of Artificial Sequence: Synthetic oligonucleotide
  Target: ATXN1; (-) strand; PAM type: NRG; PAM sequence: TGG
gaatgggaaggaatagaagc

SEQ ID NO: 92068 - DNA, 20 bp, Artificial Sequence
  Description of Artificial Sequence: Synthetic oligonucleotide
  Target: ATXN1; (-) strand; PAM type: NRG; PAM sequence: AAG
aggagaatgggaaggaatag

SEQ ID NO: 92069 - DNA, 20 bp, Artificial Sequence
  Description of Artificial Sequence: Synthetic oligonucleotide
  Target: ATXN1; (-) strand; PAM type: NRG; PAM sequence: TAG
agaaggagaatgggaaggaa

SEQ ID NO: 92070 - DNA, 20 bp, Artificial Sequence
  Description of Artificial Sequence: Synthetic oligonucleotide
  Target: ATXN1; (-) strand; PAM type: NRG; PAM sequence: AGG
taaatagaaggagaatggga

SEQ ID NO: 92071 - DNA, 20 bp, Artificial Sequence
  Description of Artificial Sequence: Synthetic oligonucleotide
  Target: ATXN1; (-) strand; PAM type: NRG; PAM sequence: AAG
ataaatagaaggagaatggg

SEQ ID NO: 92072 - DNA, 20 bp, Artificial Sequence
  Description of Artificial Sequence: Synthetic oligonucleotide
  Target: ATXN1; (-) strand; PAM type: NRG; PAM sequence: GGG
ggaataaatagaaggagaat

SEQ ID NO: 92073 - DNA, 20 bp, Artificial Sequence
  Description of Artificial Sequence: Synthetic oligonucleotide
  Target: ATXN1; (-) strand; PAM type: NRG; PAM sequence: TGG
aggaataaatagaaggagaa

SEQ ID NO: 92074 - DNA, 20 bp, Artificial Sequence
  Description of Artificial Sequence: Synthetic oligonucleotide
  Target: ATXN1; (-) strand; PAM type: NRG; PAM sequence: GAG
taactaggaataaatagaag

SEQ ID NO: 92075 - DNA, 20 bp, Artificial Sequence
  Description of Artificial Sequence: Synthetic oligonucleotide
  Target: ATXN1; (-) strand; PAM type: NRG; PAM sequence: AGG
agtaactaggaataaataga

SEQ ID NO: 92076 - DNA, 20 bp, Artificial Sequence
  Description of Artificial Sequence: Synthetic oligonucleotide
  Target: ATXN1; (-) strand; PAM type: NRG; PAM sequence: AAG
tagtaactaggaataaatag

SEQ ID NO: 92077 - DNA, 20 bp, Artificial Sequence
  Description of Artificial Sequence: Synthetic oligonucleotide
  Target: ATXN1; (-) strand; PAM type: NRG; PAM sequence: TAG
tcttagtaactaggaataaa

SEQ ID NO: 92078 - DNA, 20 bp, Artificial Sequence
  Description of Artificial Sequence: Synthetic oligonucleotide
  Target: ATXN1; (-) strand; PAM type: NRG; PAM sequence: AGG
cttaaaaattcttagtaact

SEQ ID NO: 92079 - DNA, 20 bp, Artificial Sequence
  Description of Artificial Sequence: Synthetic oligonucleotide
  Target: ATXN1; (-) strand; PAM type: NRG; PAM sequence: TAG
ccttaaaaattcttagtaac

SEQ ID NO: 92080 - DNA, 20 bp, Artificial Sequence
  Description of Artificial Sequence: Synthetic oligonucleotide
  Target: ATXN1; (-) strand; PAM type: NRG; PAM sequence: TAG
gatagcaccttaaaaattct

SEQ ID NO: 92081 - DNA, 20 bp, Artificial Sequence
  Description of Artificial Sequence: Synthetic oligonucleotide
  Target: ATXN1; (-) strand; PAM type: NRG; PAM sequence: TAG
aagtagccctggaggtgtga

SEQ ID NO: 92082 - DNA, 20 bp, Artificial Sequence
  Description of Artificial Sequence: Synthetic oligonucleotide
  Target: ATXN1; (-) strand; PAM type: NRG; PAM sequence: AGG
gcttttggaagtagccctgg

SEQ ID NO: 92083 - DNA, 20 bp, Artificial Sequence
  Description of Artificial Sequence: Synthetic oligonucleotide
  Target: ATXN1; (-) strand; PAM type: NRG; PAM sequence: GAG
ggcttttggaagtagccctg

SEQ ID NO: 92084 - DNA, 20 bp, Artificial Sequence
  Description of Artificial Sequence: Synthetic oligonucleotide
  Target: ATXN1; (-) strand; PAM type: NRG; PAM sequence: TGG
taggcttttggaagtagccc

SEQ ID NO: 92085 - DNA, 20 bp, Artificial Sequence
  Description of Artificial Sequence: Synthetic oligonucleotide
  Target: ATXN1; (-) strand; PAM type: NRG; PAM sequence: TAG
ctcgactaggcttttggaag

SEQ ID NO: 92086 - DNA, 20 bp, Artificial Sequence
  Description of Artificial Sequence: Synthetic oligonucleotide
  Target: ATXN1; (-) strand; PAM type: NRG; PAM sequence: AAG
cagctcgactaggcttttgg

SEQ ID NO: 92087 - DNA, 20 bp, Artificial Sequence
  Description of Artificial Sequence: Synthetic oligonucleotide
  Target: ATXN1; (-) strand; PAM type: NRG; PAM sequence: TGG
agtcagctcgactaggcttt

SEQ ID NO: 92088 - DNA, 20 bp, Artificial Sequence
  Description of Artificial Sequence: Synthetic oligonucleotide
  Target: ATXN1; (-) strand; PAM type: NRG; PAM sequence: AGG
ccctttgagtcagctcgact

SEQ ID NO: 92089 - DNA, 20 bp, Artificial Sequence
  Description of Artificial Sequence: Synthetic oligonucleotide
  Target: ATXN1; (-) strand; PAM type: NRG; PAM sequence: TAG
tccctttgagtcagctcgac

SEQ ID NO: 92090 - DNA, 20 bp, Artificial Sequence
  Description of Artificial Sequence: Synthetic oligonucleotide
  Target: ATXN1; (-) strand; PAM type: NRG; PAM sequence: CAG
aaagaaccttccctttgagt

SEQ ID NO: 92091 - DNA, 20 bp, Artificial Sequence
  Description of Artificial Sequence: Synthetic oligonucleotide
  Target: ATXN1; (-) strand; PAM type: NRG; PAM sequence: GAG
ccctaaagaaccttcccttt

SEQ ID NO: 92092 - DNA, 20 bp, Artificial Sequence
  Description of Artificial Sequence: Synthetic oligonucleotide
  Target: ATXN1; (-) strand; PAM type: NRG; PAM sequence: AAG
ttggattgctgaggtcccta

SEQ ID NO: 92093 - DNA, 20 bp, Artificial Sequence
  Description of Artificial Sequence: Synthetic oligonucleotide
  Target: ATXN1; (-) strand; PAM type: NRG; PAM sequence: AGG
ctgctgtgtttggattgctg

SEQ ID NO: 92094 - DNA, 20 bp, Artificial Sequence
  Description of Artificial Sequence: Synthetic oligonucleotide
  Target: ATXN1; (-) strand; PAM type: NRG; PAM sequence: GAG
tctgctgtgtttggattgct

SEQ ID NO: 92095 - DNA, 20 bp, Artificial Sequence
  Description of Artificial Sequence: Synthetic oligonucleotide
  Target: ATXN1; (-) strand; PAM type: NRG; PAM sequence: TGG
tctcagatgtctgctgtgtt

SEQ ID NO: 92096 - DNA, 20 bp, Artificial Sequence
  Description of Artificial Sequence: Synthetic oligonucleotide
  Target: ATXN1; (-) strand; PAM type: NRG; PAM sequence: CAG
agacttgtttcaggatttct

SEQ ID NO: 92097 - DNA, 20 bp, Artificial Sequence
  Description of Artificial Sequence: Synthetic oligonucleotide
  Target: ATXN1; (-) strand; PAM type: NRG; PAM sequence: AGG
tctgtaggaagacttgtttc

SEQ ID NO: 92098 - DNA, 20 bp, Artificial Sequence
  Description of Artificial Sequence: Synthetic oligonucleotide
  Target: ATXN1; (-) strand; PAM type: NRG; PAM sequence: CAG
ttctgtaggaagacttgttt

SEQ ID NO: 92099 - DNA, 20 bp, Artificial Sequence
  Description of Artificial Sequence: Synthetic oligonucleotide
  Target: ATXN1; (-) strand; PAM type: NRG; PAM sequence: AAG
ggcagtcatcattctgtagg

SEQ ID NO: 92100 - DNA, 20 bp, Artificial Sequence
  Description of Artificial Sequence: Synthetic oligonucleotide
  Target: ATXN1; (-) strand; PAM type: NRG; PAM sequence: AGG
gcaggcagtcatcattctgt

SEQ ID NO: 92101 - DNA, 20 bp, Artificial Sequence
  Description of Artificial Sequence: Synthetic oligonucleotide
  Target: ATXN1; (-) strand; PAM type: NRG; PAM sequence: TAG
ggcaggcagtcatcattctg

SEQ ID NO: 92102 - DNA, 20 bp, Artificial Sequence
  Description of Artificial Sequence: Synthetic oligonucleotide
  Target: ATXN1; (-) strand; PAM type: NRG; PAM sequence: CAG
tcagttgccagagaggcagg

SEQ ID NO: 92103 - DNA, 20 bp, Artificial Sequence
  Description of Artificial Sequence: Synthetic oligonucleotide
  Target: ATXN1; (-) strand; PAM type: NRG; PAM sequence: AGG
ttctcagttgccagagaggc

SEQ ID NO: 92104 - DNA, 20 bp, Artificial Sequence
  Description of Artificial Sequence: Synthetic oligonucleotide
  Target: ATXN1; (-) strand; PAM type: NRG; PAM sequence: CAG
attctcagttgccagagagg

SEQ ID NO: 92105 - DNA, 20 bp, Artificial Sequence
  Description of Artificial Sequence: Synthetic oligonucleotide
  Target: ATXN1; (-) strand; PAM type: NRG; PAM sequence: AGG
cccattctcagttgccagag

SEQ ID NO: 92106 - DNA, 20 bp, Artificial Sequence
  Description of Artificial Sequence: Synthetic oligonucleotide
  Target: ATXN1; (-) strand; PAM type: NRG; PAM sequence: GAG
acccattctcagttgccaga

SEQ ID NO: 92107 - DNA, 20 bp, Artificial Sequence
  Description of Artificial Sequence: Synthetic oligonucleotide
  Target: ATXN1; (-) strand; PAM type: NRG; PAM sequence: GAG
aaacccattctcagttgcca

SEQ ID NO: 92108 - DNA, 20 bp, Artificial Sequence
  Description of Artificial Sequence: Synthetic oligonucleotide
  Target: ATXN1; (-) strand; PAM type: NRG; PAM sequence: CAG
taaaacccattctcagttgc

SEQ ID NO: 92109 - DNA, 20 bp, Artificial Sequence
  Description of Artificial Sequence: Synthetic oligonucleotide
  Target: ATXN1; (-) strand; PAM type: NRG; PAM sequence: CAG
atgtttttaaaacccattct

SEQ ID NO: 92110 - DNA, 20 bp, Artificial Sequence
  Description of Artificial Sequence: Synthetic oligonucleotide
  Target: ATXN1; (-) strand; PAM type: NRG; PAM sequence: AGG
gatactttgtacagtaaagg

SEQ ID NO: 92111 - DNA, 20 bp, Artificial Sequence
  Description of Artificial Sequence: Synthetic oligonucleotide
  Target: ATXN1; (-) strand; PAM type: NRG; PAM sequence: GAG
agatactttgtacagtaaag

SEQ ID NO: 92112 - DNA, 20 bp, Artificial Sequence
  Description of Artificial Sequence: Synthetic oligonucleotide
  Target: ATXN1; (-) strand; PAM type: NRG; PAM sequence: AGG
ccagatactttgtacagtaa

SEQ ID NO: 92113 - DNA, 20 bp, Artificial Sequence
  Description of Artificial Sequence: Synthetic oligonucleotide
  Target: ATXN1; (-) strand; PAM type: NRG; PAM sequence: AAG
accagatactttgtacagta

SEQ ID NO: 92114 - DNA, 20 bp, Artificial Sequence
  Description of Artificial Sequence: Synthetic oligonucleotide
  Target: ATXN1; (-) strand; PAM type: NRG; PAM sequence: CAG
ttgtgaccagatactttgta

SEQ ID NO: 92115 - DNA, 20 bp, Artificial Sequence
  Description of Artificial Sequence: Synthetic oligonucleotide
  Target: ATXN1; (-) strand; PAM type: NRG; PAM sequence: CAG
ccaataacaaactttgtgac

SEQ ID NO: 92116 - DNA, 20 bp, Artificial Sequence
  Description of Artificial Sequence: Synthetic oligonucleotide
  Target: ATXN1; (-) strand; PAM type: NRG; PAM sequence: TGG
gaggtcataatttttaatcc

SEQ ID NO: 92117 - DNA, 20 bp, Artificial Sequence
  Description of Artificial Sequence: Synthetic oligonucleotide
  Target: ATXN1; (-) strand; PAM type: NRG; PAM sequence: AGG
gtgagagagaaaaaaggcag

SEQ ID NO: 92118 - DNA, 20 bp, Artificial Sequence
  Description of Artificial Sequence: Synthetic oligonucleotide
  Target: ATXN1; (-) strand; PAM type: NRG; PAM sequence: GAG
ggtgagagagaaaaaaggca

SEQ ID NO: 92119 - DNA, 20 bp, Artificial Sequence
  Description of Artificial Sequence: Synthetic oligonucleotide
  Target: ATXN1; (-) strand; PAM type: NRG; PAM sequence: CAG
agggtgagagagaaaaaagg

SEQ ID NO: 92120 - DNA, 20 bp, Artificial Sequence
  Description of Artificial Sequence: Synthetic oligonucleotide
  Target: ATXN1; (-) strand; PAM type: NRG; PAM sequence: AGG
ataagggtgagagagaaaaa

SEQ ID NO: 92121 - DNA, 20 bp, Artificial Sequence
  Description of Artificial Sequence: Synthetic oligonucleotide
  Target: ATXN1; (-) strand; PAM type: NRG; PAM sequence: AAG
aataagggtgagagagaaaa

SEQ ID NO: 92122 - DNA, 20 bp, Artificial Sequence
  Description of Artificial Sequence: Synthetic oligonucleotide
  Target: ATXN1; (-) strand; PAM type: NRG; PAM sequence: GAG
ttgggagaataagggtgaga

SEQ ID NO: 92123 - DNA, 20 bp, Artificial Sequence
  Description of Artificial Sequence: Synthetic oligonucleotide
  Target: ATXN1; (-) strand; PAM type: NRG; PAM sequence: GAG
ccttgggagaataagggtga

SEQ ID NO: 92124 - DNA, 20 bp, Artificial Sequence
  Description of Artificial Sequence: Synthetic oligonucleotide
  Target: ATXN1; (-) strand; PAM type: NRG; PAM sequence: GAG
caccttgggagaataagggt

SEQ ID NO: 92125 - DNA, 20 bp, Artificial Sequence
  Description of Artificial Sequence: Synthetic oligonucleotide
  Target: ATXN1; (-) strand; PAM type: NRG; PAM sequence: GGG
tatacaccttgggagaataa

SEQ ID NO: 92126 - DNA, 20 bp, Artificial Sequence
  Description of Artificial Sequence: Synthetic oligonucleotide
  Target: ATXN1; (-) strand; PAM type: NRG; PAM sequence: AGG
atatacaccttgggagaata

SEQ ID NO: 92127 - DNA, 20 bp, Artificial Sequence
  Description of Artificial Sequence: Synthetic oligonucleotide
  Target: ATXN1; (-) strand; PAM type: NRG; PAM sequence: AAG
aatatacaccttgggagaat

SEQ ID NO: 92128 - DNA, 20 bp, Artificial Sequence
  Description of Artificial Sequence: Synthetic oligonucleotide
  Target: ATXN1; (-) strand; PAM type: NRG; PAM sequence: GAG
catataaatatacaccttgg

SEQ ID NO: 92129 - DNA, 20 bp, Artificial Sequence
  Description of Artificial Sequence: Synthetic oligonucleotide
  Target: ATXN1; (-) strand; PAM type: NRG; PAM sequence: GGG
aacatataaatatacacctt

SEQ ID NO: 92130 - DNA, 20 bp, Artificial Sequence
  Description of Artificial Sequence: Synthetic oligonucleotide
  Target: ATXN1; (-) strand; PAM type: NRG; PAM sequence: TGG
aaacatataaatatacacct

SEQ ID NO: 92131 - DNA, 20 bp, Artificial Sequence
  Description of Artificial Sequence: Synthetic oligonucleotide
  Target: ATXN1; (-) strand; PAM type: NRG; PAM sequence: TGG
ctccttttgaagtctgcctt

SEQ ID NO: 92132 - DNA, 20 bp, Artificial Sequence
  Description of Artificial Sequence: Synthetic oligonucleotide
  Target: ATXN1; (-) strand; PAM type: NRG; PAM sequence: AAG
ccacaggaaagctccttttg

SEQ ID NO: 92133 - DNA, 20 bp, Artificial Sequence
  Description of Artificial Sequence: Synthetic oligonucleotide
  Target: ATXN1; (-) strand; PAM type: NRG; PAM sequence: AAG
ttaccgctcaccccacagga

SEQ ID NO: 92134 - DNA, 20 bp, Artificial Sequence
  Description of Artificial Sequence: Synthetic oligonucleotide
  Target: ATXN1; (-) strand; PAM type: NRG; PAM sequence: AGG
tcatttaccgctcaccccac

SEQ ID NO: 92135 - DNA, 20 bp, Artificial Sequence
  Description of Artificial Sequence: Synthetic oligonucleotide
  Target: ATXN1; (-) strand; PAM type: NRG; PAM sequence: CAG
ttcatttaccgctcacccca

SEQ ID NO: 92136 - DNA, 20 bp, Artificial Sequence
  Description of Artificial Sequence: Synthetic oligonucleotide
  Target: ATXN1; (-) strand; PAM type: NRG; PAM sequence: CAG
ttctctttgctctctcagtc

SEQ ID NO: 92137 - DNA, 20 bp, Artificial Sequence
  Description of Artificial Sequence: Synthetic oligonucleotide
  Target: ATXN1; (-) strand; PAM type: NRG; PAM sequence: CAG
tcattttctctttgctctct

SEQ ID NO: 92138 - DNA, 20 bp, Artificial Sequence
  Description of Artificial Sequence: Synthetic oligonucleotide
  Target: ATXN1; (-) strand; PAM type: NRG; PAM sequence: CAG
gaaaacatttcaaagaaagc

SEQ ID NO: 92139 - DNA, 20 bp, Artificial Sequence
  Description of Artificial Sequence: Synthetic oligonucleotide
  Target: ATXN1; (-) strand; PAM type: NRG; PAM sequence: AAG
atgagaaaacatttcaaaga

SEQ ID NO: 92140 - DNA, 20 bp, Artificial Sequence
  Description of Artificial Sequence: Synthetic oligonucleotide
  Target: ATXN1; (-) strand; PAM type: NRG; PAM sequence: AAG
ttagatgagaaaacatttca

SEQ ID NO: 92141 - DNA, 20 bp, Artificial Sequence
  Description of Artificial Sequence: Synthetic oligonucleotide
  Target: ATXN1; (-) strand; PAM type: NRG; PAM sequence: GAG
agcagctcccaagtttagat

SEQ ID NO: 92142 - DNA, 20 bp, Artificial Sequence
  Description of Artificial Sequence: Synthetic oligonucleotide
  Target: ATXN1; (-) strand; PAM type: NRG; PAM sequence: TAG
aagccagcagctcccaagtt

SEQ ID NO: 92143 - DNA, 20 bp, Artificial Sequence
  Description of Artificial Sequence: Synthetic oligonucleotide
  Target: ATXN1; (-) strand; PAM type: NRG; PAM sequence: AAG
atacaaagccagcagctccc

SEQ ID NO: 92144 - DNA, 20 bp, Artificial Sequence
  Description of Artificial Sequence: Synthetic oligonucleotide
  Target: ATXN1; (-) strand; PAM type: NRG; PAM sequence: CAG
gtgagtaaatacaaagccag

SEQ ID NO: 92145 - DNA, 20 bp, Artificial Sequence
  Description of Artificial Sequence: Synthetic oligonucleotide
  Target: ATXN1; (-) strand; PAM type: NRG; PAM sequence: CAG
agggtgagtaaatacaaagc

SEQ ID NO: 92146 - DNA, 20 bp, Artificial Sequence
  Description of Artificial Sequence: Synthetic oligonucleotide
  Target: ATXN1; (-) strand; PAM type: NRG; PAM sequence: AAG
tttcagggtgagtaaataca

SEQ ID NO: 92147 - DNA, 20 bp, Artificial Sequence
  Description of Artificial Sequence: Synthetic oligonucleotide
  Target: ATXN1; (-) strand; PAM type: NRG; PAM sequence: GAG
cccagatgcagtttcagggt

SEQ ID NO: 92148 - DNA, 20 bp, Artificial Sequence
  Description of Artificial Sequence: Synthetic oligonucleotide
  Target: ATXN1; (-) strand; PAM type: NRG; PAM sequence: GGG
gagtcccagatgcagtttca

SEQ ID NO: 92149 - DNA, 20 bp, Artificial Sequence
  Description of Artificial Sequence: Synthetic oligonucleotide
  Target: ATXN1; (-) strand; PAM type: NRG; PAM sequence: AGG
ggagtcccagatgcagtttc

SEQ ID NO: 92150 - DNA, 20 bp, Artificial Sequence
  Description of Artificial Sequence: Synthetic oligonucleotide
  Target: ATXN1; (-) strand; PAM type: NRG; PAM sequence: CAG
cggagtcccagatgcagttt

SEQ ID NO: 92151 - DNA, 20 bp, Artificial Sequence
  Description of Artificial Sequence: Synthetic oligonucleotide
  Target: ATXN1; (-) strand; PAM type: NRG; PAM sequence: CAG
tgactccggagtcccagatg

SEQ ID NO: 92152 - DNA, 20 bp, Artificial Sequence
  Description of Artificial Sequence: Synthetic oligonucleotide
  Target: ATXN1; (-) strand; PAM type: NRG; PAM sequence: CAG
agagcttgactccggagtcc

SEQ ID NO: 92153 - DNA, 20 bp, Artificial Sequence
  Description of Artificial Sequence: Synthetic oligonucleotide
  Target: ATXN1; (-) strand; PAM type: NRG; PAM sequence: GAG
ttattcagagcttgactccg

SEQ ID NO: 92154 - DNA, 20 bp, Artificial Sequence
  Description of Artificial Sequence: Synthetic oligonucleotide
  Target: ATXN1; (-) strand; PAM type: NRG; PAM sequence: CGG
tgttattcagagcttgactc

SEQ ID NO: 92155 - DNA, 20 bp, Artificial Sequence
  Description of Artificial Sequence: Synthetic oligonucleotide
  Target: ATXN1; (-) strand; PAM type: NRG; PAM sequence: GAG
caggctttgaatgttattca

SEQ ID NO: 92156 - DNA, 20 bp, Artificial Sequence
  Description of Artificial Sequence: Synthetic oligonucleotide
  Target: ATXN1; (-) strand; PAM type: NRG; PAM sequence: CAG
tacaggctttgaatgttatt

SEQ ID NO: 92157 - DNA, 20 bp, Artificial Sequence
  Description of Artificial Sequence: Synthetic oligonucleotide
  Target: ATXN1; (-) strand; PAM type: NRG; PAM sequence: AGG
aaattcgaacgaaagaatac

SEQ ID NO: 92158 - DNA, 20 bp, Artificial Sequence
  Description of Artificial Sequence: Synthetic oligonucleotide
  Target: ATXN1; (-) strand; PAM type: NRG; PAM sequence: CAG
aaaattcgaacgaaagaata

SEQ ID NO: 92159 - DNA, 20 bp, Artificial Sequence
  Description of Artificial Sequence: Synthetic oligonucleotide
  Target: ATXN1; (-) strand; PAM type: NRG; PAM sequence: AAG
aatgcctaaaattcgaacga

SEQ ID NO: 92160 - DNA, 20 bp, Artificial Sequence
  Description of Artificial Sequence: Synthetic oligonucleotide
  Target: ATXN1; (-) strand; PAM type: NRG; PAM sequence: AAG
gtaaaagacataggtatgac

SEQ ID NO: 92161 - DNA, 20 bp, Artificial Sequence
  Description of Artificial Sequence: Synthetic oligonucleotide
  Target: ATXN1; (-) strand; PAM type: NRG; PAM sequence: AGG
tgcattgctgtaaaagacat

SEQ ID NO: 92162 - DNA, 20 bp, Artificial Sequence
  Description of Artificial Sequence: Synthetic oligonucleotide
  Target: ATXN1; (-) strand; PAM type: NRG; PAM sequence: TAG
ttgcattgctgtaaaagaca

SEQ ID NO: 92163 - DNA, 20 bp, Artificial Sequence
  Description of Artificial Sequence: Synthetic oligonucleotide
  Target: ATXN1; (-) strand; PAM type: NRG; PAM sequence: AAG
tttaagttgcattgctgtaa

SEQ ID NO: 92164 - DNA, 20 bp, Artificial Sequence
  Description of Artificial Sequence: Synthetic oligonucleotide
  Target: ATXN1; (-) strand; PAM type: NRG; PAM sequence: AAG
tttcagttattgcctcattt

SEQ ID NO: 92165 - DNA, 20 bp, Artificial Sequence
  Description of Artificial Sequence: Synthetic oligonucleotide
  Target: ATXN1; (-) strand; PAM type: NRG; PAM sequence: CAG
tctccctggttaagccattt

SEQ ID NO: 92166 - DNA, 20 bp, Artificial Sequence
  Description of Artificial Sequence: Synthetic oligonucleotide
  Target: ATXN1; (-) strand; PAM type: NRG; PAM sequence: AAG
taaaccacatctccctggtt

SEQ ID NO: 92167 - DNA, 20 bp, Artificial Sequence
  Description of Artificial Sequence: Synthetic oligonucleotide
  Target: ATXN1; (-) strand; PAM type: NRG; PAM sequence: TGG
ggtgctaaaccacatctccc

SEQ ID NO: 92168 - DNA, 20 bp, Artificial Sequence
  Description of Artificial Sequence: Synthetic oligonucleotide
  Target: ATXN1; (-) strand; PAM type: NRG; PAM sequence: TGG
tggatggctggattgcaaca

SEQ ID NO: 92169 - DNA, 20 bp, Artificial Sequence
  Description of Artificial Sequence: Synthetic oligonucleotide
  Target: ATXN1; (-) strand; PAM type: NRG; PAM sequence: TGG
ctccatgagggttggatggc

SEQ ID NO: 92170 - DNA, 20 bp, Artificial Sequence
  Description of Artificial Sequence: Synthetic oligonucleotide
  Target: ATXN1; (-) strand; PAM type: NRG; PAM sequence: TGG
agacctccatgagggttgga

SEQ ID NO: 92171 - DNA, 20 bp, Artificial Sequence
  Description of Artificial Sequence: Synthetic oligonucleotide
  Target: ATXN1; (-) strand; PAM type: NRG; PAM sequence: TGG
tcagagacctccatgagggt

SEQ ID NO: 92172 - DNA, 20 bp, Artificial Sequence
  Description of Artificial Sequence: Synthetic oligonucleotide
  Target: ATXN1; (-) strand; PAM type: NRG; PAM sequence: GGG
caactcagagacctccatga

SEQ ID NO: 92173 - DNA, 20 bp, Artificial Sequence
  Description of Artificial Sequence: Synthetic oligonucleotide
  Target: ATXN1; (-) strand; PAM type: NRG; PAM sequence: AGG
ccaactcagagacctccatg

SEQ ID NO: 92174 - DNA, 20 bp, Artificial Sequence
  Description of Artificial Sequence: Synthetic oligonucleotide
  Target: ATXN1; (-) strand; PAM type: NRG; PAM sequence: GAG
cccaactcagagacctccat

SEQ ID NO: 92175 - DNA, 20 bp, Artificial Sequence
  Description of Artificial Sequence: Synthetic oligonucleotide
  Target: ATXN1; (-) strand; PAM type: NRG; PAM sequence: GAG
tggtaggttcccccaactca

SEQ ID NO: 92176 - DNA, 20 bp, Artificial Sequence
  Description of Artificial Sequence: Synthetic oligonucleotide
  Target: ATXN1; (-) strand; PAM type: NRG; PAM sequence: CAG
gttggtaggttcccccaact

SEQ ID NO: 92177 - DNA, 20 bp, Artificial Sequence
  Description of Artificial Sequence: Synthetic oligonucleotide
  Target: ATXN1; (-) strand; PAM type: NRG; PAM sequence: AGG
tcagtaaaccagttgttggt

SEQ ID NO: 92178 - DNA, 20 bp, Artificial Sequence
  Description of Artificial Sequence: Synthetic oligonucleotide
  Target: ATXN1; (-) strand; PAM type: NRG; PAM sequence: TAG
ctcagtaaaccagttgttgg

SEQ ID NO: 92179 - DNA, 20 bp, Artificial Sequence
  Description of Artificial Sequence: Synthetic oligonucleotide
  Target: ATXN1; (-) strand; PAM type: NRG; PAM sequence: TGG
gatctcagtaaaccagttgt

SEQ ID NO: 92180 - DNA, 20 bp, Artificial Sequence
  Description of Artificial Sequence: Synthetic oligonucleotide
  Target: ATXN1; (-) strand; PAM type: NRG; PAM sequence: CAG
gctgtgagatctcagtaaac

SEQ ID NO: 92181 - DNA, 20 bp, Artificial Sequence
  Description of Artificial Sequence: Synthetic oligonucleotide
  Target: ATXN1; (-) strand; PAM type: NRG; PAM sequence: CAG
tagtgtgggctgtgagatct

SEQ ID NO: 92182 - DNA, 20 bp, Artificial Sequence
  Description of Artificial Sequence: Synthetic oligonucleotide
  Target: ATXN1; (-) strand; PAM type: NRG; PAM sequence: GAG
agcatcatagtgtgggctgt

SEQ ID NO: 92183 - DNA, 20 bp, Artificial Sequence
  Description of Artificial Sequence: Synthetic oligonucleotide
  Target: ATXN1; (-) strand; PAM type: NRG; PAM sequence: GGG
cacccaaagcatcatagtgt

SEQ ID NO: 92184 - DNA, 20 bp, Artificial Sequence
  Description of Artificial Sequence: Synthetic oligonucleotide
  Target: ATXN1; (-) strand; PAM type: NRG; PAM sequence: TGG
gcacccaaagcatcatagtg

SEQ ID NO: 92185 - DNA, 20 bp, Artificial Sequence
  Description of Artificial Sequence: Synthetic oligonucleotide
  Target: ATXN1; (-) strand; PAM type: NRG; PAM sequence: TAG
tagtggcacccaaagcatca

SEQ ID NO: 92186 - DNA, 20 bp, Artificial Sequence
  Description of Artificial Sequence: Synthetic oligonucleotide
  Target: ATXN1; (-) strand; PAM type: NRG; PAM sequence: AAG
cttttagttagtggcaccca

SEQ ID NO: 92187 - DNA, 20 bp, Artificial Sequence
  Description of Artificial Sequence: Synthetic oligonucleotide
  Target: ATXN1; (-) strand; PAM type: NRG; PAM sequence: TGG
aagagggaccttttagttag

SEQ ID NO: 92188 - DNA, 20 bp, Artificial Sequence
  Description of Artificial Sequence: Synthetic oligonucleotide
  Target: ATXN1; (-) strand; PAM type: NRG; PAM sequence: TAG
aaaaagagggaccttttagt

SEQ ID NO: 92189 - DNA, 20 bp, Artificial Sequence
  Description of Artificial Sequence: Synthetic oligonucleotide
  Target: ATXN1; (-) strand; PAM type: NRG; PAM sequence: TAG
aattaaaaagagggaccttt

SEQ ID NO: 92190 - DNA, 20 bp, Artificial Sequence
  Description of Artificial Sequence: Synthetic oligonucleotide
  Target: ATXN1; (-) strand; PAM type: NRG; PAM sequence: GGG
gcaatagataattaaaaaga

SEQ ID NO: 92191 - DNA, 20 bp, Artificial Sequence
  Description of Artificial Sequence: Synthetic oligonucleotide
  Target: ATXN1; (-) strand; PAM type: NRG; PAM sequence: AGG
tgcaatagataattaaaaag

SEQ ID NO: 92192 - DNA, 20 bp, Artificial Sequence
  Description of Artificial Sequence: Synthetic oligonucleotide
  Target: ATXN1; (-) strand; PAM type: NRG; PAM sequence: GAG
ttgcaatagataattaaaaa

SEQ ID NO: 92193 - DNA, 20 bp, Artificial Sequence
  Description of Artificial Sequence: Synthetic oligonucleotide
  Target: ATXN1; (-) strand; PAM type: NRG; PAM sequence: AAG
cgttgcaatagataattaaa

SEQ ID NO: 92194 - DNA, 20 bp, Artificial Sequence
  Description of Artificial Sequence: Synthetic oligonucleotide
  Target: ATXN1; (-) strand; PAM type: NRG; PAM sequence: TAG
caaaaatataaccgttgcaa

SEQ ID NO: 92195 - DNA, 20 bp, Artificial Sequence
  Description of Artificial Sequence: Synthetic oligonucleotide
  Target: ATXN1; (-) strand; PAM type: NRG; PAM sequence: TAG
ggtgggagggccagaatcca

SEQ ID NO: 92196 - DNA, 20 bp, Artificial Sequence
  Description of Artificial Sequence: Synthetic oligonucleotide
  Target: ATXN1; (-) strand; PAM type: NRG; PAM sequence: CAG
caggaatcaggtgggagggc

SEQ ID NO: 92197 - DNA, 20 bp, Artificial Sequence
  Description of Artificial Sequence: Synthetic oligonucleotide
  Target: ATXN1; (-) strand; PAM type: NRG; PAM sequence: GGG
gtgtcaggaatcaggtggga

SEQ ID NO: 92198 - DNA, 20 bp, Artificial Sequence
  Description of Artificial Sequence: Synthetic oligonucleotide
  Target: ATXN1; (-) strand; PAM type: NRG; PAM sequence: AGG
tgtgtcaggaatcaggtggg

SEQ ID NO: 92199 - DNA, 20 bp, Artificial Sequence
  Description of Artificial Sequence: Synthetic oligonucleotide
  Target: ATXN1; (-) strand; PAM type: NRG; PAM sequence: GAG
ctgtgtcaggaatcaggtgg

SEQ ID NO: 92200 - DNA, 20 bp, Artificial Sequence
  Description of Artificial Sequence: Synthetic oligonucleotide
  Target: ATXN1; (-) strand; PAM type: NRG; PAM sequence: GGG
ctctgtgtcaggaatcaggt

SEQ ID NO: 92201 - DNA, 20 bp, Artificial Sequence
  Description of Artificial Sequence: Synthetic oligonucleotide
  Target: ATXN1; (-) strand; PAM type: NRG; PAM sequence: TGG
tctctgtgtcaggaatcagg

SEQ ID NO: 92202 - DNA, 20 bp, Artificial Sequence
  Description of Artificial Sequence: Synthetic oligonucleotide
  Target: ATXN1; (-) strand; PAM type: NRG; PAM sequence: AGG
ttttctctgtgtcaggaatc

SEQ ID NO: 92203 - DNA, 20 bp, Artificial Sequence
  Description of Artificial Sequence: Synthetic oligonucleotide
  Target: ATXN1; (-) strand; PAM type: NRG; PAM sequence: CAG
attttctctgtgtcaggaat

SEQ ID NO: 92204 - DNA, 20 bp, Artificial Sequence
  Description of Artificial Sequence: Synthetic oligonucleotide
  Target: ATXN1; (-) strand; PAM type: NRG; PAM sequence: AGG
agggccattttctctgtgtc

SEQ ID NO: 92205 - DNA, 20 bp, Artificial Sequence
  Description of Artificial Sequence: Synthetic oligonucleotide
  Target: ATXN1; (-) strand; PAM type: NRG; PAM sequence: CAG
gagggccattttctctgtgt

SEQ ID NO: 92206 - DNA, 20 bp, Artificial Sequence
  Description of Artificial Sequence: Synthetic oligonucleotide
  Target: ATXN1; (-) strand; PAM type: NRG; PAM sequence: GGG
ctacgtgactgatgttcaga

SEQ ID NO: 92207 - DNA, 20 bp, Artificial Sequence
  Description of Artificial Sequence: Synthetic oligonucleotide
  Target: ATXN1; (-) strand; PAM type: NRG; PAM sequence: AGG
cctacgtgactgatgttcag

SEQ ID NO: 92208 - DNA, 20 bp, Artificial Sequence
  Description of Artificial Sequence: Synthetic oligonucleotide
  Target: ATXN1; (-) strand; PAM type: NRG; PAM sequence: GAG
ccctacgtgactgatgttca

SEQ ID NO: 92209 - DNA, 20 bp, Artificial Sequence
  Description of Artificial Sequence: Synthetic oligonucleotide
  Target: ATXN1; (-) strand; PAM type: NRG; PAM sequence: CAG
taccctacgtgactgatgtt

SEQ ID NO: 92210 - DNA, 20 bp, Artificial Sequence
  Description of Artificial Sequence: Synthetic oligonucleotide
  Target: ATXN1; (-) strand; PAM type: NRG; PAM sequence: AAG
ctgctaagcacttagtcctt

SEQ ID NO: 92211 - DNA, 20 bp, Artificial Sequence
  Description of Artificial Sequence: Synthetic oligonucleotide
  Target: ATXN1; (-) strand; PAM type: NRG; PAM sequence: TAG
caaacagactgctaagcact

SEQ ID NO: 92212 - DNA, 20 bp, Artificial Sequence
  Description of Artificial Sequence: Synthetic oligonucleotide
  Target: ATXN1; (-) strand; PAM type: NRG; PAM sequence: AAG
tgtgtgccaaacagactgct

SEQ ID NO: 92213 - DNA, 20 bp, Artificial Sequence
  Description of Artificial Sequence: Synthetic oligonucleotide
  Target: ATXN1; (-) strand; PAM type: NRG; PAM sequence: CAG
agcacctactgtgtgccaaa

SEQ ID NO: 92214 - DNA, 20 bp, Artificial Sequence
  Description of Artificial Sequence: Synthetic oligonucleotide
  Target: ATXN1; (-) strand; PAM type: NRG; PAM sequence: GAG
aaaggtaatcaacatttatt

SEQ ID NO: 92215 - DNA, 20 bp, Artificial Sequence
  Description of Artificial Sequence: Synthetic oligonucleotide
  Target: ATXN1; (-) strand; PAM type: NRG; PAM sequence: AGG
atttggggaaaaaggaagaa

SEQ ID NO: 92216 - DNA, 20 bp, Artificial Sequence
  Description of Artificial Sequence: Synthetic oligonucleotide
  Target: ATXN1; (-) strand; PAM type: NRG; PAM sequence: AAG
catttggggaaaaaggaaga

SEQ ID NO: 92217 - DNA, 20 bp, Artificial Sequence
  Description of Artificial Sequence: Synthetic oligonucleotide
  Target: ATXN1; (-) strand; PAM type: NRG; PAM sequence: AAG
cattcatttggggaaaaagg

SEQ ID NO: 92218 - DNA, 20 bp, Artificial Sequence
  Description of Artificial Sequence: Synthetic oligonucleotide
  Target: ATXN1; (-) strand; PAM type: NRG; PAM sequence: AGG
tttcattcatttggggaaaa

SEQ ID NO: 92219 - DNA, 20 bp, Artificial Sequence
  Description of Artificial Sequence: Synthetic oligonucleotide
  Target: ATXN1; (-) strand; PAM type: NRG; PAM sequence: AAG
ttttcattcatttggggaaa

SEQ ID NO: 92220 - DNA, 20 bp, Artificial Sequence
  Description of Artificial Sequence: Synthetic oligonucleotide
  Target: ATXN1; (-) strand; PAM type: NRG; PAM sequence: GGG
agaggtttttcattcatttg

SEQ ID NO: 92221 - DNA, 20 bp, Artificial Sequence
  Description of Artificial Sequence: Synthetic oligonucleotide
  Target: ATXN1; (-) strand; PAM type: NRG; PAM sequence: GGG
gagaggtttttcattcattt

SEQ ID NO: 92222 - DNA, 20 bp, Artificial Sequence
  Description of Artificial Sequence: Synthetic oligonucleotide
  Target: ATXN1; (-) strand; PAM type: NRG; PAM sequence: TGG
tgagaggtttttcattcatt

SEQ ID NO: 92223 - DNA, 20 bp, Artificial Sequence
  Description of Artificial Sequence: Synthetic oligonucleotide
  Target: ATXN1; (-) strand; PAM type: NRG; PAM sequence: AGG
gttgccatctctgagatgag

SEQ ID NO: 92224 - DNA, 20 bp, Artificial Sequence
  Description of Artificial Sequence: Synthetic oligonucleotide
  Target: ATXN1; (-) strand; PAM type: NRG; PAM sequence: GAG
tgttgccatctctgagatga

SEQ ID NO: 92225 - DNA, 20 bp, Artificial Sequence
  Description of Artificial Sequence: Synthetic oligonucleotide
  Target: ATXN1; (-) strand; PAM type: NRG; PAM sequence: GAG
tctgttgccatctctgagat

SEQ ID NO: 92226 - DNA, 20 bp, Artificial Sequence
  Description of Artificial Sequence: Synthetic oligonucleotide
  Target: ATXN1; (-) strand; PAM type: NRG; PAM sequence: GAG
tttaatctgttgccatctct

SEQ ID NO: 92227 - DNA, 20 bp, Artificial Sequence
  Description of Artificial Sequence: Synthetic oligonucleotide
  Target: ATXN1; (-) strand; PAM type: NRG; PAM sequence: AAG
tcgcgcttggccaatttttg

SEQ ID NO: 92228 - DNA, 20 bp, Artificial Sequence
  Description of Artificial Sequence: Synthetic oligonucleotide
  Target: ATXN1; (-) strand; PAM type: NRG; PAM sequence: TGG
caggcgtgcgccatcgcgct

SEQ ID NO: 92229 - DNA, 20 bp, Artificial Sequence
  Description of Artificial Sequence: Synthetic oligonucleotide
  Target: ATXN1; (-) strand; PAM type: NRG; PAM sequence: AGG
tcccaaattgctgggattac

SEQ ID NO: 92230 - DNA, 20 bp, Artificial Sequence
  Description of Artificial Sequence: Synthetic oligonucleotide
  Target: ATXN1; (-) strand; PAM type: NRG; PAM sequence: CAG
ctcccaaattgctgggatta

SEQ ID NO: 92231 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaattgct

SEQ ID NO: 92232 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaattgc

SEQ ID NO: 92233 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatctgcctgcct

SEQ ID NO: 92234 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaactcctgacctc

SEQ ID NO: 92235 - DNA, 20 bp, Artificial Sequence
  Description of Artificial Sequence: Synthetic oligonucleotide
  Target: ATXN1; (-) strand; PAM type: NRG; PAM sequence: TGG
tttcaccgtgttggtcaggc

SEQ ID NO: 92236 - DNA, 20 bp, Artificial Sequence
  Description of Artificial Sequence: Synthetic oligonucleotide
  Target: ATXN1; (-) strand; PAM type: NRG; PAM sequence: AGG
tgggtttcaccgtgttggtc

SEQ ID NO: 92237 - DNA, 20 bp, Artificial Sequence
  Description of Artificial Sequence: Synthetic oligonucleotide
  Target: ATXN1; (-) strand; PAM type: NRG; PAM sequence: CAG
ttgggtttcaccgtgttggt

SEQ ID NO: 92238 - DNA, 20 bp, Artificial Sequence
  Description of Artificial Sequence: Synthetic oligonucleotide
  Target: ATXN1; (-) strand; PAM type: NRG; PAM sequence: TGG
gagattgggtttcaccgtgt

SEQ ID NO: 92239 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatt

SEQ ID NO: 92240 - DNA, 20 bp, Artificial Sequence
  Description of Artificial Sequence: Synthetic oligonucleotide
  Target: ATXN1; (-) strand; PAM type: NRG; PAM sequence: TGG
tttgtatttttagtagagat

SEQ ID NO: 92241 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 92242 - DNA, 20 bp, Artificial Sequence
  Description of Artificial Sequence: Synthetic oligonucleotide
  Target: ATXN1; (-) strand; PAM type: NRG; PAM sequence: TAG
actaatttttgtatttttag

SEQ ID NO: 92243 - DNA, 20 bp, Artificial Sequence
  Description of Artificial Sequence: Synthetic oligonucleotide
  Target: ATXN1; (-) strand; PAM type: NRG; PAM sequence: TAG
ccgactaatttttgtatttt

SEQ ID NO: 92244 - DNA, 20 bp, Artificial Sequence
  Description of Artificial Sequence: Synthetic oligonucleotide
  Target: ATXN1; (-) strand; PAM type: NRG; PAM sequence: AGG
agcctcctgagtagctgtac

SEQ ID NO: 92245 - DNA, 20 bp, Artificial Sequence
  Description of Artificial Sequence: Synthetic oligonucleotide
  Target: ATXN1; (-) strand; PAM type: NRG; PAM sequence: CAG
cagcctcctgagtagctgta

SEQ ID NO: 92246 - DNA, 20 bp, Artificial Sequence
  Description of Artificial Sequence: Synthetic oligonucleotide
  Target: ATXN1; (-) strand; PAM type: NRG; PAM sequence: TAG
tcctgccccagcctcctgag

SEQ ID NO: 92247 - DNA, 20 bp, Artificial Sequence
  Description of Artificial Sequence: Synthetic oligonucleotide
  Target: ATXN1; (-) strand; PAM type: NRG; PAM sequence: GAG
ttctcctgccccagcctcct

SEQ ID NO: 92248 - DNA, 20 bp, Artificial Sequence
  Description of Artificial Sequence: Synthetic oligonucleotide
  Target: ATXN1; (-) strand; PAM type: NRG; PAM sequence: CAG
ttcaggtgattctcctgccc

SEQ ID NO: 92249 - DNA, 20 bp, Artificial Sequence
  Description of Artificial Sequence: Synthetic oligonucleotide
  Target: ATXN1; (-) strand; PAM type: NRG; PAM sequence: AGG
aatgtccatctcccgggttc

SEQ ID NO: 92250 - DNA, 20 bp, Artificial Sequence
  Description of Artificial Sequence: Synthetic oligonucleotide
  Target: ATXN1; (-) strand; PAM type: NRG; PAM sequence: CAG
taatgtccatctcccgggtt

SEQ ID NO: 92251 - DNA, 20 bp, Artificial Sequence
  Description of Artificial Sequence: Synthetic oligonucleotide
  Target: ATXN1; (-) strand; PAM type: NRG; PAM sequence: GGG
cactgtaatgtccatctccc

SEQ ID NO: 92252 - DNA, 20 bp, Artificial Sequence
  Description of Artificial Sequence: Synthetic oligonucleotide
  Target: ATXN1; (-) strand; PAM type: NRG; PAM sequence: CGG
tcactgtaatgtccatctcc

SEQ ID NO: 92253 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggggtgcaa

SEQ ID NO: 92254 - DNA, 20 bp, Artificial Sequence
  Description of Artificial Sequence: Synthetic oligonucleotide
  Target: ATXN1; (-) strand; PAM type: NRG; PAM sequence: GGG
tcactctgttgcccaggctg

SEQ ID NO: 92255 - DNA, 20 bp, Artificial Sequence
  Description of Artificial Sequence: Synthetic oligonucleotide
  Target: ATXN1; (-) strand; PAM type: NRG; PAM sequence: GGG
ctcactctgttgcccaggct

SEQ ID NO: 92256 - DNA, 20 bp, Artificial Sequence
  Description of Artificial Sequence: Synthetic oligonucleotide
  Target: ATXN1; (-) strand; PAM type: NRG; PAM sequence: TGG
actcactctgttgcccaggc

SEQ ID NO: 92257 - DNA, 20 bp, Artificial Sequence
  Description of Artificial Sequence: Synthetic oligonucleotide
  Target: ATXN1; (-) strand; PAM type: NRG; PAM sequence: AGG
cctcactcactctgttgccc

SEQ ID NO: 92258 - DNA, 20 bp, Artificial Sequence
  Description of Artificial Sequence: Synthetic oligonucleotide
  Target: ATXN1; (-) strand; PAM type: NRG; PAM sequence: CAG
gcctcactcactctgttgcc

SEQ ID NO: 92259 - DNA, 20 bp, Artificial Sequence
  Description of Artificial Sequence: Synthetic oligonucleotide
  Target: ATXN1; (-) strand; PAM type: NRG; PAM sequence: GAG
aatttatttattttgggacg

SEQ ID NO: 92260 - DNA, 20 bp, Artificial Sequence
  Description of Artificial Sequence: Synthetic oligonucleotide
  Target: ATXN1; (-) strand; PAM type: NRG; PAM sequence: CGG
ttaatttatttattttggga

SEQ ID NO: 92261 - DNA, 20 bp, Artificial Sequence
  Description of Artificial Sequence: Synthetic oligonucleotide
  Target: ATXN1; (-) strand; PAM type: NRG; PAM sequence: GGG
tttattaatttatttatttt

SEQ ID NO: 92262 - DNA, 20 bp, Artificial Sequence
  Description of Artificial Sequence: Synthetic oligonucleotide
  Target: ATXN1; (-) strand; PAM type: NRG; PAM sequence: TGG
atttattaatttatttattt

SEQ ID NO: 92263 - DNA, 20 bp, Artificial Sequence
  Description of Artificial Sequence: Synthetic oligonucleotide
  Target: ATXN1; (-) strand; PAM type: NRG; PAM sequence: AAG
aattttataaaggaaattcc

SEQ ID NO: 92264 - DNA, 20 bp, Artificial Sequence
  Description of Artificial Sequence: Synthetic oligonucleotide
  Target: ATXN1; (-) strand; PAM type: NRG; PAM sequence: AGG
gcagacatctaattttataa

SEQ ID NO: 92265 - DNA, 20 bp, Artificial Sequence
  Description of Artificial Sequence: Synthetic oligonucleotide
  Target: ATXN1; (-) strand; PAM type: NRG; PAM sequence: AAG
tgcagacatctaattttata

SEQ ID NO: 92266 - DNA, 20 bp, Artificial Sequence
  Description of Artificial Sequence: Synthetic oligonucleotide
  Target: ATXN1; (-) strand; PAM type: NRG; PAM sequence: CAG
aacaaacttcatttaatatg

SEQ ID NO: 92267 - DNA, 20 bp, Artificial Sequence
  Description of Artificial Sequence: Synthetic oligonucleotide
  Target: ATXN1; (-) strand; PAM type: NRG; PAM sequence: CAG
gaatttaaattgtaatcaag

SEQ ID NO: 92268 - DNA, 20 bp, Artificial Sequence
  Description of Artificial Sequence: Synthetic oligonucleotide
  Target: ATXN1; (-) strand; PAM type: NRG; PAM sequence: AAG
cttgaatttaaattgtaatc

SEQ ID NO: 92269 - DNA, 20 bp, Artificial Sequence
  Description of Artificial Sequence: Synthetic oligonucleotide
  Target: ATXN1; (-) strand; PAM type: NRG; PAM sequence: TAG
tctacctataaagggatttt

SEQ ID NO: 92270 - DNA, 20 bp, Artificial Sequence
  Description of Artificial Sequence: Synthetic oligonucleotide
  Target: ATXN1; (-) strand; PAM type: NRG; PAM sequence: GGG
ccctaacttctacctataaa

SEQ ID NO: 92271 - DNA, 20 bp, Artificial Sequence
  Description of Artificial Sequence: Synthetic oligonucleotide
  Target: ATXN1; (-) strand; PAM type: NRG; PAM sequence: AGG
tccctaacttctacctataa

SEQ ID NO: 92272 - DNA, 20 bp, Artificial Sequence
  Description of Artificial Sequence: Synthetic oligonucleotide
  Target: ATXN1; (-) strand; PAM type: NRG; PAM sequence: AAG
ttccctaacttctacctata

SEQ ID NO: 92273 - DNA, 20 bp, Artificial Sequence
  Description of Artificial Sequence: Synthetic oligonucleotide
  Target: ATXN1; (-) strand; PAM type: NRG; PAM sequence: AAG
ttttaccctttaactccaga

SEQ ID NO: 92274 - DNA, 20 bp, Artificial Sequence
  Description of Artificial Sequence: Synthetic oligonucleotide
  Target: ATXN1; (-) strand; PAM type: NRG; PAM sequence: CAG
actgttttaccctttaactc

SEQ ID NO: 92275 - DNA, 20 bp, Artificial Sequence
  Description of Artificial Sequence: Synthetic oligonucleotide
  Target: ATXN1; (-) strand; PAM type: NRG; PAM sequence: AAG
tttctgtattttgtagaatt

SEQ ID NO: 92276 - DNA, 20 bp, Artificial Sequence
  Description of Artificial Sequence: Synthetic oligonucleotide
  Target: ATXN1; (-) strand; PAM type: NRG; PAM sequence: TAG
aatattctttctgtattttg

SEQ ID NO: 92277 - DNA, 20 bp, Artificial Sequence
  Description of Artificial Sequence: Synthetic oligonucleotide
  Target: ATXN1; (-) strand; PAM type: NRG; PAM sequence: GGG
acatggttcctaaggaaggt

SEQ ID NO: 92278 - DNA, 20 bp, Artificial Sequence
  Description of Artificial Sequence: Synthetic oligonucleotide
  Target: ATXN1; (-) strand; PAM type: NRG; PAM sequence: TGG
cacatggttcctaaggaagg

SEQ ID NO: 92279 - DNA, 20 bp, Artificial Sequence
  Description of Artificial Sequence: Synthetic oligonucleotide
  Target: ATXN1; (-) strand; PAM type: NRG; PAM sequence: AGG
gtacacatggttcctaagga

SEQ ID NO: 92280 - DNA, 20 bp, Artificial Sequence
  Description of Artificial Sequence: Synthetic oligonucleotide
  Target: ATXN1; (-) strand; PAM type: NRG; PAM sequence: AAG
ggtacacatggttcctaagg

SEQ ID NO: 92281 - DNA, 20 bp, Artificial Sequence
  Description of Artificial Sequence: Synthetic oligonucleotide
  Target: ATXN1; (-) strand; PAM type: NRG; PAM sequence: AGG
cttggtacacatggttccta

SEQ ID NO: 92282 - DNA, 20 bp, Artificial Sequence
  Description of Artificial Sequence: Synthetic oligonucleotide
  Target: ATXN1; (-) strand; PAM type: NRG; PAM sequence: AAG
tcttggtacacatggttcct

SEQ ID NO: 92283 - DNA, 20 bp, Artificial Sequence
  Description of Artificial Sequence: Synthetic oligonucleotide
  Target: ATXN1; (-) strand; PAM type: NRG; PAM sequence: TGG
ctaaaaagtcttggtacaca

SEQ ID NO: 92284 - DNA, 20 bp, Artificial Sequence
  Description of Artificial Sequence: Synthetic oligonucleotide
  Target: ATXN1; (-) strand; PAM type: NRG; PAM sequence: TGG
gtgctattcctaaaaagtct

SEQ ID NO: 92285 - DNA, 20 bp, Artificial Sequence
  Description of Artificial Sequence: Synthetic oligonucleotide
  Target: ATXN1; (-) strand; PAM type: NRG; PAM sequence: AAG
ggcagggtgctattcctaaa

SEQ ID NO: 92286 - DNA, 20 bp, Artificial Sequence
  Description of Artificial Sequence: Synthetic oligonucleotide
  Target: ATXN1; (-) strand; PAM type: NRG; PAM sequence: GGG
aagaatacaatcttcaggca

SEQ ID NO: 92287 - DNA, 20 bp, Artificial Sequence
  Description of Artificial Sequence: Synthetic oligonucleotide
  Target: ATXN1; (-) strand; PAM type: NRG; PAM sequence: AGG
caagaatacaatcttcaggc

SEQ ID NO: 92288 - DNA, 20 bp, Artificial Sequence
  Description of Artificial Sequence: Synthetic oligonucleotide
  Target: ATXN1; (-) strand; PAM type: NRG; PAM sequence: CAG
gcaagaatacaatcttcagg

SEQ ID NO: 92289 - DNA, 20 bp, Artificial Sequence
  Description of Artificial Sequence: Synthetic oligonucleotide
  Target: ATXN1; (-) strand; PAM type: NRG; PAM sequence: AGG
tgggcaagaatacaatcttc

SEQ ID NO: 92290 - DNA, 20 bp, Artificial Sequence
  Description of Artificial Sequence: Synthetic oligonucleotide
  Target: ATXN1; (-) strand; PAM type: NRG; PAM sequence: CAG
gtgggcaagaatacaatctt

SEQ ID NO: 92291 - DNA, 20 bp, Artificial Sequence
  Description of Artificial Sequence: Synthetic oligonucleotide
  Target: ATXN1; (-) strand; PAM type: NRG; PAM sequence: AAG
gttaggaaagaacagtgggc

SEQ ID NO: 92292 - DNA, 20 bp, Artificial Sequence
  Description of Artificial Sequence: Synthetic oligonucleotide
  Target: ATXN1; (-) strand; PAM type: NRG; PAM sequence: GGG
ttttgttaggaaagaacagt

SEQ ID NO: 92293 - DNA, 20 bp, Artificial Sequence
  Description of Artificial Sequence: Synthetic oligonucleotide
  Target: ATXN1; (-) strand; PAM type: NRG; PAM sequence: TGG
attttgttaggaaagaacag

SEQ ID NO: 92294 - DNA, 20 bp, Artificial Sequence
  Description of Artificial Sequence: Synthetic oligonucleotide
  Target: ATXN1; (-) strand; PAM type: NRG; PAM sequence: CAG
gaaattttgttaggaaagaa

SEQ ID NO: 92295 - DNA, 20 bp, Artificial Sequence
  Description of Artificial Sequence: Synthetic oligonucleotide
  Target: ATXN1; (-) strand; PAM type: NRG; PAM sequence: AAG
gaagggaaattttgttagga

SEQ ID NO: 92296 - DNA, 20 bp, Artificial Sequence
  Description of Artificial Sequence: Synthetic oligonucleotide
  Target: ATXN1; (-) strand; PAM type: NRG; PAM sequence: AGG
acttgaagggaaattttgtt

SEQ ID NO: 92297 - DNA, 20 bp, Artificial Sequence
  Description of Artificial Sequence: Synthetic oligonucleotide
  Target: ATXN1; (-) strand; PAM type: NRG; PAM sequence: TAG
aacttgaagggaaattttgt

SEQ ID NO: 92298 - DNA, 20 bp, Artificial Sequence
  Description of Artificial Sequence: Synthetic oligonucleotide
  Target: ATXN1; (-) strand; PAM type: NRG; PAM sequence: GGG
caacgaaaggagaacttgaa

SEQ ID NO: 92299 - DNA, 20 bp, Artificial Sequence
  Description of Artificial Sequence: Synthetic oligonucleotide
  Target: ATXN1; (-) strand; PAM type: NRG; PAM sequence: AGG
acaacgaaaggagaacttga

SEQ ID NO: 92300 - DNA, 20 bp, Artificial Sequence
  Description of Artificial Sequence: Synthetic oligonucleotide
  Target: ATXN1; (-) strand; PAM type: NRG; PAM sequence: AAG
cacaacgaaaggagaacttg

SEQ ID NO: 92301 - DNA, 20 bp, Artificial Sequence
  Description of Artificial Sequence: Synthetic oligonucleotide
  Target: ATXN1; (-) strand; PAM type: NRG; PAM sequence: GAG
actgaagttcacaacgaaag

SEQ ID NO: 92302 - DNA, 20 bp, Artificial Sequence
  Description of Artificial Sequence: Synthetic oligonucleotide
  Target: ATXN1; (-) strand; PAM type: NRG; PAM sequence: AGG
taactgaagttcacaacgaa

SEQ ID NO: 92303 - DNA, 20 bp, Artificial Sequence
  Description of Artificial Sequence: Synthetic oligonucleotide
  Target: ATXN1; (-) strand; PAM type: NRG; PAM sequence: AAG
ataactgaagttcacaacga

SEQ ID NO: 92304 - DNA, 20 bp, Artificial Sequence
  Description of Artificial Sequence: Synthetic oligonucleotide
  Target: ATXN1; (-) strand; PAM type: NRG; PAM sequence: AAG
cagtggaaaggcaataactg

SEQ ID NO: 92305 - DNA, 20 bp, Artificial Sequence
  Description of Artificial Sequence: Synthetic oligonucleotide
  Target: ATXN1; (-) strand; PAM type: NRG; PAM sequence: AGG
gttgtgtttagccagtggaa

SEQ ID NO: 92306 - DNA, 20 bp, Artificial Sequence
  Description of Artificial Sequence: Synthetic oligonucleotide
  Target: ATXN1; (-) strand; PAM type: NRG; PAM sequence: AAG
ggttgtgtttagccagtgga

SEQ ID NO: 92307 - DNA, 20 bp, Artificial Sequence
  Description of Artificial Sequence: Synthetic oligonucleotide
  Target: ATXN1; (-) strand; PAM type: NRG; PAM sequence: TGG
gtgtggttgtgtttagccag

SEQ ID NO: 92308 - DNA, 20 bp, Artificial Sequence
  Description of Artificial Sequence: Synthetic oligonucleotide
  Target: ATXN1; (-) strand; PAM type: NRG; PAM sequence: CAG
tatgtgtggttgtgtttagc

SEQ ID NO: 92309 - DNA, 20 bp, Artificial Sequence
  Description of Artificial Sequence: Synthetic oligonucleotide
  Target: ATXN1; (-) strand; PAM type: NRG; PAM sequence: TAG
aagatatgtgtggttgtgtt

SEQ ID NO: 92310 - DNA, 20 bp, Artificial Sequence
  Description of Artificial Sequence: Synthetic oligonucleotide
  Target: ATXN1; (-) strand; PAM type: NRG; PAM sequence: TGG
tagcttttgaaagatatgtg

SEQ ID NO: 92311 - DNA, 20 bp, Artificial Sequence
  Description of Artificial Sequence: Synthetic oligonucleotide
  Target: ATXN1; (-) strand; PAM type: NRG; PAM sequence: AAG
atgcttcaattagcttttga

SEQ ID NO: 92312 - DNA, 20 bp, Artificial Sequence
  Description of Artificial Sequence: Synthetic oligonucleotide
  Target: ATXN1; (-) strand; PAM type: NRG; PAM sequence: TAG
taacttctttatgcttcaat

SEQ ID NO: 92313 - DNA, 20 bp, Artificial Sequence
  Description of Artificial Sequence: Synthetic oligonucleotide
  Target: ATXN1; (-) strand; PAM type: NRG; PAM sequence: TGG
cactgacttgaaatttgacc

SEQ ID NO: 92314 - DNA, 20 bp, Artificial Sequence
  Description of Artificial Sequence: Synthetic oligonucleotide
  Target: ATXN1; (-) strand; PAM type: NRG; PAM sequence: TGG
aagaggaaggtctgtattta

SEQ ID NO: 92315 - DNA, 20 bp, Artificial Sequence
  Description of Artificial Sequence: Synthetic oligonucleotide
  Target: ATXN1; (-) strand; PAM type: NRG; PAM sequence: AGG
cagaacactcagcaagagga

SEQ ID NO: 92316 - DNA, 20 bp, Artificial Sequence
  Description of Artificial Sequence: Synthetic oligonucleotide
  Target: ATXN1; (-) strand; PAM type: NRG; PAM sequence: AAG
ccagaacactcagcaagagg

SEQ ID NO: 92317 - DNA, 20 bp, Artificial Sequence
  Description of Artificial Sequence: Synthetic oligonucleotide
  Target: ATXN1; (-) strand; PAM type: NRG; PAM sequence: AGG
cacccagaacactcagcaag

SEQ ID NO: 92318 - DNA, 20 bp, Artificial Sequence
  Description of Artificial Sequence: Synthetic oligonucleotide
  Target: ATXN1; (-) strand; PAM type: NRG; PAM sequence: GAG
gcacccagaacactcagcaa

SEQ ID NO: 92319 - DNA, 20 bp, Artificial Sequence
  Description of Artificial Sequence: Synthetic oligonucleotide
  Target: ATXN1; (-) strand; PAM type: NRG; PAM sequence: AAG
cggcacccagaacactcagc

SEQ ID NO: 92320 - DNA, 20 bp, Artificial Sequence
  Description of Artificial Sequence: Synthetic oligonucleotide
  Target: ATXN1; (-) strand; PAM type: NRG; PAM sequence: CAG
ggcccggcacccagaacact

SEQ ID NO: 92321 - DNA, 20 bp, Artificial Sequence
  Description of Artificial Sequence: Synthetic oligonucleotide
  Target: ATXN1; (-) strand; PAM type: NRG; PAM sequence: CAG
ctgcagcatggcccggcacc

SEQ ID NO: 92322 - DNA, 20 bp, Artificial Sequence
  Description of Artificial Sequence: Synthetic oligonucleotide
  Target: ATXN1; (-) strand; PAM type: NRG; PAM sequence: CGG
tttcaccctgcagcatggcc

SEQ ID NO: 92323 - DNA, 20 bp, Artificial Sequence
  Description of Artificial Sequence: Synthetic oligonucleotide
  Target: ATXN1; (-) strand; PAM type: NRG; PAM sequence: TGG
caaaatttcaccctgcagca

SEQ ID NO: 92324 - DNA, 20 bp, Artificial Sequence
  Description of Artificial Sequence: Synthetic oligonucleotide
  Target: ATXN1; (-) strand; PAM type: NRG; PAM sequence: CAG
aaagtcaaaatttcaccctg

SEQ ID NO: 92325 - DNA, 20 bp, Artificial Sequence
  Description of Artificial Sequence: Synthetic oligonucleotide
  Target: ATXN1; (-) strand; PAM type: NRG; PAM sequence: AAG
attttgaaaacaccaatcaa

SEQ ID NO: 92326 - DNA, 20 bp, Artificial Sequence
  Description of Artificial Sequence: Synthetic oligonucleotide
  Target: ATXN1; (-) strand; PAM type: NRG; PAM sequence: AGG
agctacttttaaatacacaa

SEQ ID NO: 92327 - DNA, 20 bp, Artificial Sequence
  Description of Artificial Sequence: Synthetic oligonucleotide
  Target: ATXN1; (-) strand; PAM type: NRG; PAM sequence: AAG
gagctacttttaaatacaca

SEQ ID NO: 92328 - DNA, 20 bp, Artificial Sequence
  Description of Artificial Sequence: Synthetic oligonucleotide
  Target: ATXN1; (-) strand; PAM type: NRG; PAM sequence: GAG
tccttctatcttgtcaatat

SEQ ID NO: 92329 - DNA, 20 bp, Artificial Sequence
  Description of Artificial Sequence: Synthetic oligonucleotide
  Target: ATXN1; (-) strand; PAM type: NRG; PAM sequence: AAG
aacgttaatgacatttgtcc

SEQ ID NO: 92330 - DNA, 20 bp, Artificial Sequence
  Description of Artificial Sequence: Synthetic oligonucleotide
  Target: ATXN1; (-) strand; PAM type: NRG; PAM sequence: AGG
gtggcacctgtgataggtcc

SEQ ID NO: 92331 - DNA, 20 bp, Artificial Sequence
  Description of Artificial Sequence: Synthetic oligonucleotide
  Target: ATXN1; (-) strand; PAM type: NRG; PAM sequence: CAG
agtggcacctgtgataggtc

SEQ ID NO: 92332 - DNA, 20 bp, Artificial Sequence
  Description of Artificial Sequence: Synthetic oligonucleotide
  Target: ATXN1; (-) strand; PAM type: NRG; PAM sequence: AGG
taaccagtggcacctgtgat

SEQ ID NO: 92333 - DNA, 20 bp, Artificial Sequence
  Description of Artificial Sequence: Synthetic oligonucleotide
  Target: ATXN1; (-) strand; PAM type: NRG; PAM sequence: TAG
ataaccagtggcacctgtga

SEQ ID NO: 92334 - DNA, 20 bp, Artificial Sequence
  Description of Artificial Sequence: Synthetic oligonucleotide
  Target: ATXN1; (-) strand; PAM type: NRG; PAM sequence: TGG
atgcatatgttaataaccag

SEQ ID NO: 92335 - DNA, 20 bp, Artificial Sequence
  Description of Artificial Sequence: Synthetic oligonucleotide
  Target: ATXN1; (-) strand; PAM type: NRG; PAM sequence: CAG
tacatgcatatgttaataac

SEQ ID NO: 92336 - DNA, 20 bp, Artificial Sequence
  Description of Artificial Sequence: Synthetic oligonucleotide
  Target: ATXN1; (-) strand; PAM type: NRG; PAM sequence: GAG
gttatacagtgtctttcagg

SEQ ID NO: 92337 - DNA, 20 bp, Artificial Sequence
  Description of Artificial Sequence: Synthetic oligonucleotide
  Target: ATXN1; (-) strand; PAM type: NRG; PAM sequence: GGG
cagttatacagtgtctttca

SEQ ID NO: 92338 - DNA, 20 bp, Artificial Sequence
  Description of Artificial Sequence: Synthetic oligonucleotide
  Target: ATXN1; (-) strand; PAM type: NRG; PAM sequence: AGG
ccagttatacagtgtctttc

SEQ ID NO: 92339 - DNA, 20 bp, Artificial Sequence
  Description of Artificial Sequence: Synthetic oligonucleotide
  Target: ATXN1; (-) strand; PAM type: NRG; PAM sequence: CAG
gccagttatacagtgtcttt

SEQ ID NO: 92340 - DNA, 20 bp, Artificial Sequence
  Description of Artificial Sequence: Synthetic oligonucleotide
  Target: ATXN1; (-) strand; PAM type: NRG; PAM sequence: CAG
aggcatttgagccagttata

SEQ ID NO: 92341 - DNA, 20 bp, Artificial Sequence
  Description of Artificial Sequence: Synthetic oligonucleotide
  Target: ATXN1; (-) strand; PAM type: NRG; PAM sequence: CAG
ccatttgtaggcatttgagc

SEQ ID NO: 92342 - DNA, 20 bp, Artificial Sequence
  Description of Artificial Sequence: Synthetic oligonucleotide
  Target: ATXN1; (-) strand; PAM type: NRG; PAM sequence: GAG
ccttccatttgtaggcattt

SEQ ID NO: 92343 - DNA, 20 bp, Artificial Sequence
  Description of Artificial Sequence: Synthetic oligonucleotide
  Target: ATXN1; (-) strand; PAM type: NRG; PAM sequence: AGG
ctaaacctccttccatttgt

SEQ ID NO: 92344 - DNA, 20 bp, Artificial Sequence
  Description of Artificial Sequence: Synthetic oligonucleotide
  Target: ATXN1; (-) strand; PAM type: NRG; PAM sequence: TAG
actaaacctccttccatttg

SEQ ID NO: 92345 - DNA, 20 bp, Artificial Sequence
  Description of Artificial Sequence: Synthetic oligonucleotide
  Target: ATXN1; (-) strand; PAM type: NRG; PAM sequence: AGG
ggaaaaatagagtatatttt

SEQ ID NO: 92346 - DNA, 20 bp, Artificial Sequence
  Description of Artificial Sequence: Synthetic oligonucleotide
  Target: ATXN1; (-) strand; PAM type: NRG; PAM sequence: TAG
gggaaaaatagagtatattt

SEQ ID NO: 92347 - DNA, 20 bp, Artificial Sequence
  Description of Artificial Sequence: Synthetic oligonucleotide
  Target: ATXN1; (-) strand; PAM type: NRG; PAM sequence: GAG
tgcacttaaagggaaaaata

SEQ ID NO: 92348 - DNA, 20 bp, Artificial Sequence
  Description of Artificial Sequence: Synthetic oligonucleotide
  Target: ATXN1; (-) strand; PAM type: NRG; PAM sequence: TAG
gttgcacttaaagggaaaaa

SEQ ID NO: 92349 - DNA, 20 bp, Artificial Sequence
  Description of Artificial Sequence: Synthetic oligonucleotide
  Target: ATXN1; (-) strand; PAM type: NRG; PAM sequence: GGG
gtgattcagttgcacttaaa

SEQ ID NO: 92350 - DNA, 20 bp, Artificial Sequence
  Description of Artificial Sequence: Synthetic oligonucleotide
  Target: ATXN1; (-) strand; PAM type: NRG; PAM sequence: AGG
tgtgattcagttgcacttaa

SEQ ID NO: 92351 - DNA, 20 bp, Artificial Sequence
  Description of Artificial Sequence: Synthetic oligonucleotide
  Target: ATXN1; (-) strand; PAM type: NRG; PAM sequence: AAG
ttgtgattcagttgcactta

SEQ ID NO: 92352 - DNA, 20 bp, Artificial Sequence
  Description of Artificial Sequence: Synthetic oligonucleotide
  Target: ATXN1; (-) strand; PAM type: NRG; PAM sequence: CAG
gcttctcgtggattgtgatt

SEQ ID NO: 92353 - DNA, 20 bp, Artificial Sequence
  Description of Artificial Sequence: Synthetic oligonucleotide
  Target: ATXN1; (-) strand; PAM type: NRG; PAM sequence: TGG
tttgcacaaactgcttctcg

SEQ ID NO: 92354 - DNA, 20 bp, Artificial Sequence
  Description of Artificial Sequence: Synthetic oligonucleotide
  Target: ATXN1; (-) strand; PAM type: NRG; PAM sequence: GAG
tagtgtagctcttacatgca

SEQ ID NO: 92355 - DNA, 20 bp, Artificial Sequence
  Description of Artificial Sequence: Synthetic oligonucleotide
  Target: ATXN1; (-) strand; PAM type: NRG; PAM sequence: CAG
tttagtgtagctcttacatg

SEQ ID NO: 92356 - DNA, 20 bp, Artificial Sequence
  Description of Artificial Sequence: Synthetic oligonucleotide
  Target: ATXN1; (-) strand; PAM type: NRG; PAM sequence: TAG
gggtctagtgcagtttagtg

SEQ ID NO: 92357 - DNA, 20 bp, Artificial Sequence
  Description of Artificial Sequence: Synthetic oligonucleotide
  Target: ATXN1; (-) strand; PAM type: NRG; PAM sequence: TAG
gaacggggtctagtgcagtt

SEQ ID NO: 92358 - DNA, 20 bp, Artificial Sequence
  Description of Artificial Sequence: Synthetic oligonucleotide
  Target: ATXN1; (-) strand; PAM type: NRG; PAM sequence: CAG
tcttagaacggggtctagtg

SEQ ID NO: 92359 - DNA, 20 bp, Artificial Sequence
  Description of Artificial Sequence: Synthetic oligonucleotide
  Target: ATXN1; (-) strand; PAM type: NRG; PAM sequence: TAG
tcttatcttagaacggggtc

SEQ ID NO: 92360 - DNA, 20 bp, Artificial Sequence
  Description of Artificial Sequence: Synthetic oligonucleotide
  Target: ATXN1; (-) strand; PAM type: NRG; PAM sequence: GGG
acgggtcttatcttagaacg

SEQ ID NO: 92361 - DNA, 20 bp, Artificial Sequence
  Description of Artificial Sequence: Synthetic oligonucleotide
  Target: ATXN1; (-) strand; PAM type: NRG; PAM sequence: GGG
tacgggtcttatcttagaac

SEQ ID NO: 92362 - DNA, 20 bp, Artificial Sequence
  Description of Artificial Sequence: Synthetic oligonucleotide
  Target: ATXN1; (-) strand; PAM type: NRG; PAM sequence: CGG
atacgggtcttatcttagaa

SEQ ID NO: 92363 - DNA, 20 bp, Artificial Sequence
  Description of Artificial Sequence: Synthetic oligonucleotide
  Target: ATXN1; (-) strand; PAM type: NRG; PAM sequence: TAG
tgttaatacgggtcttatct

SEQ ID NO: 92364 - DNA, 20 bp, Artificial Sequence
  Description of Artificial Sequence: Synthetic oligonucleotide
  Target: ATXN1; (-) strand; PAM type: NRG; PAM sequence: GGG
ttccctggctctgttaatac

SEQ ID NO: 92365 - DNA, 20 bp, Artificial Sequence
  Description of Artificial Sequence: Synthetic oligonucleotide
  Target: ATXN1; (-) strand; PAM type: NRG; PAM sequence: CGG
cttccctggctctgttaata

SEQ ID NO: 92366 - DNA, 20 bp, Artificial Sequence
  Description of Artificial Sequence: Synthetic oligonucleotide
  Target: ATXN1; (-) strand; PAM type: NRG; PAM sequence: TGG
atcttcttttcattcttccc

SEQ ID NO: 92367 - DNA, 20 bp, Artificial Sequence
  Description of Artificial Sequence: Synthetic oligonucleotide
  Target: ATXN1; (-) strand; PAM type: NRG; PAM sequence: CAG
ctgaatgcatcttgcactcc

SEQ ID NO: 92368 - DNA, 20 bp, Artificial Sequence
  Description of Artificial Sequence: Synthetic oligonucleotide
  Target: ATXN1; (-) strand; PAM type: NRG; PAM sequence: CAG
cctcatttctcattgcagct

SEQ ID NO: 92369 - DNA, 20 bp, Artificial Sequence
  Description of Artificial Sequence: Synthetic oligonucleotide
  Target: ATXN1; (-) strand; PAM type: NRG; PAM sequence: CAG
gatgccctcatttctcattg

SEQ ID NO: 92370 - DNA, 20 bp, Artificial Sequence
  Description of Artificial Sequence: Synthetic oligonucleotide
  Target: ATXN1; (-) strand; PAM type: NRG; PAM sequence: AAG
aaaaaaagaaaagaaaaaaa

SEQ ID NO: 92371 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaagaa

SEQ ID NO: 92372 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaaa

SEQ ID NO: 92373 - DNA, 20 bp, Artificial Sequence
  Description of Artificial Sequence: Synthetic oligonucleotide
  Target: ATXN1; (-) strand; PAM type: NRG; PAM sequence: AGG
ttcaagctcctgaaagcaag

SEQ ID NO: 92374 - DNA, 20 bp, Artificial Sequence
  Description of Artificial Sequence: Synthetic oligonucleotide
  Target: ATXN1; (-) strand; PAM type: NRG; PAM sequence: GAG
tttcaagctcctgaaagcaa

SEQ ID NO: 92375 - DNA, 20 bp, Artificial Sequence
  Description of Artificial Sequence: Synthetic oligonucleotide
  Target: ATXN1; (-) strand; PAM type: NRG; PAM sequence: AAG
tttttcaagctcctgaaagc

SEQ ID NO: 92376 - DNA, 20 bp, Artificial Sequence
  Description of Artificial Sequence: Synthetic oligonucleotide
  Target: ATXN1; (-) strand; PAM type: NRG; PAM sequence: AAG
tttatttttcaagctcctga

SEQ ID NO: 92377 - DNA, 20 bp, Artificial Sequence
  Description of Artificial Sequence: Synthetic oligonucleotide
  Target: ATXN1; (-) strand; PAM type: NRG; PAM sequence: AAG
gtcgctctggtttatttttc

SEQ ID NO: 92378 - DNA, 20 bp, Artificial Sequence
  Description of Artificial Sequence: Synthetic oligonucleotide
  Target: ATXN1; (-) strand; PAM type: NRG; PAM sequence: TGG
cttgcagcccttggtcgctc

SEQ ID NO: 92379 - DNA, 20 bp, Artificial Sequence
  Description of Artificial Sequence: Synthetic oligonucleotide
  Target: ATXN1; (-) strand; PAM type: NRG; PAM sequence: TGG
ggtcaaagccttgcagccct

SEQ ID NO: 92380 - DNA, 20 bp, Artificial Sequence
  Description of Artificial Sequence: Synthetic oligonucleotide
  Target: ATXN1; (-) strand; PAM type: NRG; PAM sequence: CAG
accagaaggtcaaagccttg

SEQ ID NO: 92381 - DNA, 20 bp, Artificial Sequence
  Description of Artificial Sequence: Synthetic oligonucleotide
  Target: ATXN1; (-) strand; PAM type: NRG; PAM sequence: AAG
ctgtcttcaccagaaggtca

SEQ ID NO: 92382 - DNA, 20 bp, Artificial Sequence
  Description of Artificial Sequence: Synthetic oligonucleotide
  Target: ATXN1; (-) strand; PAM type: NRG; PAM sequence: AGG
taaaggctgtcttcaccaga

SEQ ID NO: 92383 - DNA, 20 bp, Artificial Sequence
  Description of Artificial Sequence: Synthetic oligonucleotide
  Target: ATXN1; (-) strand; PAM type: NRG; PAM sequence: AAG
ctaaaggctgtcttcaccag

SEQ ID NO: 92384 - DNA, 20 bp, Artificial Sequence
  Description of Artificial Sequence: Synthetic oligonucleotide
  Target: ATXN1; (-) strand; PAM type: NRG; PAM sequence: CAG
ctgctaaaggctgtcttcac

SEQ ID NO: 92385 - DNA, 20 bp, Artificial Sequence
  Description of Artificial Sequence: Synthetic oligonucleotide
  Target: ATXN1; (-) strand; PAM type: NRG; PAM sequence: AGG
gattaggttcctcctgctaa

SEQ ID NO: 92386 - DNA, 20 bp, Artificial Sequence
  Description of Artificial Sequence: Synthetic oligonucleotide
  Target: ATXN1; (-) strand; PAM type: NRG; PAM sequence: AAG
ggattaggttcctcctgcta

SEQ ID NO: 92387 - DNA, 20 bp, Artificial Sequence
  Description of Artificial Sequence: Synthetic oligonucleotide
  Target: ATXN1; (-) strand; PAM type: NRG; PAM sequence: AGG
acagacaacttcctgggatt

SEQ ID NO: 92388 - DNA, 20 bp, Artificial Sequence
  Description of Artificial Sequence: Synthetic oligonucleotide
  Target: ATXN1; (-) strand; PAM type: NRG; PAM sequence: TAG
tacagacaacttcctgggat

SEQ ID NO: 92389 - DNA, 20 bp, Artificial Sequence
  Description of Artificial Sequence: Synthetic oligonucleotide
  Target: ATXN1; (-) strand; PAM type: NRG; PAM sequence: GGG
caaagtacagacaacttcct

SEQ ID NO: 92390 - DNA, 20 bp, Artificial Sequence
  Description of Artificial Sequence: Synthetic oligonucleotide
  Target: ATXN1; (-) strand; PAM type: NRG; PAM sequence: TGG
gcaaagtacagacaacttcc

SEQ ID NO: 92391 - DNA, 20 bp, Artificial Sequence
  Description of Artificial Sequence: Synthetic oligonucleotide
  Target: ATXN1; (-) strand; PAM type: NRG; PAM sequence: CAG
tggtagcagaaagcaaagta

SEQ ID NO: 92392 - DNA, 20 bp, Artificial Sequence
  Description of Artificial Sequence: Synthetic oligonucleotide
  Target: ATXN1; (-) strand; PAM type: NRG; PAM sequence: AAG
tagtgtggtagcagaaagca

SEQ ID NO: 92393 - DNA, 20 bp, Artificial Sequence
  Description of Artificial Sequence: Synthetic oligonucleotide
  Target: ATXN1; (-) strand; PAM type: NRG; PAM sequence: AAG
tcttctagtgtggtagcaga

SEQ ID NO: 92394 - DNA, 20 bp, Artificial Sequence
  Description of Artificial Sequence: Synthetic oligonucleotide
  Target: ATXN1; (-) strand; PAM type: NRG; PAM sequence: CAG
gtaatcttctagtgtggtag

SEQ ID NO: 92395 - DNA, 20 bp, Artificial Sequence
  Description of Artificial Sequence: Synthetic oligonucleotide
  Target: ATXN1; (-) strand; PAM type: NRG; PAM sequence: TAG
caagtaatcttctagtgtgg

SEQ ID NO: 92396 - DNA, 20 bp, Artificial Sequence
  Description of Artificial Sequence: Synthetic oligonucleotide
  Target: ATXN1; (-) strand; PAM type: NRG; PAM sequence: TGG
gatcaagtaatcttctagtg

SEQ ID NO: 92397 - DNA, 20 bp, Artificial Sequence
  Description of Artificial Sequence: Synthetic oligonucleotide
  Target: ATXN1; (-) strand; PAM type: NRG; PAM sequence: TAG
tgtttgatcaagtaatcttc

SEQ ID NO: 92398 - DNA, 20 bp, Artificial Sequence
  Description of Artificial Sequence: Synthetic oligonucleotide
  Target: ATXN1; (-) strand; PAM type: NRG; PAM sequence: AAG
aaatgcccatttgtttgatc

SEQ ID NO: 92399 - DNA, 20 bp, Artificial Sequence
  Description of Artificial Sequence: Synthetic oligonucleotide
  Target: ATXN1; (-) strand; PAM type: NRG; PAM sequence: GGG
catgatacagagatatcatg

SEQ ID NO: 92400 - DNA, 20 bp, Artificial Sequence
  Description of Artificial Sequence: Synthetic oligonucleotide
  Target: ATXN1; (-) strand; PAM type: NRG; PAM sequence: GGG
tcatgatacagagatatcat

SEQ ID NO: 92401 - DNA, 20 bp, Artificial Sequence
  Description of Artificial Sequence: Synthetic oligonucleotide
  Target: ATXN1; (-) strand; PAM type: NRG; PAM sequence: TGG
ttcatgatacagagatatca

SEQ ID NO: 92402 - DNA, 20 bp, Artificial Sequence
  Description of Artificial Sequence: Synthetic oligonucleotide
  Target: ATXN1; (-) strand; PAM type: NRG; PAM sequence: GAG
atgtactttttcatgataca

SEQ ID NO: 92403 - DNA, 20 bp, Artificial Sequence
  Description of Artificial Sequence: Synthetic oligonucleotide
  Target: ATXN1; (-) strand; PAM type: NRG; PAM sequence: CAG
aaatgtactttttcatgata

SEQ ID NO: 92404 - DNA, 20 bp, Artificial Sequence
  Description of Artificial Sequence: Synthetic oligonucleotide
  Target: ATXN1; (-) strand; PAM type: NRG; PAM sequence: TAG
gaaggaaacggcaatacaat

SEQ ID NO: 92405 - DNA, 20 bp, Artificial Sequence
  Description of Artificial Sequence: Synthetic oligonucleotide
  Target: ATXN1; (-) strand; PAM type: NRG; PAM sequence: CGG
gaaagaggcggagaaggaaa

SEQ ID NO: 92406 - DNA, 20 bp, Artificial Sequence
  Description of Artificial Sequence: Synthetic oligonucleotide
  Target: ATXN1; (-) strand; PAM type: NRG; PAM sequence: AGG
gtgggagaaagaggcggaga

SEQ ID NO: 92407 - DNA, 20 bp, Artificial Sequence
  Description of Artificial Sequence: Synthetic oligonucleotide
  Target: ATXN1; (-) strand; PAM type: NRG; PAM sequence: AAG
ggtgggagaaagaggcggag

SEQ ID NO: 92408 - DNA, 20 bp, Artificial Sequence
  Description of Artificial Sequence: Synthetic oligonucleotide
  Target: ATXN1; (-) strand; PAM type: NRG; PAM sequence: GAG
gtaggtgggagaaagaggcg

SEQ ID NO: 92409 - DNA, 20 bp, Artificial Sequence
  Description of Artificial Sequence: Synthetic oligonucleotide
  Target: ATXN1; (-) strand; PAM type: NRG; PAM sequence: CGG
gggtaggtgggagaaagagg

SEQ ID NO: 92410 - DNA, 20 bp, Artificial Sequence
  Description of Artificial Sequence: Synthetic oligonucleotide
  Target: ATXN1; (-) strand; PAM type: NRG; PAM sequence: AGG
tgggggtaggtgggagaaag

SEQ ID NO: 92411 - DNA, 20 bp, Artificial Sequence
  Description of Artificial Sequence: Synthetic oligonucleotide
  Target: ATXN1; (-) strand; PAM type: NRG; PAM sequence: GAG
gtgggggtaggtgggagaaa

SEQ ID NO: 92412 - DNA, 20 bp, Artificial Sequence
  Description of Artificial Sequence: Synthetic oligonucleotide
  Target: ATXN1; (-) strand; PAM type: NRG; PAM sequence: AAG
gggtgggggtaggtgggaga

SEQ ID NO: 92413 - DNA, 20 bp, Artificial Sequence
  Description of Artificial Sequence: Synthetic oligonucleotide
  Target: ATXN1; (-) strand; PAM type: NRG; PAM sequence: GAG
ggaggggtgggggtaggtgg

SEQ ID NO: 92414 - DNA, 20 bp, Artificial Sequence
  Description of Artificial Sequence: Synthetic oligonucleotide
  Target: ATXN1; (-) strand; PAM type: NRG; PAM sequence: GGG
taggaggggtgggggtaggt

SEQ ID NO: 92415 - DNA, 20 bp, Artificial Sequence
  Description of Artificial Sequence: Synthetic oligonucleotide
  Target: ATXN1; (-) strand; PAM type: NRG; PAM sequence: TGG
gtaggaggggtgggggtagg

SEQ ID NO: 92416 - DNA, 20 bp, Artificial Sequence
  Description of Artificial Sequence: Synthetic oligonucleotide
  Target: ATXN1; (-) strand; PAM type: NRG; PAM sequence: AGG
agtgtaggaggggtgggggt

SEQ ID NO: 92417 - DNA, 20 bp, Artificial Sequence
  Description of Artificial Sequence: Synthetic oligonucleotide
  Target: ATXN1; (-) strand; PAM type: NRG; PAM sequence: TAG
cagtgtaggaggggtggggg

SEQ ID NO: 92418 - DNA, 20 bp, Artificial Sequence
  Description of Artificial Sequence: Synthetic oligonucleotide
  Target: ATXN1; (-) strand; PAM type: NRG; PAM sequence: GGG
tgccagtgtaggaggggtgg

SEQ ID NO: 92419 - DNA, 20 bp, Artificial Sequence
  Description of Artificial Sequence: Synthetic oligonucleotide
  Target: ATXN1; (-) strand; PAM type: NRG; PAM sequence: GGG
atgccagtgtaggaggggtg

SEQ ID NO: 92420 - DNA, 20 bp, Artificial Sequence
  Description of Artificial Sequence: Synthetic oligonucleotide
  Target: ATXN1; (-) strand; PAM type: NRG; PAM sequence: GGG
aatgccagtgtaggaggggt

SEQ ID NO: 92421 - DNA, 20 bp, Artificial Sequence
  Description of Artificial Sequence: Synthetic oligonucleotide
  Target: ATXN1; (-) strand; PAM type: NRG; PAM sequence: TGG
gaatgccagtgtaggagggg

SEQ ID NO: 92422 - DNA, 20 bp, Artificial Sequence
  Description of Artificial Sequence: Synthetic oligonucleotide
  Target: ATXN1; (-) strand; PAM type: NRG; PAM sequence: GGG
agagaatgccagtgtaggag

SEQ ID NO: 92423 - DNA, 20 bp, Artificial Sequence
  Description of Artificial Sequence: Synthetic oligonucleotide
  Target: ATXN1; (-) strand; PAM type: NRG; PAM sequence: GGG
cagagaatgccagtgtagga

SEQ ID NO: 92424 - DNA, 20 bp, Artificial Sequence
  Description of Artificial Sequence: Synthetic oligonucleotide
  Target: ATXN1; (-) strand; PAM type: NRG; PAM sequence: AGG
acagagaatgccagtgtagg

SEQ ID NO: 92425 - DNA, 20 bp, Artificial Sequence
  Description of Artificial Sequence: Synthetic oligonucleotide
  Target: ATXN1; (-) strand; PAM type: NRG; PAM sequence: GAG
cacagagaatgccagtgtag

SEQ ID NO: 92426 - DNA, 20 bp, Artificial Sequence
  Description of Artificial Sequence: Synthetic oligonucleotide
  Target: ATXN1; (-) strand; PAM type: NRG; PAM sequence: AGG
accacagagaatgccagtgt

SEQ ID NO: 92427 - DNA, 20 bp, Artificial Sequence
  Description of Artificial Sequence: Synthetic oligonucleotide
  Target: ATXN1; (-) strand; PAM type: NRG; PAM sequence: TAG
gaccacagagaatgccagtg

SEQ ID NO: 92428 - DNA, 20 bp, Artificial Sequence
  Description of Artificial Sequence: Synthetic oligonucleotide
  Target: ATXN1; (-) strand; PAM type: NRG; PAM sequence: CAG
tctttgaccacagagaatgc

SEQ ID NO: 92429 - DNA, 20 bp, Artificial Sequence
  Description of Artificial Sequence: Synthetic oligonucleotide
  Target: ATXN1; (-) strand; PAM type: NRG; PAM sequence: GAG
aaacagattctttgaccaca

SEQ ID NO: 92430 - DNA, 20 bp, Artificial Sequence
  Description of Artificial Sequence: Synthetic oligonucleotide
  Target: ATXN1; (-) strand; PAM type: NRG; PAM sequence: CAG
tgaaacagattctttgacca

SEQ ID NO: 92431 - DNA, 20 bp, Artificial Sequence
  Description of Artificial Sequence: Synthetic oligonucleotide
  Target: ATXN1; (-) strand; PAM type: NRG; PAM sequence: CAG
attgaacactaatactgaaa

SEQ ID NO: 92432 - DNA, 20 bp, Artificial Sequence
  Description of Artificial Sequence: Synthetic oligonucleotide
  Target: ATXN1; (-) strand; PAM type: NRG; PAM sequence: GAG
aatagcacaggaaatgtgta

SEQ ID NO: 92433 - DNA, 20 bp, Artificial Sequence
  Description of Artificial Sequence: Synthetic oligonucleotide
  Target: ATXN1; (-) strand; PAM type: NRG; PAM sequence: TAG
taaatagcacaggaaatgtg

SEQ ID NO: 92434 - DNA, 20 bp, Artificial Sequence
  Description of Artificial Sequence: Synthetic oligonucleotide
  Target: ATXN1; (-) strand; PAM type: NRG; PAM sequence: AGG
tagggtgctttaaatagcac

SEQ ID NO: 92435 - DNA, 20 bp, Artificial Sequence
  Description of Artificial Sequence: Synthetic oligonucleotide
  Target: ATXN1; (-) strand; PAM type: NRG; PAM sequence: CAG
ttagggtgctttaaatagca

SEQ ID NO: 92436 - DNA, 20 bp, Artificial Sequence
  Description of Artificial Sequence: Synthetic oligonucleotide
  Target: ATXN1; (-) strand; PAM type: NRG; PAM sequence: TAG
attgcttagggtgctttaaa

SEQ ID NO: 92437 - DNA, 20 bp, Artificial Sequence
  Description of Artificial Sequence: Synthetic oligonucleotide
  Target: ATXN1; (-) strand; PAM type: NRG; PAM sequence: GGG
ttagagcaaataattgctta

SEQ ID NO: 92438 - DNA, 20 bp, Artificial Sequence
  Description of Artificial Sequence: Synthetic oligonucleotide
  Target: ATXN1; (-) strand; PAM type: NRG; PAM sequence: AGG
tttagagcaaataattgctt

SEQ ID NO: 92439 - DNA, 20 bp, Artificial Sequence
  Description of Artificial Sequence: Synthetic oligonucleotide
  Target: ATXN1; (-) strand; PAM type: NRG; PAM sequence: TAG
ctttagagcaaataattgct

SEQ ID NO: 92440 - DNA, 20 bp, Artificial Sequence
  Description of Artificial Sequence: Synthetic oligonucleotide
  Target: ATXN1; (-) strand; PAM type: NRG; PAM sequence: GAG
atttacagtttaatacttta

SEQ ID NO: 92441 - DNA, 20 bp, Artificial Sequence
  Description of Artificial Sequence: Synthetic oligonucleotide
  Target: ATXN1; (-) strand; PAM type: NRG; PAM sequence: TAG
aaatttacagtttaatactt

SEQ ID NO: 92442 - DNA, 20 bp, Artificial Sequence
  Description of Artificial Sequence: Synthetic oligonucleotide
  Target: ATXN1; (-) strand; PAM type: NRG; PAM sequence: CAG
gcaccagctaagaaaattta

SEQ ID NO: 92443 - DNA, 20 bp, Artificial Sequence
  Description of Artificial Sequence: Synthetic oligonucleotide
  Target: ATXN1; (-) strand; PAM type: NRG; PAM sequence: AAG
tataggaattggcaccagct

SEQ ID NO: 92444 - DNA, 20 bp, Artificial Sequence
  Description of Artificial Sequence: Synthetic oligonucleotide
  Target: ATXN1; (-) strand; PAM type: NRG; PAM sequence: CAG
attactataggaattggcac

SEQ ID NO: 92445 - DNA, 20 bp, Artificial Sequence
  Description of Artificial Sequence: Synthetic oligonucleotide
  Target: ATXN1; (-) strand; PAM type: NRG; PAM sequence: TGG
acagctattactataggaat

SEQ ID NO: 92446 - DNA, 20 bp, Artificial Sequence
  Description of Artificial Sequence: Synthetic oligonucleotide
  Target: ATXN1; (-) strand; PAM type: NRG; PAM sequence: AGG
tctgtgacagctattactat

SEQ ID NO: 92447 - DNA, 20 bp, Artificial Sequence
  Description of Artificial Sequence: Synthetic oligonucleotide
  Target: ATXN1; (-) strand; PAM type: NRG; PAM sequence: TAG
ttctgtgacagctattacta

SEQ ID NO: 92448 - DNA, 20 bp, Artificial Sequence
  Description of Artificial Sequence: Synthetic oligonucleotide
  Target: ATXN1; (-) strand; PAM type: NRG; PAM sequence: CAG
tctaaagtacttttctgtga

SEQ ID NO: 92449 - DNA, 20 bp, Artificial Sequence
  Description of Artificial Sequence: Synthetic oligonucleotide
  Target: ATXN1; (-) strand; PAM type: NRG; PAM sequence: AAG
agccgtgtttgagtactcta

SEQ ID NO: 92450 - DNA, 20 bp, Artificial Sequence
  Description of Artificial Sequence: Synthetic oligonucleotide
  Target: ATXN1; (-) strand; PAM type: NRG; PAM sequence: GAG
ccggtttaaaagccgtgttt

SEQ ID NO: 92451 - DNA, 20 bp, Artificial Sequence
  Description of Artificial Sequence: Synthetic oligonucleotide
  Target: ATXN1; (-) strand; PAM type: NRG; PAM sequence: AAG
catgagtgttgccggtttaa

SEQ ID NO: 92452 - DNA, 20 bp, Artificial Sequence
  Description of Artificial Sequence: Synthetic oligonucleotide
  Target: ATXN1; (-) strand; PAM type: NRG; PAM sequence: CGG
aaatgtagcatgagtgttgc

SEQ ID NO: 92453 - DNA, 20 bp, Artificial Sequence
  Description of Artificial Sequence: Synthetic oligonucleotide
  Target: ATXN1; (-) strand; PAM type: NRG; PAM sequence: GAG
agtcttggcaaatgtagcat

SEQ ID NO: 92454 - DNA, 20 bp, Artificial Sequence
  Description of Artificial Sequence: Synthetic oligonucleotide
  Target: ATXN1; (-) strand; PAM type: NRG; PAM sequence: TAG
tagaaaagtcttggcaaatg

SEQ ID NO: 92455 - DNA, 20 bp, Artificial Sequence
  Description of Artificial Sequence: Synthetic oligonucleotide
  Target: ATXN1; (-) strand; PAM type: NRG; PAM sequence: TGG
tatgacaactagaaaagtct

SEQ ID NO: 92456 - DNA, 20 bp, Artificial Sequence
  Description of Artificial Sequence: Synthetic oligonucleotide
  Target: ATXN1; (-) strand; PAM type: NRG; PAM sequence: AAG
taaaaatatgacaactagaa

SEQ ID NO: 92457 - DNA, 20 bp, Artificial Sequence
  Description of Artificial Sequence: Synthetic oligonucleotide
  Target: ATXN1; (-) strand; PAM type: NRG; PAM sequence: TAG
tgctataaaaatatgacaac

SEQ ID NO: 92458 - DNA, 20 bp, Artificial Sequence
  Description of Artificial Sequence: Synthetic oligonucleotide
  Target: ATXN1; (-) strand; PAM type: NRG; PAM sequence: TAG
atatgacactttgttgcagt

SEQ ID NO: 92459 - DNA, 20 bp, Artificial Sequence
  Description of Artificial Sequence: Synthetic oligonucleotide
  Target: ATXN1; (-) strand; PAM type: NRG; PAM sequence: CAG
ctacatatgacactttgttg

SEQ ID NO: 92460 - DNA, 20 bp, Artificial Sequence
  Description of Artificial Sequence: Synthetic oligonucleotide
  Target: ATXN1; (-) strand; PAM type: NRG; PAM sequence: GAG
aagcttcaaatatgaaaaaa

SEQ ID NO: 92461 - DNA, 20 bp, Artificial Sequence
  Description of Artificial Sequence: Synthetic oligonucleotide
  Target: ATXN1; (-) strand; PAM type: NRG; PAM sequence: AAG
taaagcttcaaatatgaaaa

SEQ ID NO: 92462 - DNA, 20 bp, Artificial Sequence
  Description of Artificial Sequence: Synthetic oligonucleotide
  Target: ATXN1; (-) strand; PAM type: NRG; PAM sequence: AAG
aagactacagtgtgcctata

SEQ ID NO: 92463 - DNA, 20 bp, Artificial Sequence
  Description of Artificial Sequence: Synthetic oligonucleotide
  Target: ATXN1; (-) strand; PAM type: NRG; PAM sequence: CAG
aaaattatgttgaaagacta

SEQ ID NO: 92464 - DNA, 20 bp, Artificial Sequence
  Description of Artificial Sequence: Synthetic oligonucleotide
  Target: ATXN1; (-) strand; PAM type: NRG; PAM sequence: AAG
ttggagaaaaattatgttga

SEQ ID NO: 92465 - DNA, 20 bp, Artificial Sequence
  Description of Artificial Sequence: Synthetic oligonucleotide
  Target: ATXN1; (-) strand; PAM type: NRG; PAM sequence: GAG
ctatctcatctttttgcttg

SEQ ID NO: 92466 - DNA, 20 bp, Artificial Sequence
  Description of Artificial Sequence: Synthetic oligonucleotide
  Target: ATXN1; (-) strand; PAM type: NRG; PAM sequence: TGG
ttctatctcatctttttgct

SEQ ID NO: 92467 - DNA, 20 bp, Artificial Sequence
  Description of Artificial Sequence: Synthetic oligonucleotide
  Target: ATXN1; (-) strand; PAM type: NRG; PAM sequence: AAG
gcagtataacgatgagattg

SEQ ID NO: 92468 - DNA, 20 bp, Artificial Sequence
  Description of Artificial Sequence: Synthetic oligonucleotide
  Target: ATXN1; (-) strand; PAM type: NRG; PAM sequence: GAG
acaccaagcagtataacgat

SEQ ID NO: 92469 - DNA, 20 bp, Artificial Sequence
  Description of Artificial Sequence: Synthetic oligonucleotide
  Target: ATXN1; (-) strand; PAM type: NRG; PAM sequence: CAG
ttctggcctgtaacaccaag

SEQ ID NO: 92470 - DNA, 20 bp, Artificial Sequence
  Description of Artificial Sequence: Synthetic oligonucleotide
  Target: ATXN1; (-) strand; PAM type: NRG; PAM sequence: AAG
tgattctggcctgtaacacc

SEQ ID NO: 92471 - DNA, 20 bp, Artificial Sequence
  Description of Artificial Sequence: Synthetic oligonucleotide
  Target: ATXN1; (-) strand; PAM type: NRG; PAM sequence: TGG
ttttccaatggtcatgattc

SEQ ID NO: 92472 - DNA, 20 bp, Artificial Sequence
  Description of Artificial Sequence: Synthetic oligonucleotide
  Target: ATXN1; (-) strand; PAM type: NRG; PAM sequence: TGG
gccggagtgatattttccaa

SEQ ID NO: 92473 - DNA, 20 bp, Artificial Sequence
  Description of Artificial Sequence: Synthetic oligonucleotide
  Target: ATXN1; (-) strand; PAM type: NRG; PAM sequence: GAG
tgagccaccacacccggccg

SEQ ID NO: 92474 - DNA, 20 bp, Artificial Sequence
  Description of Artificial Sequence: Synthetic oligonucleotide
  Target: ATXN1; (-) strand; PAM type: NRG; PAM sequence: CGG
cgtgagccaccacacccggc

SEQ ID NO: 92475 - DNA, 20 bp, Artificial Sequence
  Description of Artificial Sequence: Synthetic oligonucleotide
  Target: ATXN1; (-) strand; PAM type: NRG; PAM sequence: CGG
caggcgtgagccaccacacc

SEQ ID NO: 92476 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 92477 - DNA, 20 bp, Artificial Sequence
  Description of Artificial Sequence: Synthetic oligonucleotide
  Target: ATXN1; (-) strand; PAM type: NRG; PAM sequence: AGG
tcctaaagtgctgggattac

SEQ ID NO: 92478 - DNA, 20 bp, Artificial Sequence
  Description of Artificial Sequence: Synthetic oligonucleotide
  Target: ATXN1; (-) strand; PAM type: NRG; PAM sequence: CAG
ctcctaaagtgctgggatta

SEQ ID NO: 92479 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcctaaagtgct

SEQ ID NO: 92480 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcctaaagtgc

SEQ ID NO: 92481 - DNA, 20 bp, Artificial Sequence
  Description of Artificial Sequence: Synthetic oligonucleotide
  Target: ATXN1; (-) strand; PAM type: NRG; PAM sequence: AAG
ccacctgcctcggcctccta

SEQ ID NO: 92482 - DNA, 20 bp, Artificial Sequence
  Description of Artificial Sequence: Synthetic oligonucleotide
  Target: ATXN1; (-) strand; PAM type: NRG; PAM sequence: CGG
ctcaagtgatccacctgcct

SEQ ID NO: 92483 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcctgacctc

SEQ ID NO: 92484 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 92485 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 92486 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccatgttggc

SEQ ID NO: 92487 - DNA, 20 bp, Artificial Sequence
  Description of Artificial Sequence: Synthetic oligonucleotide
  Target: ATXN1; (-) strand; PAM type: NRG; PAM sequence: TGG
gagacggggtttcaccatgt

SEQ ID NO: 92488 - DNA, 20 bp, Artificial Sequence
  Description of Artificial Sequence: Synthetic oligonucleotide
  Target: ATXN1; (-) strand; PAM type: NRG; PAM sequence: GGG
ttgtattttcagtagagacg

SEQ ID NO: 92489 - DNA, 20 bp, Artificial Sequence
  Description of Artificial Sequence: Synthetic oligonucleotide
  Target: ATXN1; (-) strand; PAM type: NRG; PAM sequence: GGG
tttgtattttcagtagagac

SEQ ID NO: 92490 - DNA, 20 bp, Artificial Sequence
  Description of Artificial Sequence: Synthetic oligonucleotide
  Target: ATXN1; (-) strand; PAM type: NRG; PAM sequence: CGG
ttttgtattttcagtagaga

SEQ ID NO: 92491 - DNA, 20 bp, Artificial Sequence
  Description of Artificial Sequence: Synthetic oligonucleotide
  Target: ATXN1; (-) strand; PAM type: NRG; PAM sequence: GAG
taatttttgtattttcagta

SEQ ID NO: 92492 - DNA, 20 bp, Artificial Sequence
  Description of Artificial Sequence: Synthetic oligonucleotide
  Target: ATXN1; (-) strand; PAM type: NRG; PAM sequence: TAG
gttaatttttgtattttcag

SEQ ID NO: 92493 - DNA, 20 bp, Artificial Sequence
  Description of Artificial Sequence: Synthetic oligonucleotide
  Target: ATXN1; (-) strand; PAM type: NRG; PAM sequence: CAG
ctggttaatttttgtatttt

SEQ ID NO: 92494 - DNA, 20 bp, Artificial Sequence
  Description of Artificial Sequence: Synthetic oligonucleotide
  Target: ATXN1; (-) strand; PAM type: NRG; PAM sequence: TGG
caggcacccattagcacgcc

SEQ ID NO: 92495 - DNA, 20 bp, Artificial Sequence
  Description of Artificial Sequence: Synthetic oligonucleotide
  Target: ATXN1; (-) strand; PAM type: NRG; PAM sequence: TAG
ctggaattacaggcacccat

SEQ ID NO: 92496 - DNA, 20 bp, Artificial Sequence
  Description of Artificial Sequence: Synthetic oligonucleotide
  Target: ATXN1; (-) strand; PAM type: NRG; PAM sequence: AGG
tccaaagtagctggaattac

SEQ ID NO: 92497 - DNA, 20 bp, Artificial Sequence
  Description of Artificial Sequence: Synthetic oligonucleotide
  Target: ATXN1; (-) strand; PAM type: NRG; PAM sequence: CAG
ctccaaagtagctggaatta

SEQ ID NO: 92498 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctccaaagtagc

SEQ ID NO: 92499 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctccaaag

SEQ ID NO: 92500 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctcca

SEQ ID NO: 92501 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 92502 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcctgagttc

SEQ ID NO: 92503 - DNA, 20 bp, Artificial Sequence
  Description of Artificial Sequence: Synthetic oligonucleotide
  Target: ATXN1; (-) strand; PAM type: NRG; PAM sequence: GAG
tattgcaacctctgcctcct

SEQ ID NO: 92504 - DNA, 20 bp, Artificial Sequence
  Description of Artificial Sequence: Synthetic oligonucleotide
  Target: ATXN1; (-) strand; PAM type: NRG; PAM sequence: CGG
tgagtggagtggtgccatct

SEQ ID NO: 92505 - DNA, 20 bp, Artificial Sequence
  Description of Artificial Sequence: Synthetic oligonucleotide
  Target: ATXN1; (-) strand; PAM type: NRG; PAM sequence: TGG
ttacccagacttgagtggag

SEQ ID NO: 92506 - DNA, 20 bp, Artificial Sequence
  Description of Artificial Sequence: Synthetic oligonucleotide
  Target: ATXN1; (-) strand; PAM type: NRG; PAM sequence: GAG
ctgttacccagacttgagtg

SEQ ID NO: 92507 - DNA, 20 bp, Artificial Sequence
  Description of Artificial Sequence: Synthetic oligonucleotide
  Target: ATXN1; (-) strand; PAM type: NRG; PAM sequence: TGG
ctctgttacccagacttgag

SEQ ID NO: 92508 - DNA, 20 bp, Artificial Sequence
  Description of Artificial Sequence: Synthetic oligonucleotide
  Target: ATXN1; (-) strand; PAM type: NRG; PAM sequence: GAG
tcactctgttacccagactt

SEQ ID NO: 92509 - DNA, 20 bp, Artificial Sequence
  Description of Artificial Sequence: Synthetic oligonucleotide
  Target: ATXN1; (-) strand; PAM type: NRG; PAM sequence: CAG
tggagtctcactctgttacc

SEQ ID NO: 92510 - DNA, 20 bp, Artificial Sequence
  Description of Artificial Sequence: Synthetic oligonucleotide
  Target: ATXN1; (-) strand; PAM type: NRG; PAM sequence: GAG
ttttgtgtgtgtgtgagatg

SEQ ID NO: 92511 - DNA, 20 bp, Artificial Sequence
  Description of Artificial Sequence: Synthetic oligonucleotide
  Target: ATXN1; (-) strand; PAM type: NRG; PAM sequence: TGG
ttttttgtgtgtgtgtgaga

SEQ ID NO: 92512 - DNA, 20 bp, Artificial Sequence
  Description of Artificial Sequence: Synthetic oligonucleotide
  Target: ATXN1; (-) strand; PAM type: NRG; PAM sequence: GAG
atttttttttgtgtgtgtgt

SEQ ID NO: 92513 - DNA, 20 bp, Artificial Sequence
  Description of Artificial Sequence: Synthetic oligonucleotide
  Target: ATXN1; (-) strand; PAM type: NRG; PAM sequence: GAG
atttggagctttatcaaatg

SEQ ID NO: 92514 - DNA, 20 bp, Artificial Sequence
  Description of Artificial Sequence: Synthetic oligonucleotide
  Target: ATXN1; (-) strand; PAM type: NRG; PAM sequence: TGG
tgatttggagctttatcaaa

SEQ ID NO: 92515 - DNA, 20 bp, Artificial Sequence
  Description of Artificial Sequence: Synthetic oligonucleotide
  Target: ATXN1; (-) strand; PAM type: NRG; PAM sequence: GAG
ttatcagctattatgatttg

SEQ ID NO: 92516 - DNA, 20 bp, Artificial Sequence
  Description of Artificial Sequence: Synthetic oligonucleotide
  Target: ATXN1; (-) strand; PAM type: NRG; PAM sequence: TGG
ttttatcagctattatgatt

SEQ ID NO: 92517 - DNA, 20 bp, Artificial Sequence
  Description of Artificial Sequence: Synthetic oligonucleotide
  Target: ATXN1; (-) strand; PAM type: NRG; PAM sequence: CAG
gtgttgggggactcttttat

SEQ ID NO: 92518 - DNA, 20 bp, Artificial Sequence
  Description of Artificial Sequence: Synthetic oligonucleotide
  Target: ATXN1; (-) strand; PAM type: NRG; PAM sequence: GGG
ctttatagaactagtgttgg

SEQ ID NO: 92519 - DNA, 20 bp, Artificial Sequence
  Description of Artificial Sequence: Synthetic oligonucleotide
  Target: ATXN1; (-) strand; PAM type: NRG; PAM sequence: GGG
cctttatagaactagtgttg

SEQ ID NO: 92520 - DNA, 20 bp, Artificial Sequence
  Description of Artificial Sequence: Synthetic oligonucleotide
  Target: ATXN1; (-) strand; PAM type: NRG; PAM sequence: GGG
ccctttatagaactagtgtt

SEQ ID NO: 92521 - DNA, 20 bp, Artificial Sequence
  Description of Artificial Sequence: Synthetic oligonucleotide
  Target: ATXN1; (-) strand; PAM type: NRG; PAM sequence: TGG
accctttatagaactagtgt

SEQ ID NO: 92522 - DNA, 20 bp, Artificial Sequence
  Description of Artificial Sequence: Synthetic oligonucleotide
  Target: ATXN1; (-) strand; PAM type: NRG; PAM sequence: TAG
gtgtgcaccctttatagaac

SEQ ID NO: 92523 - DNA, 20 bp, Artificial Sequence
  Description of Artificial Sequence: Synthetic oligonucleotide
  Target: ATXN1; (-) strand; PAM type: NRG; PAM sequence: TAG
aatacagtgtgcacccttta

SEQ ID NO: 92524 - DNA, 20 bp, Artificial Sequence
  Description of Artificial Sequence: Synthetic oligonucleotide
  Target: ATXN1; (-) strand; PAM type: NRG; PAM sequence: CAG
tgcatttgtatgtgtaaata

SEQ ID NO: 92525 - DNA, 20 bp, Artificial Sequence
  Description of Artificial Sequence: Synthetic oligonucleotide
  Target: ATXN1; (-) strand; PAM type: NRG; PAM sequence: AAG
ttggttgcttaatatttttc

SEQ ID NO: 92526 - DNA, 20 bp, Artificial Sequence
  Description of Artificial Sequence: Synthetic oligonucleotide
  Target: ATXN1; (-) strand; PAM type: NRG; PAM sequence: TGG
atatttacatatgtatgttt

SEQ ID NO: 92527 - DNA, 20 bp, Artificial Sequence
  Description of Artificial Sequence: Synthetic oligonucleotide
  Target: ATXN1; (-) strand; PAM type: NRG; PAM sequence: TAG
gcatacatgtagaagtatat

SEQ ID NO: 92528 - DNA, 20 bp, Artificial Sequence
  Description of Artificial Sequence: Synthetic oligonucleotide
  Target: ATXN1; (-) strand; PAM type: NRG; PAM sequence: AAG
taataagggcatacatgtag

SEQ ID NO: 92529 - DNA, 20 bp, Artificial Sequence
  Description of Artificial Sequence: Synthetic oligonucleotide
  Target: ATXN1; (-) strand; PAM type: NRG; PAM sequence: TAG
acttaataagggcatacatg

SEQ ID NO: 92530 - DNA, 20 bp, Artificial Sequence
  Description of Artificial Sequence: Synthetic oligonucleotide
  Target: ATXN1; (-) strand; PAM type: NRG; PAM sequence: GGG
aacataaaagtacttaataa

SEQ ID NO: 92531 - DNA, 20 bp, Artificial Sequence
  Description of Artificial Sequence: Synthetic oligonucleotide
  Target: ATXN1; (-) strand; PAM type: NRG; PAM sequence: AGG
aaacataaaagtacttaata

SEQ ID NO: 92532 - DNA, 20 bp, Artificial Sequence
  Description of Artificial Sequence: Synthetic oligonucleotide
  Target: ATXN1; (-) strand; PAM type: NRG; PAM sequence: AAG
caaacataaaagtacttaat

SEQ ID NO: 92533 - DNA, 20 bp, Artificial Sequence
  Description of Artificial Sequence: Synthetic oligonucleotide
  Target: ATXN1; (-) strand; PAM type: NRG; PAM sequence: AAG
gcacatctagtcaaacataa

SEQ ID NO: 92534 - DNA, 20 bp, Artificial Sequence
  Description of Artificial Sequence: Synthetic oligonucleotide
  Target: ATXN1; (-) strand; PAM type: NRG; PAM sequence: TAG
gatttcaaaagaagcacatc

SEQ ID NO: 92535 - DNA, 20 bp, Artificial Sequence
  Description of Artificial Sequence: Synthetic oligonucleotide
  Target: ATXN1; (-) strand; PAM type: NRG; PAM sequence: AAG
agctaaaaagatttcaaaag

SEQ ID NO: 92536 - DNA, 20 bp, Artificial Sequence
  Description of Artificial Sequence: Synthetic oligonucleotide
  Target: ATXN1; (-) strand; PAM type: NRG; PAM sequence: AAG
tgaagctaaaaagatttcaa

SEQ ID NO: 92537 - DNA, 20 bp, Artificial Sequence
  Description of Artificial Sequence: Synthetic oligonucleotide
  Target: ATXN1; (-) strand; PAM type: NRG; PAM sequence: AAG
aaacatgtaatgaagctaaa

SEQ ID NO: 92538 - DNA, 20 bp, Artificial Sequence
  Description of Artificial Sequence: Synthetic oligonucleotide
  Target: ATXN1; (-) strand; PAM type: NRG; PAM sequence: AAG
aattacaaaaacatgtaatg

SEQ ID NO: 92539 - DNA, 20 bp, Artificial Sequence
  Description of Artificial Sequence: Synthetic oligonucleotide
  Target: ATXN1; (-) strand; PAM type: NRG; PAM sequence: TAG
agtcttagctgtttaggatt

SEQ ID NO: 92540 - DNA, 20 bp, Artificial Sequence
  Description of Artificial Sequence: Synthetic oligonucleotide
  Target: ATXN1; (-) strand; PAM type: NRG; PAM sequence: AGG
taatgcagtcttagctgttt

SEQ ID NO: 92541 - DNA, 20 bp, Artificial Sequence
  Description of Artificial Sequence: Synthetic oligonucleotide
  Target: ATXN1; (-) strand; PAM type: NRG; PAM sequence: TAG
ttaatgcagtcttagctgtt

SEQ ID NO: 92542 - DNA, 20 bp, Artificial Sequence
  Description of Artificial Sequence: Synthetic oligonucleotide
  Target: ATXN1; (-) strand; PAM type: NRG; PAM sequence: TAG
gtggcaatttaatgcagtct

SEQ ID NO: 92543 - DNA, 20 bp, Artificial Sequence
  Description of Artificial Sequence: Synthetic oligonucleotide
  Target: ATXN1; (-) strand; PAM type: NRG; PAM sequence: CAG
atggaggtggcaatttaatg

SEQ ID NO: 92544 - DNA, 20 bp, Artificial Sequence
  Description of Artificial Sequence: Synthetic oligonucleotide
  Target: ATXN1; (-) strand; PAM type: NRG; PAM sequence: TGG
tacaattctgtagatggagg

SEQ ID NO: 92545 - DNA, 20 bp, Artificial Sequence
  Description of Artificial Sequence: Synthetic oligonucleotide
  Target: ATXN1; (-) strand; PAM type: NRG; PAM sequence: AGG
ccatacaattctgtagatgg

SEQ ID NO: 92546 - DNA, 20 bp, Artificial Sequence
  Description of Artificial Sequence: Synthetic oligonucleotide
  Target: ATXN1; (-) strand; PAM type: NRG; PAM sequence: GAG
gccatacaattctgtagatg

SEQ ID NO: 92547 - DNA, 20 bp, Artificial Sequence
  Description of Artificial Sequence: Synthetic oligonucleotide
  Target: ATXN1; (-) strand; PAM type: NRG; PAM sequence: TGG
gggccatacaattctgtaga

SEQ ID NO: 92548 - DNA, 20 bp, Artificial Sequence
  Description of Artificial Sequence: Synthetic oligonucleotide
  Target: ATXN1; (-) strand; PAM type: NRG; PAM sequence: TAG
tcaagggccatacaattctg

SEQ ID NO: 92549 - DNA, 20 bp, Artificial Sequence
  Description of Artificial Sequence: Synthetic oligonucleotide
  Target: ATXN1; (-) strand; PAM type: NRG; PAM sequence: GGG
catccatggaagtttttcaa

SEQ ID NO: 92550 - DNA, 20 bp, Artificial Sequence
  Description of Artificial Sequence: Synthetic oligonucleotide
  Target: ATXN1; (-) strand; PAM type: NRG; PAM sequence: AGG
tcatccatggaagtttttca

SEQ ID NO: 92551 - DNA, 20 bp, Artificial Sequence
  Description of Artificial Sequence: Synthetic oligonucleotide
  Target: ATXN1; (-) strand; PAM type: NRG; PAM sequence: AAG
ctcatccatggaagtttttc

SEQ ID NO: 92552 - DNA, 20 bp, Artificial Sequence
  Description of Artificial Sequence: Synthetic oligonucleotide
  Target: ATXN1; (-) strand; PAM type: NRG; PAM sequence: AAG
caaattgcactcatccatgg

SEQ ID NO: 92553 - DNA, 20 bp, Artificial Sequence
  Description of Artificial Sequence: Synthetic oligonucleotide
  Target: ATXN1; (-) strand; PAM type: NRG; PAM sequence: TGG
ttgcaaattgcactcatcca

SEQ ID NO: 92554 - DNA, 20 bp, Artificial Sequence
  Description of Artificial Sequence: Synthetic oligonucleotide
  Target: ATXN1; (-) strand; PAM type: NRG; PAM sequence: TGG
ggtaaagaggcttttggttt

SEQ ID NO: 92555 - DNA, 20 bp, Artificial Sequence
  Description of Artificial Sequence: Synthetic oligonucleotide
  Target: ATXN1; (-) strand; PAM type: NRG; PAM sequence: TGG
aaaataggtaaagaggcttt

SEQ ID NO: 92556 - DNA, 20 bp, Artificial Sequence
  Description of Artificial Sequence: Synthetic oligonucleotide
  Target: ATXN1; (-) strand; PAM type: NRG; PAM sequence: AGG
catttaaaaaataggtaaag

SEQ ID NO: 92557 - DNA, 20 bp, Artificial Sequence
  Description of Artificial Sequence: Synthetic oligonucleotide
  Target: ATXN1; (-) strand; PAM type: NRG; PAM sequence: GAG
acatttaaaaaataggtaaa

SEQ ID NO: 92558 - DNA, 20 bp, Artificial Sequence
  Description of Artificial Sequence: Synthetic oligonucleotide
  Target: ATXN1; (-) strand; PAM type: NRG; PAM sequence: AAG
ctacatttaaaaaataggta

SEQ ID NO: 92559 - DNA, 20 bp, Artificial Sequence
  Description of Artificial Sequence: Synthetic oligonucleotide
  Target: ATXN1; (-) strand; PAM type: NRG; PAM sequence: AGG
attcactacatttaaaaaat

SEQ ID NO: 92560 - DNA, 20 bp, Artificial Sequence
  Description of Artificial Sequence: Synthetic oligonucleotide
  Target: ATXN1; (-) strand; PAM type: NRG; PAM sequence: TAG
aattcactacatttaaaaaa

SEQ ID NO: 92561 - DNA, 20 bp, Artificial Sequence
  Description of Artificial Sequence: Synthetic oligonucleotide
  Target: ATXN1; (-) strand; PAM type: NRG; PAM sequence: TGG
aagagaattctttcatcggt

SEQ ID NO: 92562 - DNA, 20 bp, Artificial Sequence
  Description of Artificial Sequence: Synthetic oligonucleotide
  Target: ATXN1; (-) strand; PAM type: NRG; PAM sequence: CGG
gaataagagaattctttcat

SEQ ID NO: 92563 - DNA, 20 bp, Artificial Sequence
  Description of Artificial Sequence: Synthetic oligonucleotide
  Target: ATXN1; (-) strand; PAM type: NRG; PAM sequence: GAG
tcccggcatggcaggaataa

SEQ ID NO: 92564 - DNA, 20 bp, Artificial Sequence
  Description of Artificial Sequence: Synthetic oligonucleotide
  Target: ATXN1; (-) strand; PAM type: NRG; PAM sequence: AAG
ggtcccggcatggcaggaat

SEQ ID NO: 92565 - DNA, 20 bp, Artificial Sequence
  Description of Artificial Sequence: Synthetic oligonucleotide
  Target: ATXN1; (-) strand; PAM type: NRG; PAM sequence: AGG
agaatgggtcccggcatggc

SEQ ID NO: 92566 - DNA, 20 bp, Artificial Sequence
  Description of Artificial Sequence: Synthetic oligonucleotide
  Target: ATXN1; (-) strand; PAM type: NRG; PAM sequence: CAG
cagaatgggtcccggcatgg

SEQ ID NO: 92567 - DNA, 20 bp, Artificial Sequence
  Description of Artificial Sequence: Synthetic oligonucleotide
  Target: ATXN1; (-) strand; PAM type: NRG; PAM sequence: TGG
actcagaatgggtcccggca

SEQ ID NO: 92568 - DNA, 20 bp, Artificial Sequence
  Description of Artificial Sequence: Synthetic oligonucleotide
  Target: ATXN1; (-) strand; PAM type: NRG; PAM sequence: CGG
gtaaaactcagaatgggtcc

SEQ ID NO: 92569 - DNA, 20 bp, Artificial Sequence
  Description of Artificial Sequence: Synthetic oligonucleotide
  Target: ATXN1; (-) strand; PAM type: NRG; PAM sequence: GGG
gtgggtgtaaaactcagaat

SEQ ID NO: 92570 - DNA, 20 bp, Artificial Sequence
  Description of Artificial Sequence: Synthetic oligonucleotide
  Target: ATXN1; (-) strand; PAM type: NRG; PAM sequence: TGG
ggtgggtgtaaaactcagaa

SEQ ID NO: 92571 - DNA, 20 bp, Artificial Sequence
  Description of Artificial Sequence: Synthetic oligonucleotide
  Target: ATXN1; (-) strand; PAM type: NRG; PAM sequence: CAG
ggtatggtgggtgtaaaact

SEQ ID NO: 92572 - DNA, 20 bp, Artificial Sequence
  Description of Artificial Sequence: Synthetic oligonucleotide
  Target: ATXN1; (-) strand; PAM type: NRG; PAM sequence: GGG
gtagtaatacctggtatggt

SEQ ID NO: 92573 - DNA, 20 bp, Artificial Sequence
  Description of Artificial Sequence: Synthetic oligonucleotide
  Target: ATXN1; (-) strand; PAM type: NRG; PAM sequence: TGG
agtagtaatacctggtatgg

SEQ ID NO: 92574 - DNA, 20 bp, Artificial Sequence
  Description of Artificial Sequence: Synthetic oligonucleotide
  Target: ATXN1; (-) strand; PAM type: NRG; PAM sequence: TGG
gcaagtagtaatacctggta

SEQ ID NO: 92575 - DNA, 20 bp, Artificial Sequence
  Description of Artificial Sequence: Synthetic oligonucleotide
  Target: ATXN1; (-) strand; PAM type: NRG; PAM sequence: TGG
tttcagcaagtagtaatacc

SEQ ID NO: 92576 - DNA, 20 bp, Artificial Sequence
  Description of Artificial Sequence: Synthetic oligonucleotide
  Target: ATXN1; (-) strand; PAM type: NRG; PAM sequence: TAG
taatgcaggctttcagcaag

SEQ ID NO: 92577 - DNA, 20 bp, Artificial Sequence
  Description of Artificial Sequence: Synthetic oligonucleotide
  Target: ATXN1; (-) strand; PAM type: NRG; PAM sequence: AAG
ctttaatgcaggctttcagc

SEQ ID NO: 92578 - DNA, 20 bp, Artificial Sequence
  Description of Artificial Sequence: Synthetic oligonucleotide
  Target: ATXN1; (-) strand; PAM type: NRG; PAM sequence: CAG
aatgctttaatgcaggcttt

SEQ ID NO: 92579 - DNA, 20 bp, Artificial Sequence
  Description of Artificial Sequence: Synthetic oligonucleotide
  Target: ATXN1; (-) strand; PAM type: NRG; PAM sequence: AGG
gtcccttaatgctttaatgc

SEQ ID NO: 92580 - DNA, 20 bp, Artificial Sequence
  Description of Artificial Sequence: Synthetic oligonucleotide
  Target: ATXN1; (-) strand; PAM type: NRG; PAM sequence: CAG
tgtcccttaatgctttaatg

SEQ ID NO: 92581 - DNA, 20 bp, Artificial Sequence
  Description of Artificial Sequence: Synthetic oligonucleotide
  Target: ATXN1; (-) strand; PAM type: NRG; PAM sequence: AAG
accattaagtggaatatgtt

SEQ ID NO: 92582 - DNA, 20 bp, Artificial Sequence
  Description of Artificial Sequence: Synthetic oligonucleotide
  Target: ATXN1; (-) strand; PAM type: NRG; PAM sequence: TGG
cacaatcaaaaaccattaag

SEQ ID NO: 92583 - DNA, 20 bp, Artificial Sequence
  Description of Artificial Sequence: Synthetic oligonucleotide
  Target: ATXN1; (-) strand; PAM type: NRG; PAM sequence: AAG
taacacaatcaaaaaccatt

SEQ ID NO: 92584 - DNA, 20 bp, Artificial Sequence
  Description of Artificial Sequence: Synthetic oligonucleotide
  Target: ATXN1; (-) strand; PAM type: NRG; PAM sequence: GGG
atttttgggaaccaatgtga

SEQ ID NO: 92585 - DNA, 20 bp, Artificial Sequence
  Description of Artificial Sequence: Synthetic oligonucleotide
  Target: ATXN1; (-) strand; PAM type: NRG; PAM sequence: AGG
catttttgggaaccaatgtg

SEQ ID NO: 92586 - DNA, 20 bp, Artificial Sequence
  Description of Artificial Sequence: Synthetic oligonucleotide
  Target: ATXN1; (-) strand; PAM type: NRG; PAM sequence: GAG
acatttttgggaaccaatgt

SEQ ID NO: 92587 - DNA, 20 bp, Artificial Sequence
  Description of Artificial Sequence: Synthetic oligonucleotide
  Target: ATXN1; (-) strand; PAM type: NRG; PAM sequence: GGG
ttaaaatagcaaacattttt

SEQ ID NO: 92588 - DNA, 20 bp, Artificial Sequence
  Description of Artificial Sequence: Synthetic oligonucleotide
  Target: ATXN1; (-) strand; PAM type: NRG; PAM sequence: TGG
cttaaaatagcaaacatttt

SEQ ID NO: 92589 - DNA, 20 bp, Artificial Sequence
  Description of Artificial Sequence: Synthetic oligonucleotide
  Target: ATXN1; (-) strand; PAM type: NRG; PAM sequence: TAG
taatagtgtggctcttaaaa

SEQ ID NO: 92590 - DNA, 20 bp, Artificial Sequence
  Description of Artificial Sequence: Synthetic oligonucleotide
  Target: ATXN1; (-) strand; PAM type: NRG; PAM sequence: TGG
acttgtggttcttaatagtg

SEQ ID NO: 92591 - DNA, 20 bp, Artificial Sequence
  Description of Artificial Sequence: Synthetic oligonucleotide
  Target: ATXN1; (-) strand; PAM type: NRG; PAM sequence: TAG
ggctgacttgtggttcttaa

SEQ ID NO: 92592 - DNA, 20 bp, Artificial Sequence
  Description of Artificial Sequence: Synthetic oligonucleotide
  Target: ATXN1; (-) strand; PAM type: NRG; PAM sequence: TGG
tgccgtgcctggctgacttg

SEQ ID NO: 92593 - DNA, 20 bp, Artificial Sequence
  Description of Artificial Sequence: Synthetic oligonucleotide
  Target: ATXN1; (-) strand; PAM type: NRG; PAM sequence: TGG
cagacatgagctgccgtgcc

SEQ ID NO: 92594 - DNA, 20 bp, Artificial Sequence
  Description of Artificial Sequence: Synthetic oligonucleotide
  Target: ATXN1; (-) strand; PAM type: NRG; PAM sequence: GAG
agtgttgggattacagacat

SEQ ID NO: 92595 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgttgggatta

SEQ ID NO: 92596 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgtt

SEQ ID NO: 92597 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgt

SEQ ID NO: 92598 - DNA, 20 bp, Artificial Sequence
  Description of Artificial Sequence: Synthetic oligonucleotide
  Target: ATXN1; (-) strand; PAM type: NRG; PAM sequence: AAG
cctcccgcctcggcctccca

SEQ ID NO: 92599 - DNA, 20 bp, Artificial Sequence
  Description of Artificial Sequence: Synthetic oligonucleotide
  Target: ATXN1; (-) strand; PAM type: NRG; PAM sequence: CGG
ctcaagccatcctcccgcct

SEQ ID NO: 92600 - DNA, 20 bp, Artificial Sequence
  Description of Artificial Sequence: Synthetic oligonucleotide
  Target: ATXN1; (-) strand; PAM type: NRG; PAM sequence: AAG
tgtctcgaactcttggcctc

SEQ ID NO: 92601 - DNA, 20 bp, Artificial Sequence
  Description of Artificial Sequence: Synthetic oligonucleotide
  Target: ATXN1; (-) strand; PAM type: NRG; PAM sequence: TGG
caaagcttgtctcgaactct

SEQ ID NO: 92602 - DNA, 20 bp, Artificial Sequence
  Description of Artificial Sequence: Synthetic oligonucleotide
  Target: ATXN1; (-) strand; PAM type: NRG; PAM sequence: AAG
agggtcttgctatgttgcca

SEQ ID NO: 92603 - DNA, 20 bp, Artificial Sequence
  Description of Artificial Sequence: Synthetic oligonucleotide
  Target: ATXN1; (-) strand; PAM type: NRG; PAM sequence: GGG
aaaatttttttgtagagaca

SEQ ID NO: 92604 - DNA, 20 bp, Artificial Sequence
  Description of Artificial Sequence: Synthetic oligonucleotide
  Target: ATXN1; (-) strand; PAM type: NRG; PAM sequence: AGG
taaaatttttttgtagagac

SEQ ID NO: 92605 - DNA, 20 bp, Artificial Sequence
  Description of Artificial Sequence: Synthetic oligonucleotide
  Target: ATXN1; (-) strand; PAM type: NRG; PAM sequence: CAG
ttaaaatttttttgtagaga

SEQ ID NO: 92606 - DNA, 20 bp, Artificial Sequence
  Description of Artificial Sequence: Synthetic oligonucleotide
  Target: ATXN1; (-) strand; PAM type: NRG; PAM sequence: GAG
atttttaaaatttttttgta

SEQ ID NO: 92607 - DNA, 20 bp, Artificial Sequence
  Description of Artificial Sequence: Synthetic oligonucleotide
  Target: ATXN1; (-) strand; PAM type: NRG; PAM sequence: TAG
taatttttaaaatttttttg

SEQ ID NO: 92608 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgattagct

SEQ ID NO: 92609 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccgattagc

SEQ ID NO: 92610 - DNA, 20 bp, Artificial Sequence
  Description of Artificial Sequence: Synthetic oligonucleotide
  Target: ATXN1; (-) strand; PAM type: NRG; PAM sequence: TAG
tcctacctcagcctcccgat

SEQ ID NO: 92611 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatcctcctacct

SEQ ID NO: 92612 - DNA, 20 bp, Artificial Sequence
  Description of Artificial Sequence: Synthetic oligonucleotide
  Target: ATXN1; (-) strand; PAM type: NRG; PAM sequence: AAG
agccttgaacccttgggctc

SEQ ID NO: 92613 - DNA, 20 bp, Artificial Sequence
  Description of Artificial Sequence: Synthetic oligonucleotide
  Target: ATXN1; (-) strand; PAM type: NRG; PAM sequence: GGG
tactgcagccttgaaccctt

SEQ ID NO: 92614 - DNA, 20 bp, Artificial Sequence
  Description of Artificial Sequence: Synthetic oligonucleotide
  Target: ATXN1; (-) strand; PAM type: NRG; PAM sequence: TGG
ttactgcagccttgaaccct

SEQ ID NO: 92615 - DNA, 20 bp, Artificial Sequence
  Description of Artificial Sequence: Synthetic oligonucleotide
  Target: ATXN1; (-) strand; PAM type: NRG; PAM sequence: CAG
gcatgatcacagctttactg

SEQ ID NO: 92616 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgatca

SEQ ID NO: 92617 - DNA, 20 bp, Artificial Sequence
  Description of Artificial Sequence: Synthetic oligonucleotide
  Target: ATXN1; (-) strand; PAM type: NRG; PAM sequence: TGG
ttgtccgaactggagtgcag

SEQ ID NO: 92618 - DNA, 20 bp, Artificial Sequence
  Description of Artificial Sequence: Synthetic oligonucleotide
  Target: ATXN1; (-) strand; PAM type: NRG; PAM sequence: CAG
ctgttgtccgaactggagtg

SEQ ID NO: 92619 - DNA, 20 bp, Artificial Sequence
  Description of Artificial Sequence: Synthetic oligonucleotide
  Target: ATXN1; (-) strand; PAM type: NRG; PAM sequence: GAG
tcagtctgttgtccgaactg

SEQ ID NO: 92620 - DNA, 20 bp, Artificial Sequence
  Description of Artificial Sequence: Synthetic oligonucleotide
  Target: ATXN1; (-) strand; PAM type: NRG; PAM sequence: TGG
tctcagtctgttgtccgaac

SEQ ID NO: 92621 - DNA, 20 bp, Artificial Sequence
  Description of Artificial Sequence: Synthetic oligonucleotide
  Target: ATXN1; (-) strand; PAM type: NRG; PAM sequence: CAG
ttttccaagaggtcagttct

SEQ ID NO: 92622 - DNA, 20 bp, Artificial Sequence
  Description of Artificial Sequence: Synthetic oligonucleotide
  Target: ATXN1; (-) strand; PAM type: NRG; PAM sequence: CAG
cttttttttttccaagaggt

SEQ ID NO: 92623 - DNA, 20 bp, Artificial Sequence
  Description of Artificial Sequence: Synthetic oligonucleotide
  Target: ATXN1; (-) strand; PAM type: NRG; PAM sequence: AGG
gtttcttttttttttccaag

SEQ ID NO: 92624 - DNA, 20 bp, Artificial Sequence
  Description of Artificial Sequence: Synthetic oligonucleotide
  Target: ATXN1; (-) strand; PAM type: NRG; PAM sequence: GAG
tgtttcttttttttttccaa

SEQ ID NO: 92625 - DNA, 20 bp, Artificial Sequence
  Description of Artificial Sequence: Synthetic oligonucleotide
  Target: ATXN1; (-) strand; PAM type: NRG; PAM sequence: AAG
cctgtttcttttttttttcc

SEQ ID NO: 92626 - DNA, 20 bp, Artificial Sequence
  Description of Artificial Sequence: Synthetic oligonucleotide
  Target: ATXN1; (-) strand; PAM type: NRG; PAM sequence: TGG
taggtgtgaaccaccatgcc

SEQ ID NO: 92627 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtaccgggattat

SEQ ID NO: 92628 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtaccgggatta

SEQ ID NO: 92629 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtacc

SEQ ID NO: 92630 - DNA, 20 bp, Artificial Sequence
  Description of Artificial Sequence: Synthetic oligonucleotide
  Target: ATXN1; (-) strand; PAM type: NRG; PAM sequence: CGG
acctcggcctcccaaagtac

SEQ ID NO: 92631 - DNA, 20 bp, Artificial Sequence
  Description of Artificial Sequence: Synthetic oligonucleotide
  Target: ATXN1; (-) strand; PAM type: NRG; PAM sequence: AAG
ctcccgacctcggcctccca

SEQ ID NO: 92632 - DNA, 20 bp, Artificial Sequence
  Description of Artificial Sequence: Synthetic oligonucleotide
  Target: ATXN1; (-) strand; PAM type: NRG; PAM sequence: CGG
tggtcttgaactcccgacct

SEQ ID NO: 92633 - DNA, 20 bp, Artificial Sequence
  Description of Artificial Sequence: Synthetic oligonucleotide
  Target: ATXN1; (-) strand; PAM type: NRG; PAM sequence: TGG
tttctccatgttggtcaagc

SEQ ID NO: 92634 - DNA, 20 bp, Artificial Sequence
  Description of Artificial Sequence: Synthetic oligonucleotide
  Target: ATXN1; (-) strand; PAM type: NRG; PAM sequence: AAG
ggggtttctccatgttggtc

SEQ ID NO: 92635 - DNA, 20 bp, Artificial Sequence
  Description of Artificial Sequence: Synthetic oligonucleotide
  Target: ATXN1; (-) strand; PAM type: NRG; PAM sequence: TGG
aagatggggtttctccatgt

SEQ ID NO: 92636 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtcaagatg

SEQ ID NO: 92637 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtcaagat

SEQ ID NO: 92638 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtcaaga

SEQ ID NO: 92639 - DNA, 20 bp, Artificial Sequence
  Description of Artificial Sequence: Synthetic oligonucleotide
  Target: ATXN1; (-) strand; PAM type: NRG; PAM sequence: AAG
ctaattttgtatttttagtc

SEQ ID NO: 92640 - DNA, 20 bp, Artificial Sequence
  Description of Artificial Sequence: Synthetic oligonucleotide
  Target: ATXN1; (-) strand; PAM type: NRG; PAM sequence: TAG
cccagctaattttgtatttt

SEQ ID NO: 92641 - DNA, 20 bp, Artificial Sequence
  Description of Artificial Sequence: Synthetic oligonucleotide
  Target: ATXN1; (-) strand; PAM type: NRG; PAM sequence: CAG
caggcatatgccaccacacc

SEQ ID NO: 92642 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 92643 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 92644 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 92645 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 92646 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 92647 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 92648 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 92649 - DNA, 20 bp, Artificial Sequence
  Description of Artificial Sequence: Synthetic oligonucleotide
  Target: ATXN1; (-) strand; PAM type: NRG; PAM sequence: AAG
aacctctccctcccggattc

SEQ ID NO: 92650 - DNA, 20 bp, Artificial Sequence
  Description of Artificial Sequence: Synthetic oligonucleotide
  Target: ATXN1; (-) strand; PAM type: NRG; PAM sequence: CGG
tcactgtaacctctccctcc

SEQ ID NO: 92651 - DNA, 20 bp, Artificial Sequence
  Description of Artificial Sequence: Synthetic oligonucleotide
  Target: ATXN1; (-) strand; PAM type: NRG; PAM sequence: TGG
ggagtgcaatggcacgatct

SEQ ID NO: 92652 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcaa

SEQ ID NO: 92653 - DNA, 20 bp, Artificial Sequence
  Description of Artificial Sequence: Synthetic oligonucleotide
  Target: ATXN1; (-) strand; PAM type: NRG; PAM sequence: GAG
tgctcttgttgcccaggctg

SEQ ID NO: 92654 - DNA, 20 bp, Artificial Sequence
  Description of Artificial Sequence: Synthetic oligonucleotide
  Target: ATXN1; (-) strand; PAM type: NRG; PAM sequence: TGG
tttgctcttgttgcccaggc

SEQ ID NO: 92655 - DNA, 20 bp, Artificial Sequence
  Description of Artificial Sequence: Synthetic oligonucleotide
  Target: ATXN1; (-) strand; PAM type: NRG; PAM sequence: AGG
gagttttgctcttgttgccc

SEQ ID NO: 92656 - DNA, 20 bp, Artificial Sequence
  Description of Artificial Sequence: Synthetic oligonucleotide
  Target: ATXN1; (-) strand; PAM type: NRG; PAM sequence: CAG
ggagttttgctcttgttgcc

SEQ ID NO: 92657 - DNA, 20 bp, Artificial Sequence
  Description of Artificial Sequence: Synthetic oligonucleotide
  Target: ATXN1; (-) strand; PAM type: NRG; PAM sequence: GAG
gttctttttcatttgagatg

SEQ ID NO: 92658 - DNA, 20 bp, Artificial Sequence
  Description of Artificial Sequence: Synthetic oligonucleotide
  Target: ATXN1; (-) strand; PAM type: NRG; PAM sequence: TGG
tggttctttttcatttgaga

SEQ ID NO: 92659 - DNA, 20 bp, Artificial Sequence
  Description of Artificial Sequence: Synthetic oligonucleotide
  Target: ATXN1; (-) strand; PAM type: NRG; PAM sequence: GAG
ccagtggttctttttcattt

SEQ ID NO: 92660 - DNA, 20 bp, Artificial Sequence
  Description of Artificial Sequence: Synthetic oligonucleotide
  Target: ATXN1; (-) strand; PAM type: NRG; PAM sequence: TGG
gagccactccacccagccag

SEQ ID NO: 92661 - DNA, 20 bp, Artificial Sequence
  Description of Artificial Sequence: Synthetic oligonucleotide
  Target: ATXN1; (-) strand; PAM type: NRG; PAM sequence: CAG
catgagccactccacccagc

SEQ ID NO: 92662 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccactccacc

SEQ ID NO: 92663 - DNA, 20 bp, Artificial Sequence
  Description of Artificial Sequence: Synthetic oligonucleotide
  Target: ATXN1; (-) strand; PAM type: NRG; PAM sequence: GAG
agtgctgagattacaggcat

SEQ ID NO: 92664 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgagattac

SEQ ID NO: 92665 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgagatta

SEQ ID NO: 92666 - DNA, 20 bp, Artificial Sequence
  Description of Artificial Sequence: Synthetic oligonucleotide
  Target: ATXN1; (-) strand; PAM type: NRG; PAM sequence: GAG
ccttggcctcccaaagtgct

SEQ ID NO: 92667 - DNA, 20 bp, Artificial Sequence
  Description of Artificial Sequence: Synthetic oligonucleotide
  Target: ATXN1; (-) strand; PAM type: NRG; PAM sequence: AAG
ccacctaccttggcctccca

SEQ ID NO: 92668 - DNA, 20 bp, Artificial Sequence
  Description of Artificial Sequence: Synthetic oligonucleotide
  Target: ATXN1; (-) strand; PAM type: NRG; PAM sequence: TGG
cacaagaaatccacctacct

SEQ ID NO: 92669 - DNA, 20 bp, Artificial Sequence
  Description of Artificial Sequence: Synthetic oligonucleotide
  Target: ATXN1; (-) strand; PAM type: NRG; PAM sequence: AAG
ggttttgaactcctgaccac

SEQ ID NO: 92670 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 92671 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 92672 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggc

SEQ ID NO: 92673 - DNA, 20 bp, Artificial Sequence
  Description of Artificial Sequence: Synthetic oligonucleotide
  Target: ATXN1; (-) strand; PAM type: NRG; PAM sequence: TGG
tggctggggtttcaccatgt

SEQ ID NO: 92674 - DNA, 20 bp, Artificial Sequence
  Description of Artificial Sequence: Synthetic oligonucleotide
  Target: ATXN1; (-) strand; PAM type: NRG; PAM sequence: GGG
gtcagcctccggagtggctg

SEQ ID NO: 92675 - DNA, 20 bp, Artificial Sequence
  Description of Artificial Sequence: Synthetic oligonucleotide
  Target: ATXN1; (-) strand; PAM type: NRG; PAM sequence: GGG
cgtcagcctccggagtggct

SEQ ID NO: 92676 - DNA, 20 bp, Artificial Sequence
  Description of Artificial Sequence: Synthetic oligonucleotide
  Target: ATXN1; (-) strand; PAM type: NRG; PAM sequence: TGG
gcgtcagcctccggagtggc

SEQ ID NO: 92677 - DNA, 20 bp, Artificial Sequence
  Description of Artificial Sequence: Synthetic oligonucleotide
  Target: ATXN1; (-) strand; PAM type: NRG; PAM sequence: TGG
tcctgcgtcagcctccggag

SEQ ID NO: 92678 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcgtcagcctccg

SEQ ID NO: 92679 - DNA, 20 bp, Artificial Sequence
  Description of Artificial Sequence: Synthetic oligonucleotide
  Target: ATXN1; (-) strand; PAM type: NRG; PAM sequence: CGG
gattctcctgcgtcagcctc

SEQ ID NO: 92680 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcgt

SEQ ID NO: 92681 - DNA, 20 bp, Artificial Sequence
  Description of Artificial Sequence: Synthetic oligonucleotide
  Target: ATXN1; (-) strand; PAM type: NRG; PAM sequence: AAG
aatctccgcctcttgggttc

SEQ ID NO: 92682 - DNA, 20 bp, Artificial Sequence
  Description of Artificial Sequence: Synthetic oligonucleotide
  Target: ATXN1; (-) strand; PAM type: NRG; PAM sequence: GGG
cactgcaatctccgcctctt

SEQ ID NO: 92683 - DNA, 20 bp, Artificial Sequence
  Description of Artificial Sequence: Synthetic oligonucleotide
  Target: ATXN1; (-) strand; PAM type: NRG; PAM sequence: TGG
tcactgcaatctccgcctct

SEQ ID NO: 92684 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggtgagatct

SEQ ID NO: 92685 - DNA, 20 bp, Artificial Sequence
  Description of Artificial Sequence: Synthetic oligonucleotide
  Target: ATXN1; (-) strand; PAM type: NRG; PAM sequence: GAG
ctaggctggagtgcagtggt

SEQ ID NO: 92686 - DNA, 20 bp, Artificial Sequence
  Description of Artificial Sequence: Synthetic oligonucleotide
  Target: ATXN1; (-) strand; PAM type: NRG; PAM sequence: TGG
ttgcctaggctggagtgcag

SEQ ID NO: 92687 - DNA, 20 bp, Artificial Sequence
  Description of Artificial Sequence: Synthetic oligonucleotide
  Target: ATXN1; (-) strand; PAM type: NRG; PAM sequence: CAG
cggttgcctaggctggagtg

SEQ ID NO: 92688 - DNA, 20 bp, Artificial Sequence
  Description of Artificial Sequence: Synthetic oligonucleotide
  Target: ATXN1; (-) strand; PAM type: NRG; PAM sequence: GAG
tctgtcggttgcctaggctg

SEQ ID NO: 92689 - DNA, 20 bp, Artificial Sequence
  Description of Artificial Sequence: Synthetic oligonucleotide
  Target: ATXN1; (-) strand; PAM type: NRG; PAM sequence: TGG
actctgtcggttgcctaggc

SEQ ID NO: 92690 - DNA, 20 bp, Artificial Sequence
  Description of Artificial Sequence: Synthetic oligonucleotide
  Target: ATXN1; (-) strand; PAM type: NRG; PAM sequence: AGG
tctcactctgtcggttgcct

SEQ ID NO: 92691 - DNA, 20 bp, Artificial Sequence
  Description of Artificial Sequence: Synthetic oligonucleotide
  Target: ATXN1; (-) strand; PAM type: NRG; PAM sequence: TAG
gtctcactctgtcggttgcc

SEQ ID NO: 92692 - DNA, 20 bp, Artificial Sequence
  Description of Artificial Sequence: Synthetic oligonucleotide
  Target: ATXN1; (-) strand; PAM type: NRG; PAM sequence: CGG
tatatggggtctcactctgt

SEQ ID NO: 92693 - DNA, 20 bp, Artificial Sequence
  Description of Artificial Sequence: Synthetic oligonucleotide
  Target: ATXN1; (-) strand; PAM type: NRG; PAM sequence: GGG
agacattttttttttatatg

SEQ ID NO: 92694 - DNA, 20 bp, Artificial Sequence
  Description of Artificial Sequence: Synthetic oligonucleotide
  Target: ATXN1; (-) strand; PAM type: NRG; PAM sequence: GGG
tagacattttttttttatat

SEQ ID NO: 92695 - DNA, 20 bp, Artificial Sequence
  Description of Artificial Sequence: Synthetic oligonucleotide
  Target: ATXN1; (-) strand; PAM type: NRG; PAM sequence: TGG
atagacattttttttttata

SEQ ID NO: 92696 - DNA, 20 bp, Artificial Sequence
  Description of Artificial Sequence: Synthetic oligonucleotide
  Target: ATXN1; (-) strand; PAM type: NRG; PAM sequence: TAG
aatcttaactctatagtcta

SEQ ID NO: 92697 - DNA, 20 bp, Artificial Sequence
  Description of Artificial Sequence: Synthetic oligonucleotide
  Target: ATXN1; (-) strand; PAM type: NRG; PAM sequence: TAG
attcacaaatcttaactcta

SEQ ID NO: 92698 - DNA, 20 bp, Artificial Sequence
  Description of Artificial Sequence: Synthetic oligonucleotide
  Target: ATXN1; (-) strand; PAM type: NRG; PAM sequence: AGG
agatctctcacaagcttgtc

SEQ ID NO: 92699 - DNA, 20 bp, Artificial Sequence
  Description of Artificial Sequence: Synthetic oligonucleotide
  Target: ATXN1; (-) strand; PAM type: NRG; PAM sequence: CAG
cagatctctcacaagcttgt

SEQ ID NO: 92700 - DNA, 20 bp, Artificial Sequence
  Description of Artificial Sequence: Synthetic oligonucleotide
  Target: ATXN1; (-) strand; PAM type: NRG; PAM sequence: AAG
tgtgccaacagatctctcac

SEQ ID NO: 92701 - DNA, 20 bp, Artificial Sequence
  Description of Artificial Sequence: Synthetic oligonucleotide
  Target: ATXN1; (-) strand; PAM type: NRG; PAM sequence: CAG
atttcatatgactgtgccaa

SEQ ID NO: 92702 - DNA, 20 bp, Artificial Sequence
  Description of Artificial Sequence: Synthetic oligonucleotide
  Target: ATXN1; (-) strand; PAM type: NRG; PAM sequence: AGG
agcaaacagaacacctgaga

SEQ ID NO: 92703 - DNA, 20 bp, Artificial Sequence
  Description of Artificial Sequence: Synthetic oligonucleotide
  Target: ATXN1; (-) strand; PAM type: NRG; PAM sequence: AAG
tagcaaacagaacacctgag

SEQ ID NO: 92704 - DNA, 20 bp, Artificial Sequence
  Description of Artificial Sequence: Synthetic oligonucleotide
  Target: ATXN1; (-) strand; PAM type: NRG; PAM sequence: GAG
ttgtagcaaacagaacacct

SEQ ID NO: 92705 - DNA, 20 bp, Artificial Sequence
  Description of Artificial Sequence: Synthetic oligonucleotide
  Target: ATXN1; (-) strand; PAM type: NRG; PAM sequence: CAG
atgctatgttttgtagcaaa

SEQ ID NO: 92706 - DNA, 20 bp, Artificial Sequence
  Description of Artificial Sequence: Synthetic oligonucleotide
  Target: ATXN1; (-) strand; PAM type: NRG; PAM sequence: TAG
gtaaagcatgctatgttttg

SEQ ID NO: 92707 - DNA, 20 bp, Artificial Sequence
  Description of Artificial Sequence: Synthetic oligonucleotide
  Target: ATXN1; (-) strand; PAM type: NRG; PAM sequence: AAG
gaggcatgcccttccaagta

SEQ ID NO: 92708 - DNA, 20 bp, Artificial Sequence
  Description of Artificial Sequence: Synthetic oligonucleotide
  Target: ATXN1; (-) strand; PAM type: NRG; PAM sequence: AAG
caaatgaggcatgcccttcc

SEQ ID NO: 92709 - DNA, 20 bp, Artificial Sequence
  Description of Artificial Sequence: Synthetic oligonucleotide
  Target: ATXN1; (-) strand; PAM type: NRG; PAM sequence: AGG
atttttgcctcactcaaatg

SEQ ID NO: 92710 - DNA, 20 bp, Artificial Sequence
  Description of Artificial Sequence: Synthetic oligonucleotide
  Target: ATXN1; (-) strand; PAM type: NRG; PAM sequence: GAG
tatttttgcctcactcaaat

SEQ ID NO: 92711 - DNA, 20 bp, Artificial Sequence
  Description of Artificial Sequence: Synthetic oligonucleotide
  Target: ATXN1; (-) strand; PAM type: NRG; PAM sequence: GAG
tagtgttgggaattcttggt

SEQ ID NO: 92712 - DNA, 20 bp, Artificial Sequence
  Description of Artificial Sequence: Synthetic oligonucleotide
  Target: ATXN1; (-) strand; PAM type: NRG; PAM sequence: TGG
tgactagtgttgggaattct

SEQ ID NO: 92713 - DNA, 20 bp, Artificial Sequence
  Description of Artificial Sequence: Synthetic oligonucleotide
  Target: ATXN1; (-) strand; PAM type: NRG; PAM sequence: GGG
ccagtgtcatgactagtgtt

SEQ ID NO: 92714 - DNA, 20 bp, Artificial Sequence
  Description of Artificial Sequence: Synthetic oligonucleotide
  Target: ATXN1; (-) strand; PAM type: NRG; PAM sequence: TGG
cccagtgtcatgactagtgt

SEQ ID NO: 92715 - DNA, 20 bp, Artificial Sequence
  Description of Artificial Sequence: Synthetic oligonucleotide
  Target: ATXN1; (-) strand; PAM type: NRG; PAM sequence: TAG
gggatgcccagtgtcatgac

SEQ ID NO: 92716 - DNA, 20 bp, Artificial Sequence
  Description of Artificial Sequence: Synthetic oligonucleotide
  Target: ATXN1; (-) strand; PAM type: NRG; PAM sequence: CAG
gcgttccttgcggggatgcc

SEQ ID NO: 92717 - DNA, 20 bp, Artificial Sequence
  Description of Artificial Sequence: Synthetic oligonucleotide
  Target: ATXN1; (-) strand; PAM type: NRG; PAM sequence: GGG
gaaggcgagcgttccttgcg

SEQ ID NO: 92718 - DNA, 20 bp, Artificial Sequence
  Description of Artificial Sequence: Synthetic oligonucleotide
  Target: ATXN1; (-) strand; PAM type: NRG; PAM sequence: GGG
tgaaggcgagcgttccttgc

SEQ ID NO: 92719 - DNA, 20 bp, Artificial Sequence
  Description of Artificial Sequence: Synthetic oligonucleotide
  Target: ATXN1; (-) strand; PAM type: NRG; PAM sequence: CGG
gtgaaggcgagcgttccttg

SEQ ID NO: 92720 - DNA, 20 bp, Artificial Sequence
  Description of Artificial Sequence: Synthetic oligonucleotide
  Target: ATXN1; (-) strand; PAM type: NRG; PAM sequence: GAG
aacctttaaaaagtgaaggc

SEQ ID NO: 92721 - DNA, 20 bp, Artificial Sequence
  Description of Artificial Sequence: Synthetic oligonucleotide
  Target: ATXN1; (-) strand; PAM type: NRG; PAM sequence: AGG
aacaaacctttaaaaagtga

SEQ ID NO: 92722 - DNA, 20 bp, Artificial Sequence
  Description of Artificial Sequence: Synthetic oligonucleotide
  Target: ATXN1; (-) strand; PAM type: NRG; PAM sequence: AAG
gaacaaacctttaaaaagtg

SEQ ID NO: 92723 - DNA, 20 bp, Artificial Sequence
  Description of Artificial Sequence: Synthetic oligonucleotide
  Target: ATXN1; (-) strand; PAM type: NRG; PAM sequence: AAG
ggtcagaacaaacctttaaa

SEQ ID NO: 92724 - DNA, 20 bp, Artificial Sequence
  Description of Artificial Sequence: Synthetic oligonucleotide
  Target: ATXN1; (-) strand; PAM type: NRG; PAM sequence: CAG
agaacaaagaagaactgggt

SEQ ID NO: 92725 - DNA, 20 bp, Artificial Sequence
  Description of Artificial Sequence: Synthetic oligonucleotide
  Target: ATXN1; (-) strand; PAM type: NRG; PAM sequence: GGG
atggagaacaaagaagaact

SEQ ID NO: 92726 - DNA, 20 bp, Artificial Sequence
  Description of Artificial Sequence: Synthetic oligonucleotide
  Target: ATXN1; (-) strand; PAM type: NRG; PAM sequence: TGG
catggagaacaaagaagaac

SEQ ID NO: 92727 - DNA, 20 bp, Artificial Sequence
  Description of Artificial Sequence: Synthetic oligonucleotide
  Target: ATXN1; (-) strand; PAM type: NRG; PAM sequence: AAG
caccatcatggagaacaaag

SEQ ID NO: 92728 - DNA, 20 bp, Artificial Sequence
  Description of Artificial Sequence: Synthetic oligonucleotide
  Target: ATXN1; (-) strand; PAM type: NRG; PAM sequence: AAG
tcgcaccatcatggagaaca

SEQ ID NO: 92729 - DNA, 20 bp, Artificial Sequence
  Description of Artificial Sequence: Synthetic oligonucleotide
  Target: ATXN1; (-) strand; PAM type: NRG; PAM sequence: GAG
tcttttctcgcaccatcatg

SEQ ID NO: 92730 - DNA, 20 bp, Artificial Sequence
  Description of Artificial Sequence: Synthetic oligonucleotide
  Target: ATXN1; (-) strand; PAM type: NRG; PAM sequence: TGG
cttcttttctcgcaccatca

SEQ ID NO: 92731 - DNA, 20 bp, Artificial Sequence
  Description of Artificial Sequence: Synthetic oligonucleotide
  Target: ATXN1; (-) strand; PAM type: NRG; PAM sequence: CAG
acacaaaaatgcacaccagc

SEQ ID NO: 92732 - DNA, 20 bp, Artificial Sequence
  Description of Artificial Sequence: Synthetic oligonucleotide
  Target: ATXN1; (-) strand; PAM type: NRG; PAM sequence: CAG
aagtacacaaaaatgcacac

SEQ ID NO: 92733 - DNA, 20 bp, Artificial Sequence
  Description of Artificial Sequence: Synthetic oligonucleotide
  Target: ATXN1; (-) strand; PAM type: NRG; PAM sequence: AAG
tatacatatatttttcacga

SEQ ID NO: 92734 - DNA, 20 bp, Artificial Sequence
  Description of Artificial Sequence: Synthetic oligonucleotide
  Target: ATXN1; (-) strand; PAM type: NRG; PAM sequence: AAG
agtgagactccatctcaaaa

SEQ ID NO: 92735 - DNA, 20 bp, Artificial Sequence
  Description of Artificial Sequence: Synthetic oligonucleotide
  Target: ATXN1; (-) strand; PAM type: NRG; PAM sequence: GAG
tccagcctgagcgacagagt

SEQ ID NO: 92736 - DNA, 20 bp, Artificial Sequence
  Description of Artificial Sequence: Synthetic oligonucleotide
  Target: ATXN1; (-) strand; PAM type: NRG; PAM sequence: GAG
acactccagcctgagcgaca

SEQ ID NO: 92737 - DNA, 20 bp, Artificial Sequence
  Description of Artificial Sequence: Synthetic oligonucleotide
  Target: ATXN1; (-) strand; PAM type: NRG; PAM sequence: CAG
ctacactccagcctgagcga

SEQ ID NO: 92738 - DNA, 20 bp, Artificial Sequence
  Description of Artificial Sequence: Synthetic oligonucleotide
  Target: ATXN1; (-) strand; PAM type: NRG; PAM sequence: GAG
gcaccactacactccagcct

SEQ ID NO: 92739 - DNA, 20 bp, Artificial Sequence
  Description of Artificial Sequence: Synthetic oligonucleotide
  Target: ATXN1; (-) strand; PAM type: NRG; PAM sequence: CAG
gagattgcaccactacactc

SEQ ID NO: 92740 - DNA, 20 bp, Artificial Sequence
  Description of Artificial Sequence: Synthetic oligonucleotide
  Target: ATXN1; (-) strand; PAM type: NRG; PAM sequence: GAG
ggtcgaggctgcagtgagct

SEQ ID NO: 92741 - DNA, 20 bp, Artificial Sequence
  Description of Artificial Sequence: Synthetic oligonucleotide
  Target: ATXN1; (-) strand; PAM type: NRG; PAM sequence: GAG
tgggaggtcgaggctgcagt

SEQ ID NO: 92742 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggtcgaggctg

SEQ ID NO: 92743 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgggaggtcg

SEQ ID NO: 92744 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctgggaggtc

SEQ ID NO: 92745 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctggg

SEQ ID NO: 92746 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaacctgg

SEQ ID NO: 92747 - DNA, 20 bp, Artificial Sequence
  Description of Artificial Sequence: Synthetic oligonucleotide
  Target: ATXN1; (-) strand; PAM type: NRG; PAM sequence: GGG
caggagaattgcttgaacct

SEQ ID NO: 92748 - DNA, 20 bp, Artificial Sequence
  Description of Artificial Sequence: Synthetic oligonucleotide
  Target: ATXN1; (-) strand; PAM type: NRG; PAM sequence: TGG
gcaggagaattgcttgaacc

SEQ ID NO: 92749 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcag

SEQ ID NO: 92750 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 92751 - DNA, 20 bp, Artificial Sequence
  Description of Artificial Sequence: Synthetic oligonucleotide
  Target: ATXN1; (-) strand; PAM type: NRG; PAM sequence: CAG
cgctactcaggaggctgagg

SEQ ID NO: 92752 - DNA, 20 bp, Artificial Sequence
  Description of Artificial Sequence: Synthetic oligonucleotide
  Target: ATXN1; (-) strand; PAM type: NRG; PAM sequence: AGG
ccccgctactcaggaggctg

SEQ ID NO: 92753 - DNA, 20 bp, Artificial Sequence
  Description of Artificial Sequence: Synthetic oligonucleotide
  Target: ATXN1; (-) strand; PAM type: NRG; PAM sequence: GAG
tccccgctactcaggaggct

SEQ ID NO: 92754 - DNA, 20 bp, Artificial Sequence
  Description of Artificial Sequence: Synthetic oligonucleotide
  Target: ATXN1; (-) strand; PAM type: NRG; PAM sequence: AGG
tgtggtccccgctactcagg

SEQ ID NO: 92755 - DNA, 20 bp, Artificial Sequence
  Description of Artificial Sequence: Synthetic oligonucleotide
  Target: ATXN1; (-) strand; PAM type: NRG; PAM sequence: GAG
ctgtggtccccgctactcag

SEQ ID NO: 92756 - DNA, 20 bp, Artificial Sequence
  Description of Artificial Sequence: Synthetic oligonucleotide
  Target: ATXN1; (-) strand; PAM type: NRG; PAM sequence: AGG
gcctgtggtccccgctactc

SEQ ID NO: 92757 - DNA, 20 bp, Artificial Sequence
  Description of Artificial Sequence: Synthetic oligonucleotide
  Target: ATXN1; (-) strand; PAM type: NRG; PAM sequence: CAG
cgcctgtggtccccgctact

SEQ ID NO: 92758 - DNA, 20 bp, Artificial Sequence
  Description of Artificial Sequence: Synthetic oligonucleotide
  Target: ATXN1; (-) strand; PAM type: NRG; PAM sequence: TGG
caaaaattagcacacgcctg

SEQ ID NO: 92759 - DNA, 20 bp, Artificial Sequence
  Description of Artificial Sequence: Synthetic oligonucleotide
  Target: ATXN1; (-) strand; PAM type: NRG; PAM sequence: TAG
ctttactaaaatacaaaaat

SEQ ID NO: 92760 - DNA, 20 bp, Artificial Sequence
  Description of Artificial Sequence: Synthetic oligonucleotide
  Target: ATXN1; (-) strand; PAM type: NRG; PAM sequence: TGG
cgagaccagcctgaccaaca

SEQ ID NO: 92761 - DNA, 20 bp, Artificial Sequence
  Description of Artificial Sequence: Synthetic oligonucleotide
  Target: ATXN1; (-) strand; PAM type: NRG; PAM sequence: CAG
tgaggtccatagttcgagac

SEQ ID NO: 92762 - DNA, 20 bp, Artificial Sequence
  Description of Artificial Sequence: Synthetic oligonucleotide
  Target: ATXN1; (-) strand; PAM type: NRG; PAM sequence: GAG
ttatttgaggtccatagttc

SEQ ID NO: 92763 - DNA, 20 bp, Artificial Sequence
  Description of Artificial Sequence: Synthetic oligonucleotide
  Target: ATXN1; (-) strand; PAM type: NRG; PAM sequence: TAG
ggtggattatttgaggtcca

SEQ ID NO: 92764 - DNA, 20 bp, Artificial Sequence
  Description of Artificial Sequence: Synthetic oligonucleotide
  Target: ATXN1; (-) strand; PAM type: NRG; PAM sequence: AGG
caaggcaggtggattatttg

SEQ ID NO: 92765 - DNA, 20 bp, Artificial Sequence
  Description of Artificial Sequence: Synthetic oligonucleotide
  Target: ATXN1; (-) strand; PAM type: NRG; PAM sequence: GAG
ccaaggcaggtggattattt

SEQ ID NO: 92766 - DNA, 20 bp, Artificial Sequence
  Description of Artificial Sequence: Synthetic oligonucleotide
  Target: ATXN1; (-) strand; PAM type: NRG; PAM sequence: TGG
ctttgagaggccaaggcagg

SEQ ID NO: 92767 - DNA, 20 bp, Artificial Sequence
  Description of Artificial Sequence: Synthetic oligonucleotide
  Target: ATXN1; (-) strand; PAM type: NRG; PAM sequence: AGG
gcactttgagaggccaaggc

SEQ ID NO: 92768 - DNA, 20 bp, Artificial Sequence
  Description of Artificial Sequence: Synthetic oligonucleotide
  Target: ATXN1; (-) strand; PAM type: NRG; PAM sequence: CAG
agcactttgagaggccaagg

SEQ ID NO: 92769 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgagaggcca

SEQ ID NO: 92770 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttgagaggcc

SEQ ID NO: 92771 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttgag

SEQ ID NO: 92772 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttga

SEQ ID NO: 92773 - DNA, 20 bp, Artificial Sequence
  Description of Artificial Sequence: Synthetic oligonucleotide
  Target: ATXN1; (-) strand; PAM type: NRG; PAM sequence: GAG
gtctgtaatcccagcacttt

SEQ ID NO: 92774 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgtctgtaatcc

SEQ ID NO: 92775 - DNA, 20 bp, Artificial Sequence
  Description of Artificial Sequence: Synthetic oligonucleotide
  Target: ATXN1; (-) strand; PAM type: NRG; PAM sequence: TGG
atttttaagactaggcacgg

SEQ ID NO: 92776 - DNA, 20 bp, Artificial Sequence
  Description of Artificial Sequence: Synthetic oligonucleotide
  Target: ATXN1; (-) strand; PAM type: NRG; PAM sequence: CGG
aatatttttaagactaggca

SEQ ID NO: 92777 - DNA, 20 bp, Artificial Sequence
  Description of Artificial Sequence: Synthetic oligonucleotide
  Target: ATXN1; (-) strand; PAM type: NRG; PAM sequence: AGG
tttaaaatatttttaagact

SEQ ID NO: 92778 - DNA, 20 bp, Artificial Sequence
  Description of Artificial Sequence: Synthetic oligonucleotide
  Target: ATXN1; (-) strand; PAM type: NRG; PAM sequence: TAG
ttttaaaatatttttaagac

SEQ ID NO: 92779 - DNA, 20 bp, Artificial Sequence
  Description of Artificial Sequence: Synthetic oligonucleotide
  Target: ATXN1; (-) strand; PAM type: NRG; PAM sequence: AAG
tgacgttttaaaatattttt

SEQ ID NO: 92780 - DNA, 20 bp, Artificial Sequence
  Description of Artificial Sequence: Synthetic oligonucleotide
  Target: ATXN1; (-) strand; PAM type: NRG; PAM sequence: TAG
cacctcagaaggaaccacta

SEQ ID NO: 92781 - DNA, 20 bp, Artificial Sequence
  Description of Artificial Sequence: Synthetic oligonucleotide
  Target: ATXN1; (-) strand; PAM type: NRG; PAM sequence: AGG
cacattcttcccacctcaga

SEQ ID NO: 92782 - DNA, 20 bp, Artificial Sequence
  Description of Artificial Sequence: Synthetic oligonucleotide
  Target: ATXN1; (-) strand; PAM type: NRG; PAM sequence: AAG
tcacattcttcccacctcag

SEQ ID NO: 92783 - DNA, 20 bp, Artificial Sequence
  Description of Artificial Sequence: Synthetic oligonucleotide
  Target: ATXN1; (-) strand; PAM type: NRG; PAM sequence: CAG
ttgtcacattcttcccacct

SEQ ID NO: 92784 - DNA, 20 bp, Artificial Sequence
  Description of Artificial Sequence: Synthetic oligonucleotide
  Target: ATXN1; (-) strand; PAM type: NRG; PAM sequence: TGG
tcaactggatgtcctctatg

SEQ ID NO: 92785 - DNA, 20 bp, Artificial Sequence
  Description of Artificial Sequence: Synthetic oligonucleotide
  Target: ATXN1; (-) strand; PAM type: NRG; PAM sequence: TGG
attttaaaattaccatcaac

SEQ ID NO: 92786 - DNA, 20 bp, Artificial Sequence
  Description of Artificial Sequence: Synthetic oligonucleotide
  Target: ATXN1; (-) strand; PAM type: NRG; PAM sequence: CAG
aattataaaaaataagggtt

SEQ ID NO: 92787 - DNA, 20 bp, Artificial Sequence
  Description of Artificial Sequence: Synthetic oligonucleotide
  Target: ATXN1; (-) strand; PAM type: NRG; PAM sequence: GGG
atgtaaattataaaaaataa

SEQ ID NO: 92788 - DNA, 20 bp, Artificial Sequence
  Description of Artificial Sequence: Synthetic oligonucleotide
  Target: ATXN1; (-) strand; PAM type: NRG; PAM sequence: AGG
aatgtaaattataaaaaata

SEQ ID NO: 92789 - DNA, 20 bp, Artificial Sequence
  Description of Artificial Sequence: Synthetic oligonucleotide
  Target: ATXN1; (-) strand; PAM type: NRG; PAM sequence: AAG
aaatgtaaattataaaaaat

SEQ ID NO: 92790 - DNA, 20 bp, Artificial Sequence
  Description of Artificial Sequence: Synthetic oligonucleotide
  Target: ATXN1; (-) strand; PAM type: NRG; PAM sequence: AAG
acagtaaaatagaaatacaa

SEQ ID NO: 92791 - DNA, 20 bp, Artificial Sequence
  Description of Artificial Sequence: Synthetic oligonucleotide
  Target: ATXN1; (-) strand; PAM type: NRG; PAM sequence: TAG
taaaataaaatacagtaaaa

SEQ ID NO: 92792 - DNA, 20 bp, Artificial Sequence
  Description of Artificial Sequence: Synthetic oligonucleotide
  Target: ATXN1; (-) strand; PAM type: NRG; PAM sequence: CAG
actaaatataaaataaaata

SEQ ID NO: 92793 - DNA, 20 bp, Artificial Sequence
  Description of Artificial Sequence: Synthetic oligonucleotide
  Target: ATXN1; (-) strand; PAM type: NRG; PAM sequence: TAG
gcctaccacctgtgtcattg

SEQ ID NO: 92794 - DNA, 20 bp, Artificial Sequence
  Description of Artificial Sequence: Synthetic oligonucleotide
  Target: ATXN1; (-) strand; PAM type: NRG; PAM sequence: TAG
catgcatgccattttaacct

SEQ ID NO: 92795 - DNA, 20 bp, Artificial Sequence
  Description of Artificial Sequence: Synthetic oligonucleotide
  Target: ATXN1; (-) strand; PAM type: NRG; PAM sequence: GGG
agctagtaagtggtgggact

SEQ ID NO: 92796 - DNA, 20 bp, Artificial Sequence
  Description of Artificial Sequence: Synthetic oligonucleotide
  Target: ATXN1; (-) strand; PAM type: NRG; PAM sequence: TGG
gagctagtaagtggtgggac

SEQ ID NO: 92797 - DNA, 20 bp, Artificial Sequence
  Description of Artificial Sequence: Synthetic oligonucleotide
  Target: ATXN1; (-) strand; PAM type: NRG; PAM sequence: GGG
tcacagagctagtaagtggt

SEQ ID NO: 92798 - DNA, 20 bp, Artificial Sequence
  Description of Artificial Sequence: Synthetic oligonucleotide
  Target: ATXN1; (-) strand; PAM type: NRG; PAM sequence: TGG
gtcacagagctagtaagtgg

SEQ ID NO: 92799 - DNA, 20 bp, Artificial Sequence
  Description of Artificial Sequence: Synthetic oligonucleotide
  Target: ATXN1; (-) strand; PAM type: NRG; PAM sequence: TGG
aaggtcacagagctagtaag

SEQ ID NO: 92800 - DNA, 20 bp, Artificial Sequence
  Description of Artificial Sequence: Synthetic oligonucleotide
  Target: ATXN1; (-) strand; PAM type: NRG; PAM sequence: AAG
cccaaggtcacagagctagt

SEQ ID NO: 92801 - DNA, 20 bp, Artificial Sequence
  Description of Artificial Sequence: Synthetic oligonucleotide
  Target: ATXN1; (-) strand; PAM type: NRG; PAM sequence: TAG
cttgcccaaggtcacagagc

SEQ ID NO: 92802 - DNA, 20 bp, Artificial Sequence
  Description of Artificial Sequence: Synthetic oligonucleotide
  Target: ATXN1; (-) strand; PAM type: NRG; PAM sequence: GAG
gtagcttgcccaaggtcaca

SEQ ID NO: 92803 - DNA, 20 bp, Artificial Sequence
  Description of Artificial Sequence: Synthetic oligonucleotide
  Target: ATXN1; (-) strand; PAM type: NRG; PAM sequence: CAG
tagtagcttgcccaaggtca

SEQ ID NO: 92804 - DNA, 20 bp, Artificial Sequence
  Description of Artificial Sequence: Synthetic oligonucleotide
  Target: ATXN1; (-) strand; PAM type: NRG; PAM sequence: AGG
ccgggttagtagcttgccca

SEQ ID NO: 92805 - DNA, 20 bp, Artificial Sequence
  Description of Artificial Sequence: Synthetic oligonucleotide
  Target: ATXN1; (-) strand; PAM type: NRG; PAM sequence: AAG
accgggttagtagcttgccc

SEQ ID NO: 92806 - DNA, 20 bp, Artificial Sequence
  Description of Artificial Sequence: Synthetic oligonucleotide
  Target: ATXN1; (-) strand; PAM type: NRG; PAM sequence: TAG
agatgaggtaaccgggttag

SEQ ID NO: 92807 - DNA, 20 bp, Artificial Sequence
  Description of Artificial Sequence: Synthetic oligonucleotide
  Target: ATXN1; (-) strand; PAM type: NRG; PAM sequence: TAG
tacagatgaggtaaccgggt

SEQ ID NO: 92808 - DNA, 20 bp, Artificial Sequence
  Description of Artificial Sequence: Synthetic oligonucleotide
  Target: ATXN1; (-) strand; PAM type: NRG; PAM sequence: GGG
accttacagatgaggtaacc

SEQ ID NO: 92809 - DNA, 20 bp, Artificial Sequence
  Description of Artificial Sequence: Synthetic oligonucleotide
  Target: ATXN1; (-) strand; PAM type: NRG; PAM sequence: CGG
caccttacagatgaggtaac

SEQ ID NO: 92810 - DNA, 20 bp, Artificial Sequence
  Description of Artificial Sequence: Synthetic oligonucleotide
  Target: ATXN1; (-) strand; PAM type: NRG; PAM sequence: AGG
ttatctccaccttacagatg

SEQ ID NO: 92811 - DNA, 20 bp, Artificial Sequence
  Description of Artificial Sequence: Synthetic oligonucleotide
  Target: ATXN1; (-) strand; PAM type: NRG; PAM sequence: GAG
attatctccaccttacagat

SEQ ID NO: 92812 - DNA, 20 bp, Artificial Sequence
  Description of Artificial Sequence: Synthetic oligonucleotide
  Target: ATXN1; (-) strand; PAM type: NRG; PAM sequence: CAG
tcattattatctccacctta

SEQ ID NO: 92813 - DNA, 20 bp, Artificial Sequence
  Description of Artificial Sequence: Synthetic oligonucleotide
  Target: ATXN1; (-) strand; PAM type: NRG; PAM sequence: AGG
tcctcacagtaaacctacat

SEQ ID NO: 92814 - DNA, 20 bp, Artificial Sequence
  Description of Artificial Sequence: Synthetic oligonucleotide
  Target: ATXN1; (-) strand; PAM type: NRG; PAM sequence: TAG
atcctcacagtaaacctaca

SEQ ID NO: 92815 - DNA, 20 bp, Artificial Sequence
  Description of Artificial Sequence: Synthetic oligonucleotide
  Target: ATXN1; (-) strand; PAM type: NRG; PAM sequence: CAG
tactaatcacttaatcctca

SEQ ID NO: 92816 - DNA, 20 bp, Artificial Sequence
  Description of Artificial Sequence: Synthetic oligonucleotide
  Target: ATXN1; (-) strand; PAM type: NRG; PAM sequence: CAG
attgaggatttaggatgtgt

SEQ ID NO: 92817 - DNA, 20 bp, Artificial Sequence
  Description of Artificial Sequence: Synthetic oligonucleotide
  Target: ATXN1; (-) strand; PAM type: NRG; PAM sequence: AGG
ggctggcatattgaggattt

SEQ ID NO: 92818 - DNA, 20 bp, Artificial Sequence
  Description of Artificial Sequence: Synthetic oligonucleotide
  Target: ATXN1; (-) strand; PAM type: NRG; PAM sequence: TAG
tggctggcatattgaggatt

SEQ ID NO: 92819 - DNA, 20 bp, Artificial Sequence
  Description of Artificial Sequence: Synthetic oligonucleotide
  Target: ATXN1; (-) strand; PAM type: NRG; PAM sequence: AGG
aatggctggctggcatattg

SEQ ID NO: 92820 - DNA, 20 bp, Artificial Sequence
  Description of Artificial Sequence: Synthetic oligonucleotide
  Target: ATXN1; (-) strand; PAM type: NRG; PAM sequence: GAG
taatggctggctggcatatt

SEQ ID NO: 92821 - DNA, 20 bp, Artificial Sequence
  Description of Artificial Sequence: Synthetic oligonucleotide
  Target: ATXN1; (-) strand; PAM type: NRG; PAM sequence: TGG
taacaataataatggctggc

SEQ ID NO: 92822 - DNA, 20 bp, Artificial Sequence
  Description of Artificial Sequence: Synthetic oligonucleotide
  Target: ATXN1; (-) strand; PAM type: NRG; PAM sequence: TGG
cttctaacaataataatggc

SEQ ID NO: 92823 - DNA, 20 bp, Artificial Sequence
  Description of Artificial Sequence: Synthetic oligonucleotide
  Target: ATXN1; (-) strand; PAM type: NRG; PAM sequence: TGG
tgttcttctaacaataataa

SEQ ID NO: 92824 - DNA, 20 bp, Artificial Sequence
  Description of Artificial Sequence: Synthetic oligonucleotide
  Target: ATXN1; (-) strand; PAM type: NRG; PAM sequence: GAG
agaaaagcccacaatgcagg

SEQ ID NO: 92825 - DNA, 20 bp, Artificial Sequence
  Description of Artificial Sequence: Synthetic oligonucleotide
  Target: ATXN1; (-) strand; PAM type: NRG; PAM sequence: GGG
tcagaaaagcccacaatgca

SEQ ID NO: 92826 - DNA, 20 bp, Artificial Sequence
  Description of Artificial Sequence: Synthetic oligonucleotide
  Target: ATXN1; (-) strand; PAM type: NRG; PAM sequence: AGG
ctcagaaaagcccacaatgc

SEQ ID NO: 92827 - DNA, 20 bp, Artificial Sequence
  Description of Artificial Sequence: Synthetic oligonucleotide
  Target: ATXN1; (-) strand; PAM type: NRG; PAM sequence: CAG
actcagaaaagcccacaatg

SEQ ID NO: 92828 - DNA, 20 bp, Artificial Sequence
  Description of Artificial Sequence: Synthetic oligonucleotide
  Target: ATXN1; (-) strand; PAM type: NRG; PAM sequence: AAG
gggagtgtacacactcagaa

SEQ ID NO: 92829 - DNA, 20 bp, Artificial Sequence
  Description of Artificial Sequence: Synthetic oligonucleotide
  Target: ATXN1; (-) strand; PAM type: NRG; PAM sequence: CAG
aaggagggagtgtacacact

SEQ ID NO: 92830 - DNA, 20 bp, Artificial Sequence
  Description of Artificial Sequence: Synthetic oligonucleotide
  Target: ATXN1; (-) strand; PAM type: NRG; PAM sequence: GAG
cgatcagaaacacaaggagg

SEQ ID NO: 92831 - DNA, 20 bp, Artificial Sequence
  Description of Artificial Sequence: Synthetic oligonucleotide
  Target: ATXN1; (-) strand; PAM type: NRG; PAM sequence: GGG
tgcgatcagaaacacaagga

SEQ ID NO: 92832 - DNA, 20 bp, Artificial Sequence
  Description of Artificial Sequence: Synthetic oligonucleotide
  Target: ATXN1; (-) strand; PAM type: NRG; PAM sequence: AGG
ttgcgatcagaaacacaagg

SEQ ID NO: 92833 - DNA, 20 bp, Artificial Sequence
  Description of Artificial Sequence: Synthetic oligonucleotide
  Target: ATXN1; (-) strand; PAM type: NRG; PAM sequence: GAG
tttgcgatcagaaacacaag

SEQ ID NO: 92834 - DNA, 20 bp, Artificial Sequence
  Description of Artificial Sequence: Synthetic oligonucleotide
  Target: ATXN1; (-) strand; PAM type: NRG; PAM sequence: AGG
tatttgcgatcagaaacaca

SEQ ID NO: 92835 - DNA, 20 bp, Artificial Sequence
  Description of Artificial Sequence: Synthetic oligonucleotide
  Target: ATXN1; (-) strand; PAM type: NRG; PAM sequence: AAG
ttatttgcgatcagaaacac

SEQ ID NO: 92836 - DNA, 20 bp, Artificial Sequence
  Description of Artificial Sequence: Synthetic oligonucleotide
  Target: ATXN1; (-) strand; PAM type: NRG; PAM sequence: CAG
aataaatatttatttgcgat

SEQ ID NO: 92837 - DNA, 20 bp, Artificial Sequence
  Description of Artificial Sequence: Synthetic oligonucleotide
  Target: ATXN1; (-) strand; PAM type: NRG; PAM sequence: TAG
aagtggaacttgattgctga

SEQ ID NO: 92838 - DNA, 20 bp, Artificial Sequence
  Description of Artificial Sequence: Synthetic oligonucleotide
  Target: ATXN1; (-) strand; PAM type: NRG; PAM sequence: TGG
cggagtggctcttaaaaaag

SEQ ID NO: 92839 - DNA, 20 bp, Artificial Sequence
  Description of Artificial Sequence: Synthetic oligonucleotide
  Target: ATXN1; (-) strand; PAM type: NRG; PAM sequence: AAG
acacggagtggctcttaaaa

SEQ ID NO: 92840 - DNA, 20 bp, Artificial Sequence
  Description of Artificial Sequence: Synthetic oligonucleotide
  Target: ATXN1; (-) strand; PAM type: NRG; PAM sequence: TGG
tcttctagtgacacacggag

SEQ ID NO: 92841 - DNA, 20 bp, Artificial Sequence
  Description of Artificial Sequence: Synthetic oligonucleotide
  Target: ATXN1; (-) strand; PAM type: NRG; PAM sequence: GAG
gcatcttctagtgacacacg

SEQ ID NO: 92842 - DNA, 20 bp, Artificial Sequence
  Description of Artificial Sequence: Synthetic oligonucleotide
  Target: ATXN1; (-) strand; PAM type: NRG; PAM sequence: CGG
gggcatcttctagtgacaca

SEQ ID NO: 92843 - DNA, 20 bp, Artificial Sequence
  Description of Artificial Sequence: Synthetic oligonucleotide
  Target: ATXN1; (-) strand; PAM type: NRG; PAM sequence: TAG
ccattcatttgggcatcttc

SEQ ID NO: 92844 - DNA, 20 bp, Artificial Sequence
  Description of Artificial Sequence: Synthetic oligonucleotide
  Target: ATXN1; (-) strand; PAM type: NRG; PAM sequence: GGG
tttgtttcctccattcattt

SEQ ID NO: 92845 - DNA, 20 bp, Artificial Sequence
  Description of Artificial Sequence: Synthetic oligonucleotide
  Target: ATXN1; (-) strand; PAM type: NRG; PAM sequence: TGG
atttgtttcctccattcatt

SEQ ID NO: 92846 - DNA, 20 bp, Artificial Sequence
  Description of Artificial Sequence: Synthetic oligonucleotide
  Target: ATXN1; (-) strand; PAM type: NRG; PAM sequence: TAG
acacttttcttataaaccat

SEQ ID NO: 92847 - DNA, 20 bp, Artificial Sequence
  Description of Artificial Sequence: Synthetic oligonucleotide
  Target: ATXN1; (-) strand; PAM type: NRG; PAM sequence: CAG
tgaaagggttcctggatatt

SEQ ID NO: 92848 - DNA, 20 bp, Artificial Sequence
  Description of Artificial Sequence: Synthetic oligonucleotide
  Target: ATXN1; (-) strand; PAM type: NRG; PAM sequence: TGG
ggcttccctgaaagggttcc

SEQ ID NO: 92849 - DNA, 20 bp, Artificial Sequence
  Description of Artificial Sequence: Synthetic oligonucleotide
  Target: ATXN1; (-) strand; PAM type: NRG; PAM sequence: GGG
ttaatgaggcttccctgaaa

SEQ ID NO: 92850 - DNA, 20 bp, Artificial Sequence
  Description of Artificial Sequence: Synthetic oligonucleotide
  Target: ATXN1; (-) strand; PAM type: NRG; PAM sequence: AGG
attaatgaggcttccctgaa

SEQ ID NO: 92851 - DNA, 20 bp, Artificial Sequence
  Description of Artificial Sequence: Synthetic oligonucleotide
  Target: ATXN1; (-) strand; PAM type: NRG; PAM sequence: AAG
tattaatgaggcttccctga

SEQ ID NO: 92852 - DNA, 20 bp, Artificial Sequence
  Description of Artificial Sequence: Synthetic oligonucleotide
  Target: ATXN1; (-) strand; PAM type: NRG; PAM sequence: AGG
tatagcagttaatattaatg

SEQ ID NO: 92853 - DNA, 20 bp, Artificial Sequence
  Description of Artificial Sequence: Synthetic oligonucleotide
  Target: ATXN1; (-) strand; PAM type: NRG; PAM sequence: GAG
atatagcagttaatattaat

SEQ ID NO: 92854 - DNA, 20 bp, Artificial Sequence
  Description of Artificial Sequence: Synthetic oligonucleotide
  Target: ATXN1; (-) strand; PAM type: NRG; PAM sequence: CAG
tggtcttctcttatatatag

SEQ ID NO: 92855 - DNA, 20 bp, Artificial Sequence
  Description of Artificial Sequence: Synthetic oligonucleotide
  Target: ATXN1; (-) strand; PAM type: NRG; PAM sequence: TAG
ttttggtcttctcttatata

SEQ ID NO: 92856 - DNA, 20 bp, Artificial Sequence
  Description of Artificial Sequence: Synthetic oligonucleotide
  Target: ATXN1; (-) strand; PAM type: NRG; PAM sequence: TGG
tgtaccccgagacagaattt

SEQ ID NO: 92857 - DNA, 20 bp, Artificial Sequence
  Description of Artificial Sequence: Synthetic oligonucleotide
  Target: ATXN1; (-) strand; PAM type: NRG; PAM sequence: CAG
attttgtctgtaccccgaga

SEQ ID NO: 92858 - DNA, 20 bp, Artificial Sequence
  Description of Artificial Sequence: Synthetic oligonucleotide
  Target: ATXN1; (-) strand; PAM type: NRG; PAM sequence: GAG
ctggattttgtctgtacccc

SEQ ID NO: 92859 - DNA, 20 bp, Artificial Sequence
  Description of Artificial Sequence: Synthetic oligonucleotide
  Target: ATXN1; (-) strand; PAM type: NRG; PAM sequence: TGG
ttcatactttaaattactgc

SEQ ID NO: 92860 - DNA, 20 bp, Artificial Sequence
  Description of Artificial Sequence: Synthetic oligonucleotide
  Target: ATXN1; (-) strand; PAM type: NRG; PAM sequence: TAG
gtacacctacaggtgagtgg

SEQ ID NO: 92861 - DNA, 20 bp, Artificial Sequence
  Description of Artificial Sequence: Synthetic oligonucleotide
  Target: ATXN1; (-) strand; PAM type: NRG; PAM sequence: TGG
tgagtacacctacaggtgag

SEQ ID NO: 92862 - DNA, 20 bp, Artificial Sequence
  Description of Artificial Sequence: Synthetic oligonucleotide
  Target: ATXN1; (-) strand; PAM type: NRG; PAM sequence: GAG
ctctgagtacacctacaggt

SEQ ID NO: 92863 - DNA, 20 bp, Artificial Sequence
  Description of Artificial Sequence: Synthetic oligonucleotide
  Target: ATXN1; (-) strand; PAM type: NRG; PAM sequence: AGG
tgaactctgagtacacctac

SEQ ID NO: 92864 - DNA, 20 bp, Artificial Sequence
  Description of Artificial Sequence: Synthetic oligonucleotide
  Target: ATXN1; (-) strand; PAM type: NRG; PAM sequence: CAG
gtgaactctgagtacaccta

SEQ ID NO: 92865 - DNA, 20 bp, Artificial Sequence
  Description of Artificial Sequence: Synthetic oligonucleotide
  Target: ATXN1; (-) strand; PAM type: NRG; PAM sequence: GAG
taatgtattttgtgaactct

SEQ ID NO: 92866 - DNA, 20 bp, Artificial Sequence
  Description of Artificial Sequence: Synthetic oligonucleotide
  Target: ATXN1; (-) strand; PAM type: NRG; PAM sequence: AGG
ctttgtcaatgtaagatatt

SEQ ID NO: 92867 - DNA, 20 bp, Artificial Sequence
  Description of Artificial Sequence: Synthetic oligonucleotide
  Target: ATXN1; (-) strand; PAM type: NRG; PAM sequence: TAG
tctttgtcaatgtaagatat

SEQ ID NO: 92868 - DNA, 20 bp, Artificial Sequence
  Description of Artificial Sequence: Synthetic oligonucleotide
  Target: ATXN1; (-) strand; PAM type: NRG; PAM sequence: AAG
tgattattctttgtcaatgt

SEQ ID NO: 92869 - DNA, 20 bp, Artificial Sequence
  Description of Artificial Sequence: Synthetic oligonucleotide
  Target: ATXN1; (-) strand; PAM type: NRG; PAM sequence: TGG
accttttaaaaagagttaag

SEQ ID NO: 92870 - DNA, 20 bp, Artificial Sequence
  Description of Artificial Sequence: Synthetic oligonucleotide
  Target: ATXN1; (-) strand; PAM type: NRG; PAM sequence: AAG
gcaaccttttaaaaagagtt

SEQ ID NO: 92871 - DNA, 20 bp, Artificial Sequence
  Description of Artificial Sequence: Synthetic oligonucleotide
  Target: ATXN1; (-) strand; PAM type: NRG; PAM sequence: GAG
tcactgcaaccttttaaaaa

SEQ ID NO: 92872 - DNA, 20 bp, Artificial Sequence
  Description of Artificial Sequence: Synthetic oligonucleotide
  Target: ATXN1; (-) strand; PAM type: NRG; PAM sequence: AAG
gctcactgcaaccttttaaa

SEQ ID NO: 92873 - DNA, 20 bp, Artificial Sequence
  Description of Artificial Sequence: Synthetic oligonucleotide
  Target: ATXN1; (-) strand; PAM type: NRG; PAM sequence: CAG
ggagtgcaatggcacgatct

SEQ ID NO: 92874 - DNA, 20 bp, Artificial Sequence
  Description of Artificial Sequence: Synthetic oligonucleotide
  Target: ATXN1; (-) strand; PAM type: NRG; PAM sequence: TGG
ttgcctgggctggagtgcaa

SEQ ID NO: 92875 - DNA, 20 bp, Artificial Sequence
  Description of Artificial Sequence: Synthetic oligonucleotide
  Target: ATXN1; (-) strand; PAM type: NRG; PAM sequence: GAG
tcgcactgttgcctgggctg

SEQ ID NO: 92876 - DNA, 20 bp, Artificial Sequence
  Description of Artificial Sequence: Synthetic oligonucleotide
  Target: ATXN1; (-) strand; PAM type: NRG; PAM sequence: TGG
tctcgcactgttgcctgggc

SEQ ID NO: 92877 - DNA, 20 bp, Artificial Sequence
  Description of Artificial Sequence: Synthetic oligonucleotide
  Target: ATXN1; (-) strand; PAM type: NRG; PAM sequence: GGG
ggagtctcgcactgttgcct

SEQ ID NO: 92878 - DNA, 20 bp, Artificial Sequence
  Description of Artificial Sequence: Synthetic oligonucleotide
  Target: ATXN1; (-) strand; PAM type: NRG; PAM sequence: TGG
tggagtctcgcactgttgcc

SEQ ID NO: 92879 - DNA, 20 bp, Artificial Sequence
  Description of Artificial Sequence: Synthetic oligonucleotide
  Target: ATXN1; (-) strand; PAM type: NRG; PAM sequence: GAG
tttttttcttttttgagatg

SEQ ID NO: 92880 - DNA, 20 bp, Artificial Sequence
  Description of Artificial Sequence: Synthetic oligonucleotide
  Target: ATXN1; (-) strand; PAM type: NRG; PAM sequence: TGG
tttttttttcttttttgaga

SEQ ID NO: 92881 - DNA, 20 bp, Artificial Sequence
  Description of Artificial Sequence: Synthetic oligonucleotide
  Target: ATXN1; (-) strand; PAM type: NRG; PAM sequence: GAG
acagtttttttttctttttt

SEQ ID NO: 92882 - DNA, 20 bp, Artificial Sequence
  Description of Artificial Sequence: Synthetic oligonucleotide
  Target: ATXN1; (-) strand; PAM type: NRG; PAM sequence: CAG
tttttgtattatttgaggga

SEQ ID NO: 92883 - DNA, 20 bp, Artificial Sequence
  Description of Artificial Sequence: Synthetic oligonucleotide
  Target: ATXN1; (-) strand; PAM type: NRG; PAM sequence: GGG
gctttttttgtattatttga

SEQ ID NO: 92884 - DNA, 20 bp, Artificial Sequence
  Description of Artificial Sequence: Synthetic oligonucleotide
  Target: ATXN1; (-) strand; PAM type: NRG; PAM sequence: AGG
tgctttttttgtattatttg

SEQ ID NO: 92885 - DNA, 20 bp, Artificial Sequence
  Description of Artificial Sequence: Synthetic oligonucleotide
  Target: ATXN1; (-) strand; PAM type: NRG; PAM sequence: GAG
atgctttttttgtattattt

SEQ ID NO: 92886 - DNA, 20 bp, Artificial Sequence
  Description of Artificial Sequence: Synthetic oligonucleotide
  Target: ATXN1; (-) strand; PAM type: NRG; PAM sequence: CAG
ttgtggcccatggtttcaaa

SEQ ID NO: 92887 - DNA, 20 bp, Artificial Sequence
  Description of Artificial Sequence: Synthetic oligonucleotide
  Target: ATXN1; (-) strand; PAM type: NRG; PAM sequence: TGG
gcggaataagttgtggccca

SEQ ID NO: 92888 - DNA, 20 bp, Artificial Sequence
  Description of Artificial Sequence: Synthetic oligonucleotide
  Target: ATXN1; (-) strand; PAM type: NRG; PAM sequence: TGG
aaataatgcggaataagttg

SEQ ID NO: 92889 - DNA, 20 bp, Artificial Sequence
  Description of Artificial Sequence: Synthetic oligonucleotide
  Target: ATXN1; (-) strand; PAM type: NRG; PAM sequence: AAG
agggaaaaataatgcggaat

SEQ ID NO: 92890 - DNA, 20 bp, Artificial Sequence
  Description of Artificial Sequence: Synthetic oligonucleotide
  Target: ATXN1; (-) strand; PAM type: NRG; PAM sequence: CGG
gctagcagggaaaaataatg

SEQ ID NO: 92891 - DNA, 20 bp, Artificial Sequence
  Description of Artificial Sequence: Synthetic oligonucleotide
  Target: ATXN1; (-) strand; PAM type: NRG; PAM sequence: GGG
tgcagagtactatgctagca

SEQ ID NO: 92892 - DNA, 20 bp, Artificial Sequence
  Description of Artificial Sequence: Synthetic oligonucleotide
  Target: ATXN1; (-) strand; PAM type: NRG; PAM sequence: AGG
atgcagagtactatgctagc

SEQ ID NO: 92893 - DNA, 20 bp, Artificial Sequence
  Description of Artificial Sequence: Synthetic oligonucleotide
  Target: ATXN1; (-) strand; PAM type: NRG; PAM sequence: CAG
tatgcagagtactatgctag

SEQ ID NO: 92894 - DNA, 20 bp, Artificial Sequence
  Description of Artificial Sequence: Synthetic oligonucleotide
  Target: ATXN1; (-) strand; PAM type: NRG; PAM sequence: TAG
ctatatgcagagtactatgc

SEQ ID NO: 92895 - DNA, 20 bp, Artificial Sequence
  Description of Artificial Sequence: Synthetic oligonucleotide
  Target: ATXN1; (-) strand; PAM type: NRG; PAM sequence: GAG
ttctcagcctactatatgca

SEQ ID NO: 92896 - DNA, 20 bp, Artificial Sequence
  Description of Artificial Sequence: Synthetic oligonucleotide
  Target: ATXN1; (-) strand; PAM type: NRG; PAM sequence: CAG
ttttctcagcctactatatg

SEQ ID NO: 92897 - DNA, 20 bp, Artificial Sequence
  Description of Artificial Sequence: Synthetic oligonucleotide
  Target: ATXN1; (-) strand; PAM type: NRG; PAM sequence: CAG
aatttaattctattttttct

SEQ ID NO: 92898 - DNA, 20 bp, Artificial Sequence
  Description of Artificial Sequence: Synthetic oligonucleotide
  Target: ATXN1; (-) strand; PAM type: NRG; PAM sequence: GGG
tcatgaaatttaaatcagaa

SEQ ID NO: 92899 - DNA, 20 bp, Artificial Sequence
  Description of Artificial Sequence: Synthetic oligonucleotide
  Target: ATXN1; (-) strand; PAM type: NRG; PAM sequence: AGG
ttcatgaaatttaaatcaga

SEQ ID NO: 92900 - DNA, 20 bp, Artificial Sequence
  Description of Artificial Sequence: Synthetic oligonucleotide
  Target: ATXN1; (-) strand; PAM type: NRG; PAM sequence: AAG
attcatgaaatttaaatcag

SEQ ID NO: 92901 - DNA, 20 bp, Artificial Sequence
  Description of Artificial Sequence: Synthetic oligonucleotide
  Target: ATXN1; (-) strand; PAM type: NRG; PAM sequence: CAG
gtaattcatgaaatttaaat

SEQ ID NO: 92902 - DNA, 20 bp, Artificial Sequence
  Description of Artificial Sequence: Synthetic oligonucleotide
  Target: ATXN1; (-) strand; PAM type: NRG; PAM sequence: CAG
taacagtttgagtatttagg

SEQ ID NO: 92903 - DNA, 20 bp, Artificial Sequence
  Description of Artificial Sequence: Synthetic oligonucleotide
  Target: ATXN1; (-) strand; PAM type: NRG; PAM sequence: AGG
caataacagtttgagtattt

SEQ ID NO: 92904 - DNA, 20 bp, Artificial Sequence
  Description of Artificial Sequence: Synthetic oligonucleotide
  Target: ATXN1; (-) strand; PAM type: NRG; PAM sequence: TAG
tcaataacagtttgagtatt

SEQ ID NO: 92905 - DNA, 20 bp, Artificial Sequence
  Description of Artificial Sequence: Synthetic oligonucleotide
  Target: ATXN1; (-) strand; PAM type: NRG; PAM sequence: GAG
gctataatcaataacagttt

SEQ ID NO: 92906 - DNA, 20 bp, Artificial Sequence
  Description of Artificial Sequence: Synthetic oligonucleotide
  Target: ATXN1; (-) strand; PAM type: NRG; PAM sequence: CAG
atatcagctataatcaataa

SEQ ID NO: 92907 - DNA, 20 bp, Artificial Sequence
  Description of Artificial Sequence: Synthetic oligonucleotide
  Target: ATXN1; (-) strand; PAM type: NRG; PAM sequence: CAG
tggagtttagccatgaatat

SEQ ID NO: 92908 - DNA, 20 bp, Artificial Sequence
  Description of Artificial Sequence: Synthetic oligonucleotide
  Target: ATXN1; (-) strand; PAM type: NRG; PAM sequence: TAG
tatcagtgaattctggagtt

SEQ ID NO: 92909 - DNA, 20 bp, Artificial Sequence
  Description of Artificial Sequence: Synthetic oligonucleotide
  Target: ATXN1; (-) strand; PAM type: NRG; PAM sequence: GAG
taatgtatcagtgaattctg

SEQ ID NO: 92910 - DNA, 20 bp, Artificial Sequence
  Description of Artificial Sequence: Synthetic oligonucleotide
  Target: ATXN1; (-) strand; PAM type: NRG; PAM sequence: TGG
attaatgtatcagtgaattc

SEQ ID NO: 92911 - DNA, 20 bp, Artificial Sequence
  Description of Artificial Sequence: Synthetic oligonucleotide
  Target: ATXN1; (-) strand; PAM type: NRG; PAM sequence: CAG
acatttcattattaatgtat

SEQ ID NO: 92912 - DNA, 20 bp, Artificial Sequence
  Description of Artificial Sequence: Synthetic oligonucleotide
  Target: ATXN1; (-) strand; PAM type: NRG; PAM sequence: AGG
ttaagtgaaattaaggagag

SEQ ID NO: 92913 - DNA, 20 bp, Artificial Sequence
  Description of Artificial Sequence: Synthetic oligonucleotide
  Target: ATXN1; (-) strand; PAM type: NRG; PAM sequence: GAG
attaagtgaaattaaggaga

SEQ ID NO: 92914 - DNA, 20 bp, Artificial Sequence
  Description of Artificial Sequence: Synthetic oligonucleotide
  Target: ATXN1; (-) strand; PAM type: NRG; PAM sequence: GAG
acattaagtgaaattaagga

SEQ ID NO: 92915 - DNA, 20 bp, Artificial Sequence
  Description of Artificial Sequence: Synthetic oligonucleotide
  Target: ATXN1; (-) strand; PAM type: NRG; PAM sequence: GAG
tcacattaagtgaaattaag

SEQ ID NO: 92916 - DNA, 20 bp, Artificial Sequence
  Description of Artificial Sequence: Synthetic oligonucleotide
  Target: ATXN1; (-) strand; PAM type: NRG; PAM sequence: AGG
gctcacattaagtgaaatta

SEQ ID NO: 92917 - DNA, 20 bp, Artificial Sequence
  Description of Artificial Sequence: Synthetic oligonucleotide
  Target: ATXN1; (-) strand; PAM type: NRG; PAM sequence: AAG
tgctcacattaagtgaaatt

SEQ ID NO: 92918 - DNA, 20 bp, Artificial Sequence
  Description of Artificial Sequence: Synthetic oligonucleotide
  Target: ATXN1; (-) strand; PAM type: NRG; PAM sequence: AAG
agattgaacatgctcacatt

SEQ ID NO: 92919 - DNA, 20 bp, Artificial Sequence
  Description of Artificial Sequence: Synthetic oligonucleotide
  Target: ATXN1; (-) strand; PAM type: NRG; PAM sequence: TAG
aaacactgaaatcaaagctg

SEQ ID NO: 92920 - DNA, 20 bp, Artificial Sequence
  Description of Artificial Sequence: Synthetic oligonucleotide
  Target: ATXN1; (-) strand; PAM type: NRG; PAM sequence: AAG
aaaattaaacactgaaatca

SEQ ID NO: 92921 - DNA, 20 bp, Artificial Sequence
  Description of Artificial Sequence: Synthetic oligonucleotide
  Target: ATXN1; (-) strand; PAM type: NRG; PAM sequence: AGG
tttctaaaaacttaccaggt

SEQ ID NO: 92922 - DNA, 20 bp, Artificial Sequence
  Description of Artificial Sequence: Synthetic oligonucleotide
  Target: ATXN1; (-) strand; PAM type: NRG; PAM sequence: TAG
gtttctaaaaacttaccagg

SEQ ID NO: 92923 - DNA, 20 bp, Artificial Sequence
  Description of Artificial Sequence: Synthetic oligonucleotide
  Target: ATXN1; (-) strand; PAM type: NRG; PAM sequence: AGG
tatgtttctaaaaacttacc

SEQ ID NO: 92924 - DNA, 20 bp, Artificial Sequence
  Description of Artificial Sequence: Synthetic oligonucleotide
  Target: ATXN1; (-) strand; PAM type: NRG; PAM sequence: CAG
ttatgtttctaaaaacttac

SEQ ID NO: 92925 - DNA, 20 bp, Artificial Sequence
  Description of Artificial Sequence: Synthetic oligonucleotide
  Target: ATXN1; (-) strand; PAM type: NRG; PAM sequence: CAG
tatatatttcccaaagttgt

SEQ ID NO: 92926 - DNA, 20 bp, Artificial Sequence
  Description of Artificial Sequence: Synthetic oligonucleotide
  Target: ATXN1; (-) strand; PAM type: NRG; PAM sequence: AAG
cagaacgtatatatttccca

SEQ ID NO: 92927 - DNA, 20 bp, Artificial Sequence
  Description of Artificial Sequence: Synthetic oligonucleotide
  Target: ATXN1; (-) strand; PAM type: NRG; PAM sequence: CAG
atgccttaatttcgttcttt

SEQ ID NO: 92928 - DNA, 20 bp, Artificial Sequence
  Description of Artificial Sequence: Synthetic oligonucleotide
  Target: ATXN1; (-) strand; PAM type: NRG; PAM sequence: AAG
actgttaaagaaagaacaca

SEQ ID NO: 92929 - DNA, 20 bp, Artificial Sequence
  Description of Artificial Sequence: Synthetic oligonucleotide
  Target: ATXN1; (-) strand; PAM type: NRG; PAM sequence: AAG
agattaggaactgttaaaga

SEQ ID NO: 92930 - DNA, 20 bp, Artificial Sequence
  Description of Artificial Sequence: Synthetic oligonucleotide
  Target: ATXN1; (-) strand; PAM type: NRG; PAM sequence: AAG
agggagattaggaactgtta

SEQ ID NO: 92931 - DNA, 20 bp, Artificial Sequence
  Description of Artificial Sequence: Synthetic oligonucleotide
  Target: ATXN1; (-) strand; PAM type: NRG; PAM sequence: AGG
aaatacactgaagggagatt

SEQ ID NO: 92932 - DNA, 20 bp, Artificial Sequence
  Description of Artificial Sequence: Synthetic oligonucleotide
  Target: ATXN1; (-) strand; PAM type: NRG; PAM sequence: TAG
taaatacactgaagggagat

SEQ ID NO: 92933 - DNA, 20 bp, Artificial Sequence
  Description of Artificial Sequence: Synthetic oligonucleotide
  Target: ATXN1; (-) strand; PAM type: NRG; PAM sequence: GAG
cccaataaatacactgaagg

SEQ ID NO: 92934 - DNA, 20 bp, Artificial Sequence
  Description of Artificial Sequence: Synthetic oligonucleotide
  Target: ATXN1; (-) strand; PAM type: NRG; PAM sequence: GGG
tgcccaataaatacactgaa

SEQ ID NO: 92935 - DNA, 20 bp, Artificial Sequence
  Description of Artificial Sequence: Synthetic oligonucleotide
  Target: ATXN1; (-) strand; PAM type: NRG; PAM sequence: AGG
atgcccaataaatacactga

SEQ ID NO: 92936 - DNA, 20 bp, Artificial Sequence
  Description of Artificial Sequence: Synthetic oligonucleotide
  Target: ATXN1; (-) strand; PAM type: NRG; PAM sequence: AAG
aatgcccaataaatacactg

SEQ ID NO: 92937 - DNA, 20 bp, Artificial Sequence
  Description of Artificial Sequence: Synthetic oligonucleotide
  Target: ATXN1; (-) strand; PAM type: NRG; PAM sequence: TAG
tactaggagaactgttgtgt

SEQ ID NO: 92938 - DNA, 20 bp, Artificial Sequence
  Description of Artificial Sequence: Synthetic oligonucleotide
  Target: ATXN1; (-) strand; PAM type: NRG; PAM sequence: GAG
ggttgatttcattctactag

SEQ ID NO: 92939 - DNA, 20 bp, Artificial Sequence
  Description of Artificial Sequence: Synthetic oligonucleotide
  Target: ATXN1; (-) strand; PAM type: NRG; PAM sequence: AGG
aaggttgatttcattctact

SEQ ID NO: 92940 - DNA, 20 bp, Artificial Sequence
  Description of Artificial Sequence: Synthetic oligonucleotide
  Target: ATXN1; (-) strand; PAM type: NRG; PAM sequence: TAG
taaggttgatttcattctac

SEQ ID NO: 92941 - DNA, 20 bp, Artificial Sequence
  Description of Artificial Sequence: Synthetic oligonucleotide
  Target: ATXN1; (-) strand; PAM type: NRG; PAM sequence: AGG
ctgaaaagctctttatttta

SEQ ID NO: 92942 - DNA, 20 bp, Artificial Sequence
  Description of Artificial Sequence: Synthetic oligonucleotide
  Target: ATXN1; (-) strand; PAM type: NRG; PAM sequence: AAG
cctgaaaagctctttatttt

SEQ ID NO: 92943 - DNA, 20 bp, Artificial Sequence
  Description of Artificial Sequence: Synthetic oligonucleotide
  Target: ATXN1; (-) strand; PAM type: NRG; PAM sequence: AAG
agcctctttttactcctgaa

SEQ ID NO: 92944 - DNA, 20 bp, Artificial Sequence
  Description of Artificial Sequence: Synthetic oligonucleotide
  Target: ATXN1; (-) strand; PAM type: NRG; PAM sequence: CAG
ctagcatttttcttttgtaa

SEQ ID NO: 92945 - DNA, 20 bp, Artificial Sequence
  Description of Artificial Sequence: Synthetic oligonucleotide
  Target: ATXN1; (-) strand; PAM type: NRG; PAM sequence: TAG
atataaagataattcccctc

SEQ ID NO: 92946 - DNA, 20 bp, Artificial Sequence
  Description of Artificial Sequence: Synthetic oligonucleotide
  Target: ATXN1; (-) strand; PAM type: NRG; PAM sequence: AAG
gtaaattactatgtgatata

SEQ ID NO: 92947 - DNA, 20 bp, Artificial Sequence
  Description of Artificial Sequence: Synthetic oligonucleotide
  Target: ATXN1; (-) strand; PAM type: NRG; PAM sequence: AAG
tgatacaactttaagtttct

SEQ ID NO: 92948 - DNA, 20 bp, Artificial Sequence
  Description of Artificial Sequence: Synthetic oligonucleotide
  Target: ATXN1; (-) strand; PAM type: NRG; PAM sequence: AAG
tacagctatgatacaacttt

SEQ ID NO: 92949 - DNA, 20 bp, Artificial Sequence
  Description of Artificial Sequence: Synthetic oligonucleotide
  Target: ATXN1; (-) strand; PAM type: NRG; PAM sequence: CAG
ttcagttttggctaattgta

SEQ ID NO: 92950 - DNA, 20 bp, Artificial Sequence
  Description of Artificial Sequence: Synthetic oligonucleotide
  Target: ATXN1; (-) strand; PAM type: NRG; PAM sequence: TGG
tcataaaatatattcagttt

SEQ ID NO: 92951 - DNA, 20 bp, Artificial Sequence
  Description of Artificial Sequence: Synthetic oligonucleotide
  Target: ATXN1; (-) strand; PAM type: NRG; PAM sequence: CAG
agtatctcataaaatatatt

SEQ ID NO: 92952 - DNA, 20 bp, Artificial Sequence
  Description of Artificial Sequence: Synthetic oligonucleotide
  Target: ATXN1; (-) strand; PAM type: NRG; PAM sequence: CAG
cctttgttcttgtgagtaat

SEQ ID NO: 92953 - DNA, 20 bp, Artificial Sequence
  Description of Artificial Sequence: Synthetic oligonucleotide
  Target: ATXN1; (-) strand; PAM type: NRG; PAM sequence: GAG
ggatttccctttgttcttgt

SEQ ID NO: 92954 - DNA, 20 bp, Artificial Sequence
  Description of Artificial Sequence: Synthetic oligonucleotide
  Target: ATXN1; (-) strand; PAM type: NRG; PAM sequence: TGG
caggaatttaatccttcaat

SEQ ID NO: 92955 - DNA, 20 bp, Artificial Sequence
  Description of Artificial Sequence: Synthetic oligonucleotide
  Target: ATXN1; (-) strand; PAM type: NRG; PAM sequence: AGG
catgagtgactggttttgac

SEQ ID NO: 92956 - DNA, 20 bp, Artificial Sequence
  Description of Artificial Sequence: Synthetic oligonucleotide
  Target: ATXN1; (-) strand; PAM type: NRG; PAM sequence: CAG
acatgagtgactggttttga

SEQ ID NO: 92957 - DNA, 20 bp, Artificial Sequence
  Description of Artificial Sequence: Synthetic oligonucleotide
  Target: ATXN1; (-) strand; PAM type: NRG; PAM sequence: TGG
cgtgcagacacatgagtgac

SEQ ID NO: 92958 - DNA, 20 bp, Artificial Sequence
  Description of Artificial Sequence: Synthetic oligonucleotide
  Target: ATXN1; (-) strand; PAM type: NRG; PAM sequence: GAG
cgatatacgtgcagacacat

SEQ ID NO: 92959 - DNA, 20 bp, Artificial Sequence
  Description of Artificial Sequence: Synthetic oligonucleotide
  Target: ATXN1; (-) strand; PAM type: NRG; PAM sequence: CAG
aacactttgcgatatacgtg

SEQ ID NO: 92960 - DNA, 20 bp, Artificial Sequence
  Description of Artificial Sequence: Synthetic oligonucleotide
  Target: ATXN1; (-) strand; PAM type: NRG; PAM sequence: TGG
ctggaaaggggatttatacc

SEQ ID NO: 92961 - DNA, 20 bp, Artificial Sequence
  Description of Artificial Sequence: Synthetic oligonucleotide
  Target: ATXN1; (-) strand; PAM type: NRG; PAM sequence: GGG
aatttctgctctctggaaag

SEQ ID NO: 92962 - DNA, 20 bp, Artificial Sequence
  Description of Artificial Sequence: Synthetic oligonucleotide
  Target: ATXN1; (-) strand; PAM type: NRG; PAM sequence: GGG
gaatttctgctctctggaaa

SEQ ID NO: 92963 - DNA, 20 bp, Artificial Sequence
  Description of Artificial Sequence: Synthetic oligonucleotide
  Target: ATXN1; (-) strand; PAM type: NRG; PAM sequence: AGG
ggaatttctgctctctggaa

SEQ ID NO: 92964 - DNA, 20 bp, Artificial Sequence
  Description of Artificial Sequence: Synthetic oligonucleotide
  Target: ATXN1; (-) strand; PAM type: NRG; PAM sequence: AAG
aggaatttctgctctctgga

SEQ ID NO: 92965 - DNA, 20 bp, Artificial Sequence
  Description of Artificial Sequence: Synthetic oligonucleotide
  Target: ATXN1; (-) strand; PAM type: NRG; PAM sequence: TGG
gattaggaatttctgctctc

SEQ ID NO: 92966 - DNA, 20 bp, Artificial Sequence
  Description of Artificial Sequence: Synthetic oligonucleotide
  Target: ATXN1; (-) strand; PAM type: NRG; PAM sequence: AGG
agtttgaagtgtggcagatt

SEQ ID NO: 92967 - DNA, 20 bp, Artificial Sequence
  Description of Artificial Sequence: Synthetic oligonucleotide
  Target: ATXN1; (-) strand; PAM type: NRG; PAM sequence: TAG
cagtttgaagtgtggcagat

SEQ ID NO: 92968 - DNA, 20 bp, Artificial Sequence
  Description of Artificial Sequence: Synthetic oligonucleotide
  Target: ATXN1; (-) strand; PAM type: NRG; PAM sequence: CAG
tatttcagtttgaagtgtgg

SEQ ID NO: 92969 - DNA, 20 bp, Artificial Sequence
  Description of Artificial Sequence: Synthetic oligonucleotide
  Target: ATXN1; (-) strand; PAM type: NRG; PAM sequence: TGG
atctatttcagtttgaagtg

SEQ ID NO: 92970 - DNA, 20 bp, Artificial Sequence
  Description of Artificial Sequence: Synthetic oligonucleotide
  Target: ATXN1; (-) strand; PAM type: NRG; PAM sequence: AAG
gatgaatctatttcagtttg

SEQ ID NO: 92971 - DNA, 20 bp, Artificial Sequence
  Description of Artificial Sequence: Synthetic oligonucleotide
  Target: ATXN1; (-) strand; PAM type: NRG; PAM sequence: CAG
aaatgctgatgaatctattt

SEQ ID NO: 92972 - DNA, 20 bp, Artificial Sequence
  Description of Artificial Sequence: Synthetic oligonucleotide
  Target: ATXN1; (-) strand; PAM type: NRG; PAM sequence: GAG
cctttgctaatggctttggg

SEQ ID NO: 92973 - DNA, 20 bp, Artificial Sequence
  Description of Artificial Sequence: Synthetic oligonucleotide
  Target: ATXN1; (-) strand; PAM type: NRG; PAM sequence: GGG
aacctttgctaatggctttg

SEQ ID NO: 92974 - DNA, 20 bp, Artificial Sequence
  Description of Artificial Sequence: Synthetic oligonucleotide
  Target: ATXN1; (-) strand; PAM type: NRG; PAM sequence: GGG
taacctttgctaatggcttt

SEQ ID NO: 92975 - DNA, 20 bp, Artificial Sequence
  Description of Artificial Sequence: Synthetic oligonucleotide
  Target: ATXN1; (-) strand; PAM type: NRG; PAM sequence: TGG
ataacctttgctaatggctt

SEQ ID NO: 92976 - DNA, 20 bp, Artificial Sequence
  Description of Artificial Sequence: Synthetic oligonucleotide
  Target: ATXN1; (-) strand; PAM type: NRG; PAM sequence: TGG
ttacaaataacctttgctaa

SEQ ID NO: 92977 - DNA, 20 bp, Artificial Sequence
  Description of Artificial Sequence: Synthetic oligonucleotide
  Target: ATXN1; (-) strand; PAM type: NRG; PAM sequence: CAG
ttttgccttgttatgtgctg

SEQ ID NO: 92978 - DNA, 20 bp, Artificial Sequence
  Description of Artificial Sequence: Synthetic oligonucleotide
  Target: ATXN1; (-) strand; PAM type: NRG; PAM sequence: AAG
ttgcttttctctctgactga

SEQ ID NO: 92979 - DNA, 20 bp, Artificial Sequence
  Description of Artificial Sequence: Synthetic oligonucleotide
  Target: ATXN1; (-) strand; PAM type: NRG; PAM sequence: GAG
atttaccagtctctgtgaag

SEQ ID NO: 92980 - DNA, 20 bp, Artificial Sequence
  Description of Artificial Sequence: Synthetic oligonucleotide
  Target: ATXN1; (-) strand; PAM type: NRG; PAM sequence: AGG
ttatttaccagtctctgtga

SEQ ID NO: 92981 - DNA, 20 bp, Artificial Sequence
  Description of Artificial Sequence: Synthetic oligonucleotide
  Target: ATXN1; (-) strand; PAM type: NRG; PAM sequence: AAG
tttatttaccagtctctgtg

SEQ ID NO: 92982 - DNA, 20 bp, Artificial Sequence
  Description of Artificial Sequence: Synthetic oligonucleotide
  Target: ATXN1; (-) strand; PAM type: NRG; PAM sequence: CAG
tgcatacattctttatttac

SEQ ID NO: 92983 - DNA, 20 bp, Artificial Sequence
  Description of Artificial Sequence: Synthetic oligonucleotide
  Target: ATXN1; (-) strand; PAM type: NRG; PAM sequence: AGG
ggaaacaggaaagcaaatcc

SEQ ID NO: 92984 - DNA, 20 bp, Artificial Sequence
  Description of Artificial Sequence: Synthetic oligonucleotide
  Target: ATXN1; (-) strand; PAM type: NRG; PAM sequence: CAG
aggaaacaggaaagcaaatc

SEQ ID NO: 92985 - DNA, 20 bp, Artificial Sequence
  Description of Artificial Sequence: Synthetic oligonucleotide
  Target: ATXN1; (-) strand; PAM type: NRG; PAM sequence: AAG
ttactggcaaggaaacagga

SEQ ID NO: 92986 - DNA, 20 bp, Artificial Sequence
  Description of Artificial Sequence: Synthetic oligonucleotide
  Target: ATXN1; (-) strand; PAM type: NRG; PAM sequence: AGG
aaagttactggcaaggaaac

SEQ ID NO: 92987 - DNA, 20 bp, Artificial Sequence
  Description of Artificial Sequence: Synthetic oligonucleotide
  Target: ATXN1; (-) strand; PAM type: NRG; PAM sequence: CAG
aaaagttactggcaaggaaa

SEQ ID NO: 92988 - DNA, 20 bp, Artificial Sequence
  Description of Artificial Sequence: Synthetic oligonucleotide
  Target: ATXN1; (-) strand; PAM type: NRG; PAM sequence: AGG
tataaaaaaagttactggca

SEQ ID NO: 92989 - DNA, 20 bp, Artificial Sequence
  Description of Artificial Sequence: Synthetic oligonucleotide
  Target: ATXN1; (-) strand; PAM type: NRG; PAM sequence: AAG
atataaaaaaagttactggc

SEQ ID NO: 92990 - DNA, 20 bp, Artificial Sequence
  Description of Artificial Sequence: Synthetic oligonucleotide
  Target: ATXN1; (-) strand; PAM type: NRG; PAM sequence: TGG
aatcatataaaaaaagttac

SEQ ID NO: 92991 - DNA, 20 bp, Artificial Sequence
  Description of Artificial Sequence: Synthetic oligonucleotide
  Target: ATXN1; (-) strand; PAM type: NRG; PAM sequence: AAG
gttagataatcatataaaaa

SEQ ID NO: 92992 - DNA, 20 bp, Artificial Sequence
  Description of Artificial Sequence: Synthetic oligonucleotide
  Target: ATXN1; (-) strand; PAM type: NRG; PAM sequence: TAG
ttgaaggtttgtttgactgt

SEQ ID NO: 92993 - DNA, 20 bp, Artificial Sequence
  Description of Artificial Sequence: Synthetic oligonucleotide
  Target: ATXN1; (-) strand; PAM type: NRG; PAM sequence: AGG
tgcgtaattcattgctttga

SEQ ID NO: 92994 - DNA, 20 bp, Artificial Sequence
  Description of Artificial Sequence: Synthetic oligonucleotide
  Target: ATXN1; (-) strand; PAM type: NRG; PAM sequence: AAG
atgcgtaattcattgctttg

SEQ ID NO: 92995 - DNA, 20 bp, Artificial Sequence
  Description of Artificial Sequence: Synthetic oligonucleotide
  Target: ATXN1; (-) strand; PAM type: NRG; PAM sequence: GAG
ctttgctctcttttgtgtga

SEQ ID NO: 92996 - DNA, 20 bp, Artificial Sequence
  Description of Artificial Sequence: Synthetic oligonucleotide
  Target: ATXN1; (-) strand; PAM type: NRG; PAM sequence: GAG
agctttgctctcttttgtgt

SEQ ID NO: 92997 - DNA, 20 bp, Artificial Sequence
  Description of Artificial Sequence: Synthetic oligonucleotide
  Target: ATXN1; (-) strand; PAM type: NRG; PAM sequence: CAG
tcacgatatttaaatagcat

SEQ ID NO: 92998 - DNA, 20 bp, Artificial Sequence
  Description of Artificial Sequence: Synthetic oligonucleotide
  Target: ATXN1; (-) strand; PAM type: NRG; PAM sequence: TAG
aatatttcacgatatttaaa

SEQ ID NO: 92999 - DNA, 20 bp, Artificial Sequence
  Description of Artificial Sequence: Synthetic oligonucleotide
  Target: ATXN1; (-) strand; PAM type: NRG; PAM sequence: AGG
acttccatctgtgcatggtt

SEQ ID NO: 93000 - DNA, 20 bp, Artificial Sequence
  Description of Artificial Sequence: Synthetic oligonucleotide
  Target: ATXN1; (-) strand; PAM type: NRG; PAM sequence: TAG
tacttccatctgtgcatggt

SEQ ID NO: 93001 - DNA, 20 bp, Artificial Sequence
  Description of Artificial Sequence: Synthetic oligonucleotide
  Target: ATXN1; (-) strand; PAM type: NRG; PAM sequence: TGG
tctgtacttccatctgtgca

SEQ ID NO: 93002 - DNA, 20 bp, Artificial Sequence
  Description of Artificial Sequence: Synthetic oligonucleotide
  Target: ATXN1; (-) strand; PAM type: NRG; PAM sequence: CAG
tttctgaaccaggcggttgg

SEQ ID NO: 93003 - DNA, 20 bp, Artificial Sequence
  Description of Artificial Sequence: Synthetic oligonucleotide
  Target: ATXN1; (-) strand; PAM type: NRG; PAM sequence: TGG
aagtttctgaaccaggcggt

SEQ ID NO: 93004 - DNA, 20 bp, Artificial Sequence
  Description of Artificial Sequence: Synthetic oligonucleotide
  Target: ATXN1; (-) strand; PAM type: NRG; PAM sequence: CGG
agcaaagtttctgaaccagg

SEQ ID NO: 93005 - DNA, 20 bp, Artificial Sequence
  Description of Artificial Sequence: Synthetic oligonucleotide
  Target: ATXN1; (-) strand; PAM type: NRG; PAM sequence: AGG
tagagcaaagtttctgaacc

SEQ ID NO: 93006 - DNA, 20 bp, Artificial Sequence
  Description of Artificial Sequence: Synthetic oligonucleotide
  Target: ATXN1; (-) strand; PAM type: NRG; PAM sequence: CAG
atagagcaaagtttctgaac

SEQ ID NO: 93007 - DNA, 20 bp, Artificial Sequence
  Description of Artificial Sequence: Synthetic oligonucleotide
  Target: ATXN1; (-) strand; PAM type: NRG; PAM sequence: AAG
aaataattaaaaatagagca

SEQ ID NO: 93008 - DNA, 20 bp, Artificial Sequence
  Description of Artificial Sequence: Synthetic oligonucleotide
  Target: ATXN1; (-) strand; PAM type: NRG; PAM sequence: GAG
gaaccaaataattaaaaata

SEQ ID NO: 93009 - DNA, 20 bp, Artificial Sequence
  Description of Artificial Sequence: Synthetic oligonucleotide
  Target: ATXN1; (-) strand; PAM type: NRG; PAM sequence: TAG
ctgaaccaaataattaaaaa

SEQ ID NO: 93010 - DNA, 20 bp, Artificial Sequence
  Description of Artificial Sequence: Synthetic oligonucleotide
  Target: ATXN1; (-) strand; PAM type: NRG; PAM sequence: GGG
cacagaagttaatcacaaat

SEQ ID NO: 93011 - DNA, 20 bp, Artificial Sequence
  Description of Artificial Sequence: Synthetic oligonucleotide
  Target: ATXN1; (-) strand; PAM type: NRG; PAM sequence: TGG
acacagaagttaatcacaaa

SEQ ID NO: 93012 - DNA, 20 bp, Artificial Sequence
  Description of Artificial Sequence: Synthetic oligonucleotide
  Target: ATXN1; (-) strand; PAM type: NRG; PAM sequence: AAG
tcctttgccatgcaacacag

SEQ ID NO: 93013 - DNA, 20 bp, Artificial Sequence
  Description of Artificial Sequence: Synthetic oligonucleotide
  Target: ATXN1; (-) strand; PAM type: NRG; PAM sequence: CAG
acttcctttgccatgcaaca

SEQ ID NO: 93014 - DNA, 20 bp, Artificial Sequence
  Description of Artificial Sequence: Synthetic oligonucleotide
  Target: ATXN1; (-) strand; PAM type: NRG; PAM sequence: AGG
tgtgttctttgctgtgggtc

SEQ ID NO: 93015 - DNA, 20 bp, Artificial Sequence
  Description of Artificial Sequence: Synthetic oligonucleotide
  Target: ATXN1; (-) strand; PAM type: NRG; PAM sequence: CAG
ctgtgttctttgctgtgggt

SEQ ID NO: 93016 - DNA, 20 bp, Artificial Sequence
  Description of Artificial Sequence: Synthetic oligonucleotide
  Target: ATXN1; (-) strand; PAM type: NRG; PAM sequence: GGG
ctttctgtgttctttgctgt

SEQ ID NO: 93017 - DNA, 20 bp, Artificial Sequence
  Description of Artificial Sequence: Synthetic oligonucleotide
  Target: ATXN1; (-) strand; PAM type: NRG; PAM sequence: TGG
tctttctgtgttctttgctg

SEQ ID NO: 93018 - DNA, 20 bp, Artificial Sequence
  Description of Artificial Sequence: Synthetic oligonucleotide
  Target: ATXN1; (-) strand; PAM type: NRG; PAM sequence: AAG
ctagctgtttaaaaataatt

SEQ ID NO: 93019 - DNA, 20 bp, Artificial Sequence
  Description of Artificial Sequence: Synthetic oligonucleotide
  Target: ATXN1; (-) strand; PAM type: NRG; PAM sequence: TAG
catggtttacaatattacac

SEQ ID NO: 93020 - DNA, 20 bp, Artificial Sequence
  Description of Artificial Sequence: Synthetic oligonucleotide
  Target: ATXN1; (-) strand; PAM type: NRG; PAM sequence: TGG
aaattagttgtctctacaca

SEQ ID NO: 93021 - DNA, 20 bp, Artificial Sequence
  Description of Artificial Sequence: Synthetic oligonucleotide
  Target: ATXN1; (-) strand; PAM type: NRG; PAM sequence: TAG
tcaactggtctttgacaaat

SEQ ID NO: 93022 - DNA, 20 bp, Artificial Sequence
  Description of Artificial Sequence: Synthetic oligonucleotide
  Target: ATXN1; (-) strand; PAM type: NRG; PAM sequence: TGG
aaactgcaacagtcatcaac

SEQ ID NO: 93023 - DNA, 20 bp, Artificial Sequence
  Description of Artificial Sequence: Synthetic oligonucleotide
  Target: ATXN1; (-) strand; PAM type: NRG; PAM sequence: CAG
cctacagcttcaaactgcaa

SEQ ID NO: 93024 - DNA, 20 bp, Artificial Sequence
  Description of Artificial Sequence: Synthetic oligonucleotide
  Target: ATXN1; (-) strand; PAM type: NRG; PAM sequence: CAG
tctgttcttcatacacccta

SEQ ID NO: 93025 - DNA, 20 bp, Artificial Sequence
  Description of Artificial Sequence: Synthetic oligonucleotide
  Target: ATXN1; (-) strand; PAM type: NRG; PAM sequence: TGG
atcacttactaaagttccct

SEQ ID NO: 93026 - DNA, 20 bp, Artificial Sequence
  Description of Artificial Sequence: Synthetic oligonucleotide
  Target: ATXN1; (-) strand; PAM type: NRG; PAM sequence: AAG
cattttggcatcacttacta

SEQ ID NO: 93027 - DNA, 20 bp, Artificial Sequence
  Description of Artificial Sequence: Synthetic oligonucleotide
  Target: ATXN1; (-) strand; PAM type: NRG; PAM sequence: TGG
tgtcattatgagattcattt

SEQ ID NO: 93028 - DNA, 20 bp, Artificial Sequence
  Description of Artificial Sequence: Synthetic oligonucleotide
  Target: ATXN1; (-) strand; PAM type: NRG; PAM sequence: GAG
gaaaatctatttgtcattat

SEQ ID NO: 93029 - DNA, 20 bp, Artificial Sequence
  Description of Artificial Sequence: Synthetic oligonucleotide
  Target: ATXN1; (-) strand; PAM type: NRG; PAM sequence: GAG
tgctccattgttatttctca

SEQ ID NO: 93030 - DNA, 20 bp, Artificial Sequence
  Description of Artificial Sequence: Synthetic oligonucleotide
  Target: ATXN1; (-) strand; PAM type: NRG; PAM sequence: CAG
cttgctccattgttatttct

SEQ ID NO: 93031 - DNA, 20 bp, Artificial Sequence
  Description of Artificial Sequence: Synthetic oligonucleotide
  Target: ATXN1; (-) strand; PAM type: NRG; PAM sequence: AGG
cttctcctgctaatgagatt

SEQ ID NO: 93032 - DNA, 20 bp, Artificial Sequence
  Description of Artificial Sequence: Synthetic oligonucleotide
  Target: ATXN1; (-) strand; PAM type: NRG; PAM sequence: TAG
acttctcctgctaatgagat

SEQ ID NO: 93033 - DNA, 20 bp, Artificial Sequence
  Description of Artificial Sequence: Synthetic oligonucleotide
  Target: ATXN1; (-) strand; PAM type: NRG; PAM sequence: GAG
ctgaaacttctcctgctaat

SEQ ID NO: 93034 - DNA, 20 bp, Artificial Sequence
  Description of Artificial Sequence: Synthetic oligonucleotide
  Target: ATXN1; (-) strand; PAM type: NRG; PAM sequence: TAG
ggcattccattcactgctcc

SEQ ID NO: 93035 - DNA, 20 bp, Artificial Sequence
  Description of Artificial Sequence: Synthetic oligonucleotide
  Target: ATXN1; (-) strand; PAM type: NRG; PAM sequence: TGG
tttcctgtgcttaaggctgc

SEQ ID NO: 93036 - DNA, 20 bp, Artificial Sequence
  Description of Artificial Sequence: Synthetic oligonucleotide
  Target: ATXN1; (-) strand; PAM type: NRG; PAM sequence: AGG
gagtccatttcctgtgctta

SEQ ID NO: 93037 - DNA, 20 bp, Artificial Sequence
  Description of Artificial Sequence: Synthetic oligonucleotide
  Target: ATXN1; (-) strand; PAM type: NRG; PAM sequence: AAG
tgagtccatttcctgtgctt

SEQ ID NO: 93038 - DNA, 20 bp, Artificial Sequence
  Description of Artificial Sequence: Synthetic oligonucleotide
  Target: ATXN1; (-) strand; PAM type: NRG; PAM sequence: GAG
ctgaccaacttcttgcatct

SEQ ID NO: 93039 - DNA, 20 bp, Artificial Sequence
  Description of Artificial Sequence: Synthetic oligonucleotide
  Target: ATXN1; (-) strand; PAM type: NRG; PAM sequence: GAG
tattctgaatattatggctg

SEQ ID NO: 93040 - DNA, 20 bp, Artificial Sequence
  Description of Artificial Sequence: Synthetic oligonucleotide
  Target: ATXN1; (-) strand; PAM type: NRG; PAM sequence: TGG
gttattctgaatattatggc

SEQ ID NO: 93041 - DNA, 20 bp, Artificial Sequence
  Description of Artificial Sequence: Synthetic oligonucleotide
  Target: ATXN1; (-) strand; PAM type: NRG; PAM sequence: TGG
gtgtgttattctgaatatta

SEQ ID NO: 93042 - DNA, 20 bp, Artificial Sequence
  Description of Artificial Sequence: Synthetic oligonucleotide
  Target: ATXN1; (-) strand; PAM type: NRG; PAM sequence: TAG
atcttgctcagctaaaattc

SEQ ID NO: 93043 - DNA, 20 bp, Artificial Sequence
  Description of Artificial Sequence: Synthetic oligonucleotide
  Target: ATXN1; (-) strand; PAM type: NRG; PAM sequence: CAG
ttctgggatttcatcttgct

SEQ ID NO: 93044 - DNA, 20 bp, Artificial Sequence
  Description of Artificial Sequence: Synthetic oligonucleotide
  Target: ATXN1; (-) strand; PAM type: NRG; PAM sequence: GGG
tctctttctacttctcttct

SEQ ID NO: 93045 - DNA, 20 bp, Artificial Sequence
  Description of Artificial Sequence: Synthetic oligonucleotide
  Target: ATXN1; (-) strand; PAM type: NRG; PAM sequence: TGG
ttctctttctacttctcttc

SEQ ID NO: 93046 - DNA, 20 bp, Artificial Sequence
  Description of Artificial Sequence: Synthetic oligonucleotide
  Target: ATXN1; (-) strand; PAM type: NRG; PAM sequence: CAG
aaatataaaacagttccaaa

SEQ ID NO: 93047 - DNA, 20 bp, Artificial Sequence
  Description of Artificial Sequence: Synthetic oligonucleotide
  Target: ATXN1; (-) strand; PAM type: NRG; PAM sequence: CAG
cagcacttaaaaatataaaa

SEQ ID NO: 93048 - DNA, 20 bp, Artificial Sequence
  Description of Artificial Sequence: Synthetic oligonucleotide
  Target: ATXN1; (-) strand; PAM type: NRG; PAM sequence: CAG
ttttttgttttgtaaatgca

SEQ ID NO: 93049 - DNA, 20 bp, Artificial Sequence
  Description of Artificial Sequence: Synthetic oligonucleotide
  Target: ATXN1; (-) strand; PAM type: NRG; PAM sequence: TAG
gggtttattgttttcttact

SEQ ID NO: 93050 - DNA, 20 bp, Artificial Sequence
  Description of Artificial Sequence: Synthetic oligonucleotide
  Target: ATXN1; (-) strand; PAM type: NRG; PAM sequence: GGG
ttataactaatttgctactt

SEQ ID NO: 93051 - DNA, 20 bp, Artificial Sequence
  Description of Artificial Sequence: Synthetic oligonucleotide
  Target: ATXN1; (-) strand; PAM type: NRG; PAM sequence: TGG
tttataactaatttgctact

SEQ ID NO: 93052 - DNA, 20 bp, Artificial Sequence
  Description of Artificial Sequence: Synthetic oligonucleotide
  Target: ATXN1; (-) strand; PAM type: NRG; PAM sequence: TGG
ctgctttcaaaattcttaac

SEQ ID NO: 93053 - DNA, 20 bp, Artificial Sequence
  Description of Artificial Sequence: Synthetic oligonucleotide
  Target: ATXN1; (-) strand; PAM type: NRG; PAM sequence: TAG
aataaagttctgttaggttt

SEQ ID NO: 93054 - DNA, 20 bp, Artificial Sequence
  Description of Artificial Sequence: Synthetic oligonucleotide
  Target: ATXN1; (-) strand; PAM type: NRG; PAM sequence: AGG
tcgaggaataaagttctgtt

SEQ ID NO: 93055 - DNA, 20 bp, Artificial Sequence
  Description of Artificial Sequence: Synthetic oligonucleotide
  Target: ATXN1; (-) strand; PAM type: NRG; PAM sequence: TAG
ctcgaggaataaagttctgt

SEQ ID NO: 93056 - DNA, 20 bp, Artificial Sequence
  Description of Artificial Sequence: Synthetic oligonucleotide
  Target: ATXN1; (-) strand; PAM type: NRG; PAM sequence: AAG
agaaagcttctcgaggaata

SEQ ID NO: 93057 - DNA, 20 bp, Artificial Sequence
  Description of Artificial Sequence: Synthetic oligonucleotide
  Target: ATXN1; (-) strand; PAM type: NRG; PAM sequence: AGG
gatcaagagaaagcttctcg

SEQ ID NO: 93058 - DNA, 20 bp, Artificial Sequence
  Description of Artificial Sequence: Synthetic oligonucleotide
  Target: ATXN1; (-) strand; PAM type: NRG; PAM sequence: GAG
tgatcaagagaaagcttctc

SEQ ID NO: 93059 - DNA, 20 bp, Artificial Sequence
  Description of Artificial Sequence: Synthetic oligonucleotide
  Target: ATXN1; (-) strand; PAM type: NRG; PAM sequence: AAG
tagggctattgatcaagaga

SEQ ID NO: 93060 - DNA, 20 bp, Artificial Sequence
  Description of Artificial Sequence: Synthetic oligonucleotide
  Target: ATXN1; (-) strand; PAM type: NRG; PAM sequence: GAG
attttagggctattgatcaa

SEQ ID NO: 93061 - DNA, 20 bp, Artificial Sequence
  Description of Artificial Sequence: Synthetic oligonucleotide
  Target: ATXN1; (-) strand; PAM type: NRG; PAM sequence: AAG
aaattttagggctattgatc

SEQ ID NO: 93062 - DNA, 20 bp, Artificial Sequence
  Description of Artificial Sequence: Synthetic oligonucleotide
  Target: ATXN1; (-) strand; PAM type: NRG; PAM sequence: GGG
cagaatgtcttaaaatttta

SEQ ID NO: 93063 - DNA, 20 bp, Artificial Sequence
  Description of Artificial Sequence: Synthetic oligonucleotide
  Target: ATXN1; (-) strand; PAM type: NRG; PAM sequence: AGG
acagaatgtcttaaaatttt

SEQ ID NO: 93064 - DNA, 20 bp, Artificial Sequence
  Description of Artificial Sequence: Synthetic oligonucleotide
  Target: ATXN1; (-) strand; PAM type: NRG; PAM sequence: TAG
tacagaatgtcttaaaattt

SEQ ID NO: 93065 - DNA, 20 bp, Artificial Sequence
  Description of Artificial Sequence: Synthetic oligonucleotide
  Target: ATXN1; (-) strand; PAM type: NRG; PAM sequence: CAG
gtacattaaggacttaaata

SEQ ID NO: 93066 - DNA, 20 bp, Artificial Sequence
  Description of Artificial Sequence: Synthetic oligonucleotide
  Target: ATXN1; (-) strand; PAM type: NRG; PAM sequence: AGG
gaggttttccaagtacatta

SEQ ID NO: 93067 - DNA, 20 bp, Artificial Sequence
  Description of Artificial Sequence: Synthetic oligonucleotide
  Target: ATXN1; (-) strand; PAM type: NRG; PAM sequence: AAG
tgaggttttccaagtacatt

SEQ ID NO: 93068 - DNA, 20 bp, Artificial Sequence
  Description of Artificial Sequence: Synthetic oligonucleotide
  Target: ATXN1; (-) strand; PAM type: NRG; PAM sequence: AAG
agtagactctgaggttttcc

SEQ ID NO: 93069 - DNA, 20 bp, Artificial Sequence
  Description of Artificial Sequence: Synthetic oligonucleotide
  Target: ATXN1; (-) strand; PAM type: NRG; PAM sequence: AGG
gtatgattcagtagactctg

SEQ ID NO: 93070 - DNA, 20 bp, Artificial Sequence
  Description of Artificial Sequence: Synthetic oligonucleotide
  Target: ATXN1; (-) strand; PAM type: NRG; PAM sequence: GAG
tgtatgattcagtagactct

SEQ ID NO: 93071 - DNA, 20 bp, Artificial Sequence
  Description of Artificial Sequence: Synthetic oligonucleotide
  Target: ATXN1; (-) strand; PAM type: NRG; PAM sequence: TAG
tcgtggcctgtatgattcag

SEQ ID NO: 93072 - DNA, 20 bp, Artificial Sequence
  Description of Artificial Sequence: Synthetic oligonucleotide
  Target: ATXN1; (-) strand; PAM type: NRG; PAM sequence: CAG
tcttcgtggcctgtatgatt

SEQ ID NO: 93073 - DNA, 20 bp, Artificial Sequence
  Description of Artificial Sequence: Synthetic oligonucleotide
  Target: ATXN1; (-) strand; PAM type: NRG; PAM sequence: TGG
tgaaatattttggctcttcg

SEQ ID NO: 93074 - DNA, 20 bp, Artificial Sequence
  Description of Artificial Sequence: Synthetic oligonucleotide
  Target: ATXN1; (-) strand; PAM type: NRG; PAM sequence: TGG
ctattactcctgaaatattt

SEQ ID NO: 93075 - DNA, 20 bp, Artificial Sequence
  Description of Artificial Sequence: Synthetic oligonucleotide
  Target: ATXN1; (-) strand; PAM type: NRG; PAM sequence: TAG
ttcgctgcaaatgtaatttt

SEQ ID NO: 93076 - DNA, 20 bp, Artificial Sequence
  Description of Artificial Sequence: Synthetic oligonucleotide
  Target: ATXN1; (-) strand; PAM type: NRG; PAM sequence: TGG
gatcattctggcattggtcc

SEQ ID NO: 93077 - DNA, 20 bp, Artificial Sequence
  Description of Artificial Sequence: Synthetic oligonucleotide
  Target: ATXN1; (-) strand; PAM type: NRG; PAM sequence: TGG
ttcccagatcattctggcat

SEQ ID NO: 93078 - DNA, 20 bp, Artificial Sequence
  Description of Artificial Sequence: Synthetic oligonucleotide
  Target: ATXN1; (-) strand; PAM type: NRG; PAM sequence: TGG
tttaaattcccagatcattc

SEQ ID NO: 93079 - DNA, 20 bp, Artificial Sequence
  Description of Artificial Sequence: Synthetic oligonucleotide
  Target: ATXN1; (-) strand; PAM type: NRG; PAM sequence: CAG
tgttttgttttttaaattcc

SEQ ID NO: 93080 - DNA, 20 bp, Artificial Sequence
  Description of Artificial Sequence: Synthetic oligonucleotide
  Target: ATXN1; (-) strand; PAM type: NRG; PAM sequence: AGG
actctcctcaaggagaaatt

SEQ ID NO: 93081 - DNA, 20 bp, Artificial Sequence
  Description of Artificial Sequence: Synthetic oligonucleotide
  Target: ATXN1; (-) strand; PAM type: NRG; PAM sequence: TAG
tactctcctcaaggagaaat

SEQ ID NO: 93082 - DNA, 20 bp, Artificial Sequence
  Description of Artificial Sequence: Synthetic oligonucleotide
  Target: ATXN1; (-) strand; PAM type: NRG; PAM sequence: GAG
ccatttctactctcctcaag

SEQ ID NO: 93083 - DNA, 20 bp, Artificial Sequence
  Description of Artificial Sequence: Synthetic oligonucleotide
  Target: ATXN1; (-) strand; PAM type: NRG; PAM sequence: AGG
ctccatttctactctcctca

SEQ ID NO: 93084 - DNA, 20 bp, Artificial Sequence
  Description of Artificial Sequence: Synthetic oligonucleotide
  Target: ATXN1; (-) strand; PAM type: NRG; PAM sequence: AAG
tctccatttctactctcctc

SEQ ID NO: 93085 - DNA, 20 bp, Artificial Sequence
  Description of Artificial Sequence: Synthetic oligonucleotide
  Target: ATXN1; (-) strand; PAM type: NRG; PAM sequence: AAG
ttgagagcccccagcaaagg

SEQ ID NO: 93086 - DNA, 20 bp, Artificial Sequence
  Description of Artificial Sequence: Synthetic oligonucleotide
  Target: ATXN1; (-) strand; PAM type: NRG; PAM sequence: AGG
gaattgagagcccccagcaa

SEQ ID NO: 93087 - DNA, 20 bp, Artificial Sequence
  Description of Artificial Sequence: Synthetic oligonucleotide
  Target: ATXN1; (-) strand; PAM type: NRG; PAM sequence: AAG
agaattgagagcccccagca

SEQ ID NO: 93088 - DNA, 20 bp, Artificial Sequence
  Description of Artificial Sequence: Synthetic oligonucleotide
  Target: ATXN1; (-) strand; PAM type: NRG; PAM sequence: CAG
gcttcagaattgagagcccc

SEQ ID NO: 93089 - DNA, 20 bp, Artificial Sequence
  Description of Artificial Sequence: Synthetic oligonucleotide
  Target: ATXN1; (-) strand; PAM type: NRG; PAM sequence: GAG
gaactgagcttcagaattga

SEQ ID NO: 93090 - DNA, 20 bp, Artificial Sequence
  Description of Artificial Sequence: Synthetic oligonucleotide
  Target: ATXN1; (-) strand; PAM type: NRG; PAM sequence: GAG
aggaactgagcttcagaatt

SEQ ID NO: 93091 - DNA, 20 bp, Artificial Sequence
  Description of Artificial Sequence: Synthetic oligonucleotide
  Target: ATXN1; (-) strand; PAM type: NRG; PAM sequence: CAG
cggtttaaggaactgagctt

SEQ ID NO: 93092 - DNA, 20 bp, Artificial Sequence
  Description of Artificial Sequence: Synthetic oligonucleotide
  Target: ATXN1; (-) strand; PAM type: NRG; PAM sequence: GAG
tgttagcggtttaaggaact

SEQ ID NO: 93093 - DNA, 20 bp, Artificial Sequence
  Description of Artificial Sequence: Synthetic oligonucleotide
  Target: ATXN1; (-) strand; PAM type: NRG; PAM sequence: AGG
tagccagtgttagcggttta

SEQ ID NO: 93094 - DNA, 20 bp, Artificial Sequence
  Description of Artificial Sequence: Synthetic oligonucleotide
  Target: ATXN1; (-) strand; PAM type: NRG; PAM sequence: AAG
atagccagtgttagcggttt

SEQ ID NO: 93095 - DNA, 20 bp, Artificial Sequence
  Description of Artificial Sequence: Synthetic oligonucleotide
  Target: ATXN1; (-) strand; PAM type: NRG; PAM sequence: CGG
aagctaatagccagtgttag

SEQ ID NO: 93096 - DNA, 20 bp, Artificial Sequence
  Description of Artificial Sequence: Synthetic oligonucleotide
  Target: ATXN1; (-) strand; PAM type: NRG; PAM sequence: TAG
tgaaagctaatagccagtgt

SEQ ID NO: 93097 - DNA, 20 bp, Artificial Sequence
  Description of Artificial Sequence: Synthetic oligonucleotide
  Target: ATXN1; (-) strand; PAM type: NRG; PAM sequence: CAG
cccagctgaaagctaatagc

SEQ ID NO: 93098 - DNA, 20 bp, Artificial Sequence
  Description of Artificial Sequence: Synthetic oligonucleotide
  Target: ATXN1; (-) strand; PAM type: NRG; PAM sequence: TAG
ccagcccagctgaaagctaa

SEQ ID NO: 93099 - DNA, 20 bp, Artificial Sequence
  Description of Artificial Sequence: Synthetic oligonucleotide
  Target: ATXN1; (-) strand; PAM type: NRG; PAM sequence: AAG
atgtcaaccagcccagctga

SEQ ID NO: 93100 - DNA, 20 bp, Artificial Sequence
  Description of Artificial Sequence: Synthetic oligonucleotide
  Target: ATXN1; (-) strand; PAM type: NRG; PAM sequence: CAG
tcttgccatgtcaaccagcc

SEQ ID NO: 93101 - DNA, 20 bp, Artificial Sequence
  Description of Artificial Sequence: Synthetic oligonucleotide
  Target: ATXN1; (-) strand; PAM type: NRG; PAM sequence: CAG
aagggtcttgccatgtcaac

SEQ ID NO: 93102 - DNA, 20 bp, Artificial Sequence
  Description of Artificial Sequence: Synthetic oligonucleotide
  Target: ATXN1; (-) strand; PAM type: NRG; PAM sequence: GGG
atatggatgtgcccttctaa

SEQ ID NO: 93103 - DNA, 20 bp, Artificial Sequence
  Description of Artificial Sequence: Synthetic oligonucleotide
  Target: ATXN1; (-) strand; PAM type: NRG; PAM sequence: AGG
aatatggatgtgcccttcta

SEQ ID NO: 93104 - DNA, 20 bp, Artificial Sequence
  Description of Artificial Sequence: Synthetic oligonucleotide
  Target: ATXN1; (-) strand; PAM type: NRG; PAM sequence: AAG
aaatatggatgtgcccttct

SEQ ID NO: 93105 - DNA, 20 bp, Artificial Sequence
  Description of Artificial Sequence: Synthetic oligonucleotide
  Target: ATXN1; (-) strand; PAM type: NRG; PAM sequence: TGG
tccataattacccacaaata

SEQ ID NO: 93106 - DNA, 20 bp, Artificial Sequence
  Description of Artificial Sequence: Synthetic oligonucleotide
  Target: ATXN1; (-) strand; PAM type: NRG; PAM sequence: GAG
tctcctcatgatggctccct

SEQ ID NO: 93107 - DNA, 20 bp, Artificial Sequence
  Description of Artificial Sequence: Synthetic oligonucleotide
  Target: ATXN1; (-) strand; PAM type: NRG; PAM sequence: TGG
cttttttcttctcctcatga

SEQ ID NO: 93108 - DNA, 20 bp, Artificial Sequence
  Description of Artificial Sequence: Synthetic oligonucleotide
  Target: ATXN1; (-) strand; PAM type: NRG; PAM sequence: CAG
ttattttggactttctgaaa

SEQ ID NO: 93109 - DNA, 20 bp, Artificial Sequence
  Description of Artificial Sequence: Synthetic oligonucleotide
  Target: ATXN1; (-) strand; PAM type: NRG; PAM sequence: TGG
ataataaagtcactttattt

SEQ ID NO: 93110 - DNA, 20 bp, Artificial Sequence
  Description of Artificial Sequence: Synthetic oligonucleotide
  Target: ATXN1; (-) strand; PAM type: NRG; PAM sequence: AAG
atatgaatatgtatataata

SEQ ID NO: 93111 - DNA, 20 bp, Artificial Sequence
  Description of Artificial Sequence: Synthetic oligonucleotide
  Target: ATXN1; (-) strand; PAM type: NRG; PAM sequence: AGG
acctatttgcataatagagg

SEQ ID NO: 93112 - DNA, 20 bp, Artificial Sequence
  Description of Artificial Sequence: Synthetic oligonucleotide
  Target: ATXN1; (-) strand; PAM type: NRG; PAM sequence: GAG
cacctatttgcataatagag

SEQ ID NO: 93113 - DNA, 20 bp, Artificial Sequence
  Description of Artificial Sequence: Synthetic oligonucleotide
  Target: ATXN1; (-) strand; PAM type: NRG; PAM sequence: AGG
ttcacctatttgcataatag

SEQ ID NO: 93114 - DNA, 20 bp, Artificial Sequence
  Description of Artificial Sequence: Synthetic oligonucleotide
  Target: ATXN1; (-) strand; PAM type: NRG; PAM sequence: GAG
cttcacctatttgcataata

SEQ ID NO: 93115 - DNA, 20 bp, Artificial Sequence
  Description of Artificial Sequence: Synthetic oligonucleotide
  Target: ATXN1; (-) strand; PAM type: NRG; PAM sequence: TAG
tacttcacctatttgcataa

SEQ ID NO: 93116 - DNA, 20 bp, Artificial Sequence
  Description of Artificial Sequence: Synthetic oligonucleotide
  Target: ATXN1; (-) strand; PAM type: NRG; PAM sequence: TAG
atcctggttttttaaaattc

SEQ ID NO: 93117 - DNA, 20 bp, Artificial Sequence
  Description of Artificial Sequence: Synthetic oligonucleotide
  Target: ATXN1; (-) strand; PAM type: NRG; PAM sequence: TGG
atgtgctttttttaaaatcc

SEQ ID NO: 93118 - DNA, 20 bp, Artificial Sequence
  Description of Artificial Sequence: Synthetic oligonucleotide
  Target: ATXN1; (-) strand; PAM type: NRG; PAM sequence: TAG
aactataaataattcagtca

SEQ ID NO: 93119 - DNA, 20 bp, Artificial Sequence
  Description of Artificial Sequence: Synthetic oligonucleotide
  Target: ATXN1; (-) strand; PAM type: NRG; PAM sequence: CAG
atttgcaactataaataatt

SEQ ID NO: 93120 - DNA, 20 bp, Artificial Sequence
  Description of Artificial Sequence: Synthetic oligonucleotide
  Target: ATXN1; (-) strand; PAM type: NRG; PAM sequence: AAG
aatactaggttggtattatg

SEQ ID NO: 93121 - DNA, 20 bp, Artificial Sequence
  Description of Artificial Sequence: Synthetic oligonucleotide
  Target: ATXN1; (-) strand; PAM type: NRG; PAM sequence: TGG
ctgcagtaataatactaggt

SEQ ID NO: 93122 - DNA, 20 bp, Artificial Sequence
  Description of Artificial Sequence: Synthetic oligonucleotide
  Target: ATXN1; (-) strand; PAM type: NRG; PAM sequence: AGG
gtgcctgcagtaataatact

SEQ ID NO: 93123 - DNA, 20 bp, Artificial Sequence
  Description of Artificial Sequence: Synthetic oligonucleotide
  Target: ATXN1; (-) strand; PAM type: NRG; PAM sequence: TAG
agtgcctgcagtaataatac

SEQ ID NO: 93124 - DNA, 20 bp, Artificial Sequence
  Description of Artificial Sequence: Synthetic oligonucleotide
  Target: ATXN1; (-) strand; PAM type: NRG; PAM sequence: CAG
taagccagggccagtgcctg

SEQ ID NO: 93125 - DNA, 20 bp, Artificial Sequence
  Description of Artificial Sequence: Synthetic oligonucleotide
  Target: ATXN1; (-) strand; PAM type: NRG; PAM sequence: CAG
taacatttctaagccagggc

SEQ ID NO: 93126 - DNA, 20 bp, Artificial Sequence
  Description of Artificial Sequence: Synthetic oligonucleotide
  Target: ATXN1; (-) strand; PAM type: NRG; PAM sequence: GGG
gaaataacatttctaagcca

SEQ ID NO: 93127 - DNA, 20 bp, Artificial Sequence
  Description of Artificial Sequence: Synthetic oligonucleotide
  Target: ATXN1; (-) strand; PAM type: NRG; PAM sequence: AGG
tgaaataacatttctaagcc

SEQ ID NO: 93128 - DNA, 20 bp, Artificial Sequence
  Description of Artificial Sequence: Synthetic oligonucleotide
  Target: ATXN1; (-) strand; PAM type: NRG; PAM sequence: CAG
atgaaataacatttctaagc

SEQ ID NO: 93129 - DNA, 20 bp, Artificial Sequence
  Description of Artificial Sequence: Synthetic oligonucleotide
  Target: ATXN1; (-) strand; PAM type: NRG; PAM sequence: AAG
ctaaatgaaataacatttct

SEQ ID NO: 93130 - DNA, 20 bp, Artificial Sequence
  Description of Artificial Sequence: Synthetic oligonucleotide
  Target: ATXN1; (-) strand; PAM type: NRG; PAM sequence: TAG
gtggctagtgttacaacaaa

SEQ ID NO: 93131 - DNA, 20 bp, Artificial Sequence
  Description of Artificial Sequence: Synthetic oligonucleotide
  Target: ATXN1; (-) strand; PAM type: NRG; PAM sequence: TAG
tcaaaccccatcacagtggc

SEQ ID NO: 93132 - DNA, 20 bp, Artificial Sequence
  Description of Artificial Sequence: Synthetic oligonucleotide
  Target: ATXN1; (-) strand; PAM type: NRG; PAM sequence: TGG
cgggtcaaaccccatcacag

SEQ ID NO: 93133 - DNA, 20 bp, Artificial Sequence
  Description of Artificial Sequence: Synthetic oligonucleotide
  Target: ATXN1; (-) strand; PAM type: NRG; PAM sequence: CAG
acacgggtcaaaccccatca

SEQ ID NO: 93134 - DNA, 20 bp, Artificial Sequence
  Description of Artificial Sequence: Synthetic oligonucleotide
  Target: ATXN1; (-) strand; PAM type: NRG; PAM sequence: GGG
tgttttatggacaaagacac

SEQ ID NO: 93135 - DNA, 20 bp, Artificial Sequence
  Description of Artificial Sequence: Synthetic oligonucleotide
  Target: ATXN1; (-) strand; PAM type: NRG; PAM sequence: CGG
ttgttttatggacaaagaca

SEQ ID NO: 93136 - DNA, 20 bp, Artificial Sequence
  Description of Artificial Sequence: Synthetic oligonucleotide
  Target: ATXN1; (-) strand; PAM type: NRG; PAM sequence: AAG
atagggttgttttatggaca

SEQ ID NO: 93137 - DNA, 20 bp, Artificial Sequence
  Description of Artificial Sequence: Synthetic oligonucleotide
  Target: ATXN1; (-) strand; PAM type: NRG; PAM sequence: TGG
tatcttatagggttgtttta

SEQ ID NO: 93138 - DNA, 20 bp, Artificial Sequence
  Description of Artificial Sequence: Synthetic oligonucleotide
  Target: ATXN1; (-) strand; PAM type: NRG; PAM sequence: GGG
tcatgtttacatatcttata

SEQ ID NO: 93139 - DNA, 20 bp, Artificial Sequence
  Description of Artificial Sequence: Synthetic oligonucleotide
  Target: ATXN1; (-) strand; PAM type: NRG; PAM sequence: AGG
ttcatgtttacatatcttat

SEQ ID NO: 93140 - DNA, 20 bp, Artificial Sequence
  Description of Artificial Sequence: Synthetic oligonucleotide
  Target: ATXN1; (-) strand; PAM type: NRG; PAM sequence: TAG
attcatgtttacatatctta

SEQ ID NO: 93141 - DNA, 20 bp, Artificial Sequence
  Description of Artificial Sequence: Synthetic oligonucleotide
  Target: ATXN1; (-) strand; PAM type: NRG; PAM sequence: AAG
tttttgctttctttcactta

SEQ ID NO: 93142 - DNA, 20 bp, Artificial Sequence
  Description of Artificial Sequence: Synthetic oligonucleotide
  Target: ATXN1; (-) strand; PAM type: NRG; PAM sequence: CAG
ctagaatatcccacagaaag

SEQ ID NO: 93143 - DNA, 20 bp, Artificial Sequence
  Description of Artificial Sequence: Synthetic oligonucleotide
  Target: ATXN1; (-) strand; PAM type: NRG; PAM sequence: AAG
taactagaatatcccacaga

SEQ ID NO: 93144 - DNA, 20 bp, Artificial Sequence
  Description of Artificial Sequence: Synthetic oligonucleotide
  Target: ATXN1; (-) strand; PAM type: NRG; PAM sequence: CAG
catttaactagaatatccca

SEQ ID NO: 93145 - DNA, 20 bp, Artificial Sequence
  Description of Artificial Sequence: Synthetic oligonucleotide
  Target: ATXN1; (-) strand; PAM type: NRG; PAM sequence: TAG
ttgaatagctttcatttaac

SEQ ID NO: 93146 - DNA, 20 bp, Artificial Sequence
  Description of Artificial Sequence: Synthetic oligonucleotide
  Target: ATXN1; (-) strand; PAM type: NRG; PAM sequence: TAG
agcaattgattcaagttgaa

SEQ ID NO: 93147 - DNA, 20 bp, Artificial Sequence
  Description of Artificial Sequence: Synthetic oligonucleotide
  Target: ATXN1; (-) strand; PAM type: NRG; PAM sequence: AAG
atggatacagcaattgattc

SEQ ID NO: 93148 - DNA, 20 bp, Artificial Sequence
  Description of Artificial Sequence: Synthetic oligonucleotide
  Target: ATXN1; (-) strand; PAM type: NRG; PAM sequence: CAG
tgtgtattggagaatggata

SEQ ID NO: 93149 - DNA, 20 bp, Artificial Sequence
  Description of Artificial Sequence: Synthetic oligonucleotide
  Target: ATXN1; (-) strand; PAM type: NRG; PAM sequence: TGG
atctgctgtgtattggagaa

SEQ ID NO: 93150 - DNA, 20 bp, Artificial Sequence
  Description of Artificial Sequence: Synthetic oligonucleotide
  Target: ATXN1; (-) strand; PAM type: NRG; PAM sequence: GAG
tataaatctgctgtgtattg

SEQ ID NO: 93151 - DNA, 20 bp, Artificial Sequence
  Description of Artificial Sequence: Synthetic oligonucleotide
  Target: ATXN1; (-) strand; PAM type: NRG; PAM sequence: TGG
aatataaatctgctgtgtat

SEQ ID NO: 93152 - DNA, 20 bp, Artificial Sequence
  Description of Artificial Sequence: Synthetic oligonucleotide
  Target: ATXN1; (-) strand; PAM type: NRG; PAM sequence: CAG
aaggaatggaagagatattt

SEQ ID NO: 93153 - DNA, 20 bp, Artificial Sequence
  Description of Artificial Sequence: Synthetic oligonucleotide
  Target: ATXN1; (-) strand; PAM type: NRG; PAM sequence: GAG
gtaggacaaaaggaatggaa

SEQ ID NO: 93154 - DNA, 20 bp, Artificial Sequence
  Description of Artificial Sequence: Synthetic oligonucleotide
  Target: ATXN1; (-) strand; PAM type: NRG; PAM sequence: AAG
atgtaggacaaaaggaatgg

SEQ ID NO: 93155 - DNA, 20 bp, Artificial Sequence
  Description of Artificial Sequence: Synthetic oligonucleotide
  Target: ATXN1; (-) strand; PAM type: NRG; PAM sequence: TGG
gttatgtaggacaaaaggaa

SEQ ID NO: 93156 - DNA, 20 bp, Artificial Sequence
  Description of Artificial Sequence: Synthetic oligonucleotide
  Target: ATXN1; (-) strand; PAM type: NRG; PAM sequence: AGG
ggaatgttatgtaggacaaa

SEQ ID NO: 93157 - DNA, 20 bp, Artificial Sequence
  Description of Artificial Sequence: Synthetic oligonucleotide
  Target: ATXN1; (-) strand; PAM type: NRG; PAM sequence: AAG
tggaatgttatgtaggacaa

SEQ ID NO: 93158 - DNA, 20 bp, Artificial Sequence
  Description of Artificial Sequence: Synthetic oligonucleotide
  Target: ATXN1; (-) strand; PAM type: NRG; PAM sequence: AGG
cagcccatggaatgttatgt

SEQ ID NO: 93159 - DNA, 20 bp, Artificial Sequence
  Description of Artificial Sequence: Synthetic oligonucleotide
  Target: ATXN1; (-) strand; PAM type: NRG; PAM sequence: TAG
tcagcccatggaatgttatg

SEQ ID NO: 93160 - DNA, 20 bp, Artificial Sequence
  Description of Artificial Sequence: Synthetic oligonucleotide
  Target: ATXN1; (-) strand; PAM type: NRG; PAM sequence: TGG
ctcgttgggagttcagccca

SEQ ID NO: 93161 - DNA, 20 bp, Artificial Sequence
  Description of Artificial Sequence: Synthetic oligonucleotide
  Target: ATXN1; (-) strand; PAM type: NRG; PAM sequence: CAG
tatgcccctcgttgggagtt

SEQ ID NO: 93162 - DNA, 20 bp, Artificial Sequence
  Description of Artificial Sequence: Synthetic oligonucleotide
  Target: ATXN1; (-) strand; PAM type: NRG; PAM sequence: GAG
aaatatatgcccctcgttgg

SEQ ID NO: 93163 - DNA, 20 bp, Artificial Sequence
  Description of Artificial Sequence: Synthetic oligonucleotide
  Target: ATXN1; (-) strand; PAM type: NRG; PAM sequence: GGG
acaaatatatgcccctcgtt

SEQ ID NO: 93164 - DNA, 20 bp, Artificial Sequence
  Description of Artificial Sequence: Synthetic oligonucleotide
  Target: ATXN1; (-) strand; PAM type: NRG; PAM sequence: TGG
gacaaatatatgcccctcgt

SEQ ID NO: 93165 - DNA, 20 bp, Artificial Sequence
  Description of Artificial Sequence: Synthetic oligonucleotide
  Target: ATXN1; (-) strand; PAM type: NRG; PAM sequence: AAG
aatagaacaagtgcaaacag

SEQ ID NO: 93166 - DNA, 20 bp, Artificial Sequence
  Description of Artificial Sequence: Synthetic oligonucleotide
  Target: ATXN1; (-) strand; PAM type: NRG; PAM sequence: CAG
tacaatagaacaagtgcaaa

SEQ ID NO: 93167 - DNA, 20 bp, Artificial Sequence
  Description of Artificial Sequence: Synthetic oligonucleotide
  Target: ATXN1; (-) strand; PAM type: NRG; PAM sequence: AAG
aagacaaactacaatagaac

SEQ ID NO: 93168 - DNA, 20 bp, Artificial Sequence
  Description of Artificial Sequence: Synthetic oligonucleotide
  Target: ATXN1; (-) strand; PAM type: NRG; PAM sequence: TAG
gcaacaaagacaaactacaa

SEQ ID NO: 93169 - DNA, 20 bp, Artificial Sequence
  Description of Artificial Sequence: Synthetic oligonucleotide
  Target: ATXN1; (-) strand; PAM type: NRG; PAM sequence: AAG
aaaatggaaaatttgcaaca

SEQ ID NO: 93170 - DNA, 20 bp, Artificial Sequence
  Description of Artificial Sequence: Synthetic oligonucleotide
  Target: ATXN1; (-) strand; PAM type: NRG; PAM sequence: TGG
ttgtcaggaaagggtcaaaa

SEQ ID NO: 93171 - DNA, 20 bp, Artificial Sequence
  Description of Artificial Sequence: Synthetic oligonucleotide
  Target: ATXN1; (-) strand; PAM type: NRG; PAM sequence: GGG
attaatgttttgtcaggaaa

SEQ ID NO: 93172 - DNA, 20 bp, Artificial Sequence
  Description of Artificial Sequence: Synthetic oligonucleotide
  Target: ATXN1; (-) strand; PAM type: NRG; PAM sequence: AGG
tattaatgttttgtcaggaa

SEQ ID NO: 93173 - DNA, 20 bp, Artificial Sequence
  Description of Artificial Sequence: Synthetic oligonucleotide
  Target: ATXN1; (-) strand; PAM type: NRG; PAM sequence: AAG
atattaatgttttgtcagga

SEQ ID NO: 93174 - DNA, 20 bp, Artificial Sequence
  Description of Artificial Sequence: Synthetic oligonucleotide
  Target: ATXN1; (-) strand; PAM type: NRG; PAM sequence: AGG
gtatatattaatgttttgtc

SEQ ID NO: 93175 - DNA, 20 bp, Artificial Sequence
  Description of Artificial Sequence: Synthetic oligonucleotide
  Target: ATXN1; (-) strand; PAM type: NRG; PAM sequence: CAG
tgtatatattaatgttttgt

SEQ ID NO: 93176 - DNA, 20 bp, Artificial Sequence
  Description of Artificial Sequence: Synthetic oligonucleotide
  Target: ATXN1; (-) strand; PAM type: NRG; PAM sequence: AAG
tttttttttttttttttaac

SEQ ID NO: 93177 - DNA, 20 bp, Artificial Sequence
  Description of Artificial Sequence: Synthetic oligonucleotide
  Target: ATXN1; (-) strand; PAM type: NRG; PAM sequence: GGG
ggtacagaataaaaatgtca

SEQ ID NO: 93178 - DNA, 20 bp, Artificial Sequence
  Description of Artificial Sequence: Synthetic oligonucleotide
  Target: ATXN1; (-) strand; PAM type: NRG; PAM sequence: AGG
tggtacagaataaaaatgtc

SEQ ID NO: 93179 - DNA, 20 bp, Artificial Sequence
  Description of Artificial Sequence: Synthetic oligonucleotide
  Target: ATXN1; (-) strand; PAM type: NRG; PAM sequence: CAG
gtggtacagaataaaaatgt

SEQ ID NO: 93180 - DNA, 20 bp, Artificial Sequence
  Description of Artificial Sequence: Synthetic oligonucleotide
  Target: ATXN1; (-) strand; PAM type: NRG; PAM sequence: CAG
atgggtgcttcaaggtggta

SEQ ID NO: 93181 - DNA, 20 bp, Artificial Sequence
  Description of Artificial Sequence: Synthetic oligonucleotide
  Target: ATXN1; (-) strand; PAM type: NRG; PAM sequence: TGG
aagttatgggtgcttcaagg

SEQ ID NO: 93182 - DNA, 20 bp, Artificial Sequence
  Description of Artificial Sequence: Synthetic oligonucleotide
  Target: ATXN1; (-) strand; PAM type: NRG; PAM sequence: AGG
aaaaagttatgggtgcttca

SEQ ID NO: 93183 - DNA, 20 bp, Artificial Sequence
  Description of Artificial Sequence: Synthetic oligonucleotide
  Target: ATXN1; (-) strand; PAM type: NRG; PAM sequence: AAG
taaaaagttatgggtgcttc

SEQ ID NO: 93184 - DNA, 20 bp, Artificial Sequence
  Description of Artificial Sequence: Synthetic oligonucleotide
  Target: ATXN1; (-) strand; PAM type: NRG; PAM sequence: GGG
ggcttattttaaaaagttat

SEQ ID NO: 93185 - DNA, 20 bp, Artificial Sequence
  Description of Artificial Sequence: Synthetic oligonucleotide
  Target: ATXN1; (-) strand; PAM type: NRG; PAM sequence: TGG
gggcttattttaaaaagtta

SEQ ID NO: 93186 - DNA, 20 bp, Artificial Sequence
  Description of Artificial Sequence: Synthetic oligonucleotide
  Target: ATXN1; (-) strand; PAM type: NRG; PAM sequence: AAG
atagcagggcttattttaaa

SEQ ID NO: 93187 - DNA, 20 bp, Artificial Sequence
  Description of Artificial Sequence: Synthetic oligonucleotide
  Target: ATXN1; (-) strand; PAM type: NRG; PAM sequence: GGG
gatcactgatttaaatagca

SEQ ID NO: 93188 - DNA, 20 bp, Artificial Sequence
  Description of Artificial Sequence: Synthetic oligonucleotide
  Target: ATXN1; (-) strand; PAM type: NRG; PAM sequence: AGG
tgatcactgatttaaatagc

SEQ ID NO: 93189 - DNA, 20 bp, Artificial Sequence
  Description of Artificial Sequence: Synthetic oligonucleotide
  Target: ATXN1; (-) strand; PAM type: NRG; PAM sequence: CAG
ttgatcactgatttaaatag

SEQ ID NO: 93190 - DNA, 20 bp, Artificial Sequence
  Description of Artificial Sequence: Synthetic oligonucleotide
  Target: ATXN1; (-) strand; PAM type: NRG; PAM sequence: TAG
aatttgatcactgatttaaa

SEQ ID NO: 93191 - DNA, 20 bp, Artificial Sequence
  Description of Artificial Sequence: Synthetic oligonucleotide
  Target: ATXN1; (-) strand; PAM type: NRG; PAM sequence: CAG
atttctagtgtttacataag

SEQ ID NO: 93192 - DNA, 20 bp, Artificial Sequence
  Description of Artificial Sequence: Synthetic oligonucleotide
  Target: ATXN1; (-) strand; PAM type: NRG; PAM sequence: AAG
tggatttctagtgtttacat

SEQ ID NO: 93193 - DNA, 20 bp, Artificial Sequence
  Description of Artificial Sequence: Synthetic oligonucleotide
  Target: ATXN1; (-) strand; PAM type: NRG; PAM sequence: TAG
gaattttctccctggatttc

SEQ ID NO: 93194 - DNA, 20 bp, Artificial Sequence
  Description of Artificial Sequence: Synthetic oligonucleotide
  Target: ATXN1; (-) strand; PAM type: NRG; PAM sequence: TGG
gattggaagaattttctccc

SEQ ID NO: 93195 - DNA, 20 bp, Artificial Sequence
  Description of Artificial Sequence: Synthetic oligonucleotide
  Target: ATXN1; (-) strand; PAM type: NRG; PAM sequence: AAG
tgtgtggattgttggattgg

SEQ ID NO: 93196 - DNA, 20 bp, Artificial Sequence
  Description of Artificial Sequence: Synthetic oligonucleotide
  Target: ATXN1; (-) strand; PAM type: NRG; PAM sequence: TGG
gaatgtgtggattgttggat

SEQ ID NO: 93197 - DNA, 20 bp, Artificial Sequence
  Description of Artificial Sequence: Synthetic oligonucleotide
  Target: ATXN1; (-) strand; PAM type: NRG; PAM sequence: TGG
tgtaggaatgtgtggattgt

SEQ ID NO: 93198 - DNA, 20 bp, Artificial Sequence
  Description of Artificial Sequence: Synthetic oligonucleotide
  Target: ATXN1; (-) strand; PAM type: NRG; PAM sequence: TGG
tggttttgtgtaggaatgtg

SEQ ID NO: 93199 - DNA, 20 bp, Artificial Sequence
  Description of Artificial Sequence: Synthetic oligonucleotide
  Target: ATXN1; (-) strand; PAM type: NRG; PAM sequence: AGG
tcaagtgattggttttgtgt

SEQ ID NO: 93200 - DNA, 20 bp, Artificial Sequence
  Description of Artificial Sequence: Synthetic oligonucleotide
  Target: ATXN1; (-) strand; PAM type: NRG; PAM sequence: TAG
ctcaagtgattggttttgtg

SEQ ID NO: 93201 - DNA, 20 bp, Artificial Sequence
  Description of Artificial Sequence: Synthetic oligonucleotide
  Target: ATXN1; (-) strand; PAM type: NRG; PAM sequence: TGG
cttttaaatactcaagtgat

SEQ ID NO: 93202 - DNA, 20 bp, Artificial Sequence
  Description of Artificial Sequence: Synthetic oligonucleotide
  Target: ATXN1; (-) strand; PAM type: NRG; PAM sequence: AAG
gatctagcttttaaatactc

SEQ ID NO: 93203 - DNA, 20 bp, Artificial Sequence
  Description of Artificial Sequence: Synthetic oligonucleotide
  Target: ATXN1; (-) strand; PAM type: NRG; PAM sequence: TAG
cctgtctctcgccacagatc

SEQ ID NO: 93204 - DNA, 20 bp, Artificial Sequence
  Description of Artificial Sequence: Synthetic oligonucleotide
  Target: ATXN1; (-) strand; PAM type: NRG; PAM sequence: CAG
ttctagcctgtctctcgcca

SEQ ID NO: 93205 - DNA, 20 bp, Artificial Sequence
  Description of Artificial Sequence: Synthetic oligonucleotide
  Target: ATXN1; (-) strand; PAM type: NRG; PAM sequence: TAG
agacttgtttgtgctagttc

SEQ ID NO: 93206 - DNA, 20 bp, Artificial Sequence
  Description of Artificial Sequence: Synthetic oligonucleotide
  Target: ATXN1; (-) strand; PAM type: NRG; PAM sequence: TAG
ttgcacagacttgtttgtgc

SEQ ID NO: 93207 - DNA, 20 bp, Artificial Sequence
  Description of Artificial Sequence: Synthetic oligonucleotide
  Target: ATXN1; (-) strand; PAM type: NRG; PAM sequence: CAG
gaggataaattcatcttgca

SEQ ID NO: 93208 - DNA, 20 bp, Artificial Sequence
  Description of Artificial Sequence: Synthetic oligonucleotide
  Target: ATXN1; (-) strand; PAM type: NRG; PAM sequence: AGG
acctggagtagaggcagtgg

SEQ ID NO: 93209 - DNA, 20 bp, Artificial Sequence
  Description of Artificial Sequence: Synthetic oligonucleotide
  Target: ATXN1; (-) strand; PAM type: NRG; PAM sequence: GAG
gacctggagtagaggcagtg

SEQ ID NO: 93210 - DNA, 20 bp, Artificial Sequence
  Description of Artificial Sequence: Synthetic oligonucleotide
  Target: ATXN1; (-) strand; PAM type: NRG; PAM sequence: TGG
atgacctggagtagaggcag

SEQ ID NO: 93211 - DNA, 20 bp, Artificial Sequence
  Description of Artificial Sequence: Synthetic oligonucleotide
  Target: ATXN1; (-) strand; PAM type: NRG; PAM sequence: CAG
gggatgacctggagtagagg

SEQ ID NO: 93212 - DNA, 20 bp, Artificial Sequence
  Description of Artificial Sequence: Synthetic oligonucleotide
  Target: ATXN1; (-) strand; PAM type: NRG; PAM sequence: AGG
cctgggatgacctggagtag

SEQ ID NO: 93213 - DNA, 20 bp, Artificial Sequence
  Description of Artificial Sequence: Synthetic oligonucleotide
  Target: ATXN1; (-) strand; PAM type: NRG; PAM sequence: GAG
tcctgggatgacctggagta

SEQ ID NO: 93214 - DNA, 20 bp, Artificial Sequence
  Description of Artificial Sequence: Synthetic oligonucleotide
  Target: ATXN1; (-) strand; PAM type: NRG; PAM sequence: TAG
agtcctgggatgacctggag

SEQ ID NO: 93215 - DNA, 20 bp, Artificial Sequence
  Description of Artificial Sequence: Synthetic oligonucleotide
  Target: ATXN1; (-) strand; PAM type: NRG; PAM sequence: GAG
catagtcctgggatgacctg

SEQ ID NO: 93216 - DNA, 20 bp, Artificial Sequence
  Description of Artificial Sequence: Synthetic oligonucleotide
  Target: ATXN1; (-) strand; PAM type: NRG; PAM sequence: TGG
ggcatagtcctgggatgacc

SEQ ID NO: 93217 - DNA, 20 bp, Artificial Sequence
  Description of Artificial Sequence: Synthetic oligonucleotide
  Target: ATXN1; (-) strand; PAM type: NRG; PAM sequence: GGG
tagctcacaggcatagtcct

SEQ ID NO: 93218 - DNA, 20 bp, Artificial Sequence
  Description of Artificial Sequence: Synthetic oligonucleotide
  Target: ATXN1; (-) strand; PAM type: NRG; PAM sequence: TGG
ttagctcacaggcatagtcc

SEQ ID NO: 93219 - DNA, 20 bp, Artificial Sequence
  Description of Artificial Sequence: Synthetic oligonucleotide
  Target: ATXN1; (-) strand; PAM type: NRG; PAM sequence: TAG
ttggcattagctcacaggca

SEQ ID NO: 93220 - DNA, 20 bp, Artificial Sequence
  Description of Artificial Sequence: Synthetic oligonucleotide
  Target: ATXN1; (-) strand; PAM type: NRG; PAM sequence: AGG
ccatcttggcattagctcac

SEQ ID NO: 93221 - DNA, 20 bp, Artificial Sequence
  Description of Artificial Sequence: Synthetic oligonucleotide
  Target: ATXN1; (-) strand; PAM type: NRG; PAM sequence: CAG
tccatcttggcattagctca

SEQ ID NO: 93222 - DNA, 20 bp, Artificial Sequence
  Description of Artificial Sequence: Synthetic oligonucleotide
  Target: ATXN1; (-) strand; PAM type: NRG; PAM sequence: TAG
ttttttttccatcttggcat

SEQ ID NO: 93223 - DNA, 20 bp, Artificial Sequence
  Description of Artificial Sequence: Synthetic oligonucleotide
  Target: ATXN1; (-) strand; PAM type: NRG; PAM sequence: TGG
catccattttttttccatct

SEQ ID NO: 93224 - DNA, 20 bp, Artificial Sequence
  Description of Artificial Sequence: Synthetic oligonucleotide
  Target: ATXN1; (-) strand; PAM type: NRG; PAM sequence: AGG
acacaaatacactagaaaaa

SEQ ID NO: 93225 - DNA, 20 bp, Artificial Sequence
  Description of Artificial Sequence: Synthetic oligonucleotide
  Target: ATXN1; (-) strand; PAM type: NRG; PAM sequence: AAG
tacacaaatacactagaaaa

SEQ ID NO: 93226 - DNA, 20 bp, Artificial Sequence
  Description of Artificial Sequence: Synthetic oligonucleotide
  Target: ATXN1; (-) strand; PAM type: NRG; PAM sequence: TAG
gagtctttacacaaatacac

SEQ ID NO: 93227 - DNA, 20 bp, Artificial Sequence
  Description of Artificial Sequence: Synthetic oligonucleotide
  Target: ATXN1; (-) strand; PAM type: NRG; PAM sequence: GAG
ctccctcttgagctcttggg

SEQ ID NO: 93228 - DNA, 20 bp, Artificial Sequence
  Description of Artificial Sequence: Synthetic oligonucleotide
  Target: ATXN1; (-) strand; PAM type: NRG; PAM sequence: GGG
aactccctcttgagctcttg

SEQ ID NO: 93229 - DNA, 20 bp, Artificial Sequence
  Description of Artificial Sequence: Synthetic oligonucleotide
  Target: ATXN1; (-) strand; PAM type: NRG; PAM sequence: GGG
caactccctcttgagctctt

SEQ ID NO: 93230 - DNA, 20 bp, Artificial Sequence
  Description of Artificial Sequence: Synthetic oligonucleotide
  Target: ATXN1; (-) strand; PAM type: NRG; PAM sequence: TGG
gcaactccctcttgagctct

SEQ ID NO: 93231 - DNA, 20 bp, Artificial Sequence
  Description of Artificial Sequence: Synthetic oligonucleotide
  Target: ATXN1; (-) strand; PAM type: NRG; PAM sequence: GAG
cagagcagcaactccctctt

SEQ ID NO: 93232 - DNA, 20 bp, Artificial Sequence
  Description of Artificial Sequence: Synthetic oligonucleotide
  Target: ATXN1; (-) strand; PAM type: NRG; PAM sequence: CAG
accttttgtcatttgcagag

SEQ ID NO: 93233 - DNA, 20 bp, Artificial Sequence
  Description of Artificial Sequence: Synthetic oligonucleotide
  Target: ATXN1; (-) strand; PAM type: NRG; PAM sequence: GAG
cacaccttttgtcatttgca

SEQ ID NO: 93234 - DNA, 20 bp, Artificial Sequence
  Description of Artificial Sequence: Synthetic oligonucleotide
  Target: ATXN1; (-) strand; PAM type: NRG; PAM sequence: CAG
tacacaccttttgtcatttg

SEQ ID NO: 93235 - DNA, 20 bp, Artificial Sequence
  Description of Artificial Sequence: Synthetic oligonucleotide
  Target: ATXN1; (-) strand; PAM type: NRG; PAM sequence: CAG
tgttctgcctgattggcttg

SEQ ID NO: 93236 - DNA, 20 bp, Artificial Sequence
  Description of Artificial Sequence: Synthetic oligonucleotide
  Target: ATXN1; (-) strand; PAM type: NRG; PAM sequence: TGG
tgttaaatgttctgcctgat

SEQ ID NO: 93237 - DNA, 20 bp, Artificial Sequence
  Description of Artificial Sequence: Synthetic oligonucleotide
  Target: ATXN1; (-) strand; PAM type: NRG; PAM sequence: AGG
aggcttagtcattaatggcc

SEQ ID NO: 93238 - DNA, 20 bp, Artificial Sequence
  Description of Artificial Sequence: Synthetic oligonucleotide
  Target: ATXN1; (-) strand; PAM type: NRG; PAM sequence: CAG
caggcttagtcattaatggc

SEQ ID NO: 93239 - DNA, 20 bp, Artificial Sequence
  Description of Artificial Sequence: Synthetic oligonucleotide
  Target: ATXN1; (-) strand; PAM type: NRG; PAM sequence: TGG
ggcgcaggcttagtcattaa

SEQ ID NO: 93240 - DNA, 20 bp, Artificial Sequence
  Description of Artificial Sequence: Synthetic oligonucleotide
  Target: ATXN1; (-) strand; PAM type: NRG; PAM sequence: TAG
cttttgagctggcgcaggct

SEQ ID NO: 93241 - DNA, 20 bp, Artificial Sequence
  Description of Artificial Sequence: Synthetic oligonucleotide
  Target: ATXN1; (-) strand; PAM type: NRG; PAM sequence: AGG
gaccgcttttgagctggcgc

SEQ ID NO: 93242 - DNA, 20 bp, Artificial Sequence
  Description of Artificial Sequence: Synthetic oligonucleotide
  Target: ATXN1; (-) strand; PAM type: NRG; PAM sequence: CAG
cgaccgcttttgagctggcg

SEQ ID NO: 93243 - DNA, 20 bp, Artificial Sequence
  Description of Artificial Sequence: Synthetic oligonucleotide
  Target: ATXN1; (-) strand; PAM type: NRG; PAM sequence: TGG
gtttccgaccgcttttgagc

SEQ ID NO: 93244 - DNA, 20 bp, Artificial Sequence
  Description of Artificial Sequence: Synthetic oligonucleotide
  Target: ATXN1; (-) strand; PAM type: NRG; PAM sequence: GAG
gtctgtttccgaccgctttt

SEQ ID NO: 93245 - DNA, 20 bp, Artificial Sequence
  Description of Artificial Sequence: Synthetic oligonucleotide
  Target: ATXN1; (-) strand; PAM type: NRG; PAM sequence: TAG
tcaatgttttagctgtccca

SEQ ID NO: 93246 - DNA, 20 bp, Artificial Sequence
  Description of Artificial Sequence: Synthetic oligonucleotide
  Target: ATXN1; (-) strand; PAM type: NRG; PAM sequence: TAG
atccctgagaatcaatgttt

SEQ ID NO: 93247 - DNA, 20 bp, Artificial Sequence
  Description of Artificial Sequence: Synthetic oligonucleotide
  Target: ATXN1; (-) strand; PAM type: NRG; PAM sequence: GAG
tcctcttggacgacatccct

SEQ ID NO: 93248 - DNA, 20 bp, Artificial Sequence
  Description of Artificial Sequence: Synthetic oligonucleotide
  Target: ATXN1; (-) strand; PAM type: NRG; PAM sequence: TGG
cagcttcagagacctcctct

SEQ ID NO: 93249 - DNA, 20 bp, Artificial Sequence
  Description of Artificial Sequence: Synthetic oligonucleotide
  Target: ATXN1; (-) strand; PAM type: NRG; PAM sequence: GAG
aaggatgacacccagcttca

SEQ ID NO: 93250 - DNA, 20 bp, Artificial Sequence
  Description of Artificial Sequence: Synthetic oligonucleotide
  Target: ATXN1; (-) strand; PAM type: NRG; PAM sequence: CAG
taaaggatgacacccagctt

SEQ ID NO: 93251 - DNA, 20 bp, Artificial Sequence
  Description of Artificial Sequence: Synthetic oligonucleotide
  Target: ATXN1; (-) strand; PAM type: NRG; PAM sequence: CAG
ccaccctaaaggatgacacc

SEQ ID NO: 93252 - DNA, 20 bp, Artificial Sequence
  Description of Artificial Sequence: Synthetic oligonucleotide
  Target: ATXN1; (-) strand; PAM type: NRG; PAM sequence: AGG
tttattctgggccaccctaa

SEQ ID NO: 93253 - DNA, 20 bp, Artificial Sequence
  Description of Artificial Sequence: Synthetic oligonucleotide
  Target: ATXN1; (-) strand; PAM type: NRG; PAM sequence: AAG
ttttattctgggccacccta

SEQ ID NO: 93254 - DNA, 20 bp, Artificial Sequence
  Description of Artificial Sequence: Synthetic oligonucleotide
  Target: ATXN1; (-) strand; PAM type: NRG; PAM sequence: GGG
atgtgtcaccattttattct

SEQ ID NO: 93255 - DNA, 20 bp, Artificial Sequence
  Description of Artificial Sequence: Synthetic oligonucleotide
  Target: ATXN1; (-) strand; PAM type: NRG; PAM sequence: TGG
aatgtgtcaccattttattc

SEQ ID NO: 93256 - DNA, 20 bp, Artificial Sequence
  Description of Artificial Sequence: Synthetic oligonucleotide
  Target: ATXN1; (-) strand; PAM type: NRG; PAM sequence: AGG
gtgtttatgaactcgccagg

SEQ ID NO: 93257 - DNA, 20 bp, Artificial Sequence
  Description of Artificial Sequence: Synthetic oligonucleotide
  Target: ATXN1; (-) strand; PAM type: NRG; PAM sequence: GAG
agtgtttatgaactcgccag

SEQ ID NO: 93258 - DNA, 20 bp, Artificial Sequence
  Description of Artificial Sequence: Synthetic oligonucleotide
  Target: ATXN1; (-) strand; PAM type: NRG; PAM sequence: AGG
aaagtgtttatgaactcgcc

SEQ ID NO: 93259 - DNA, 20 bp, Artificial Sequence
  Description of Artificial Sequence: Synthetic oligonucleotide
  Target: ATXN1; (-) strand; PAM type: NRG; PAM sequence: CAG
caaagtgtttatgaactcgc

SEQ ID NO: 93260 - DNA, 20 bp, Artificial Sequence
  Description of Artificial Sequence: Synthetic oligonucleotide
  Target: ATXN1; (-) strand; PAM type: NRG; PAM sequence: AAG
cttggtgtctttgccgttca

SEQ ID NO: 93261 - DNA, 20 bp, Artificial Sequence
  Description of Artificial Sequence: Synthetic oligonucleotide
  Target: ATXN1; (-) strand; PAM type: NRG; PAM sequence: TGG
cgttggaagtccccgggact

SEQ ID NO: 93262 - DNA, 20 bp, Artificial Sequence
  Description of Artificial Sequence: Synthetic oligonucleotide
  Target: ATXN1; (-) strand; PAM type: NRG; PAM sequence: GGG
gatcttcgttggaagtcccc

SEQ ID NO: 93263 - DNA, 20 bp, Artificial Sequence
  Description of Artificial Sequence: Synthetic oligonucleotide
  Target: ATXN1; (-) strand; PAM type: NRG; PAM sequence: CGG
agatcttcgttggaagtccc

SEQ ID NO: 93264 - DNA, 20 bp, Artificial Sequence
  Description of Artificial Sequence: Synthetic oligonucleotide
  Target: ATXN1; (-) strand; PAM type: NRG; PAM sequence: AAG
tgccccaagatcttcgttgg

SEQ ID NO: 93265 - DNA, 20 bp, Artificial Sequence
  Description of Artificial Sequence: Synthetic oligonucleotide
  Target: ATXN1; (-) strand; PAM type: NRG; PAM sequence: TGG
tcttgccccaagatcttcgt

SEQ ID NO: 93266 - DNA, 20 bp, Artificial Sequence
  Description of Artificial Sequence: Synthetic oligonucleotide
  Target: ATXN1; (-) strand; PAM type: NRG; PAM sequence: AAG
tggacatctcttcttgcccc

SEQ ID NO: 93267 - DNA, 20 bp, Artificial Sequence
  Description of Artificial Sequence: Synthetic oligonucleotide
  Target: ATXN1; (-) strand; PAM type: NRG; PAM sequence: TGG
cacagaacagaaagtgctgg

SEQ ID NO: 93268 - DNA, 20 bp, Artificial Sequence
  Description of Artificial Sequence: Synthetic oligonucleotide
  Target: ATXN1; (-) strand; PAM type: NRG; PAM sequence: TGG
ggtcacagaacagaaagtgc

SEQ ID NO: 93269 - DNA, 20 bp, Artificial Sequence
  Description of Artificial Sequence: Synthetic oligonucleotide
  Target: ATXN1; (-) strand; PAM type: NRG; PAM sequence: AAG
ctaacaggtcacagaacaga

SEQ ID NO: 93270 - DNA, 20 bp, Artificial Sequence
  Description of Artificial Sequence: Synthetic oligonucleotide
  Target: ATXN1; (-) strand; PAM type: NRG; PAM sequence: CAG
ctctctaacaggtcacagaa

SEQ ID NO: 93271 - DNA, 20 bp, Artificial Sequence
  Description of Artificial Sequence: Synthetic oligonucleotide
  Target: ATXN1; (-) strand; PAM type: NRG; PAM sequence: CAG
tgtttctctctaacaggtca

SEQ ID NO: 93272 - DNA, 20 bp, Artificial Sequence
  Description of Artificial Sequence: Synthetic oligonucleotide
  Target: ATXN1; (-) strand; PAM type: NRG; PAM sequence: AGG
taagaatgtttctctctaac

SEQ ID NO: 93273 - DNA, 20 bp, Artificial Sequence
  Description of Artificial Sequence: Synthetic oligonucleotide
  Target: ATXN1; (-) strand; PAM type: NRG; PAM sequence: CAG
ctaagaatgtttctctctaa

SEQ ID NO: 93274 - DNA, 20 bp, Artificial Sequence
  Description of Artificial Sequence: Synthetic oligonucleotide
  Target: ATXN1; (-) strand; PAM type: NRG; PAM sequence: AAG
tgcttggtgatggagtagct

SEQ ID NO: 93275 - DNA, 20 bp, Artificial Sequence
  Description of Artificial Sequence: Synthetic oligonucleotide
  Target: ATXN1; (-) strand; PAM type: NRG; PAM sequence: TAG
acttttgcttggtgatggag

SEQ ID NO: 93276 - DNA, 20 bp, Artificial Sequence
  Description of Artificial Sequence: Synthetic oligonucleotide
  Target: ATXN1; (-) strand; PAM type: NRG; PAM sequence: GAG
gggacttttgcttggtgatg

SEQ ID NO: 93277 - DNA, 20 bp, Artificial Sequence
  Description of Artificial Sequence: Synthetic oligonucleotide
  Target: ATXN1; (-) strand; PAM type: NRG; PAM sequence: TGG
cagggacttttgcttggtga

SEQ ID NO: 93278 - DNA, 20 bp, Artificial Sequence
  Description of Artificial Sequence: Synthetic oligonucleotide
  Target: ATXN1; (-) strand; PAM type: NRG; PAM sequence: TGG
gcctggcagggacttttgct

SEQ ID NO: 93279 - DNA, 20 bp, Artificial Sequence
  Description of Artificial Sequence: Synthetic oligonucleotide
  Target: ATXN1; (-) strand; PAM type: NRG; PAM sequence: GGG
caaggagatacagcctggca

SEQ ID NO: 93280 - DNA, 20 bp, Artificial Sequence
  Description of Artificial Sequence: Synthetic oligonucleotide
  Target: ATXN1; (-) strand; PAM type: NRG; PAM sequence: AGG
tcaaggagatacagcctggc

SEQ ID NO: 93281 - DNA, 20 bp, Artificial Sequence
  Description of Artificial Sequence: Synthetic oligonucleotide
  Target: ATXN1; (-) strand; PAM type: NRG; PAM sequence: CAG
gtcaaggagatacagcctgg

SEQ ID NO: 93282 - DNA, 20 bp, Artificial Sequence
  Description of Artificial Sequence: Synthetic oligonucleotide
  Target: ATXN1; (-) strand; PAM type: NRG; PAM sequence: TGG
ggagtcaaggagatacagcc

SEQ ID NO: 93283 - DNA, 20 bp, Artificial Sequence
  Description of Artificial Sequence: Synthetic oligonucleotide
  Target: ATXN1; (-) strand; PAM type: NRG; PAM sequence: CAG
ccccaggagtcaaggagata

SEQ ID NO: 93284 - DNA, 20 bp, Artificial Sequence
  Description of Artificial Sequence: Synthetic oligonucleotide
  Target: ATXN1; (-) strand; PAM type: NRG; PAM sequence: GAG
cttttcccccaggagtcaag

SEQ ID NO: 93285 - DNA, 20 bp, Artificial Sequence
  Description of Artificial Sequence: Synthetic oligonucleotide
  Target: ATXN1; (-) strand; PAM type: NRG; PAM sequence: AGG
agcttttcccccaggagtca

SEQ ID NO: 93286 - DNA, 20 bp, Artificial Sequence
  Description of Artificial Sequence: Synthetic oligonucleotide
  Target: ATXN1; (-) strand; PAM type: NRG; PAM sequence: AAG
cagcttttcccccaggagtc

SEQ ID NO: 93287 - DNA, 20 bp, Artificial Sequence
  Description of Artificial Sequence: Synthetic oligonucleotide
  Target: ATXN1; (-) strand; PAM type: NRG; PAM sequence: GAG
ctttacagcttttcccccag

SEQ ID NO: 93288 - DNA, 20 bp, Artificial Sequence
  Description of Artificial Sequence: Synthetic oligonucleotide
  Target: ATXN1; (-) strand; PAM type: NRG; PAM sequence: AGG
ctctttacagcttttccccc

SEQ ID NO: 93289 - DNA, 20 bp, Artificial Sequence
  Description of Artificial Sequence: Synthetic oligonucleotide
  Target: ATXN1; (-) strand; PAM type: NRG; PAM sequence: CAG
tctctttacagcttttcccc

SEQ ID NO: 93290 - DNA, 20 bp, Artificial Sequence
  Description of Artificial Sequence: Synthetic oligonucleotide
  Target: ATXN1; (-) strand; PAM type: NRG; PAM sequence: CAG
tgccctcctcaatctcttta

SEQ ID NO: 93291 - DNA, 20 bp, Artificial Sequence
  Description of Artificial Sequence: Synthetic oligonucleotide
  Target: ATXN1; (-) strand; PAM type: NRG; PAM sequence: AGG
aggccatctatctctctctt

SEQ ID NO: 93292 - DNA, 20 bp, Artificial Sequence
  Description of Artificial Sequence: Synthetic oligonucleotide
  Target: ATXN1; (-) strand; PAM type: NRG; PAM sequence: TAG
aaggccatctatctctctct

SEQ ID NO: 93293 - DNA, 20 bp, Artificial Sequence
  Description of Artificial Sequence: Synthetic oligonucleotide
  Target: ATXN1; (-) strand; PAM type: NRG; PAM sequence: AGG
tgaaactgcaaacaagacaa

SEQ ID NO: 93294 - DNA, 20 bp, Artificial Sequence
  Description of Artificial Sequence: Synthetic oligonucleotide
  Target: ATXN1; (-) strand; PAM type: NRG; PAM sequence: AAG
gtgaaactgcaaacaagaca

SEQ ID NO: 93295 - DNA, 20 bp, Artificial Sequence
  Description of Artificial Sequence: Synthetic oligonucleotide
  Target: ATXN1; (-) strand; PAM type: NRG; PAM sequence: AAG
tcattagtgaaactgcaaac

SEQ ID NO: 93296 - DNA, 20 bp, Artificial Sequence
  Description of Artificial Sequence: Synthetic oligonucleotide
  Target: ATXN1; (-) strand; PAM type: NRG; PAM sequence: TAG
tttatatctggaaacctcat

SEQ ID NO: 93297 - DNA, 20 bp, Artificial Sequence
  Description of Artificial Sequence: Synthetic oligonucleotide
  Target: ATXN1; (-) strand; PAM type: NRG; PAM sequence: TGG
cagaagccagattttatatc

SEQ ID NO: 93298 - DNA, 20 bp, Artificial Sequence
  Description of Artificial Sequence: Synthetic oligonucleotide
  Target: ATXN1; (-) strand; PAM type: NRG; PAM sequence: CAG
catttagacttgacagaagc

SEQ ID NO: 93299 - DNA, 20 bp, Artificial Sequence
  Description of Artificial Sequence: Synthetic oligonucleotide
  Target: ATXN1; (-) strand; PAM type: NRG; PAM sequence: AAG
ttcacatttagacttgacag

SEQ ID NO: 93300 - DNA, 20 bp, Artificial Sequence
  Description of Artificial Sequence: Synthetic oligonucleotide
  Target: ATXN1; (-) strand; PAM type: NRG; PAM sequence: CAG
tgattcacatttagacttga

SEQ ID NO: 93301 - DNA, 20 bp, Artificial Sequence
  Description of Artificial Sequence: Synthetic oligonucleotide
  Target: ATXN1; (-) strand; PAM type: NRG; PAM sequence: TAG
ctcagaatctgattcacatt

SEQ ID NO: 93302 - DNA, 20 bp, Artificial Sequence
  Description of Artificial Sequence: Synthetic oligonucleotide
  Target: ATXN1; (-) strand; PAM type: NRG; PAM sequence: CAG
ttgttagttgcagaaatact

SEQ ID NO: 93303 - DNA, 20 bp, Artificial Sequence
  Description of Artificial Sequence: Synthetic oligonucleotide
  Target: ATXN1; (-) strand; PAM type: NRG; PAM sequence: CAG
ggtgaccatattgttagttg

SEQ ID NO: 93304 - DNA, 20 bp, Artificial Sequence
  Description of Artificial Sequence: Synthetic oligonucleotide
  Target: ATXN1; (-) strand; PAM type: NRG; PAM sequence: TAG
tttgctggtgaccatattgt

SEQ ID NO: 93305 - DNA, 20 bp, Artificial Sequence
  Description of Artificial Sequence: Synthetic oligonucleotide
  Target: ATXN1; (-) strand; PAM type: NRG; PAM sequence: TGG
tctttgcagaagtagtttgc

SEQ ID NO: 93306 - DNA, 20 bp, Artificial Sequence
  Description of Artificial Sequence: Synthetic oligonucleotide
  Target: ATXN1; (-) strand; PAM type: NRG; PAM sequence: TAG
cttttctttctttgcagaag

SEQ ID NO: 93307 - DNA, 20 bp, Artificial Sequence
  Description of Artificial Sequence: Synthetic oligonucleotide
  Target: ATXN1; (-) strand; PAM type: NRG; PAM sequence: AAG
agccttttctttctttgcag

SEQ ID NO: 93308 - DNA, 20 bp, Artificial Sequence
  Description of Artificial Sequence: Synthetic oligonucleotide
  Target: ATXN1; (-) strand; PAM type: NRG; PAM sequence: CAG
tgaagccttttctttctttg

SEQ ID NO: 93309 - DNA, 20 bp, Artificial Sequence
  Description of Artificial Sequence: Synthetic oligonucleotide
  Target: ATXN1; (-) strand; PAM type: NRG; PAM sequence: AAG
cagaagcaataactattatg

SEQ ID NO: 93310 - DNA, 20 bp, Artificial Sequence
  Description of Artificial Sequence: Synthetic oligonucleotide
  Target: ATXN1; (-) strand; PAM type: NRG; PAM sequence: AAG
tgtccatctcttggtgccag

SEQ ID NO: 93311 - DNA, 20 bp, Artificial Sequence
  Description of Artificial Sequence: Synthetic oligonucleotide
  Target: ATXN1; (-) strand; PAM type: NRG; PAM sequence: CAG
cactgtccatctcttggtgc

SEQ ID NO: 93312 - DNA, 20 bp, Artificial Sequence
  Description of Artificial Sequence: Synthetic oligonucleotide
  Target: ATXN1; (-) strand; PAM type: NRG; PAM sequence: TGG
aaaatacactgtccatctct

SEQ ID NO: 93313 - DNA, 20 bp, Artificial Sequence
  Description of Artificial Sequence: Synthetic oligonucleotide
  Target: ATXN1; (-) strand; PAM type: NRG; PAM sequence: TAG
acatctagtggctaatcttt

SEQ ID NO: 93314 - DNA, 20 bp, Artificial Sequence
  Description of Artificial Sequence: Synthetic oligonucleotide
  Target: ATXN1; (-) strand; PAM type: NRG; PAM sequence: TGG
tctactgttacaacatctag

SEQ ID NO: 93315 - DNA, 20 bp, Artificial Sequence
  Description of Artificial Sequence: Synthetic oligonucleotide
  Target: ATXN1; (-) strand; PAM type: NRG; PAM sequence: TAG
gtatctactgttacaacatc

SEQ ID NO: 93316 - DNA, 20 bp, Artificial Sequence
  Description of Artificial Sequence: Synthetic oligonucleotide
  Target: ATXN1; (-) strand; PAM type: NRG; PAM sequence: AAG
gagttacttccccaataatt

SEQ ID NO: 93317 - DNA, 20 bp, Artificial Sequence
  Description of Artificial Sequence: Synthetic oligonucleotide
  Target: ATXN1; (-) strand; PAM type: NRG; PAM sequence: GAG
tttgtatctgcaaaaaccat

SEQ ID NO: 93318 - DNA, 20 bp, Artificial Sequence
  Description of Artificial Sequence: Synthetic oligonucleotide
  Target: ATXN1; (-) strand; PAM type: NRG; PAM sequence: TGG
aggcaagaaggagctggtgc

SEQ ID NO: 93319 - DNA, 20 bp, Artificial Sequence
  Description of Artificial Sequence: Synthetic oligonucleotide
  Target: ATXN1; (-) strand; PAM type: NRG; PAM sequence: TGG
tctgctaggcaagaaggagc

SEQ ID NO: 93320 - DNA, 20 bp, Artificial Sequence
  Description of Artificial Sequence: Synthetic oligonucleotide
  Target: ATXN1; (-) strand; PAM type: NRG; PAM sequence: GAG
ttattctgctaggcaagaag

SEQ ID NO: 93321 - DNA, 20 bp, Artificial Sequence
  Description of Artificial Sequence: Synthetic oligonucleotide
  Target: ATXN1; (-) strand; PAM type: NRG; PAM sequence: AGG
ctttattctgctaggcaaga

SEQ ID NO: 93322 - DNA, 20 bp, Artificial Sequence
  Description of Artificial Sequence: Synthetic oligonucleotide
  Target: ATXN1; (-) strand; PAM type: NRG; PAM sequence: AAG
gctttattctgctaggcaag

SEQ ID NO: 93323 - DNA, 20 bp, Artificial Sequence
  Description of Artificial Sequence: Synthetic oligonucleotide
  Target: ATXN1; (-) strand; PAM type: NRG; PAM sequence: AAG
tcagctttattctgctaggc

SEQ ID NO: 93324 - DNA, 20 bp, Artificial Sequence
  Description of Artificial Sequence: Synthetic oligonucleotide
  Target: ATXN1; (-) strand; PAM type: NRG; PAM sequence: AGG
tgaatcagctttattctgct

SEQ ID NO: 93325 - DNA, 20 bp, Artificial Sequence
  Description of Artificial Sequence: Synthetic oligonucleotide
  Target: ATXN1; (-) strand; PAM type: NRG; PAM sequence: TAG
gtgaatcagctttattctgc

SEQ ID NO: 93326 - DNA, 20 bp, Artificial Sequence
  Description of Artificial Sequence: Synthetic oligonucleotide
  Target: ATXN1; (-) strand; PAM type: NRG; PAM sequence: CAG
tcttccagccacctgtgaat

SEQ ID NO: 93327 - DNA, 20 bp, Artificial Sequence
  Description of Artificial Sequence: Synthetic oligonucleotide
  Target: ATXN1; (-) strand; PAM type: NRG; PAM sequence: CAG
gagattagaagaagctcttc

SEQ ID NO: 93328 - DNA, 20 bp, Artificial Sequence
  Description of Artificial Sequence: Synthetic oligonucleotide
  Target: ATXN1; (-) strand; PAM type: NRG; PAM sequence: AAG
gttacagaagagattagaag

SEQ ID NO: 93329 - DNA, 20 bp, Artificial Sequence
  Description of Artificial Sequence: Synthetic oligonucleotide
  Target: ATXN1; (-) strand; PAM type: NRG; PAM sequence: AAG
gatgttacagaagagattag

SEQ ID NO: 93330 - DNA, 20 bp, Artificial Sequence
  Description of Artificial Sequence: Synthetic oligonucleotide
  Target: ATXN1; (-) strand; PAM type: NRG; PAM sequence: TAG
ctagatgttacagaagagat

SEQ ID NO: 93331 - DNA, 20 bp, Artificial Sequence
  Description of Artificial Sequence: Synthetic oligonucleotide
  Target: ATXN1; (-) strand; PAM type: NRG; PAM sequence: GAG
ttctactagatgttacagaa

SEQ ID NO: 93332 - DNA, 20 bp, Artificial Sequence
  Description of Artificial Sequence: Synthetic oligonucleotide
  Target: ATXN1; (-) strand; PAM type: NRG; PAM sequence: AAG
ctttctactagatgttacag

SEQ ID NO: 93333 - DNA, 20 bp, Artificial Sequence
  Description of Artificial Sequence: Synthetic oligonucleotide
  Target: ATXN1; (-) strand; PAM type: NRG; PAM sequence: CAG
tgtctttctactagatgtta

SEQ ID NO: 93334 - DNA, 20 bp, Artificial Sequence
  Description of Artificial Sequence: Synthetic oligonucleotide
  Target: ATXN1; (-) strand; PAM type: NRG; PAM sequence: TAG
ggtatctgctgtctttctac

SEQ ID NO: 93335 - DNA, 20 bp, Artificial Sequence
  Description of Artificial Sequence: Synthetic oligonucleotide
  Target: ATXN1; (-) strand; PAM type: NRG; PAM sequence: AGG
atcagatcatttctctgtgt

SEQ ID NO: 93336 - DNA, 20 bp, Artificial Sequence
  Description of Artificial Sequence: Synthetic oligonucleotide
  Target: ATXN1; (-) strand; PAM type: NRG; PAM sequence: TAG
aatcagatcatttctctgtg

SEQ ID NO: 93337 - DNA, 20 bp, Artificial Sequence
  Description of Artificial Sequence: Synthetic oligonucleotide
  Target: ATXN1; (-) strand; PAM type: NRG; PAM sequence: CAG
ggatgggaagattgtacaat

SEQ ID NO: 93338 - DNA, 20 bp, Artificial Sequence
  Description of Artificial Sequence: Synthetic oligonucleotide
  Target: ATXN1; (-) strand; PAM type: NRG; PAM sequence: AAG
gagaagtccttgtggatggg

SEQ ID NO: 93339 - DNA, 20 bp, Artificial Sequence
  Description of Artificial Sequence: Synthetic oligonucleotide
  Target: ATXN1; (-) strand; PAM type: NRG; PAM sequence: GGG
tctgagaagtccttgtggat

SEQ ID NO: 93340 - DNA, 20 bp, Artificial Sequence
  Description of Artificial Sequence: Synthetic oligonucleotide
  Target: ATXN1; (-) strand; PAM type: NRG; PAM sequence: TGG
ctctgagaagtccttgtgga

SEQ ID NO: 93341 - DNA, 20 bp, Artificial Sequence
  Description of Artificial Sequence: Synthetic oligonucleotide
  Target: ATXN1; (-) strand; PAM type: NRG; PAM sequence: TGG
tctgctctgagaagtccttg

SEQ ID NO: 93342 - DNA, 20 bp, Artificial Sequence
  Description of Artificial Sequence: Synthetic oligonucleotide
  Target: ATXN1; (-) strand; PAM type: NRG; PAM sequence: AAG
ttaatgtcatctgctctgag

SEQ ID NO: 93343 - DNA, 20 bp, Artificial Sequence
  Description of Artificial Sequence: Synthetic oligonucleotide
  Target: ATXN1; (-) strand; PAM type: NRG; PAM sequence: GAG
aatttaatgtcatctgctct

SEQ ID NO: 93344 - DNA, 20 bp, Artificial Sequence
  Description of Artificial Sequence: Synthetic oligonucleotide
  Target: ATXN1; (-) strand; PAM type: NRG; PAM sequence: TGG
aatcaaattgatctcatata

SEQ ID NO: 93345 - DNA, 20 bp, Artificial Sequence
  Description of Artificial Sequence: Synthetic oligonucleotide
  Target: ATXN1; (-) strand; PAM type: NRG; PAM sequence: AGG
acagcaaggttgaaaacatc

SEQ ID NO: 93346 - DNA, 20 bp, Artificial Sequence
  Description of Artificial Sequence: Synthetic oligonucleotide
  Target: ATXN1; (-) strand; PAM type: NRG; PAM sequence: CAG
gacagcaaggttgaaaacat

SEQ ID NO: 93347 - DNA, 20 bp, Artificial Sequence
  Description of Artificial Sequence: Synthetic oligonucleotide
  Target: ATXN1; (-) strand; PAM type: NRG; PAM sequence: AGG
ttaatgcacccatgacagca

SEQ ID NO: 93348 - DNA, 20 bp, Artificial Sequence
  Description of Artificial Sequence: Synthetic oligonucleotide
  Target: ATXN1; (-) strand; PAM type: NRG; PAM sequence: AAG
tttaatgcacccatgacagc

SEQ ID NO: 93349 - DNA, 20 bp, Artificial Sequence
  Description of Artificial Sequence: Synthetic oligonucleotide
  Target: ATXN1; (-) strand; PAM type: NRG; PAM sequence: CAG
ttcctttaatgcacccatga

SEQ ID NO: 93350 - DNA, 20 bp, Artificial Sequence
  Description of Artificial Sequence: Synthetic oligonucleotide
  Target: ATXN1; (-) strand; PAM type: NRG; PAM sequence: AGG
ctttaaagttgagctttttg

SEQ ID NO: 93351 - DNA, 20 bp, Artificial Sequence
  Description of Artificial Sequence: Synthetic oligonucleotide
  Target: ATXN1; (-) strand; PAM type: NRG; PAM sequence: GAG
cctttaaagttgagcttttt

SEQ ID NO: 93352 - DNA, 20 bp, Artificial Sequence
  Description of Artificial Sequence: Synthetic oligonucleotide
  Target: ATXN1; (-) strand; PAM type: NRG; PAM sequence: GAG
gccactgcacctttaaagtt

SEQ ID NO: 93353 - DNA, 20 bp, Artificial Sequence
  Description of Artificial Sequence: Synthetic oligonucleotide
  Target: ATXN1; (-) strand; PAM type: NRG; PAM sequence: AAG
ttgcagccactgcaccttta

SEQ ID NO: 93354 - DNA, 20 bp, Artificial Sequence
  Description of Artificial Sequence: Synthetic oligonucleotide
  Target: ATXN1; (-) strand; PAM type: NRG; PAM sequence: CAG
agagaatgattttcattttg

SEQ ID NO: 93355 - DNA, 20 bp, Artificial Sequence
  Description of Artificial Sequence: Synthetic oligonucleotide
  Target: ATXN1; (-) strand; PAM type: NRG; PAM sequence: GAG
ctaaacttgatggataaaca

SEQ ID NO: 93356 - DNA, 20 bp, Artificial Sequence
  Description of Artificial Sequence: Synthetic oligonucleotide
  Target: ATXN1; (-) strand; PAM type: NRG; PAM sequence: CAG
gcctaaacttgatggataaa

SEQ ID NO: 93357 - DNA, 20 bp, Artificial Sequence
  Description of Artificial Sequence: Synthetic oligonucleotide
  Target: ATXN1; (-) strand; PAM type: NRG; PAM sequence: TGG
gtgccggagcctaaacttga

SEQ ID NO: 93358 - DNA, 20 bp, Artificial Sequence
  Description of Artificial Sequence: Synthetic oligonucleotide
  Target: ATXN1; (-) strand; PAM type: NRG; PAM sequence: GAG
tagatgtttttatagtgccg

SEQ ID NO: 93359 - DNA, 20 bp, Artificial Sequence
  Description of Artificial Sequence: Synthetic oligonucleotide
  Target: ATXN1; (-) strand; PAM type: NRG; PAM sequence: CGG
gttagatgtttttatagtgc

SEQ ID NO: 93360 - DNA, 20 bp, Artificial Sequence
  Description of Artificial Sequence: Synthetic oligonucleotide
  Target: ATXN1; (-) strand; PAM type: NRG; PAM sequence: TAG
ttatatgttagatgttttta

SEQ ID NO: 93361 - DNA, 20 bp, Artificial Sequence
  Description of Artificial Sequence: Synthetic oligonucleotide
  Target: ATXN1; (-) strand; PAM type: NRG; PAM sequence: TAG
ataaataaaaaattatatgt

SEQ ID NO: 93362 - DNA, 20 bp, Artificial Sequence
  Description of Artificial Sequence: Synthetic oligonucleotide
  Target: ATXN1; (-) strand; PAM type: NRG; PAM sequence: GAG
accagcctgggccacagagt

SEQ ID NO: 93363 - DNA, 20 bp, Artificial Sequence
  Description of Artificial Sequence: Synthetic oligonucleotide
  Target: ATXN1; (-) strand; PAM type: NRG; PAM sequence: GAG
caagaccagcctgggccaca

SEQ ID NO: 93364 - DNA, 20 bp, Artificial Sequence
  Description of Artificial Sequence: Synthetic oligonucleotide
  Target: ATXN1; (-) strand; PAM type: NRG; PAM sequence: CAG
ttcaagaccagcctgggcca

SEQ ID NO: 93365 - DNA, 20 bp, Artificial Sequence
  Description of Artificial Sequence: Synthetic oligonucleotide
  Target: ATXN1; (-) strand; PAM type: NRG; PAM sequence: GGG
taggagttcaagaccagcct

SEQ ID NO: 93366 - DNA, 20 bp, Artificial Sequence
  Description of Artificial Sequence: Synthetic oligonucleotide
  Target: ATXN1; (-) strand; PAM type: NRG; PAM sequence: TGG
ctaggagttcaagaccagcc

SEQ ID NO: 93367 - DNA, 20 bp, Artificial Sequence
  Description of Artificial Sequence: Synthetic oligonucleotide
  Target: ATXN1; (-) strand; PAM type: NRG; PAM sequence: CAG
tgaggctaggagttcaagac

SEQ ID NO: 93368 - DNA, 20 bp, Artificial Sequence
  Description of Artificial Sequence: Synthetic oligonucleotide
  Target: ATXN1; (-) strand; PAM type: NRG; PAM sequence: AAG
tcgcctgaggctaggagttc

SEQ ID NO: 93369 - DNA, 20 bp, Artificial Sequence
  Description of Artificial Sequence: Synthetic oligonucleotide
  Target: ATXN1; (-) strand; PAM type: NRG; PAM sequence: GAG
gtgggatcgcctgaggctag

SEQ ID NO: 93370 - DNA, 20 bp, Artificial Sequence
  Description of Artificial Sequence: Synthetic oligonucleotide
  Target: ATXN1; (-) strand; PAM type: NRG; PAM sequence: AGG
cggtgggatcgcctgaggct

SEQ ID NO: 93371 - DNA, 20 bp, Artificial Sequence
  Description of Artificial Sequence: Synthetic oligonucleotide
  Target: ATXN1; (-) strand; PAM type: NRG; PAM sequence: TAG
gcggtgggatcgcctgaggc

SEQ ID NO: 93372 - DNA, 20 bp, Artificial Sequence
  Description of Artificial Sequence: Synthetic oligonucleotide
  Target: ATXN1; (-) strand; PAM type: NRG; PAM sequence: AGG
caaggcggtgggatcgcctg

SEQ ID NO: 93373 - DNA, 20 bp, Artificial Sequence
  Description of Artificial Sequence: Synthetic oligonucleotide
  Target: ATXN1; (-) strand; PAM type: NRG; PAM sequence: GAG
ccaaggcggtgggatcgcct

SEQ ID NO: 93374 - DNA, 20 bp, Artificial Sequence
  Description of Artificial Sequence: Synthetic oligonucleotide
  Target: ATXN1; (-) strand; PAM type: NRG; PAM sequence: GGG
ctttgggaggccaaggcggt

SEQ ID NO: 93375 - DNA, 20 bp, Artificial Sequence
  Description of Artificial Sequence: Synthetic oligonucleotide
  Target: ATXN1; (-) strand; PAM type: NRG; PAM sequence: TGG
gctttgggaggccaaggcgg

SEQ ID NO: 93376 - DNA, 20 bp, Artificial Sequence
  Description of Artificial Sequence: Synthetic oligonucleotide
  Target: ATXN1; (-) strand; PAM type: NRG; PAM sequence: CGG
agtgctttgggaggccaagg

SEQ ID NO: 93377 - DNA, 20 bp, Artificial Sequence
  Description of Artificial Sequence: Synthetic oligonucleotide
  Target: ATXN1; (-) strand; PAM type: NRG; PAM sequence: AGG
cccagtgctttgggaggcca

SEQ ID NO: 93378 - DNA, 20 bp, Artificial Sequence
  Description of Artificial Sequence: Synthetic oligonucleotide
  Target: ATXN1; (-) strand; PAM type: NRG; PAM sequence: AAG
tcccagtgctttgggaggcc

SEQ ID NO: 93379 - DNA, 20 bp, Artificial Sequence
  Description of Artificial Sequence: Synthetic oligonucleotide
  Target: ATXN1; (-) strand; PAM type: NRG; PAM sequence: AGG
tcgaatcccagtgctttggg

SEQ ID NO: 93380 - DNA, 20 bp, Artificial Sequence
  Description of Artificial Sequence: Synthetic oligonucleotide
  Target: ATXN1; (-) strand; PAM type: NRG; PAM sequence: GAG
ctcgaatcccagtgctttgg

SEQ ID NO: 93381 - DNA, 20 bp, Artificial Sequence
  Description of Artificial Sequence: Synthetic oligonucleotide
  Target: ATXN1; (-) strand; PAM type: NRG; PAM sequence: GGG
gcctcgaatcccagtgcttt

SEQ ID NO: 93382 - DNA, 20 bp, Artificial Sequence
  Description of Artificial Sequence: Synthetic oligonucleotide
  Target: ATXN1; (-) strand; PAM type: NRG; PAM sequence: TGG
tgcctcgaatcccagtgctt

SEQ ID NO: 93383 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctcgaatcc

SEQ ID NO: 93384 - DNA, 20 bp, Artificial Sequence
  Description of Artificial Sequence: Synthetic oligonucleotide
  Target: ATXN1; (-) strand; PAM type: NRG; PAM sequence: TGG
atgttagaggctgggcatgg

SEQ ID NO: 93385 - DNA, 20 bp, Artificial Sequence
  Description of Artificial Sequence: Synthetic oligonucleotide
  Target: ATXN1; (-) strand; PAM type: NRG; PAM sequence: TGG
tagatgttagaggctgggca

SEQ ID NO: 93386 - DNA, 20 bp, Artificial Sequence
  Description of Artificial Sequence: Synthetic oligonucleotide
  Target: ATXN1; (-) strand; PAM type: NRG; PAM sequence: GGG
aaatttagatgttagaggct

SEQ ID NO: 93387 - DNA, 20 bp, Artificial Sequence
  Description of Artificial Sequence: Synthetic oligonucleotide
  Target: ATXN1; (-) strand; PAM type: NRG; PAM sequence: TGG
taaatttagatgttagaggc

SEQ ID NO: 93388 - DNA, 20 bp, Artificial Sequence
  Description of Artificial Sequence: Synthetic oligonucleotide
  Target: ATXN1; (-) strand; PAM type: NRG; PAM sequence: AGG
attataaatttagatgttag

SEQ ID NO: 93389 - DNA, 20 bp, Artificial Sequence
  Description of Artificial Sequence: Synthetic oligonucleotide
  Target: ATXN1; (-) strand; PAM type: NRG; PAM sequence: GAG
cattataaatttagatgtta

SEQ ID NO: 93390 - DNA, 20 bp, Artificial Sequence
  Description of Artificial Sequence: Synthetic oligonucleotide
  Target: ATXN1; (-) strand; PAM type: NRG; PAM sequence: TAG
ttcattataaatttagatgt

SEQ ID NO: 93391 - DNA, 20 bp, Artificial Sequence
  Description of Artificial Sequence: Synthetic oligonucleotide
  Target: ATXN1; (-) strand; PAM type: NRG; PAM sequence: TAG
acagtgcttcattataaatt

SEQ ID NO: 93392 - DNA, 20 bp, Artificial Sequence
  Description of Artificial Sequence: Synthetic oligonucleotide
  Target: ATXN1; (-) strand; PAM type: NRG; PAM sequence: CAG
ttcccagttaccccttgaaa

SEQ ID NO: 93393 - DNA, 20 bp, Artificial Sequence
  Description of Artificial Sequence: Synthetic oligonucleotide
  Target: ATXN1; (-) strand; PAM type: NRG; PAM sequence: CAG
ccttgggtatgtgcaattcc

SEQ ID NO: 93394 - DNA, 20 bp, Artificial Sequence
  Description of Artificial Sequence: Synthetic oligonucleotide
  Target: ATXN1; (-) strand; PAM type: NRG; PAM sequence: GGG
atgcaagagtccaatccctt

SEQ ID NO: 93395 - DNA, 20 bp, Artificial Sequence
  Description of Artificial Sequence: Synthetic oligonucleotide
  Target: ATXN1; (-) strand; PAM type: NRG; PAM sequence: TGG
aatgcaagagtccaatccct

SEQ ID NO: 93396 - DNA, 20 bp, Artificial Sequence
  Description of Artificial Sequence: Synthetic oligonucleotide
  Target: ATXN1; (-) strand; PAM type: NRG; PAM sequence: GAG
ggaatggtgaagaaatgcaa

SEQ ID NO: 93397 - DNA, 20 bp, Artificial Sequence
  Description of Artificial Sequence: Synthetic oligonucleotide
  Target: ATXN1; (-) strand; PAM type: NRG; PAM sequence: AAG
ctggaatggtgaagaaatgc

SEQ ID NO: 93398 - DNA, 20 bp, Artificial Sequence
  Description of Artificial Sequence: Synthetic oligonucleotide
  Target: ATXN1; (-) strand; PAM type: NRG; PAM sequence: AAG
gagatggagctggaatggtg

SEQ ID NO: 93399 - DNA, 20 bp, Artificial Sequence
  Description of Artificial Sequence: Synthetic oligonucleotide
  Target: ATXN1; (-) strand; PAM type: NRG; PAM sequence: TGG
atattgagatggagctggaa

SEQ ID NO: 93400 - DNA, 20 bp, Artificial Sequence
  Description of Artificial Sequence: Synthetic oligonucleotide
  Target: ATXN1; (-) strand; PAM type: NRG; PAM sequence: TGG
gaacaatattgagatggagc

SEQ ID NO: 93401 - DNA, 20 bp, Artificial Sequence
  Description of Artificial Sequence: Synthetic oligonucleotide
  Target: ATXN1; (-) strand; PAM type: NRG; PAM sequence: GAG
cctagaacaatattgagatg

SEQ ID NO: 93402 - DNA, 20 bp, Artificial Sequence
  Description of Artificial Sequence: Synthetic oligonucleotide
  Target: ATXN1; (-) strand; PAM type: NRG; PAM sequence: TGG
cccctagaacaatattgaga

SEQ ID NO: 93403 - DNA, 20 bp, Artificial Sequence
  Description of Artificial Sequence: Synthetic oligonucleotide
  Target: ATXN1; (-) strand; PAM type: NRG; PAM sequence: GAG
tagccccctagaacaatatt

SEQ ID NO: 93404 - DNA, 20 bp, Artificial Sequence
  Description of Artificial Sequence: Synthetic oligonucleotide
  Target: ATXN1; (-) strand; PAM type: NRG; PAM sequence: TAG
gcttaactgagttagccccc

SEQ ID NO: 93405 - DNA, 20 bp, Artificial Sequence
  Description of Artificial Sequence: Synthetic oligonucleotide
  Target: ATXN1; (-) strand; PAM type: NRG; PAM sequence: TAG
atgtctttgcttaactgagt

SEQ ID NO: 93406 - DNA, 20 bp, Artificial Sequence
  Description of Artificial Sequence: Synthetic oligonucleotide
  Target: ATXN1; (-) strand; PAM type: NRG; PAM sequence: GAG
agacatgtctttgcttaact

SEQ ID NO: 93407 - DNA, 20 bp, Artificial Sequence
  Description of Artificial Sequence: Synthetic oligonucleotide
  Target: ATXN1; (-) strand; PAM type: NRG; PAM sequence: AAG
ttccgaagttgtaggatgaa

SEQ ID NO: 93408 - DNA, 20 bp, Artificial Sequence
  Description of Artificial Sequence: Synthetic oligonucleotide
  Target: ATXN1; (-) strand; PAM type: NRG; PAM sequence: AGG
atttgcgtttccgaagttgt

SEQ ID NO: 93409 - DNA, 20 bp, Artificial Sequence
  Description of Artificial Sequence: Synthetic oligonucleotide
  Target: ATXN1; (-) strand; PAM type: NRG; PAM sequence: TAG
tatttgcgtttccgaagttg

SEQ ID NO: 93410 - DNA, 20 bp, Artificial Sequence
  Description of Artificial Sequence: Synthetic oligonucleotide
  Target: ATXN1; (-) strand; PAM type: NRG; PAM sequence: AAG
agaaattatttgcgtttccg

SEQ ID NO: 93411 - DNA, 20 bp, Artificial Sequence
  Description of Artificial Sequence: Synthetic oligonucleotide
  Target: ATXN1; (-) strand; PAM type: NRG; PAM sequence: CAG
cttgtacagccaagataccc

SEQ ID NO: 93412 - DNA, 20 bp, Artificial Sequence
  Description of Artificial Sequence: Synthetic oligonucleotide
  Target: ATXN1; (-) strand; PAM type: NRG; PAM sequence: AAG
ctccatctccttgtacagcc

SEQ ID NO: 93413 - DNA, 20 bp, Artificial Sequence
  Description of Artificial Sequence: Synthetic oligonucleotide
  Target: ATXN1; (-) strand; PAM type: NRG; PAM sequence: CAG
ctcttctccatctccttgta

SEQ ID NO: 93414 - DNA, 20 bp, Artificial Sequence
  Description of Artificial Sequence: Synthetic oligonucleotide
  Target: ATXN1; (-) strand; PAM type: NRG; PAM sequence: CAG
tgattttctgacttgtagtt

SEQ ID NO: 93415 - DNA, 20 bp, Artificial Sequence
  Description of Artificial Sequence: Synthetic oligonucleotide
  Target: ATXN1; (-) strand; PAM type: NRG; PAM sequence: TAG
aaacctgattttctgacttg

SEQ ID NO: 93416 - DNA, 20 bp, Artificial Sequence
  Description of Artificial Sequence: Synthetic oligonucleotide
  Target: ATXN1; (-) strand; PAM type: NRG; PAM sequence: TAG
ccagtggttagaaatacatg

SEQ ID NO: 93417 - DNA, 20 bp, Artificial Sequence
  Description of Artificial Sequence: Synthetic oligonucleotide
  Target: ATXN1; (-) strand; PAM type: NRG; PAM sequence: TAG
atttactagattccagtggt

SEQ ID NO: 93418 - DNA, 20 bp, Artificial Sequence
  Description of Artificial Sequence: Synthetic oligonucleotide
  Target: ATXN1; (-) strand; PAM type: NRG; PAM sequence: TGG
actgatttactagattccag

SEQ ID NO: 93419 - DNA, 20 bp, Artificial Sequence
  Description of Artificial Sequence: Synthetic oligonucleotide
  Target: ATXN1; (-) strand; PAM type: NRG; PAM sequence: CAG
ttgactgatttactagattc

SEQ ID NO: 93420 - DNA, 20 bp, Artificial Sequence
  Description of Artificial Sequence: Synthetic oligonucleotide
  Target: ATXN1; (-) strand; PAM type: NRG; PAM sequence: TAG
tacgaggttgactgatttac

SEQ ID NO: 93421 - DNA, 20 bp, Artificial Sequence
  Description of Artificial Sequence: Synthetic oligonucleotide
  Target: ATXN1; (-) strand; PAM type: NRG; PAM sequence: AGG
gggagaaaacagaacctacg

SEQ ID NO: 93422 - DNA, 20 bp, Artificial Sequence
  Description of Artificial Sequence: Synthetic oligonucleotide
  Target: ATXN1; (-) strand; PAM type: NRG; PAM sequence: GAG
ggggagaaaacagaacctac

SEQ ID NO: 93423 - DNA, 20 bp, Artificial Sequence
  Description of Artificial Sequence: Synthetic oligonucleotide
  Target: ATXN1; (-) strand; PAM type: NRG; PAM sequence: CAG
tcattttctaggggagaaaa

SEQ ID NO: 93424 - DNA, 20 bp, Artificial Sequence
  Description of Artificial Sequence: Synthetic oligonucleotide
  Target: ATXN1; (-) strand; PAM type: NRG; PAM sequence: GAG
agtaccctcattttctaggg

SEQ ID NO: 93425 - DNA, 20 bp, Artificial Sequence
  Description of Artificial Sequence: Synthetic oligonucleotide
  Target: ATXN1; (-) strand; PAM type: NRG; PAM sequence: GGG
aaagtaccctcattttctag

SEQ ID NO: 93426 - DNA, 20 bp, Artificial Sequence
  Description of Artificial Sequence: Synthetic oligonucleotide
  Target: ATXN1; (-) strand; PAM type: NRG; PAM sequence: GGG
aaaagtaccctcattttcta

SEQ ID NO: 93427 - DNA, 20 bp, Artificial Sequence
  Description of Artificial Sequence: Synthetic oligonucleotide
  Target: ATXN1; (-) strand; PAM type: NRG; PAM sequence: AGG
gaaaagtaccctcattttct

SEQ ID NO: 93428 - DNA, 20 bp, Artificial Sequence
  Description of Artificial Sequence: Synthetic oligonucleotide
  Target: ATXN1; (-) strand; PAM type: NRG; PAM sequence: TAG
agaaaagtaccctcattttc

SEQ ID NO: 93429 - DNA, 20 bp, Artificial Sequence
  Description of Artificial Sequence: Synthetic oligonucleotide
  Target: ATXN1; (-) strand; PAM type: NRG; PAM sequence: AAG
taatgactgcttgagtagaa

SEQ ID NO: 93430 - DNA, 20 bp, Artificial Sequence
  Description of Artificial Sequence: Synthetic oligonucleotide
  Target: ATXN1; (-) strand; PAM type: NRG; PAM sequence: TAG
agtcataatgactgcttgag

SEQ ID NO: 93431 - DNA, 20 bp, Artificial Sequence
  Description of Artificial Sequence: Synthetic oligonucleotide
  Target: ATXN1; (-) strand; PAM type: NRG; PAM sequence: GAG
gatagtcataatgactgctt

SEQ ID NO: 93432 - DNA, 20 bp, Artificial Sequence
  Description of Artificial Sequence: Synthetic oligonucleotide
  Target: ATXN1; (-) strand; PAM type: NRG; PAM sequence: TAG
agataaattgtttcagtgga

SEQ ID NO: 93433 - DNA, 20 bp, Artificial Sequence
  Description of Artificial Sequence: Synthetic oligonucleotide
  Target: ATXN1; (-) strand; PAM type: NRG; PAM sequence: TGG
ccttagataaattgtttcag

SEQ ID NO: 93434 - DNA, 20 bp, Artificial Sequence
  Description of Artificial Sequence: Synthetic oligonucleotide
  Target: ATXN1; (-) strand; PAM type: NRG; PAM sequence: CAG
gtgccttagataaattgttt

SEQ ID NO: 93435 - DNA, 20 bp, Artificial Sequence
  Description of Artificial Sequence: Synthetic oligonucleotide
  Target: ATXN1; (-) strand; PAM type: NRG; PAM sequence: TAG
tcacagaattcagagtgcct

SEQ ID NO: 93436 - DNA, 20 bp, Artificial Sequence
  Description of Artificial Sequence: Synthetic oligonucleotide
  Target: ATXN1; (-) strand; PAM type: NRG; PAM sequence: GAG
atagcacatcacagaattca

SEQ ID NO: 93437 - DNA, 20 bp, Artificial Sequence
  Description of Artificial Sequence: Synthetic oligonucleotide
  Target: ATXN1; (-) strand; PAM type: NRG; PAM sequence: CAG
taatagcacatcacagaatt

SEQ ID NO: 93438 - DNA, 20 bp, Artificial Sequence
  Description of Artificial Sequence: Synthetic oligonucleotide
  Target: ATXN1; (-) strand; PAM type: NRG; PAM sequence: CAG
cagctgataatagcacatca

SEQ ID NO: 93439 - DNA, 20 bp, Artificial Sequence
  Description of Artificial Sequence: Synthetic oligonucleotide
  Target: ATXN1; (-) strand; PAM type: NRG; PAM sequence: TAG
gagtctgcctcagctgataa

SEQ ID NO: 93440 - DNA, 20 bp, Artificial Sequence
  Description of Artificial Sequence: Synthetic oligonucleotide
  Target: ATXN1; (-) strand; PAM type: NRG; PAM sequence: CAG
aatgtgtcatgagtctgcct

SEQ ID NO: 93441 - DNA, 20 bp, Artificial Sequence
  Description of Artificial Sequence: Synthetic oligonucleotide
  Target: ATXN1; (-) strand; PAM type: NRG; PAM sequence: GAG
tgcagtggttaatgtgtcat

SEQ ID NO: 93442 - DNA, 20 bp, Artificial Sequence
  Description of Artificial Sequence: Synthetic oligonucleotide
  Target: ATXN1; (-) strand; PAM type: NRG; PAM sequence: TGG
gttatccagaccatgtgcag

SEQ ID NO: 93443 - DNA, 20 bp, Artificial Sequence
  Description of Artificial Sequence: Synthetic oligonucleotide
  Target: ATXN1; (-) strand; PAM type: NRG; PAM sequence: CAG
acagttatccagaccatgtg

SEQ ID NO: 93444 - DNA, 20 bp, Artificial Sequence
  Description of Artificial Sequence: Synthetic oligonucleotide
  Target: ATXN1; (-) strand; PAM type: NRG; PAM sequence: CAG
cctttaaaaccacagttatc

SEQ ID NO: 93445 - DNA, 20 bp, Artificial Sequence
  Description of Artificial Sequence: Synthetic oligonucleotide
  Target: ATXN1; (-) strand; PAM type: NRG; PAM sequence: CAG
aactacagcctttaaaacca

SEQ ID NO: 93446 - DNA, 20 bp, Artificial Sequence
  Description of Artificial Sequence: Synthetic oligonucleotide
  Target: ATXN1; (-) strand; PAM type: NRG; PAM sequence: CAG
agcctctgatttagtaacta

SEQ ID NO: 93447 - DNA, 20 bp, Artificial Sequence
  Description of Artificial Sequence: Synthetic oligonucleotide
  Target: ATXN1; (-) strand; PAM type: NRG; PAM sequence: TAG
tgcagtctgagcctctgatt

SEQ ID NO: 93448 - DNA, 20 bp, Artificial Sequence
  Description of Artificial Sequence: Synthetic oligonucleotide
  Target: ATXN1; (-) strand; PAM type: NRG; PAM sequence: GAG
ttgatggtattctgcagtct

SEQ ID NO: 93449 - DNA, 20 bp, Artificial Sequence
  Description of Artificial Sequence: Synthetic oligonucleotide
  Target: ATXN1; (-) strand; PAM type: NRG; PAM sequence: CAG
tttctcttgatggtattctg

SEQ ID NO: 93450 - DNA, 20 bp, Artificial Sequence
  Description of Artificial Sequence: Synthetic oligonucleotide
  Target: ATXN1; (-) strand; PAM type: NRG; PAM sequence: TGG
aaaagtaccctttctcttga

SEQ ID NO: 93451 - DNA, 20 bp, Artificial Sequence
  Description of Artificial Sequence: Synthetic oligonucleotide
  Target: ATXN1; (-) strand; PAM type: NRG; PAM sequence: AAG
tctcttgtaggactagtcaa

SEQ ID NO: 93452 - DNA, 20 bp, Artificial Sequence
  Description of Artificial Sequence: Synthetic oligonucleotide
  Target: ATXN1; (-) strand; PAM type: NRG; PAM sequence: TAG
tcctgtttctcttgtaggac

SEQ ID NO: 93453 - DNA, 20 bp, Artificial Sequence
  Description of Artificial Sequence: Synthetic oligonucleotide
  Target: ATXN1; (-) strand; PAM type: NRG; PAM sequence: AGG
gtgtttcctgtttctcttgt

SEQ ID NO: 93454 - DNA, 20 bp, Artificial Sequence
  Description of Artificial Sequence: Synthetic oligonucleotide
  Target: ATXN1; (-) strand; PAM type: NRG; PAM sequence: TAG
tgtgtttcctgtttctcttg

SEQ ID NO: 93455 - DNA, 20 bp, Artificial Sequence
  Description of Artificial Sequence: Synthetic oligonucleotide
  Target: ATXN1; (-) strand; PAM type: NRG; PAM sequence: AAG
caaagagtatactgggagga

SEQ ID NO: 93456 - DNA, 20 bp, Artificial Sequence
  Description of Artificial Sequence: Synthetic oligonucleotide
  Target: ATXN1; (-) strand; PAM type: NRG; PAM sequence: AGG
tcttcaaagagtatactggg

SEQ ID NO: 93457 - DNA, 20 bp, Artificial Sequence
  Description of Artificial Sequence: Synthetic oligonucleotide
  Target: ATXN1; (-) strand; PAM type: NRG; PAM sequence: GAG
gtcttcaaagagtatactgg

SEQ ID NO: 93458 - DNA, 20 bp, Artificial Sequence
  Description of Artificial Sequence: Synthetic oligonucleotide
  Target: ATXN1; (-) strand; PAM type: NRG; PAM sequence: GGG
gggtcttcaaagagtatact

SEQ ID NO: 93459 - DNA, 20 bp, Artificial Sequence
  Description of Artificial Sequence: Synthetic oligonucleotide
  Target: ATXN1; (-) strand; PAM type: NRG; PAM sequence: TGG
agggtcttcaaagagtatac

SEQ ID NO: 93460 - DNA, 20 bp, Artificial Sequence
  Description of Artificial Sequence: Synthetic oligonucleotide
  Target: ATXN1; (-) strand; PAM type: NRG; PAM sequence: GAG
aaatgtccagggtcttcaaa

SEQ ID NO: 93461 - DNA, 20 bp, Artificial Sequence
  Description of Artificial Sequence: Synthetic oligonucleotide
  Target: ATXN1; (-) strand; PAM type: NRG; PAM sequence: AAG
ttaaatgtccagggtcttca

SEQ ID NO: 93462 - DNA, 20 bp, Artificial Sequence
  Description of Artificial Sequence: Synthetic oligonucleotide
  Target: ATXN1; (-) strand; PAM type: NRG; PAM sequence: GGG
tttctcattttaaatgtcca

SEQ ID NO: 93463 - DNA, 20 bp, Artificial Sequence
  Description of Artificial Sequence: Synthetic oligonucleotide
  Target: ATXN1; (-) strand; PAM type: NRG; PAM sequence: AGG
ctttctcattttaaatgtcc

SEQ ID NO: 93464 - DNA, 20 bp, Artificial Sequence
  Description of Artificial Sequence: Synthetic oligonucleotide
  Target: ATXN1; (-) strand; PAM type: NRG; PAM sequence: CAG
actttctcattttaaatgtc

SEQ ID NO: 93465 - DNA, 20 bp, Artificial Sequence
  Description of Artificial Sequence: Synthetic oligonucleotide
  Target: ATXN1; (-) strand; PAM type: NRG; PAM sequence: AAG
aatgagacttcctttaaaaa

SEQ ID NO: 93466 - DNA, 20 bp, Artificial Sequence
  Description of Artificial Sequence: Synthetic oligonucleotide
  Target: ATXN1; (-) strand; PAM type: NRG; PAM sequence: GAG
gccctgaagtctcaagaaat

SEQ ID NO: 93467 - DNA, 20 bp, Artificial Sequence
  Description of Artificial Sequence: Synthetic oligonucleotide
  Target: ATXN1; (-) strand; PAM type: NRG; PAM sequence: AAG
actttttgccctgaagtctc

SEQ ID NO: 93468 - DNA, 20 bp, Artificial Sequence
  Description of Artificial Sequence: Synthetic oligonucleotide
  Target: ATXN1; (-) strand; PAM type: NRG; PAM sequence: AAG
taatttaactttttgccctg

SEQ ID NO: 93469 - DNA, 20 bp, Artificial Sequence
  Description of Artificial Sequence: Synthetic oligonucleotide
  Target: ATXN1; (-) strand; PAM type: NRG; PAM sequence: GGG
gcaaagtttctgtctctgaa

SEQ ID NO: 93470 - DNA, 20 bp, Artificial Sequence
  Description of Artificial Sequence: Synthetic oligonucleotide
  Target: ATXN1; (-) strand; PAM type: NRG; PAM sequence: AGG
cgcaaagtttctgtctctga

SEQ ID NO: 93471 - DNA, 20 bp, Artificial Sequence
  Description of Artificial Sequence: Synthetic oligonucleotide
  Target: ATXN1; (-) strand; PAM type: NRG; PAM sequence: AAG
tcgcaaagtttctgtctctg

SEQ ID NO: 93472 - DNA, 20 bp, Artificial Sequence
  Description of Artificial Sequence: Synthetic oligonucleotide
  Target: ATXN1; (-) strand; PAM type: NRG; PAM sequence: AAG
ttcggtgacctgaaatcgca

SEQ ID NO: 93473 - DNA, 20 bp, Artificial Sequence
  Description of Artificial Sequence: Synthetic oligonucleotide
  Target: ATXN1; (-) strand; PAM type: NRG; PAM sequence: CGG
cctgctgtacagagaacatt

SEQ ID NO: 93474 - DNA, 20 bp, Artificial Sequence
  Description of Artificial Sequence: Synthetic oligonucleotide
  Target: ATXN1; (-) strand; PAM type: NRG; PAM sequence: GAG
gttggctgtcctgctgtaca

SEQ ID NO: 93475 - DNA, 20 bp, Artificial Sequence
  Description of Artificial Sequence: Synthetic oligonucleotide
  Target: ATXN1; (-) strand; PAM type: NRG; PAM sequence: CAG
ctgttggctgtcctgctgta

SEQ ID NO: 93476 - DNA, 20 bp, Artificial Sequence
  Description of Artificial Sequence: Synthetic oligonucleotide
  Target: ATXN1; (-) strand; PAM type: NRG; PAM sequence: TGG
aaatgaccaaacacagctgt

SEQ ID NO: 93477 - DNA, 20 bp, Artificial Sequence
  Description of Artificial Sequence: Synthetic oligonucleotide
  Target: ATXN1; (-) strand; PAM type: NRG; PAM sequence: CAG
tatgtgtaaatgaccaaaca

SEQ ID NO: 93478 - DNA, 20 bp, Artificial Sequence
  Description of Artificial Sequence: Synthetic oligonucleotide
  Target: ATXN1; (-) strand; PAM type: NRG; PAM sequence: GGG
atctttaagtcctggaggga

SEQ ID NO: 93479 - DNA, 20 bp, Artificial Sequence
  Description of Artificial Sequence: Synthetic oligonucleotide
  Target: ATXN1; (-) strand; PAM type: NRG; PAM sequence: AGG
catctttaagtcctggaggg

SEQ ID NO: 93480 - DNA, 20 bp, Artificial Sequence
  Description of Artificial Sequence: Synthetic oligonucleotide
  Target: ATXN1; (-) strand; PAM type: NRG; PAM sequence: GAG
tcatctttaagtcctggagg

SEQ ID NO: 93481 - DNA, 20 bp, Artificial Sequence
  Description of Artificial Sequence: Synthetic oligonucleotide
  Target: ATXN1; (-) strand; PAM type: NRG; PAM sequence: GGG
tatcatctttaagtcctgga

SEQ ID NO: 93482 - DNA, 20 bp, Artificial Sequence
  Description of Artificial Sequence: Synthetic oligonucleotide
  Target: ATXN1; (-) strand; PAM type: NRG; PAM sequence: AGG
atatcatctttaagtcctgg

SEQ ID NO: 93483 - DNA, 20 bp, Artificial Sequence
  Description of Artificial Sequence: Synthetic oligonucleotide
  Target: ATXN1; (-) strand; PAM type: NRG; PAM sequence: GAG
catatcatctttaagtcctg

SEQ ID NO: 93484 - DNA, 20 bp, Artificial Sequence
  Description of Artificial Sequence: Synthetic oligonucleotide
  Target: ATXN1; (-) strand; PAM type: NRG; PAM sequence: TGG
ttcatatcatctttaagtcc

SEQ ID NO: 93485 - DNA, 20 bp, Artificial Sequence
  Description of Artificial Sequence: Synthetic oligonucleotide
  Target: ATXN1; (-) strand; PAM type: NRG; PAM sequence: AAG
acacagttcatatcatcttt

SEQ ID NO: 93486 - DNA, 20 bp, Artificial Sequence
  Description of Artificial Sequence: Synthetic oligonucleotide
  Target: ATXN1; (-) strand; PAM type: NRG; PAM sequence: CAG
tcagactaaactccatgaca

SEQ ID NO: 93487 - DNA, 20 bp, Artificial Sequence
  Description of Artificial Sequence: Synthetic oligonucleotide
  Target: ATXN1; (-) strand; PAM type: NRG; PAM sequence: CAG
agtagtatatgagccttcct

SEQ ID NO: 93488 - DNA, 20 bp, Artificial Sequence
  Description of Artificial Sequence: Synthetic oligonucleotide
  Target: ATXN1; (-) strand; PAM type: NRG; PAM sequence: GAG
gggtctcaccagtagtatat

SEQ ID NO: 93489 - DNA, 20 bp, Artificial Sequence
  Description of Artificial Sequence: Synthetic oligonucleotide
  Target: ATXN1; (-) strand; PAM type: NRG; PAM sequence: TAG
tgaaatgtgggtctcaccag

SEQ ID NO: 93490 - DNA, 20 bp, Artificial Sequence
  Description of Artificial Sequence: Synthetic oligonucleotide
  Target: ATXN1; (-) strand; PAM type: NRG; PAM sequence: CAG
ccttgaaatgtgggtctcac

SEQ ID NO: 93491 - DNA, 20 bp, Artificial Sequence
  Description of Artificial Sequence: Synthetic oligonucleotide
  Target: ATXN1; (-) strand; PAM type: NRG; PAM sequence: GGG
tgagtaggaccttgaaatgt

SEQ ID NO: 93492 - DNA, 20 bp, Artificial Sequence
  Description of Artificial Sequence: Synthetic oligonucleotide
  Target: ATXN1; (-) strand; PAM type: NRG; PAM sequence: TGG
ctgagtaggaccttgaaatg

SEQ ID NO: 93493 - DNA, 20 bp, Artificial Sequence
  Description of Artificial Sequence: Synthetic oligonucleotide
  Target: ATXN1; (-) strand; PAM type: NRG; PAM sequence: AGG
gaagaaacgtctttctgagt

SEQ ID NO: 93494 - DNA, 20 bp, Artificial Sequence
  Description of Artificial Sequence: Synthetic oligonucleotide
  Target: ATXN1; (-) strand; PAM type: NRG; PAM sequence: TAG
tgaagaaacgtctttctgag

SEQ ID NO: 93495 - DNA, 20 bp, Artificial Sequence
  Description of Artificial Sequence: Synthetic oligonucleotide
  Target: ATXN1; (-) strand; PAM type: NRG; PAM sequence: GAG
aaatgaagaaacgtctttct

SEQ ID NO: 93496 - DNA, 20 bp, Artificial Sequence
  Description of Artificial Sequence: Synthetic oligonucleotide
  Target: ATXN1; (-) strand; PAM type: NRG; PAM sequence: AAG
taataaacaacattaaaatg

SEQ ID NO: 93497 - DNA, 20 bp, Artificial Sequence
  Description of Artificial Sequence: Synthetic oligonucleotide
  Target: ATXN1; (-) strand; PAM type: NRG; PAM sequence: GAG
cctagtgattagcagaatgt

SEQ ID NO: 93498 - DNA, 20 bp, Artificial Sequence
  Description of Artificial Sequence: Synthetic oligonucleotide
  Target: ATXN1; (-) strand; PAM type: NRG; PAM sequence: CAG
tcagtcatcctagtgattag

SEQ ID NO: 93499 - DNA, 20 bp, Artificial Sequence
  Description of Artificial Sequence: Synthetic oligonucleotide
  Target: ATXN1; (-) strand; PAM type: NRG; PAM sequence: TAG
gtttcagtcatcctagtgat

SEQ ID NO: 93500 - DNA, 20 bp, Artificial Sequence
  Description of Artificial Sequence: Synthetic oligonucleotide
  Target: ATXN1; (-) strand; PAM type: NRG; PAM sequence: TAG
caaagctgtttcagtcatcc

SEQ ID NO: 93501 - DNA, 20 bp, Artificial Sequence
  Description of Artificial Sequence: Synthetic oligonucleotide
  Target: ATXN1; (-) strand; PAM type: NRG; PAM sequence: CAG
agcgagctgcaaagctgttt

SEQ ID NO: 93502 - DNA, 20 bp, Artificial Sequence
  Description of Artificial Sequence: Synthetic oligonucleotide
  Target: ATXN1; (-) strand; PAM type: NRG; PAM sequence: AAG
tttcctcccagcgagctgca

SEQ ID NO: 93503 - DNA, 20 bp, Artificial Sequence
  Description of Artificial Sequence: Synthetic oligonucleotide
  Target: ATXN1; (-) strand; PAM type: NRG; PAM sequence: GAG
tctttaattttcctcccagc

SEQ ID NO: 93504 - DNA, 20 bp, Artificial Sequence
  Description of Artificial Sequence: Synthetic oligonucleotide
  Target: ATXN1; (-) strand; PAM type: NRG; PAM sequence: CAG
actttctttaattttcctcc

SEQ ID NO: 93505 - DNA, 20 bp, Artificial Sequence
  Description of Artificial Sequence: Synthetic oligonucleotide
  Target: ATXN1; (-) strand; PAM type: NRG; PAM sequence: AAG
taaacagatataaaaggagg

SEQ ID NO: 93506 - DNA, 20 bp, Artificial Sequence
  Description of Artificial Sequence: Synthetic oligonucleotide
  Target: ATXN1; (-) strand; PAM type: NRG; PAM sequence: AGG
gtgtaaacagatataaaagg

SEQ ID NO: 93507 - DNA, 20 bp, Artificial Sequence
  Description of Artificial Sequence: Synthetic oligonucleotide
  Target: ATXN1; (-) strand; PAM type: NRG; PAM sequence: GAG
tgtgtaaacagatataaaag

SEQ ID NO: 93508 - DNA, 20 bp, Artificial Sequence
  Description of Artificial Sequence: Synthetic oligonucleotide
  Target: ATXN1; (-) strand; PAM type: NRG; PAM sequence: AGG
tctgtgtaaacagatataaa

SEQ ID NO: 93509 - DNA, 20 bp, Artificial Sequence
  Description of Artificial Sequence: Synthetic oligonucleotide
  Target: ATXN1; (-) strand; PAM type: NRG; PAM sequence: AAG
atctgtgtaaacagatataa

SEQ ID NO: 93510 - DNA, 20 bp, Artificial Sequence
  Description of Artificial Sequence: Synthetic oligonucleotide
  Target: ATXN1; (-) strand; PAM type: NRG; PAM sequence: CAG
attttaacaatctgtgtaaa

SEQ ID NO: 93511 - DNA, 20 bp, Artificial Sequence
  Description of Artificial Sequence: Synthetic oligonucleotide
  Target: ATXN1; (-) strand; PAM type: NRG; PAM sequence: AAG
ctctactcttcagaaggaac

SEQ ID NO: 93512 - DNA, 20 bp, Artificial Sequence
  Description of Artificial Sequence: Synthetic oligonucleotide
  Target: ATXN1; (-) strand; PAM type: NRG; PAM sequence: AGG
acctttctctactcttcaga

SEQ ID NO: 93513 - DNA, 20 bp, Artificial Sequence
  Description of Artificial Sequence: Synthetic oligonucleotide
  Target: ATXN1; (-) strand; PAM type: NRG; PAM sequence: AAG
aacctttctctactcttcag

SEQ ID NO: 93514 - DNA, 20 bp, Artificial Sequence
  Description of Artificial Sequence: Synthetic oligonucleotide
  Target: ATXN1; (-) strand; PAM type: NRG; PAM sequence: CAG
ttgaacctttctctactctt

SEQ ID NO: 93515 - DNA, 20 bp, Artificial Sequence
  Description of Artificial Sequence: Synthetic oligonucleotide
  Target: ATXN1; (-) strand; PAM type: NRG; PAM sequence: AAG
ttggctttcctgttctgttt

SEQ ID NO: 93516 - DNA, 20 bp, Artificial Sequence
  Description of Artificial Sequence: Synthetic oligonucleotide
  Target: ATXN1; (-) strand; PAM type: NRG; PAM sequence: TGG
caaatttcggtgttttattt

SEQ ID NO: 93517 - DNA, 20 bp, Artificial Sequence
  Description of Artificial Sequence: Synthetic oligonucleotide
  Target: ATXN1; (-) strand; PAM type: NRG; PAM sequence: CGG
tggcatctaagcccaaattt

SEQ ID NO: 93518 - DNA, 20 bp, Artificial Sequence
  Description of Artificial Sequence: Synthetic oligonucleotide
  Target: ATXN1; (-) strand; PAM type: NRG; PAM sequence: AAG
gaaatatggtgatggcatct

SEQ ID NO: 93519 - DNA, 20 bp, Artificial Sequence
  Description of Artificial Sequence: Synthetic oligonucleotide
  Target: ATXN1; (-) strand; PAM type: NRG; PAM sequence: TGG
gtttgaaggaaatatggtga

SEQ ID NO: 93520 - DNA, 20 bp, Artificial Sequence
  Description of Artificial Sequence: Synthetic oligonucleotide
  Target: ATXN1; (-) strand; PAM type: NRG; PAM sequence: TGG
tattgagtttgaaggaaata

SEQ ID NO: 93521 - DNA, 20 bp, Artificial Sequence
  Description of Artificial Sequence: Synthetic oligonucleotide
  Target: ATXN1; (-) strand; PAM type: NRG; PAM sequence: AGG
ttgctttctattgagtttga

SEQ ID NO: 93522 - DNA, 20 bp, Artificial Sequence
  Description of Artificial Sequence: Synthetic oligonucleotide
  Target: ATXN1; (-) strand; PAM type: NRG; PAM sequence: AAG
tttgctttctattgagtttg

SEQ ID NO: 93523 - DNA, 20 bp, Artificial Sequence
  Description of Artificial Sequence: Synthetic oligonucleotide
  Target: ATXN1; (-) strand; PAM type: NRG; PAM sequence: GAG
atacaactttgctttctatt

SEQ ID NO: 93524 - DNA, 20 bp, Artificial Sequence
  Description of Artificial Sequence: Synthetic oligonucleotide
  Target: ATXN1; (-) strand; PAM type: NRG; PAM sequence: TGG
gacagaagaaaaaaatgcca

SEQ ID NO: 93525 - DNA, 20 bp, Artificial Sequence
  Description of Artificial Sequence: Synthetic oligonucleotide
  Target: ATXN1; (-) strand; PAM type: NRG; PAM sequence: AAG
gtttattattgtattgacag

SEQ ID NO: 93526 - DNA, 20 bp, Artificial Sequence
  Description of Artificial Sequence: Synthetic oligonucleotide
  Target: ATXN1; (-) strand; PAM type: NRG; PAM sequence: CAG
caagtttattattgtattga

SEQ ID NO: 93527 - DNA, 20 bp, Artificial Sequence
  Description of Artificial Sequence: Synthetic oligonucleotide
  Target: ATXN1; (-) strand; PAM type: NRG; PAM sequence: AAG
tggtcatagacccataagac

SEQ ID NO: 93528 - DNA, 20 bp, Artificial Sequence
  Description of Artificial Sequence: Synthetic oligonucleotide
  Target: ATXN1; (-) strand; PAM type: NRG; PAM sequence: AAG
gtaagtggtcatagacccat

SEQ ID NO: 93529 - DNA, 20 bp, Artificial Sequence
  Description of Artificial Sequence: Synthetic oligonucleotide
  Target: ATXN1; (-) strand; PAM type: NRG; PAM sequence: TAG
ttttcttttgtaagtggtca

SEQ ID NO: 93530 - DNA, 20 bp, Artificial Sequence
  Description of Artificial Sequence: Synthetic oligonucleotide
  Target: ATXN1; (-) strand; PAM type: NRG; PAM sequence: TGG
ttttttttttcttttgtaag

SEQ ID NO: 93531 - DNA, 20 bp, Artificial Sequence
  Description of Artificial Sequence: Synthetic oligonucleotide
  Target: ATXN1; (-) strand; PAM type: NRG; PAM sequence: AAG
ggattttttttttcttttgt

SEQ ID NO: 93532 - DNA, 20 bp, Artificial Sequence
  Description of Artificial Sequence: Synthetic oligonucleotide
  Target: ATXN1; (-) strand; PAM type: NRG; PAM sequence: TGG
cagttttgtttggtttgatt

SEQ ID NO: 93533 - DNA, 20 bp, Artificial Sequence
  Description of Artificial Sequence: Synthetic oligonucleotide
  Target: ATXN1; (-) strand; PAM type: NRG; PAM sequence: TGG
caaaagatagcagttttgtt

SEQ ID NO: 93534 - DNA, 20 bp, Artificial Sequence
  Description of Artificial Sequence: Synthetic oligonucleotide
  Target: ATXN1; (-) strand; PAM type: NRG; PAM sequence: CAG
tgatacttttcaaaagatag

SEQ ID NO: 93535 - DNA, 20 bp, Artificial Sequence
  Description of Artificial Sequence: Synthetic oligonucleotide
  Target: ATXN1; (-) strand; PAM type: NRG; PAM sequence: TAG
atctgatacttttcaaaaga

SEQ ID NO: 93536 - DNA, 20 bp, Artificial Sequence
  Description of Artificial Sequence: Synthetic oligonucleotide
  Target: ATXN1; (-) strand; PAM type: NRG; PAM sequence: AAG
tctgatctgatacttttcaa

SEQ ID NO: 93537 - DNA, 20 bp, Artificial Sequence
  Description of Artificial Sequence: Synthetic oligonucleotide
  Target: ATXN1; (-) strand; PAM type: NRG; PAM sequence: TGG
ttccccagctgctgcctttc

SEQ ID NO: 93538 - DNA, 20 bp, Artificial Sequence
  Description of Artificial Sequence: Synthetic oligonucleotide
  Target: ATXN1; (-) strand; PAM type: NRG; PAM sequence: CAG
gtgggaaagaatgtgttccc

SEQ ID NO: 93539 - DNA, 20 bp, Artificial Sequence
  Description of Artificial Sequence: Synthetic oligonucleotide
  Target: ATXN1; (-) strand; PAM type: NRG; PAM sequence: AAG
cttcatctaaggaagtggga

SEQ ID NO: 93540 - DNA, 20 bp, Artificial Sequence
  Description of Artificial Sequence: Synthetic oligonucleotide
  Target: ATXN1; (-) strand; PAM type: NRG; PAM sequence: GGG
cagccttcatctaaggaagt

SEQ ID NO: 93541 - DNA, 20 bp, Artificial Sequence
  Description of Artificial Sequence: Synthetic oligonucleotide
  Target: ATXN1; (-) strand; PAM type: NRG; PAM sequence: TGG
acagccttcatctaaggaag

SEQ ID NO: 93542 - DNA, 20 bp, Artificial Sequence
  Description of Artificial Sequence: Synthetic oligonucleotide
  Target: ATXN1; (-) strand; PAM type: NRG; PAM sequence: AAG
gagacagccttcatctaagg

SEQ ID NO: 93543 - DNA, 20 bp, Artificial Sequence
  Description of Artificial Sequence: Synthetic oligonucleotide
  Target: ATXN1; (-) strand; PAM type: NRG; PAM sequence: AGG
tgggagacagccttcatcta

SEQ ID NO: 93544 - DNA, 20 bp, Artificial Sequence
  Description of Artificial Sequence: Synthetic oligonucleotide
  Target: ATXN1; (-) strand; PAM type: NRG; PAM sequence: AAG
ttgggagacagccttcatct

SEQ ID NO: 93545 - DNA, 20 bp, Artificial Sequence
  Description of Artificial Sequence: Synthetic oligonucleotide
  Target: ATXN1; (-) strand; PAM type: NRG; PAM sequence: CAG
ttgtggcttttattgggaga

SEQ ID NO: 93546 - DNA, 20 bp, Artificial Sequence
  Description of Artificial Sequence: Synthetic oligonucleotide
  Target: ATXN1; (-) strand; PAM type: NRG; PAM sequence: GAG
caagttgtggcttttattgg

SEQ ID NO: 93547 - DNA, 20 bp, Artificial Sequence
  Description of Artificial Sequence: Synthetic oligonucleotide
  Target: ATXN1; (-) strand; PAM type: NRG; PAM sequence: GGG
cccaagttgtggcttttatt

SEQ ID NO: 93548 - DNA, 20 bp, Artificial Sequence
  Description of Artificial Sequence: Synthetic oligonucleotide
  Target: ATXN1; (-) strand; PAM type: NRG; PAM sequence: TGG
ccccaagttgtggcttttat

SEQ ID NO: 93549 - DNA, 20 bp, Artificial Sequence
  Description of Artificial Sequence: Synthetic oligonucleotide
  Target: ATXN1; (-) strand; PAM type: NRG; PAM sequence: TGG
agaagtatgaccccaagttg

SEQ ID NO: 93550 - DNA, 20 bp, Artificial Sequence
  Description of Artificial Sequence: Synthetic oligonucleotide
  Target: ATXN1; (-) strand; PAM type: NRG; PAM sequence: AAG
ctagagagaagtatgacccc

SEQ ID NO: 93551 - DNA, 20 bp, Artificial Sequence
  Description of Artificial Sequence: Synthetic oligonucleotide
  Target: ATXN1; (-) strand; PAM type: NRG; PAM sequence: AAG
ctgcaacccagactagagag

SEQ ID NO: 93552 - DNA, 20 bp, Artificial Sequence
  Description of Artificial Sequence: Synthetic oligonucleotide
  Target: ATXN1; (-) strand; PAM type: NRG; PAM sequence: GAG
tcactgcaacccagactaga

SEQ ID NO: 93553 - DNA, 20 bp, Artificial Sequence
  Description of Artificial Sequence: Synthetic oligonucleotide
  Target: ATXN1; (-) strand; PAM type: NRG; PAM sequence: GAG
ggtcactgcaacccagacta

SEQ ID NO: 93554 - DNA, 20 bp, Artificial Sequence
  Description of Artificial Sequence: Synthetic oligonucleotide
  Target: ATXN1; (-) strand; PAM type: NRG; PAM sequence: TAG
tgggtcactgcaacccagac

SEQ ID NO: 93555 - DNA, 20 bp, Artificial Sequence
  Description of Artificial Sequence: Synthetic oligonucleotide
  Target: ATXN1; (-) strand; PAM type: NRG; PAM sequence: CAG
ctgcctgggtcactgcaacc

SEQ ID NO: 93556 - DNA, 20 bp, Artificial Sequence
  Description of Artificial Sequence: Synthetic oligonucleotide
  Target: ATXN1; (-) strand; PAM type: NRG; PAM sequence: GGG
gttcacctctggagctgcct

SEQ ID NO: 93557 - DNA, 20 bp, Artificial Sequence
  Description of Artificial Sequence: Synthetic oligonucleotide
  Target: ATXN1; (-) strand; PAM type: NRG; PAM sequence: TGG
agttcacctctggagctgcc

SEQ ID NO: 93558 - DNA, 20 bp, Artificial Sequence
  Description of Artificial Sequence: Synthetic oligonucleotide
  Target: ATXN1; (-) strand; PAM type: NRG; PAM sequence: GAG
ctgtgtccagttcacctctg

SEQ ID NO: 93559 - DNA, 20 bp, Artificial Sequence
  Description of Artificial Sequence: Synthetic oligonucleotide
  Target: ATXN1; (-) strand; PAM type: NRG; PAM sequence: TGG
ctctgtgtccagttcacctc

SEQ ID NO: 93560 - DNA, 20 bp, Artificial Sequence
  Description of Artificial Sequence: Synthetic oligonucleotide
  Target: ATXN1; (-) strand; PAM type: NRG; PAM sequence: CAG
ccttttccaggctctgtgtc

SEQ ID NO: 93561 - DNA, 20 bp, Artificial Sequence
  Description of Artificial Sequence: Synthetic oligonucleotide
  Target: ATXN1; (-) strand; PAM type: NRG; PAM sequence: AGG
gattattcttccccttttcc

SEQ ID NO: 93562 - DNA, 20 bp, Artificial Sequence
  Description of Artificial Sequence: Synthetic oligonucleotide
  Target: ATXN1; (-) strand; PAM type: NRG; PAM sequence: CAG
tgattattcttccccttttc

SEQ ID NO: 93563 - DNA, 20 bp, Artificial Sequence
  Description of Artificial Sequence: Synthetic oligonucleotide
  Target: ATXN1; (-) strand; PAM type: NRG; PAM sequence: TGG
aggggaggcagaaatgactc

SEQ ID NO: 93564 - DNA, 20 bp, Artificial Sequence
  Description of Artificial Sequence: Synthetic oligonucleotide
  Target: ATXN1; (-) strand; PAM type: NRG; PAM sequence: CAG
tggcaggttccaaggggagg

SEQ ID NO: 93565 - DNA, 20 bp, Artificial Sequence
  Description of Artificial Sequence: Synthetic oligonucleotide
  Target: ATXN1; (-) strand; PAM type: NRG; PAM sequence: AGG
ccctggcaggttccaagggg

SEQ ID NO: 93566 - DNA, 20 bp, Artificial Sequence
  Description of Artificial Sequence: Synthetic oligonucleotide
  Target: ATXN1; (-) strand; PAM type: NRG; PAM sequence: GAG
gccctggcaggttccaaggg

SEQ ID NO: 93567 - DNA, 20 bp, Artificial Sequence
  Description of Artificial Sequence: Synthetic oligonucleotide
  Target: ATXN1; (-) strand; PAM type: NRG; PAM sequence: GGG
ctgccctggcaggttccaag

SEQ ID NO: 93568 - DNA, 20 bp, Artificial Sequence
  Description of Artificial Sequence: Synthetic oligonucleotide
  Target: ATXN1; (-) strand; PAM type: NRG; PAM sequence: GGG
cctgccctggcaggttccaa

SEQ ID NO: 93569 - DNA, 20 bp, Artificial Sequence
  Description of Artificial Sequence: Synthetic oligonucleotide
  Target: ATXN1; (-) strand; PAM type: NRG; PAM sequence: AGG
ccctgccctggcaggttcca

SEQ ID NO: 93570 - DNA, 20 bp, Artificial Sequence
  Description of Artificial Sequence: Synthetic oligonucleotide
  Target: ATXN1; (-) strand; PAM type: NRG; PAM sequence: AAG
gccctgccctggcaggttcc

SEQ ID NO: 93571 - DNA, 20 bp, Artificial Sequence
  Description of Artificial Sequence: Synthetic oligonucleotide
  Target: ATXN1; (-) strand; PAM type: NRG; PAM sequence: AGG
taaccttgccctgccctggc

SEQ ID NO: 93572 - DNA, 20 bp, Artificial Sequence
  Description of Artificial Sequence: Synthetic oligonucleotide
  Target: ATXN1; (-) strand; PAM type: NRG; PAM sequence: CAG
ttaaccttgccctgccctgg

SEQ ID NO: 93573 - DNA, 20 bp, Artificial Sequence
  Description of Artificial Sequence: Synthetic oligonucleotide
  Target: ATXN1; (-) strand; PAM type: NRG; PAM sequence: TGG
cttttaaccttgccctgccc

SEQ ID NO: 93574 - DNA, 20 bp, Artificial Sequence
  Description of Artificial Sequence: Synthetic oligonucleotide
  Target: ATXN1; (-) strand; PAM type: NRG; PAM sequence: AGG
ccccagaggagagtacccta

SEQ ID NO: 93575 - DNA, 20 bp, Artificial Sequence
  Description of Artificial Sequence: Synthetic oligonucleotide
  Target: ATXN1; (-) strand; PAM type: NRG; PAM sequence: AAG
cccccagaggagagtaccct

SEQ ID NO: 93576 - DNA, 20 bp, Artificial Sequence
  Description of Artificial Sequence: Synthetic oligonucleotide
  Target: ATXN1; (-) strand; PAM type: NRG; PAM sequence: GAG
gctgcagcacccccagagga

SEQ ID NO: 93577 - DNA, 20 bp, Artificial Sequence
  Description of Artificial Sequence: Synthetic oligonucleotide
  Target: ATXN1; (-) strand; PAM type: NRG; PAM sequence: GAG
ccgctgcagcacccccagag

SEQ ID NO: 93578 - DNA, 20 bp, Artificial Sequence
  Description of Artificial Sequence: Synthetic oligonucleotide
  Target: ATXN1; (-) strand; PAM type: NRG; PAM sequence: AGG
gaccgctgcagcacccccag

SEQ ID NO: 93579 - DNA, 20 bp, Artificial Sequence
  Description of Artificial Sequence: Synthetic oligonucleotide
  Target: ATXN1; (-) strand; PAM type: NRG; PAM sequence: GAG
tgaccgctgcagcaccccca

SEQ ID NO: 93580 - DNA, 20 bp, Artificial Sequence
  Description of Artificial Sequence: Synthetic oligonucleotide
  Target: ATXN1; (-) strand; PAM type: NRG; PAM sequence: CAG
tttgaccgctgcagcacccc

SEQ ID NO: 93581 - DNA, 20 bp, Artificial Sequence
  Description of Artificial Sequence: Synthetic oligonucleotide
  Target: ATXN1; (-) strand; PAM type: NRG; PAM sequence: CAG
cctgggtcctttgaccgctg

SEQ ID NO: 93582 - DNA, 20 bp, Artificial Sequence
  Description of Artificial Sequence: Synthetic oligonucleotide
  Target: ATXN1; (-) strand; PAM type: NRG; PAM sequence: GGG
ccattggaaactgaagccct

SEQ ID NO: 93583 - DNA, 20 bp, Artificial Sequence
  Description of Artificial Sequence: Synthetic oligonucleotide
  Target: ATXN1; (-) strand; PAM type: NRG; PAM sequence: TGG
cccattggaaactgaagccc

SEQ ID NO: 93584 - DNA, 20 bp, Artificial Sequence
  Description of Artificial Sequence: Synthetic oligonucleotide
  Target: ATXN1; (-) strand; PAM type: NRG; PAM sequence: AAG
atgcctcccattggaaactg

SEQ ID NO: 93585 - DNA, 20 bp, Artificial Sequence
  Description of Artificial Sequence: Synthetic oligonucleotide
  Target: ATXN1; (-) strand; PAM type: NRG; PAM sequence: TGG
ggtatggaaatgcctcccat

SEQ ID NO: 93586 - DNA, 20 bp, Artificial Sequence
  Description of Artificial Sequence: Synthetic oligonucleotide
  Target: ATXN1; (-) strand; PAM type: NRG; PAM sequence: TGG
ttaagagattctgacaggta

SEQ ID NO: 93587 - DNA, 20 bp, Artificial Sequence
  Description of Artificial Sequence: Synthetic oligonucleotide
  Target: ATXN1; (-) strand; PAM type: NRG; PAM sequence: AGG
acctgttaagagattctgac

SEQ ID NO: 93588 - DNA, 20 bp, Artificial Sequence
  Description of Artificial Sequence: Synthetic oligonucleotide
  Target: ATXN1; (-) strand; PAM type: NRG; PAM sequence: CAG
aacctgttaagagattctga

SEQ ID NO: 93589 - DNA, 20 bp, Artificial Sequence
  Description of Artificial Sequence: Synthetic oligonucleotide
  Target: ATXN1; (-) strand; PAM type: NRG; PAM sequence: GAG
catatgtcagaacctgttaa

SEQ ID NO: 93590 - DNA, 20 bp, Artificial Sequence
  Description of Artificial Sequence: Synthetic oligonucleotide
  Target: ATXN1; (-) strand; PAM type: NRG; PAM sequence: AAG
accatatgtcagaacctgtt

SEQ ID NO: 93591 - DNA, 20 bp, Artificial Sequence
  Description of Artificial Sequence: Synthetic oligonucleotide
  Target: ATXN1; (-) strand; PAM type: NRG; PAM sequence: CAG
ccatatgttggaccatatgt

SEQ ID NO: 93592 - DNA, 20 bp, Artificial Sequence
  Description of Artificial Sequence: Synthetic oligonucleotide
  Target: ATXN1; (-) strand; PAM type: NRG; PAM sequence: TGG
tggtgtgagcgaccatatgt

SEQ ID NO: 93593 - DNA, 20 bp, Artificial Sequence
  Description of Artificial Sequence: Synthetic oligonucleotide
  Target: ATXN1; (-) strand; PAM type: NRG; PAM sequence: GAG
gcatttgtggttgatggtgt

SEQ ID NO: 93594 - DNA, 20 bp, Artificial Sequence
  Description of Artificial Sequence: Synthetic oligonucleotide
  Target: ATXN1; (-) strand; PAM type: NRG; PAM sequence: TGG
gggagtgcatttgtggttga

SEQ ID NO: 93595 - DNA, 20 bp, Artificial Sequence
  Description of Artificial Sequence: Synthetic oligonucleotide
  Target: ATXN1; (-) strand; PAM type: NRG; PAM sequence: TGG
aggtggagggagtgcatttg

SEQ ID NO: 93596 - DNA, 20 bp, Artificial Sequence
  Description of Artificial Sequence: Synthetic oligonucleotide
  Target: ATXN1; (-) strand; PAM type: NRG; PAM sequence: GAG
acgccttctccaggtggagg

SEQ ID NO: 93597 - DNA, 20 bp, Artificial Sequence
  Description of Artificial Sequence: Synthetic oligonucleotide
  Target: ATXN1; (-) strand; PAM type: NRG; PAM sequence: GGG
ggacgccttctccaggtgga

SEQ ID NO: 93598 - DNA, 20 bp, Artificial Sequence
  Description of Artificial Sequence: Synthetic oligonucleotide
  Target: ATXN1; (-) strand; PAM type: NRG; PAM sequence: AGG
aggacgccttctccaggtgg

SEQ ID NO: 93599 - DNA, 20 bp, Artificial Sequence
  Description of Artificial Sequence: Synthetic oligonucleotide
  Target: ATXN1; (-) strand; PAM type: NRG; PAM sequence: GAG
gaggacgccttctccaggtg

SEQ ID NO: 93600 - DNA, 20 bp, Artificial Sequence
  Description of Artificial Sequence: Synthetic oligonucleotide
  Target: ATXN1; (-) strand; PAM type: NRG; PAM sequence: TGG
gtgaggacgccttctccagg

SEQ ID NO: 93601 - DNA, 20 bp, Artificial Sequence
  Description of Artificial Sequence: Synthetic oligonucleotide
  Target: ATXN1; (-) strand; PAM type: NRG; PAM sequence: AGG
taggtgaggacgccttctcc

SEQ ID NO: 93602 - DNA, 20 bp, Artificial Sequence
  Description of Artificial Sequence: Synthetic oligonucleotide
  Target: ATXN1; (-) strand; PAM type: NRG; PAM sequence: CAG
gtaggtgaggacgccttctc

SEQ ID NO: 93603 - DNA, 20 bp, Artificial Sequence
  Description of Artificial Sequence: Synthetic oligonucleotide
  Target: ATXN1; (-) strand; PAM type: NRG; PAM sequence: AGG
tgcactgttggtggtaggtg

SEQ ID NO: 93604 - DNA, 20 bp, Artificial Sequence
  Description of Artificial Sequence: Synthetic oligonucleotide
  Target: ATXN1; (-) strand; PAM type: NRG; PAM sequence: GAG
ttgcactgttggtggtaggt

SEQ ID NO: 93605 - DNA, 20 bp, Artificial Sequence
  Description of Artificial Sequence: Synthetic oligonucleotide
  Target: ATXN1; (-) strand; PAM type: NRG; PAM sequence: AGG
gaagttgcactgttggtggt

SEQ ID NO: 93606 - DNA, 20 bp, Artificial Sequence
  Description of Artificial Sequence: Synthetic oligonucleotide
  Target: ATXN1; (-) strand; PAM type: NRG; PAM sequence: TAG
cgaagttgcactgttggtgg

SEQ ID NO: 93607 - DNA, 20 bp, Artificial Sequence
  Description of Artificial Sequence: Synthetic oligonucleotide
  Target: ATXN1; (-) strand; PAM type: NRG; PAM sequence: TGG
tctcgaagttgcactgttgg

SEQ ID NO: 93608 - DNA, 20 bp, Artificial Sequence
  Description of Artificial Sequence: Synthetic oligonucleotide
  Target: ATXN1; (-) strand; PAM type: NRG; PAM sequence: TGG
tcatctcgaagttgcactgt

SEQ ID NO: 93609 - DNA, 20 bp, Artificial Sequence
  Description of Artificial Sequence: Synthetic oligonucleotide
  Target: ATXN1; (-) strand; PAM type: NRG; PAM sequence: AAG
ttgtaaatgacttcatctcg

SEQ ID NO: 93610 - DNA, 20 bp, Artificial Sequence
  Description of Artificial Sequence: Synthetic oligonucleotide
  Target: ATXN1; (-) strand; PAM type: NRG; PAM sequence: GGG
ggtgaccatccatctcctct

SEQ ID NO: 93611 - DNA, 20 bp, Artificial Sequence
  Description of Artificial Sequence: Synthetic oligonucleotide
  Target: ATXN1; (-) strand; PAM type: NRG; PAM sequence: TGG
gggtgaccatccatctcctc

SEQ ID NO: 93612 - DNA, 20 bp, Artificial Sequence
  Description of Artificial Sequence: Synthetic oligonucleotide
  Target: ATXN1; (-) strand; PAM type: NRG; PAM sequence: GGG
cccttttgagttggccggcc

SEQ ID NO: 93613 - DNA, 20 bp, Artificial Sequence
  Description of Artificial Sequence: Synthetic oligonucleotide
  Target: ATXN1; (-) strand; PAM type: NRG; PAM sequence: CGG
gcccttttgagttggccggc

SEQ ID NO: 93614 - DNA, 20 bp, Artificial Sequence
  Description of Artificial Sequence: Synthetic oligonucleotide
  Target: ATXN1; (-) strand; PAM type: NRG; PAM sequence: CGG
ctgtgcccttttgagttggc

SEQ ID NO: 93615 - DNA, 20 bp, Artificial Sequence
  Description of Artificial Sequence: Synthetic oligonucleotide
  Target: ATXN1; (-) strand; PAM type: NRG; PAM sequence: TGG
ttatctgtgcccttttgagt

SEQ ID NO: 93616 - DNA, 20 bp, Artificial Sequence
  Description of Artificial Sequence: Synthetic oligonucleotide
  Target: ATXN1; (-) strand; PAM type: NRG; PAM sequence: GAG
aatcttatctgtgccctttt

SEQ ID NO: 93617 - DNA, 20 bp, Artificial Sequence
  Description of Artificial Sequence: Synthetic oligonucleotide
  Target: ATXN1; (-) strand; PAM type: NRG; PAM sequence: AGG
tatgaaaccggtggggtagg

SEQ ID NO: 93618 - DNA, 20 bp, Artificial Sequence
  Description of Artificial Sequence: Synthetic oligonucleotide
  Target: ATXN1; (-) strand; PAM type: NRG; PAM sequence: GAG
gtatgaaaccggtggggtag

SEQ ID NO: 93619 - DNA, 20 bp, Artificial Sequence
  Description of Artificial Sequence: Synthetic oligonucleotide
  Target: ATXN1; (-) strand; PAM type: NRG; PAM sequence: AGG
aagtatgaaaccggtggggt

SEQ ID NO: 93620 - DNA, 20 bp, Artificial Sequence
  Description of Artificial Sequence: Synthetic oligonucleotide
  Target: ATXN1; (-) strand; PAM type: NRG; PAM sequence: TAG
caagtatgaaaccggtgggg

SEQ ID NO: 93621 - DNA, 20 bp, Artificial Sequence
  Description of Artificial Sequence: Synthetic oligonucleotide
  Target: ATXN1; (-) strand; PAM type: NRG; PAM sequence: GGG
cgtcaagtatgaaaccggtg

SEQ ID NO: 93622 - DNA, 20 bp, Artificial Sequence
  Description of Artificial Sequence: Synthetic oligonucleotide
  Target: ATXN1; (-) strand; PAM type: NRG; PAM sequence: GGG
tcgtcaagtatgaaaccggt

SEQ ID NO: 93623 - DNA, 20 bp, Artificial Sequence
  Description of Artificial Sequence: Synthetic oligonucleotide
  Target: ATXN1; (-) strand; PAM type: NRG; PAM sequence: TGG
ctcgtcaagtatgaaaccgg

SEQ ID NO: 93624 - DNA, 20 bp, Artificial Sequence
  Description of Artificial Sequence: Synthetic oligonucleotide
  Target: ATXN1; (-) strand; PAM type: NRG; PAM sequence: CGG
ctgctcgtcaagtatgaaac

SEQ ID NO: 93625 - DNA, 20 bp, Artificial Sequence
  Description of Artificial Sequence: Synthetic oligonucleotide
  Target: ATXN1; (-) strand; PAM type: NRG; PAM sequence: AAG
ttctgcaaaccctgctcgtc

SEQ ID NO: 93626 - DNA, 20 bp, Artificial Sequence
  Description of Artificial Sequence: Synthetic oligonucleotide
  Target: ATXN1; (-) strand; PAM type: NRG; PAM sequence: GGG
gagaactgcttaaaggggta

SEQ ID NO: 93627 - DNA, 20 bp, Artificial Sequence
  Description of Artificial Sequence: Synthetic oligonucleotide
  Target: ATXN1; (-) strand; PAM type: NRG; PAM sequence: AGG
ggagaactgcttaaaggggt

SEQ ID NO: 93628 - DNA, 20 bp, Artificial Sequence
  Description of Artificial Sequence: Synthetic oligonucleotide
  Target: ATXN1; (-) strand; PAM type: NRG; PAM sequence: TAG
aggagaactgcttaaagggg

SEQ ID NO: 93629 - DNA, 20 bp, Artificial Sequence
  Description of Artificial Sequence: Synthetic oligonucleotide
  Target: ATXN1; (-) strand; PAM type: NRG; PAM sequence: GGG
gaaaggagaactgcttaaag

SEQ ID NO: 93630 - DNA, 20 bp, Artificial Sequence
  Description of Artificial Sequence: Synthetic oligonucleotide
  Target: ATXN1; (-) strand; PAM type: NRG; PAM sequence: GGG
ggaaaggagaactgcttaaa

SEQ ID NO: 93631 - DNA, 20 bp, Artificial Sequence
  Description of Artificial Sequence: Synthetic oligonucleotide
  Target: ATXN1; (-) strand; PAM type: NRG; PAM sequence: AGG
tggaaaggagaactgcttaa

SEQ ID NO: 93632 - DNA, 20 bp, Artificial Sequence
  Description of Artificial Sequence: Synthetic oligonucleotide
  Target: ATXN1; (-) strand; PAM type: NRG; PAM sequence: AAG
atggaaaggagaactgctta

SEQ ID NO: 93633 - DNA, 20 bp, Artificial Sequence
  Description of Artificial Sequence: Synthetic oligonucleotide
  Target: ATXN1; (-) strand; PAM type: NRG; PAM sequence: GAG
ttaaggtaccacatggaaag

SEQ ID NO: 93634 - DNA, 20 bp, Artificial Sequence
  Description of Artificial Sequence: Synthetic oligonucleotide
  Target: ATXN1; (-) strand; PAM type: NRG; PAM sequence: AGG
ggttaaggtaccacatggaa

SEQ ID NO: 93635 - DNA, 20 bp, Artificial Sequence
  Description of Artificial Sequence: Synthetic oligonucleotide
  Target: ATXN1; (-) strand; PAM type: NRG; PAM sequence: AAG
aggttaaggtaccacatgga

SEQ ID NO: 93636 - DNA, 20 bp, Artificial Sequence
  Description of Artificial Sequence: Synthetic oligonucleotide
  Target: ATXN1; (-) strand; PAM type: NRG; PAM sequence: TGG
atttaggttaaggtaccaca

SEQ ID NO: 93637 - DNA, 20 bp, Artificial Sequence
  Description of Artificial Sequence: Synthetic oligonucleotide
  Target: ATXN1; (-) strand; PAM type: NRG; PAM sequence: AGG
ggttggttagatttaggtta

SEQ ID NO: 93638 - DNA, 20 bp, Artificial Sequence
  Description of Artificial Sequence: Synthetic oligonucleotide
  Target: ATXN1; (-) strand; PAM type: NRG; PAM sequence: AAG
tggttggttagatttaggtt

SEQ ID NO: 93639 - DNA, 20 bp, Artificial Sequence
  Description of Artificial Sequence: Synthetic oligonucleotide
  Target: ATXN1; (-) strand; PAM type: NRG; PAM sequence: AGG
gaggttggttggttagattt

SEQ ID NO: 93640 - DNA, 20 bp, Artificial Sequence
  Description of Artificial Sequence: Synthetic oligonucleotide
  Target: ATXN1; (-) strand; PAM type: NRG; PAM sequence: TAG
tgaggttggttggttagatt

SEQ ID NO: 93641 - DNA, 20 bp, Artificial Sequence
  Description of Artificial Sequence: Synthetic oligonucleotide
  Target: ATXN1; (-) strand; PAM type: NRG; PAM sequence: TAG
tctaagtgaggttggttggt

SEQ ID NO: 93642 - DNA, 20 bp, Artificial Sequence
  Description of Artificial Sequence: Synthetic oligonucleotide
  Target: ATXN1; (-) strand; PAM type: NRG; PAM sequence: TGG
aagttctaagtgaggttggt

SEQ ID NO: 93643 - DNA, 20 bp, Artificial Sequence
  Description of Artificial Sequence: Synthetic oligonucleotide
  Target: ATXN1; (-) strand; PAM type: NRG; PAM sequence: TGG
tctgaagttctaagtgaggt

SEQ ID NO: 93644 - DNA, 20 bp, Artificial Sequence
  Description of Artificial Sequence: Synthetic oligonucleotide
  Target: ATXN1; (-) strand; PAM type: NRG; PAM sequence: AGG
tagttctgaagttctaagtg

SEQ ID NO: 93645 - DNA, 20 bp, Artificial Sequence
  Description of Artificial Sequence: Synthetic oligonucleotide
  Target: ATXN1; (-) strand; PAM type: NRG; PAM sequence: GAG
gtagttctgaagttctaagt

SEQ ID NO: 93646 - DNA, 20 bp, Artificial Sequence
  Description of Artificial Sequence: Synthetic oligonucleotide
  Target: ATXN1; (-) strand; PAM type: NRG; PAM sequence: AAG
gagagtagttctgaagttct

SEQ ID NO: 93647 - DNA, 20 bp, Artificial Sequence
  Description of Artificial Sequence: Synthetic oligonucleotide
  Target: ATXN1; (-) strand; PAM type: NRG; PAM sequence: AAG
tctggaagagagtagttctg

SEQ ID NO: 93648 - DNA, 20 bp, Artificial Sequence
  Description of Artificial Sequence: Synthetic oligonucleotide
  Target: ATXN1; (-) strand; PAM type: NRG; PAM sequence: TAG
tacttttatctggaagagag

SEQ ID NO: 93649 - DNA, 20 bp, Artificial Sequence
  Description of Artificial Sequence: Synthetic oligonucleotide
  Target: ATXN1; (-) strand; PAM type: NRG; PAM sequence: GAG
agatacttttatctggaaga

SEQ ID NO: 93650 - DNA, 20 bp, Artificial Sequence
  Description of Artificial Sequence: Synthetic oligonucleotide
  Target: ATXN1; (-) strand; PAM type: NRG; PAM sequence: GAG
ggagatacttttatctggaa

SEQ ID NO: 93651 - DNA, 20 bp, Artificial Sequence
  Description of Artificial Sequence: Synthetic oligonucleotide
  Target: ATXN1; (-) strand; PAM type: NRG; PAM sequence: AAG
aaggagatacttttatctgg

SEQ ID NO: 93652 - DNA, 20 bp, Artificial Sequence
  Description of Artificial Sequence: Synthetic oligonucleotide
  Target: ATXN1; (-) strand; PAM type: NRG; PAM sequence: TGG
cccaaggagatacttttatc

SEQ ID NO: 93653 - DNA, 20 bp, Artificial Sequence
  Description of Artificial Sequence: Synthetic oligonucleotide
  Target: ATXN1; (-) strand; PAM type: NRG; PAM sequence: GAG
agtgagatagttatcccaag

SEQ ID NO: 93654 - DNA, 20 bp, Artificial Sequence
  Description of Artificial Sequence: Synthetic oligonucleotide
  Target: ATXN1; (-) strand; PAM type: NRG; PAM sequence: AGG
ctagtgagatagttatccca

SEQ ID NO: 93655 - DNA, 20 bp, Artificial Sequence
  Description of Artificial Sequence: Synthetic oligonucleotide
  Target: ATXN1; (-) strand; PAM type: NRG; PAM sequence: AAG
tctagtgagatagttatccc

SEQ ID NO: 93656 - DNA, 20 bp, Artificial Sequence
  Description of Artificial Sequence: Synthetic oligonucleotide
  Target: ATXN1; (-) strand; PAM type: NRG; PAM sequence: TAG
ggtgaaagtttctagtgaga

SEQ ID NO: 93657 - DNA, 20 bp, Artificial Sequence
  Description of Artificial Sequence: Synthetic oligonucleotide
  Target: ATXN1; (-) strand; PAM type: NRG; PAM sequence: GAG
ctcaggtgaaagtttctagt

SEQ ID NO: 93658 - DNA, 20 bp, Artificial Sequence
  Description of Artificial Sequence: Synthetic oligonucleotide
  Target: ATXN1; (-) strand; PAM type: NRG; PAM sequence: TAG
gcaactcaggtgaaagtttc

SEQ ID NO: 93659 - DNA, 20 bp, Artificial Sequence
  Description of Artificial Sequence: Synthetic oligonucleotide
  Target: ATXN1; (-) strand; PAM type: NRG; PAM sequence: AAG
atactctgcaactcaggtga

SEQ ID NO: 93660 - DNA, 20 bp, Artificial Sequence
  Description of Artificial Sequence: Synthetic oligonucleotide
  Target: ATXN1; (-) strand; PAM type: NRG; PAM sequence: AGG
gtggtcatactctgcaactc

SEQ ID NO: 93661 - DNA, 20 bp, Artificial Sequence
  Description of Artificial Sequence: Synthetic oligonucleotide
  Target: ATXN1; (-) strand; PAM type: NRG; PAM sequence: CAG
cgtggtcatactctgcaact

SEQ ID NO: 93662 - DNA, 20 bp, Artificial Sequence
  Description of Artificial Sequence: Synthetic oligonucleotide
  Target: ATXN1; (-) strand; PAM type: NRG; PAM sequence: TGG
gtctcctttaagtgctctcg

SEQ ID NO: 93663 - DNA, 20 bp, Artificial Sequence
  Description of Artificial Sequence: Synthetic oligonucleotide
  Target: ATXN1; (-) strand; PAM type: NRG; PAM sequence: AAG
gactttgatcagtctccttt

SEQ ID NO: 93664 - DNA, 20 bp, Artificial Sequence
  Description of Artificial Sequence: Synthetic oligonucleotide
  Target: ATXN1; (-) strand; PAM type: NRG; PAM sequence: CAG
atctgttttctgactttgat

SEQ ID NO: 93665 - DNA, 20 bp, Artificial Sequence
  Description of Artificial Sequence: Synthetic oligonucleotide
  Target: ATXN1; (-) strand; PAM type: NRG; PAM sequence: AGG
cgaatgaataaatgaatttg

SEQ ID NO: 93666 - DNA, 20 bp, Artificial Sequence
  Description of Artificial Sequence: Synthetic oligonucleotide
  Target: ATXN1; (-) strand; PAM type: NRG; PAM sequence: GAG
tcgaatgaataaatgaattt

SEQ ID NO: 93667 - DNA, 20 bp, Artificial Sequence
  Description of Artificial Sequence: Synthetic oligonucleotide
  Target: ATXN1; (-) strand; PAM type: NRG; PAM sequence: CAG
tatgaagatttttagaaatg

SEQ ID NO: 93668 - DNA, 20 bp, Artificial Sequence
  Description of Artificial Sequence: Synthetic oligonucleotide
  Target: ATXN1; (-) strand; PAM type: NRG; PAM sequence: TAG
ttcgattatatgaagatttt

SEQ ID NO: 93669 - DNA, 20 bp, Artificial Sequence
  Description of Artificial Sequence: Synthetic oligonucleotide
  Target: ATXN1; (-) strand; PAM type: NRG; PAM sequence: AAG
tactgaatttcgattatatg

SEQ ID NO: 93670 - DNA, 20 bp, Artificial Sequence
  Description of Artificial Sequence: Synthetic oligonucleotide
  Target: ATXN1; (-) strand; PAM type: NRG; PAM sequence: AAG
gcttttgtttttgaacgtct

SEQ ID NO: 93671 - DNA, 20 bp, Artificial Sequence
  Description of Artificial Sequence: Synthetic oligonucleotide
  Target: ATXN1; (-) strand; PAM type: NRG; PAM sequence: AGG
ttattattgaaattcaatac

SEQ ID NO: 93672 - DNA, 20 bp, Artificial Sequence
  Description of Artificial Sequence: Synthetic oligonucleotide
  Target: ATXN1; (-) strand; PAM type: NRG; PAM sequence: CAG
attattattgaaattcaata

SEQ ID NO: 93673 - DNA, 20 bp, Artificial Sequence
  Description of Artificial Sequence: Synthetic oligonucleotide
  Target: ATXN1; (-) strand; PAM type: NRG; PAM sequence: TAG
tcaatcatatttaagtttta

SEQ ID NO: 93674 - DNA, 20 bp, Artificial Sequence
  Description of Artificial Sequence: Synthetic oligonucleotide
  Target: ATXN1; (-) strand; PAM type: NRG; PAM sequence: AAG
gaattcgctcaatcatattt

SEQ ID NO: 93675 - DNA, 20 bp, Artificial Sequence
  Description of Artificial Sequence: Synthetic oligonucleotide
  Target: ATXN1; (-) strand; PAM type: NRG; PAM sequence: GAG
aaagaaagctgtacgtaata

SEQ ID NO: 93676 - DNA, 20 bp, Artificial Sequence
  Description of Artificial Sequence: Synthetic oligonucleotide
  Target: ATXN1; (-) strand; PAM type: NRG; PAM sequence: TAG
ggaaagaaagctgtacgtaa

SEQ ID NO: 93677 - DNA, 20 bp, Artificial Sequence
  Description of Artificial Sequence: Synthetic oligonucleotide
  Target: ATXN1; (-) strand; PAM type: NRG; PAM sequence: AAG
tgatgaattttctggaaaga

SEQ ID NO: 93678 - DNA, 20 bp, Artificial Sequence
  Description of Artificial Sequence: Synthetic oligonucleotide
  Target: ATXN1; (-) strand; PAM type: NRG; PAM sequence: AAG
ccaatgatgaattttctgga

SEQ ID NO: 93679 - DNA, 20 bp, Artificial Sequence
  Description of Artificial Sequence: Synthetic oligonucleotide
  Target: ATXN1; (-) strand; PAM type: NRG; PAM sequence: TGG
aggtccaatgatgaattttc

SEQ ID NO: 93680 - DNA, 20 bp, Artificial Sequence
  Description of Artificial Sequence: Synthetic oligonucleotide
  Target: ATXN1; (-) strand; PAM type: NRG; PAM sequence: AGG
cctgtgctaaggagaaagaa

SEQ ID NO: 93681 - DNA, 20 bp, Artificial Sequence
  Description of Artificial Sequence: Synthetic oligonucleotide
  Target: ATXN1; (-) strand; PAM type: NRG; PAM sequence: AAG
gcctgtgctaaggagaaaga

SEQ ID NO: 93682 - DNA, 20 bp, Artificial Sequence
  Description of Artificial Sequence: Synthetic oligonucleotide
  Target: ATXN1; (-) strand; PAM type: NRG; PAM sequence: AAG
agaagcctgtgctaaggaga

SEQ ID NO: 93683 - DNA, 20 bp, Artificial Sequence
  Description of Artificial Sequence: Synthetic oligonucleotide
  Target: ATXN1; (-) strand; PAM type: NRG; PAM sequence: GAG
tgtaagaagcctgtgctaag

SEQ ID NO: 93684 - DNA, 20 bp, Artificial Sequence
  Description of Artificial Sequence: Synthetic oligonucleotide
  Target: ATXN1; (-) strand; PAM type: NRG; PAM sequence: AGG
tgtgtaagaagcctgtgcta

SEQ ID NO: 93685 - DNA, 20 bp, Artificial Sequence
  Description of Artificial Sequence: Synthetic oligonucleotide
  Target: ATXN1; (-) strand; PAM type: NRG; PAM sequence: AAG
atgtgtaagaagcctgtgct

SEQ ID NO: 93686 - DNA, 20 bp, Artificial Sequence
  Description of Artificial Sequence: Synthetic oligonucleotide
  Target: ATXN1; (-) strand; PAM type: NRG; PAM sequence: AAG
aggtgacaaaaatgtgtaag

SEQ ID NO: 93687 - DNA, 20 bp, Artificial Sequence
  Description of Artificial Sequence: Synthetic oligonucleotide
  Target: ATXN1; (-) strand; PAM type: NRG; PAM sequence: AAG
aaaaggtgacaaaaatgtgt

SEQ ID NO: 93688 - DNA, 20 bp, Artificial Sequence
  Description of Artificial Sequence: Synthetic oligonucleotide
  Target: ATXN1; (-) strand; PAM type: NRG; PAM sequence: AGG
ccatcacacagtgagtgaaa

SEQ ID NO: 93689 - DNA, 20 bp, Artificial Sequence
  Description of Artificial Sequence: Synthetic oligonucleotide
  Target: ATXN1; (-) strand; PAM type: NRG; PAM sequence: AAG
tccatcacacagtgagtgaa

SEQ ID NO: 93690 - DNA, 20 bp, Artificial Sequence
  Description of Artificial Sequence: Synthetic oligonucleotide
  Target: ATXN1; (-) strand; PAM type: NRG; PAM sequence: GAG
tgctttgtccatcacacagt

SEQ ID NO: 93691 - DNA, 20 bp, Artificial Sequence
  Description of Artificial Sequence: Synthetic oligonucleotide
  Target: ATXN1; (-) strand; PAM type: NRG; PAM sequence: CAG
tttgtgctttgtccatcaca

SEQ ID NO: 93692 - DNA, 20 bp, Artificial Sequence
  Description of Artificial Sequence: Synthetic oligonucleotide
  Target: ATXN1; (-) strand; PAM type: NRG; PAM sequence: TGG
atggcacctgtttgttccac

SEQ ID NO: 93693 - DNA, 20 bp, Artificial Sequence
  Description of Artificial Sequence: Synthetic oligonucleotide
  Target: ATXN1; (-) strand; PAM type: NRG; PAM sequence: TGG
cacagtggtggaaaaagcta

SEQ ID NO: 93694 - DNA, 20 bp, Artificial Sequence
  Description of Artificial Sequence: Synthetic oligonucleotide
  Target: ATXN1; (-) strand; PAM type: NRG; PAM sequence: AAG
gtgaaccacagtggtggaaa

SEQ ID NO: 93695 - DNA, 20 bp, Artificial Sequence
  Description of Artificial Sequence: Synthetic oligonucleotide
  Target: ATXN1; (-) strand; PAM type: NRG; PAM sequence: TGG
ggtcctgtgaaccacagtgg

SEQ ID NO: 93696 - DNA, 20 bp, Artificial Sequence
  Description of Artificial Sequence: Synthetic oligonucleotide
  Target: ATXN1; (-) strand; PAM type: NRG; PAM sequence: TGG
tggggtcctgtgaaccacag

SEQ ID NO: 93697 - DNA, 20 bp, Artificial Sequence
  Description of Artificial Sequence: Synthetic oligonucleotide
  Target: ATXN1; (-) strand; PAM type: NRG; PAM sequence: CAG
gcatggggtcctgtgaacca

SEQ ID NO: 93698 - DNA, 20 bp, Artificial Sequence
  Description of Artificial Sequence: Synthetic oligonucleotide
  Target: ATXN1; (-) strand; PAM type: NRG; PAM sequence: GGG
tgtggtcaggaaccagcatg

SEQ ID NO: 93699 - DNA, 20 bp, Artificial Sequence
  Description of Artificial Sequence: Synthetic oligonucleotide
  Target: ATXN1; (-) strand; PAM type: NRG; PAM sequence: GGG
ttgtggtcaggaaccagcat

SEQ ID NO: 93700 - DNA, 20 bp, Artificial Sequence
  Description of Artificial Sequence: Synthetic oligonucleotide
  Target: ATXN1; (-) strand; PAM type: NRG; PAM sequence: TGG
attgtggtcaggaaccagca

SEQ ID NO: 93701 - DNA, 20 bp, Artificial Sequence
  Description of Artificial Sequence: Synthetic oligonucleotide
  Target: ATXN1; (-) strand; PAM type: NRG; PAM sequence: CAG
gtataattgtggtcaggaac

SEQ ID NO: 93702 - DNA, 20 bp, Artificial Sequence
  Description of Artificial Sequence: Synthetic oligonucleotide
  Target: ATXN1; (-) strand; PAM type: NRG; PAM sequence: AGG
tggtgtgtataattgtggtc

SEQ ID NO: 93703 - DNA, 20 bp, Artificial Sequence
  Description of Artificial Sequence: Synthetic oligonucleotide
  Target: ATXN1; (-) strand; PAM type: NRG; PAM sequence: CAG
gtggtgtgtataattgtggt

SEQ ID NO: 93704 - DNA, 20 bp, Artificial Sequence
  Description of Artificial Sequence: Synthetic oligonucleotide
  Target: ATXN1; (-) strand; PAM type: NRG; PAM sequence: TGG
aattgtggtgtgtataattg

SEQ ID NO: 93705 - DNA, 20 bp, Artificial Sequence
  Description of Artificial Sequence: Synthetic oligonucleotide
  Target: ATXN1; (-) strand; PAM type: NRG; PAM sequence: TGG
gactgtgatgtatataattg

SEQ ID NO: 93706 - DNA, 20 bp, Artificial Sequence
  Description of Artificial Sequence: Synthetic oligonucleotide
  Target: ATXN1; (-) strand; PAM type: NRG; PAM sequence: TGG
tgtgattccatctattaata

SEQ ID NO: 93707 - DNA, 20 bp, Artificial Sequence
  Description of Artificial Sequence: Synthetic oligonucleotide
  Target: ATXN1; (-) strand; PAM type: NRG; PAM sequence: TGG
gtgatgcttatgttacaaat

SEQ ID NO: 93708 - DNA, 20 bp, Artificial Sequence
  Description of Artificial Sequence: Synthetic oligonucleotide
  Target: ATXN1; (-) strand; PAM type: NRG; PAM sequence: GGG
agtgaatgggcaatacatac

SEQ ID NO: 93709 - DNA, 20 bp, Artificial Sequence
  Description of Artificial Sequence: Synthetic oligonucleotide
  Target: ATXN1; (-) strand; PAM type: NRG; PAM sequence: CGG
tagtgaatgggcaatacata

SEQ ID NO: 93710 - DNA, 20 bp, Artificial Sequence
  Description of Artificial Sequence: Synthetic oligonucleotide
  Target: ATXN1; (-) strand; PAM type: NRG; PAM sequence: GGG
gtatgtggcatctagtgaat

SEQ ID NO: 93711 - DNA, 20 bp, Artificial Sequence
  Description of Artificial Sequence: Synthetic oligonucleotide
  Target: ATXN1; (-) strand; PAM type: NRG; PAM sequence: TGG
agtatgtggcatctagtgaa

SEQ ID NO: 93712 - DNA, 20 bp, Artificial Sequence
  Description of Artificial Sequence: Synthetic oligonucleotide
  Target: ATXN1; (-) strand; PAM type: NRG; PAM sequence: TAG
tctttccagtatgtggcatc

SEQ ID NO: 93713 - DNA, 20 bp, Artificial Sequence
  Description of Artificial Sequence: Synthetic oligonucleotide
  Target: ATXN1; (-) strand; PAM type: NRG; PAM sequence: TGG
actgccctctttccagtatg

SEQ ID NO: 93714 - DNA, 20 bp, Artificial Sequence
  Description of Artificial Sequence: Synthetic oligonucleotide
  Target: ATXN1; (-) strand; PAM type: NRG; PAM sequence: CAG
aggagggactgccctctttc

SEQ ID NO: 93715 - DNA, 20 bp, Artificial Sequence
  Description of Artificial Sequence: Synthetic oligonucleotide
  Target: ATXN1; (-) strand; PAM type: NRG; PAM sequence: GGG
ttcctggcccagcgatagga

SEQ ID NO: 93716 - DNA, 20 bp, Artificial Sequence
  Description of Artificial Sequence: Synthetic oligonucleotide
  Target: ATXN1; (-) strand; PAM type: NRG; PAM sequence: AGG
tttcctggcccagcgatagg

SEQ ID NO: 93717 - DNA, 20 bp, Artificial Sequence
  Description of Artificial Sequence: Synthetic oligonucleotide
  Target: ATXN1; (-) strand; PAM type: NRG; PAM sequence: GAG
ctttcctggcccagcgatag

SEQ ID NO: 93718 - DNA, 20 bp, Artificial Sequence
  Description of Artificial Sequence: Synthetic oligonucleotide
  Target: ATXN1; (-) strand; PAM type: NRG; PAM sequence: AGG
ccctttcctggcccagcgat

SEQ ID NO: 93719 - DNA, 20 bp, Artificial Sequence
  Description of Artificial Sequence: Synthetic oligonucleotide
  Target: ATXN1; (-) strand; PAM type: NRG; PAM sequence: TAG
cccctttcctggcccagcga

SEQ ID NO: 93720 - DNA, 20 bp, Artificial Sequence
  Description of Artificial Sequence: Synthetic oligonucleotide
  Target: ATXN1; (-) strand; PAM type: NRG; PAM sequence: CAG
tcacaacccctttcctggcc

SEQ ID NO: 93721 - DNA, 20 bp, Artificial Sequence
  Description of Artificial Sequence: Synthetic oligonucleotide
  Target: ATXN1; (-) strand; PAM type: NRG; PAM sequence: TGG
atacttcacaacccctttcc

SEQ ID NO: 93722 - DNA, 20 bp, Artificial Sequence
  Description of Artificial Sequence: Synthetic oligonucleotide
  Target: ATXN1; (-) strand; PAM type: NRG; PAM sequence: TAG
ctaccttttctgggttccca

SEQ ID NO: 93723 - DNA, 20 bp, Artificial Sequence
  Description of Artificial Sequence: Synthetic oligonucleotide
  Target: ATXN1; (-) strand; PAM type: NRG; PAM sequence: GGG
tgttatttgctaccttttct

SEQ ID NO: 93724 - DNA, 20 bp, Artificial Sequence
  Description of Artificial Sequence: Synthetic oligonucleotide
  Target: ATXN1; (-) strand; PAM type: NRG; PAM sequence: TGG
atgttatttgctaccttttc

SEQ ID NO: 93725 - DNA, 20 bp, Artificial Sequence
  Description of Artificial Sequence: Synthetic oligonucleotide
  Target: ATXN1; (-) strand; PAM type: NRG; PAM sequence: GGG
ctcacgaagcccttggacta

SEQ ID NO: 93726 - DNA, 20 bp, Artificial Sequence
  Description of Artificial Sequence: Synthetic oligonucleotide
  Target: ATXN1; (-) strand; PAM type: NRG; PAM sequence: AGG
cctcacgaagcccttggact

SEQ ID NO: 93727 - DNA, 20 bp, Artificial Sequence
  Description of Artificial Sequence: Synthetic oligonucleotide
  Target: ATXN1; (-) strand; PAM type: NRG; PAM sequence: TAG
tcctcacgaagcccttggac

SEQ ID NO: 93728 - DNA, 20 bp, Artificial Sequence
  Description of Artificial Sequence: Synthetic oligonucleotide
  Target: ATXN1; (-) strand; PAM type: NRG; PAM sequence: TGG
tctcttcctcacgaagccct

SEQ ID NO: 93729 - DNA, 20 bp, Artificial Sequence
  Description of Artificial Sequence: Synthetic oligonucleotide
  Target: ATXN1; (-) strand; PAM type: NRG; PAM sequence: AAG
cttagagtctcttcctcacg

SEQ ID NO: 93730 - DNA, 20 bp, Artificial Sequence
  Description of Artificial Sequence: Synthetic oligonucleotide
  Target: ATXN1; (-) strand; PAM type: NRG; PAM sequence: GAG
attcttgaaatctcagctta

SEQ ID NO: 93731 - DNA, 20 bp, Artificial Sequence
  Description of Artificial Sequence: Synthetic oligonucleotide
  Target: ATXN1; (-) strand; PAM type: NRG; PAM sequence: TAG
tcattcttgaaatctcagct

SEQ ID NO: 93732 - DNA, 20 bp, Artificial Sequence
  Description of Artificial Sequence: Synthetic oligonucleotide
  Target: ATXN1; (-) strand; PAM type: NRG; PAM sequence: CAG
ttccctcattcttgaaatct

SEQ ID NO: 93733 - DNA, 20 bp, Artificial Sequence
  Description of Artificial Sequence: Synthetic oligonucleotide
  Target: ATXN1; (-) strand; PAM type: NRG; PAM sequence: TGG
gctcctctctctgcactgtc

SEQ ID NO: 93734 - DNA, 20 bp, Artificial Sequence
  Description of Artificial Sequence: Synthetic oligonucleotide
  Target: ATXN1; (-) strand; PAM type: NRG; PAM sequence: CAG
tgttcttcctccttagaacc

SEQ ID NO: 93735 - DNA, 20 bp, Artificial Sequence
  Description of Artificial Sequence: Synthetic oligonucleotide
  Target: ATXN1; (-) strand; PAM type: NRG; PAM sequence: TAG
gacatgttgttcttcctcct

SEQ ID NO: 93736 - DNA, 20 bp, Artificial Sequence
  Description of Artificial Sequence: Synthetic oligonucleotide
  Target: ATXN1; (-) strand; PAM type: NRG; PAM sequence: TAG
ctgttttttgctccagcctt

SEQ ID NO: 93737 - DNA, 20 bp, Artificial Sequence
  Description of Artificial Sequence: Synthetic oligonucleotide
  Target: ATXN1; (-) strand; PAM type: NRG; PAM sequence: CAG
ccatactctgttttttgctc

SEQ ID NO: 93738 - DNA, 20 bp, Artificial Sequence
  Description of Artificial Sequence: Synthetic oligonucleotide
  Target: ATXN1; (-) strand; PAM type: NRG; PAM sequence: AAG
cccatcgcacttcctccttc

SEQ ID NO: 93739 - DNA, 20 bp, Artificial Sequence
  Description of Artificial Sequence: Synthetic oligonucleotide
  Target: ATXN1; (-) strand; PAM type: NRG; PAM sequence: CGG
gccctgtattcgtcccacgt

SEQ ID NO: 93740 - DNA, 20 bp, Artificial Sequence
  Description of Artificial Sequence: Synthetic oligonucleotide
  Target: ATXN1; (-) strand; PAM type: NRG; PAM sequence: CAG
gaggaccttccttatctctc

SEQ ID NO: 93741 - DNA, 20 bp, Artificial Sequence
  Description of Artificial Sequence: Synthetic oligonucleotide
  Target: ATXN1; (-) strand; PAM type: NRG; PAM sequence: AGG
gcctggctccataggttttg

SEQ ID NO: 93742 - DNA, 20 bp, Artificial Sequence
  Description of Artificial Sequence: Synthetic oligonucleotide
  Target: ATXN1; (-) strand; PAM type: NRG; PAM sequence: GAG
agcctggctccataggtttt

SEQ ID NO: 93743 - DNA, 20 bp, Artificial Sequence
  Description of Artificial Sequence: Synthetic oligonucleotide
  Target: ATXN1; (-) strand; PAM type: NRG; PAM sequence: AGG
aatccttagcctggctccat

SEQ ID NO: 93744 - DNA, 20 bp, Artificial Sequence
  Description of Artificial Sequence: Synthetic oligonucleotide
  Target: ATXN1; (-) strand; PAM type: NRG; PAM sequence: TAG
gaatccttagcctggctcca

SEQ ID NO: 93745 - DNA, 20 bp, Artificial Sequence
  Description of Artificial Sequence: Synthetic oligonucleotide
  Target: ATXN1; (-) strand; PAM type: NRG; PAM sequence: TGG
aaagtctagaatccttagcc

SEQ ID NO: 93746 - DNA, 20 bp, Artificial Sequence
  Description of Artificial Sequence: Synthetic oligonucleotide
  Target: ATXN1; (-) strand; PAM type: NRG; PAM sequence: TAG
aggataaagtctagaatcct

SEQ ID NO: 93747 - DNA, 20 bp, Artificial Sequence
  Description of Artificial Sequence: Synthetic oligonucleotide
  Target: ATXN1; (-) strand; PAM type: NRG; PAM sequence: TAG
atggtcctcaggataaagtc

SEQ ID NO: 93748 - DNA, 20 bp, Artificial Sequence
  Description of Artificial Sequence: Synthetic oligonucleotide
  Target: ATXN1; (-) strand; PAM type: NRG; PAM sequence: AAG
ttctcatggtcctcaggata

SEQ ID NO: 93749 - DNA, 20 bp, Artificial Sequence
  Description of Artificial Sequence: Synthetic oligonucleotide
  Target: ATXN1; (-) strand; PAM type: NRG; PAM sequence: AGG
cctgggttctcatggtcctc

SEQ ID NO: 93750 - DNA, 20 bp, Artificial Sequence
  Description of Artificial Sequence: Synthetic oligonucleotide
  Target: ATXN1; (-) strand; PAM type: NRG; PAM sequence: CAG
ccctgggttctcatggtcct

SEQ ID NO: 93751 - DNA, 20 bp, Artificial Sequence
  Description of Artificial Sequence: Synthetic oligonucleotide
  Target: ATXN1; (-) strand; PAM type: NRG; PAM sequence: TGG
actccctccctgggttctca

SEQ ID NO: 93752 - DNA, 20 bp, Artificial Sequence
  Description of Artificial Sequence: Synthetic oligonucleotide
  Target: ATXN1; (-) strand; PAM type: NRG; PAM sequence: GGG
tttttcttaactccctccct

SEQ ID NO: 93753 - DNA, 20 bp, Artificial Sequence
  Description of Artificial Sequence: Synthetic oligonucleotide
  Target: ATXN1; (-) strand; PAM type: NRG; PAM sequence: TGG
gtttttcttaactccctccc

SEQ ID NO: 93754 - DNA, 20 bp, Artificial Sequence
  Description of Artificial Sequence: Synthetic oligonucleotide
  Target: ATXN1; (-) strand; PAM type: NRG; PAM sequence: TAG
aagccaaaatgaacatttgt

SEQ ID NO: 93755 - DNA, 20 bp, Artificial Sequence
  Description of Artificial Sequence: Synthetic oligonucleotide
  Target: ATXN1; (-) strand; PAM type: NRG; PAM sequence: AAG
caacatgtttttcctctttg

SEQ ID NO: 93756 - DNA, 20 bp, Artificial Sequence
  Description of Artificial Sequence: Synthetic oligonucleotide
  Target: ATXN1; (-) strand; PAM type: NRG; PAM sequence: TGG
gtctagatgtattgttgttc

SEQ ID NO: 93757 - DNA, 20 bp, Artificial Sequence
  Description of Artificial Sequence: Synthetic oligonucleotide
  Target: ATXN1; (-) strand; PAM type: NRG; PAM sequence: TAG
tacctcctaaatggcctgtc

SEQ ID NO: 93758 - DNA, 20 bp, Artificial Sequence
  Description of Artificial Sequence: Synthetic oligonucleotide
  Target: ATXN1; (-) strand; PAM type: NRG; PAM sequence: TGG
catatgatatacctcctaaa

SEQ ID NO: 93759 - DNA, 20 bp, Artificial Sequence
  Description of Artificial Sequence: Synthetic oligonucleotide
  Target: ATXN1; (-) strand; PAM type: NRG; PAM sequence: TGG
tctgctgagctggggtggtt

SEQ ID NO: 93760 - DNA, 20 bp, Artificial Sequence
  Description of Artificial Sequence: Synthetic oligonucleotide
  Target: ATXN1; (-) strand; PAM type: NRG; PAM sequence: TGG
gtggctctgctgagctgggg

SEQ ID NO: 93761 - DNA, 20 bp, Artificial Sequence
  Description of Artificial Sequence: Synthetic oligonucleotide
  Target: ATXN1; (-) strand; PAM type: NRG; PAM sequence: GGG
tgagtggctctgctgagctg

SEQ ID NO: 93762 - DNA, 20 bp, Artificial Sequence
  Description of Artificial Sequence: Synthetic oligonucleotide
  Target: ATXN1; (-) strand; PAM type: NRG; PAM sequence: GGG
ctgagtggctctgctgagct

SEQ ID NO: 93763 - DNA, 20 bp, Artificial Sequence
  Description of Artificial Sequence: Synthetic oligonucleotide
  Target: ATXN1; (-) strand; PAM type: NRG; PAM sequence: TGG
gctgagtggctctgctgagc

SEQ ID NO: 93764 - DNA, 20 bp, Artificial Sequence
  Description of Artificial Sequence: Synthetic oligonucleotide
  Target: ATXN1; (-) strand; PAM type: NRG; PAM sequence: GAG
tttagctgagtggctctgct

SEQ ID NO: 93765 - DNA, 20 bp, Artificial Sequence
  Description of Artificial Sequence: Synthetic oligonucleotide
  Target: ATXN1; (-) strand; PAM type: NRG; PAM sequence: TGG
aagtgtgagttttagctgag

SEQ ID NO: 93766 - DNA, 20 bp, Artificial Sequence
  Description of Artificial Sequence: Synthetic oligonucleotide
  Target: ATXN1; (-) strand; PAM type: NRG; PAM sequence: GAG
tcaaagtgtgagttttagct

SEQ ID NO: 93767 - DNA, 20 bp, Artificial Sequence
  Description of Artificial Sequence: Synthetic oligonucleotide
  Target: ATXN1; (-) strand; PAM type: NRG; PAM sequence: TAG
tggtctcaaagtgtgagttt

SEQ ID NO: 93768 - DNA, 20 bp, Artificial Sequence
  Description of Artificial Sequence: Synthetic oligonucleotide
  Target: ATXN1; (-) strand; PAM type: NRG; PAM sequence: GAG
gaaggctggtctcaaagtgt

SEQ ID NO: 93769 - DNA, 20 bp, Artificial Sequence
  Description of Artificial Sequence: Synthetic oligonucleotide
  Target: ATXN1; (-) strand; PAM type: NRG; PAM sequence: AAG
tttgaggaaggctggtctca

SEQ ID NO: 93770 - DNA, 20 bp, Artificial Sequence
  Description of Artificial Sequence: Synthetic oligonucleotide
  Target: ATXN1; (-) strand; PAM type: NRG; PAM sequence: TGG
ttgaattttttgaggaaggc

SEQ ID NO: 93771 - DNA, 20 bp, Artificial Sequence
  Description of Artificial Sequence: Synthetic oligonucleotide
  Target: ATXN1; (-) strand; PAM type: NRG; PAM sequence: AGG
gggattgaattttttgagga

SEQ ID NO: 93772 - DNA, 20 bp, Artificial Sequence
  Description of Artificial Sequence: Synthetic oligonucleotide
  Target: ATXN1; (-) strand; PAM type: NRG; PAM sequence: AAG
agggattgaattttttgagg

SEQ ID NO: 93773 - DNA, 20 bp, Artificial Sequence
  Description of Artificial Sequence: Synthetic oligonucleotide
  Target: ATXN1; (-) strand; PAM type: NRG; PAM sequence: AGG
cctagggattgaattttttg

SEQ ID NO: 93774 - DNA, 20 bp, Artificial Sequence
  Description of Artificial Sequence: Synthetic oligonucleotide
  Target: ATXN1; (-) strand; PAM type: NRG; PAM sequence: GAG
tcctagggattgaatttttt

SEQ ID NO: 93775 - DNA, 20 bp, Artificial Sequence
  Description of Artificial Sequence: Synthetic oligonucleotide
  Target: ATXN1; (-) strand; PAM type: NRG; PAM sequence: GGG
aggttgggaacaacttccta

SEQ ID NO: 93776 - DNA, 20 bp, Artificial Sequence
  Description of Artificial Sequence: Synthetic oligonucleotide
  Target: ATXN1; (-) strand; PAM type: NRG; PAM sequence: AGG
aaggttgggaacaacttcct

SEQ ID NO: 93777 - DNA, 20 bp, Artificial Sequence
  Description of Artificial Sequence: Synthetic oligonucleotide
  Target: ATXN1; (-) strand; PAM type: NRG; PAM sequence: TAG
gaaggttgggaacaacttcc

SEQ ID NO: 93778 - DNA, 20 bp, Artificial Sequence
  Description of Artificial Sequence: Synthetic oligonucleotide
  Target: ATXN1; (-) strand; PAM type: NRG; PAM sequence: GGG
agctcttccagtggaaggtt

SEQ ID NO: 93779 - DNA, 20 bp, Artificial Sequence
  Description of Artificial Sequence: Synthetic oligonucleotide
  Target: ATXN1; (-) strand; PAM type: NRG; PAM sequence: TGG
tagctcttccagtggaaggt

SEQ ID NO: 93780 - DNA, 20 bp, Artificial Sequence
  Description of Artificial Sequence: Synthetic oligonucleotide
  Target: ATXN1; (-) strand; PAM type: NRG; PAM sequence: AGG
gggatagctcttccagtgga

SEQ ID NO: 93781 - DNA, 20 bp, Artificial Sequence
  Description of Artificial Sequence: Synthetic oligonucleotide
  Target: ATXN1; (-) strand; PAM type: NRG; PAM sequence: AAG
ggggatagctcttccagtgg

SEQ ID NO: 93782 - DNA, 20 bp, Artificial Sequence
  Description of Artificial Sequence: Synthetic oligonucleotide
  Target: ATXN1; (-) strand; PAM type: NRG; PAM sequence: TGG
tccggggatagctcttccag

SEQ ID NO: 93783 - DNA, 20 bp, Artificial Sequence
  Description of Artificial Sequence: Synthetic oligonucleotide
  Target: ATXN1; (-) strand; PAM type: NRG; PAM sequence: CAG
ttctccggggatagctcttc

SEQ ID NO: 93784 - DNA, 20 bp, Artificial Sequence
  Description of Artificial Sequence: Synthetic oligonucleotide
  Target: ATXN1; (-) strand; PAM type: NRG; PAM sequence: TAG
ttgtagctcttctccgggga

SEQ ID NO: 93785 - DNA, 20 bp, Artificial Sequence
  Description of Artificial Sequence: Synthetic oligonucleotide
  Target: ATXN1; (-) strand; PAM type: NRG; PAM sequence: GGG
cctgttgtagctcttctccg

SEQ ID NO: 93786 - DNA, 20 bp, Artificial Sequence
  Description of Artificial Sequence: Synthetic oligonucleotide
  Target: ATXN1; (-) strand; PAM type: NRG; PAM sequence: GGG
tcctgttgtagctcttctcc

SEQ ID NO: 93787 - DNA, 20 bp, Artificial Sequence
  Description of Artificial Sequence: Synthetic oligonucleotide
  Target: ATXN1; (-) strand; PAM type: NRG; PAM sequence: CGG
ttcctgttgtagctcttctc

SEQ ID NO: 93788 - DNA, 20 bp, Artificial Sequence
  Description of Artificial Sequence: Synthetic oligonucleotide
  Target: ATXN1; (-) strand; PAM type: NRG; PAM sequence: TAG
ccctgattcctttcctgttg

SEQ ID NO: 93789 - DNA, 20 bp, Artificial Sequence
  Description of Artificial Sequence: Synthetic oligonucleotide
  Target: ATXN1; (-) strand; PAM type: NRG; PAM sequence: AGG
catccatgtaggaaccagag

SEQ ID NO: 93790 - DNA, 20 bp, Artificial Sequence
  Description of Artificial Sequence: Synthetic oligonucleotide
  Target: ATXN1; (-) strand; PAM type: NRG; PAM sequence: GAG
tcatccatgtaggaaccaga

SEQ ID NO: 93791 - DNA, 20 bp, Artificial Sequence
  Description of Artificial Sequence: Synthetic oligonucleotide
  Target: ATXN1; (-) strand; PAM type: NRG; PAM sequence: GAG
tttcatccatgtaggaacca

SEQ ID NO: 93792 - DNA, 20 bp, Artificial Sequence
  Description of Artificial Sequence: Synthetic oligonucleotide
  Target: ATXN1; (-) strand; PAM type: NRG; PAM sequence: CAG
gttttcatccatgtaggaac

SEQ ID NO: 93793 - DNA, 20 bp, Artificial Sequence
  Description of Artificial Sequence: Synthetic oligonucleotide
  Target: ATXN1; (-) strand; PAM type: NRG; PAM sequence: AGG
gcgctggttttcatccatgt

SEQ ID NO: 93794 - DNA, 20 bp, Artificial Sequence
  Description of Artificial Sequence: Synthetic oligonucleotide
  Target: ATXN1; (-) strand; PAM type: NRG; PAM sequence: TAG
ggcgctggttttcatccatg

SEQ ID NO: 93795 - DNA, 20 bp, Artificial Sequence
  Description of Artificial Sequence: Synthetic oligonucleotide
  Target: ATXN1; (-) strand; PAM type: NRG; PAM sequence: TGG
aggaatgggctccttggcgc

SEQ ID NO: 93796 - DNA, 20 bp, Artificial Sequence
  Description of Artificial Sequence: Synthetic oligonucleotide
  Target: ATXN1; (-) strand; PAM type: NRG; PAM sequence: TGG
ctgctaaggaatgggctcct

SEQ ID NO: 93797 - DNA, 20 bp, Artificial Sequence
  Description of Artificial Sequence: Synthetic oligonucleotide
  Target: ATXN1; (-) strand; PAM type: NRG; PAM sequence: GGG
aggctgccctgctaaggaat

SEQ ID NO: 93798 - DNA, 20 bp, Artificial Sequence
  Description of Artificial Sequence: Synthetic oligonucleotide
  Target: ATXN1; (-) strand; PAM type: NRG; PAM sequence: TGG
caggctgccctgctaaggaa

SEQ ID NO: 93799 - DNA, 20 bp, Artificial Sequence
  Description of Artificial Sequence: Synthetic oligonucleotide
  Target: ATXN1; (-) strand; PAM type: NRG; PAM sequence: AGG
cgtagcaggctgccctgcta

SEQ ID NO: 93800 - DNA, 20 bp, Artificial Sequence
  Description of Artificial Sequence: Synthetic oligonucleotide
  Target: ATXN1; (-) strand; PAM type: NRG; PAM sequence: AAG
acgtagcaggctgccctgct

SEQ ID NO: 93801 - DNA, 20 bp, Artificial Sequence
  Description of Artificial Sequence: Synthetic oligonucleotide
  Target: ATXN1; (-) strand; PAM type: NRG; PAM sequence: AGG
ttacatttctgctacgtagc

SEQ ID NO: 93802 - DNA, 20 bp, Artificial Sequence
  Description of Artificial Sequence: Synthetic oligonucleotide
  Target: ATXN1; (-) strand; PAM type: NRG; PAM sequence: CAG
cttacatttctgctacgtag

SEQ ID NO: 93803 - DNA, 20 bp, Artificial Sequence
  Description of Artificial Sequence: Synthetic oligonucleotide
  Target: ATXN1; (-) strand; PAM type: NRG; PAM sequence: TAG
tgtcttacatttctgctacg

SEQ ID NO: 93804 - DNA, 20 bp, Artificial Sequence
  Description of Artificial Sequence: Synthetic oligonucleotide
  Target: ATXN1; (-) strand; PAM type: NRG; PAM sequence: GGG
tatccaagtctctggggtcg

SEQ ID NO: 93805 - DNA, 20 bp, Artificial Sequence
  Description of Artificial Sequence: Synthetic oligonucleotide
  Target: ATXN1; (-) strand; PAM type: NRG; PAM sequence: GGG
ttatccaagtctctggggtc

SEQ ID NO: 93806 - DNA, 20 bp, Artificial Sequence
  Description of Artificial Sequence: Synthetic oligonucleotide
  Target: ATXN1; (-) strand; PAM type: NRG; PAM sequence: CGG
attatccaagtctctggggt

SEQ ID NO: 93807 - DNA, 20 bp, Artificial Sequence
  Description of Artificial Sequence: Synthetic oligonucleotide
  Target: ATXN1; (-) strand; PAM type: NRG; PAM sequence: GGG
aaccattatccaagtctctg

SEQ ID NO: 93808 - DNA, 20 bp, Artificial Sequence
  Description of Artificial Sequence: Synthetic oligonucleotide
  Target: ATXN1; (-) strand; PAM type: NRG; PAM sequence: GGG
taaccattatccaagtctct

SEQ ID NO: 93809 - DNA, 20 bp, Artificial Sequence
  Description of Artificial Sequence: Synthetic oligonucleotide
  Target: ATXN1; (-) strand; PAM type: NRG; PAM sequence: TGG
ctaaccattatccaagtctc

SEQ ID NO: 93810 - DNA, 20 bp, Artificial Sequence
  Description of Artificial Sequence: Synthetic oligonucleotide
  Target: ATXN1; (-) strand; PAM type: NRG; PAM sequence: AAG
ccaaagtctaaccattatcc

SEQ ID NO: 93811 - DNA, 20 bp, Artificial Sequence
  Description of Artificial Sequence: Synthetic oligonucleotide
  Target: ATXN1; (-) strand; PAM type: NRG; PAM sequence: AAG
aggaatctcaggcctggcca

SEQ ID NO: 93812 - DNA, 20 bp, Artificial Sequence
  Description of Artificial Sequence: Synthetic oligonucleotide
  Target: ATXN1; (-) strand; PAM type: NRG; PAM sequence: TGG
tcagtcaggaatctcaggcc

SEQ ID NO: 93813 - DNA, 20 bp, Artificial Sequence
  Description of Artificial Sequence: Synthetic oligonucleotide
  Target: ATXN1; (-) strand; PAM type: NRG; PAM sequence: AGG
agagatcagtcaggaatctc

SEQ ID NO: 93814 - DNA, 20 bp, Artificial Sequence
  Description of Artificial Sequence: Synthetic oligonucleotide
  Target: ATXN1; (-) strand; PAM type: NRG; PAM sequence: CAG
gagagatcagtcaggaatct

SEQ ID NO: 93815 - DNA, 20 bp, Artificial Sequence
  Description of Artificial Sequence: Synthetic oligonucleotide
  Target: ATXN1; (-) strand; PAM type: NRG; PAM sequence: AGG
agggcctagagagatcagtc

SEQ ID NO: 93816 - DNA, 20 bp, Artificial Sequence
  Description of Artificial Sequence: Synthetic oligonucleotide
  Target: ATXN1; (-) strand; PAM type: NRG; PAM sequence: CAG
tagggcctagagagatcagt

SEQ ID NO: 93817 - DNA, 20 bp, Artificial Sequence
  Description of Artificial Sequence: Synthetic oligonucleotide
  Target: ATXN1; (-) strand; PAM type: NRG; PAM sequence: CAG
tgactagggcctagagagat

SEQ ID NO: 93818 - DNA, 20 bp, Artificial Sequence
  Description of Artificial Sequence: Synthetic oligonucleotide
  Target: ATXN1; (-) strand; PAM type: NRG; PAM sequence: GAG
ctccctgactagggcctaga

SEQ ID NO: 93819 - DNA, 20 bp, Artificial Sequence
  Description of Artificial Sequence: Synthetic oligonucleotide
  Target: ATXN1; (-) strand; PAM type: NRG; PAM sequence: GAG
gcctccctgactagggccta

SEQ ID NO: 93820 - DNA, 20 bp, Artificial Sequence
  Description of Artificial Sequence: Synthetic oligonucleotide
  Target: ATXN1; (-) strand; PAM type: NRG; PAM sequence: TAG
cagcctccctgactagggcc

SEQ ID NO: 93821 - DNA, 20 bp, Artificial Sequence
  Description of Artificial Sequence: Synthetic oligonucleotide
  Target: ATXN1; (-) strand; PAM type: NRG; PAM sequence: GGG
tctggcagcctccctgacta

SEQ ID NO: 93822 - DNA, 20 bp, Artificial Sequence
  Description of Artificial Sequence: Synthetic oligonucleotide
  Target: ATXN1; (-) strand; PAM type: NRG; PAM sequence: AGG
gtctggcagcctccctgact

SEQ ID NO: 93823 - DNA, 20 bp, Artificial Sequence
  Description of Artificial Sequence: Synthetic oligonucleotide
  Target: ATXN1; (-) strand; PAM type: NRG; PAM sequence: TAG
tgtctggcagcctccctgac

SEQ ID NO: 93824 - DNA, 20 bp, Artificial Sequence
  Description of Artificial Sequence: Synthetic oligonucleotide
  Target: ATXN1; (-) strand; PAM type: NRG; PAM sequence: CAG
gtgggtagaaacatgtctgg

SEQ ID NO: 93825 - DNA, 20 bp, Artificial Sequence
  Description of Artificial Sequence: Synthetic oligonucleotide
  Target: ATXN1; (-) strand; PAM type: NRG; PAM sequence: TGG
gcagtgggtagaaacatgtc

SEQ ID NO: 93826 - DNA, 20 bp, Artificial Sequence
  Description of Artificial Sequence: Synthetic oligonucleotide
  Target: ATXN1; (-) strand; PAM type: NRG; PAM sequence: TAG
cctgtcctgggagcagtggg

SEQ ID NO: 93827 - DNA, 20 bp, Artificial Sequence
  Description of Artificial Sequence: Synthetic oligonucleotide
  Target: ATXN1; (-) strand; PAM type: NRG; PAM sequence: GGG
agccctgtcctgggagcagt

SEQ ID NO: 93828 - DNA, 20 bp, Artificial Sequence
  Description of Artificial Sequence: Synthetic oligonucleotide
  Target: ATXN1; (-) strand; PAM type: NRG; PAM sequence: TGG
gagccctgtcctgggagcag

SEQ ID NO: 93829 - DNA, 20 bp, Artificial Sequence
  Description of Artificial Sequence: Synthetic oligonucleotide
  Target: ATXN1; (-) strand; PAM type: NRG; PAM sequence: CAG
agggagccctgtcctgggag

SEQ ID NO: 93830 - DNA, 20 bp, Artificial Sequence
  Description of Artificial Sequence: Synthetic oligonucleotide
  Target: ATXN1; (-) strand; PAM type: NRG; PAM sequence: GAG
ctcagggagccctgtcctgg

SEQ ID NO: 93831 - DNA, 20 bp, Artificial Sequence
  Description of Artificial Sequence: Synthetic oligonucleotide
  Target: ATXN1; (-) strand; PAM type: NRG; PAM sequence: GGG
ttctcagggagccctgtcct

SEQ ID NO: 93832 - DNA, 20 bp, Artificial Sequence
  Description of Artificial Sequence: Synthetic oligonucleotide
  Target: ATXN1; (-) strand; PAM type: NRG; PAM sequence: TGG
tttctcagggagccctgtcc

SEQ ID NO: 93833 - DNA, 20 bp, Artificial Sequence
  Description of Artificial Sequence: Synthetic oligonucleotide
  Target: ATXN1; (-) strand; PAM type: NRG; PAM sequence: GAG
tgacctgtgtgtttctcagg

SEQ ID NO: 93834 - DNA, 20 bp, Artificial Sequence
  Description of Artificial Sequence: Synthetic oligonucleotide
  Target: ATXN1; (-) strand; PAM type: NRG; PAM sequence: GGG
gctgacctgtgtgtttctca

SEQ ID NO: 93835 - DNA, 20 bp, Artificial Sequence
  Description of Artificial Sequence: Synthetic oligonucleotide
  Target: ATXN1; (-) strand; PAM type: NRG; PAM sequence: AGG
tgctgacctgtgtgtttctc

SEQ ID NO: 93836 - DNA, 20 bp, Artificial Sequence
  Description of Artificial Sequence: Synthetic oligonucleotide
  Target: ATXN1; (-) strand; PAM type: NRG; PAM sequence: CAG
ttgctgacctgtgtgtttct

SEQ ID NO: 93837 - DNA, 20 bp, Artificial Sequence
  Description of Artificial Sequence: Synthetic oligonucleotide
  Target: ATXN1; (-) strand; PAM type: NRG; PAM sequence: CAG
gctgtggcatcctctctgcc

SEQ ID NO: 93838 - DNA, 20 bp, Artificial Sequence
  Description of Artificial Sequence: Synthetic oligonucleotide
  Target: ATXN1; (-) strand; PAM type: NRG; PAM sequence: TGG
ctgtgccggtttcctggctg

SEQ ID NO: 93839 - DNA, 20 bp, Artificial Sequence
  Description of Artificial Sequence: Synthetic oligonucleotide
  Target: ATXN1; (-) strand; PAM type: NRG; PAM sequence: TGG
cccaccctgtgccggtttcc

SEQ ID NO: 93840 - DNA, 20 bp, Artificial Sequence
  Description of Artificial Sequence: Synthetic oligonucleotide
  Target: ATXN1; (-) strand; PAM type: NRG; PAM sequence: CGG
gattctcacccaccctgtgc

SEQ ID NO: 93841 - DNA, 20 bp, Artificial Sequence
  Description of Artificial Sequence: Synthetic oligonucleotide
  Target: ATXN1; (-) strand; PAM type: NRG; PAM sequence: GGG
cccagtctttctatttccaa

SEQ ID NO: 93842 - DNA, 20 bp, Artificial Sequence
  Description of Artificial Sequence: Synthetic oligonucleotide
  Target: ATXN1; (-) strand; PAM type: NRG; PAM sequence: AGG
tcccagtctttctatttcca

SEQ ID NO: 93843 - DNA, 20 bp, Artificial Sequence
  Description of Artificial Sequence: Synthetic oligonucleotide
  Target: ATXN1; (-) strand; PAM type: NRG; PAM sequence: AAG
gtcccagtctttctatttcc

SEQ ID NO: 93844 - DNA, 20 bp, Artificial Sequence
  Description of Artificial Sequence: Synthetic oligonucleotide
  Target: ATXN1; (-) strand; PAM type: NRG; PAM sequence: CAG
actgtttcctgttgaagtcc

SEQ ID NO: 93845 - DNA, 20 bp, Artificial Sequence
  Description of Artificial Sequence: Synthetic oligonucleotide
  Target: ATXN1; (-) strand; PAM type: NRG; PAM sequence: AAG
ttgggaactgtttcctgttg

SEQ ID NO: 93846 - DNA, 20 bp, Artificial Sequence
  Description of Artificial Sequence: Synthetic oligonucleotide
  Target: ATXN1; (-) strand; PAM type: NRG; PAM sequence: GGG
ttctgctcacttttcccctt

SEQ ID NO: 93847 - DNA, 20 bp, Artificial Sequence
  Description of Artificial Sequence: Synthetic oligonucleotide
  Target: ATXN1; (-) strand; PAM type: NRG; PAM sequence: TGG
cttctgctcacttttcccct

SEQ ID NO: 93848 - DNA, 20 bp, Artificial Sequence
  Description of Artificial Sequence: Synthetic oligonucleotide
  Target: ATXN1; (-) strand; PAM type: NRG; PAM sequence: TAG
ctggatggctttgctgggaa

SEQ ID NO: 93849 - DNA, 20 bp, Artificial Sequence
  Description of Artificial Sequence: Synthetic oligonucleotide
  Target: ATXN1; (-) strand; PAM type: NRG; PAM sequence: GGG
gtccactggatggctttgct

SEQ ID NO: 93850 - DNA, 20 bp, Artificial Sequence
  Description of Artificial Sequence: Synthetic oligonucleotide
  Target: ATXN1; (-) strand; PAM type: NRG; PAM sequence: TGG
ggtccactggatggctttgc

SEQ ID NO: 93851 - DNA, 20 bp, Artificial Sequence
  Description of Artificial Sequence: Synthetic oligonucleotide
  Target: ATXN1; (-) strand; PAM type: NRG; PAM sequence: TGG
ctggcgagtggtccactgga

SEQ ID NO: 93852 - DNA, 20 bp, Artificial Sequence
  Description of Artificial Sequence: Synthetic oligonucleotide
  Target: ATXN1; (-) strand; PAM type: NRG; PAM sequence: TGG
caggctggcgagtggtccac

SEQ ID NO: 93853 - DNA, 20 bp, Artificial Sequence
  Description of Artificial Sequence: Synthetic oligonucleotide
  Target: ATXN1; (-) strand; PAM type: NRG; PAM sequence: TGG
ttctgcaccaggctggcgag

SEQ ID NO: 93854 - DNA, 20 bp, Artificial Sequence
  Description of Artificial Sequence: Synthetic oligonucleotide
  Target: ATXN1; (-) strand; PAM type: NRG; PAM sequence: GAG
aaattctgcaccaggctggc

SEQ ID NO: 93855 - DNA, 20 bp, Artificial Sequence
  Description of Artificial Sequence: Synthetic oligonucleotide
  Target: ATXN1; (-) strand; PAM type: NRG; PAM sequence: TGG
gctcaaattctgcaccaggc

SEQ ID NO: 93856 - DNA, 20 bp, Artificial Sequence
  Description of Artificial Sequence: Synthetic oligonucleotide
  Target: ATXN1; (-) strand; PAM type: NRG; PAM sequence: AGG
cgcagctcaaattctgcacc

SEQ ID NO: 93857 - DNA, 20 bp, Artificial Sequence
  Description of Artificial Sequence: Synthetic oligonucleotide
  Target: ATXN1; (-) strand; PAM type: NRG; PAM sequence: CAG
ccgcagctcaaattctgcac

SEQ ID NO: 93858 - DNA, 20 bp, Artificial Sequence
  Description of Artificial Sequence: Synthetic oligonucleotide
  Target: ATXN1; (-) strand; PAM type: NRG; PAM sequence: CAG
aggaataaatgagattaccg

SEQ ID NO: 93859 - DNA, 20 bp, Artificial Sequence
  Description of Artificial Sequence: Synthetic oligonucleotide
  Target: ATXN1; (-) strand; PAM type: NRG; PAM sequence: GAG
ccaacctggcaggaataaat

SEQ ID NO: 93860 - DNA, 20 bp, Artificial Sequence
  Description of Artificial Sequence: Synthetic oligonucleotide
  Target: ATXN1; (-) strand; PAM type: NRG; PAM sequence: AGG
gtacccagggccaacctggc

SEQ ID NO: 93861 - DNA, 20 bp, Artificial Sequence
  Description of Artificial Sequence: Synthetic oligonucleotide
  Target: ATXN1; (-) strand; PAM type: NRG; PAM sequence: CAG
tgtacccagggccaacctgg

SEQ ID NO: 93862 - DNA, 20 bp, Artificial Sequence
  Description of Artificial Sequence: Synthetic oligonucleotide
  Target: ATXN1; (-) strand; PAM type: NRG; PAM sequence: TGG
acttgtacccagggccaacc

SEQ ID NO: 93863 - DNA, 20 bp, Artificial Sequence
  Description of Artificial Sequence: Synthetic oligonucleotide
  Target: ATXN1; (-) strand; PAM type: NRG; PAM sequence: GGG
ttttcttctacttgtaccca

SEQ ID NO: 93864 - DNA, 20 bp, Artificial Sequence
  Description of Artificial Sequence: Synthetic oligonucleotide
  Target: ATXN1; (-) strand; PAM type: NRG; PAM sequence: AGG
cttttcttctacttgtaccc

SEQ ID NO: 93865 - DNA, 20 bp, Artificial Sequence
  Description of Artificial Sequence: Synthetic oligonucleotide
  Target: ATXN1; (-) strand; PAM type: NRG; PAM sequence: CAG
tcttttcttctacttgtacc

SEQ ID NO: 93866 - DNA, 20 bp, Artificial Sequence
  Description of Artificial Sequence: Synthetic oligonucleotide
  Target: ATXN1; (-) strand; PAM type: NRG; PAM sequence: CAG
ggttcaagtttttatatgat

SEQ ID NO: 93867 - DNA, 20 bp, Artificial Sequence
  Description of Artificial Sequence: Synthetic oligonucleotide
  Target: ATXN1; (-) strand; PAM type: NRG; PAM sequence: AAG
tttttgttgtacaacggttc

SEQ ID NO: 93868 - DNA, 20 bp, Artificial Sequence
  Description of Artificial Sequence: Synthetic oligonucleotide
  Target: ATXN1; (-) strand; PAM type: NRG; PAM sequence: CGG
tgatgctttttgttgtacaa

SEQ ID NO: 93869 - DNA, 20 bp, Artificial Sequence
  Description of Artificial Sequence: Synthetic oligonucleotide
  Target: ATXN1; (-) strand; PAM type: NRG; PAM sequence: CAG
agtccagtgtcctttcattt

SEQ ID NO: 93870 - DNA, 20 bp, Artificial Sequence
  Description of Artificial Sequence: Synthetic oligonucleotide
  Target: ATXN1; (-) strand; PAM type: NRG; PAM sequence: CAG
ctacagctacttccctagtc

SEQ ID NO: 93871 - DNA, 20 bp, Artificial Sequence
  Description of Artificial Sequence: Synthetic oligonucleotide
  Target: ATXN1; (-) strand; PAM type: NRG; PAM sequence: TAG
atttgctacagctacttccc

SEQ ID NO: 93872 - DNA, 20 bp, Artificial Sequence
  Description of Artificial Sequence: Synthetic oligonucleotide
  Target: ATXN1; (-) strand; PAM type: NRG; PAM sequence: CAG
ttaaaaagtcctatttgcta

SEQ ID NO: 93873 - DNA, 20 bp, Artificial Sequence
  Description of Artificial Sequence: Synthetic oligonucleotide
  Target: ATXN1; (-) strand; PAM type: NRG; PAM sequence: AAG
tagatattaatccatttaaa

SEQ ID NO: 93874 - DNA, 20 bp, Artificial Sequence
  Description of Artificial Sequence: Synthetic oligonucleotide
  Target: ATXN1; (-) strand; PAM type: NRG; PAM sequence: TAG
tatgagctctttatatgttc

SEQ ID NO: 93875 - DNA, 20 bp, Artificial Sequence
  Description of Artificial Sequence: Synthetic oligonucleotide
  Target: ATXN1; (-) strand; PAM type: NRG; PAM sequence: GAG
gttttctaatctatgtatat

SEQ ID NO: 93876 - DNA, 20 bp, Artificial Sequence
  Description of Artificial Sequence: Synthetic oligonucleotide
  Target: ATXN1; (-) strand; PAM type: NRG; PAM sequence: AAG
tttttacaattagcaaatgg

SEQ ID NO: 93877 - DNA, 20 bp, Artificial Sequence
  Description of Artificial Sequence: Synthetic oligonucleotide
  Target: ATXN1; (-) strand; PAM type: NRG; PAM sequence: TGG
ttctttttacaattagcaaa

SEQ ID NO: 93878 - DNA, 20 bp, Artificial Sequence
  Description of Artificial Sequence: Synthetic oligonucleotide
  Target: ATXN1; (-) strand; PAM type: NRG; PAM sequence: TAG
ctaattgttctttttacaat

SEQ ID NO: 93879 - DNA, 20 bp, Artificial Sequence
  Description of Artificial Sequence: Synthetic oligonucleotide
  Target: ATXN1; (-) strand; PAM type: NRG; PAM sequence: TGG
cctttgatccctctcagaga

SEQ ID NO: 93880 - DNA, 20 bp, Artificial Sequence
  Description of Artificial Sequence: Synthetic oligonucleotide
  Target: ATXN1; (-) strand; PAM type: NRG; PAM sequence: GAG
cattcctttgatccctctca

SEQ ID NO: 93881 - DNA, 20 bp, Artificial Sequence
  Description of Artificial Sequence: Synthetic oligonucleotide
  Target: ATXN1; (-) strand; PAM type: NRG; PAM sequence: CAG
ttcattcctttgatccctct

SEQ ID NO: 93882 - DNA, 20 bp, Artificial Sequence
  Description of Artificial Sequence: Synthetic oligonucleotide
  Target: ATXN1; (-) strand; PAM type: NRG; PAM sequence: AAG
taataggctctttggtttta

SEQ ID NO: 93883 - DNA, 20 bp, Artificial Sequence
  Description of Artificial Sequence: Synthetic oligonucleotide
  Target: ATXN1; (-) strand; PAM type: NRG; PAM sequence: TGG
ggctaatttaataggctctt

SEQ ID NO: 93884 - DNA, 20 bp, Artificial Sequence
  Description of Artificial Sequence: Synthetic oligonucleotide
  Target: ATXN1; (-) strand; PAM type: NRG; PAM sequence: AGG
tattttttggctaatttaat

SEQ ID NO: 93885 - DNA, 20 bp, Artificial Sequence
  Description of Artificial Sequence: Synthetic oligonucleotide
  Target: ATXN1; (-) strand; PAM type: NRG; PAM sequence: TAG
ctattttttggctaatttaa

SEQ ID NO: 93886 - DNA, 20 bp, Artificial Sequence
  Description of Artificial Sequence: Synthetic oligonucleotide
  Target: ATXN1; (-) strand; PAM type: NRG; PAM sequence: TGG
ttgtgggacttactattttt

SEQ ID NO: 93887 - DNA, 20 bp, Artificial Sequence
  Description of Artificial Sequence: Synthetic oligonucleotide
  Target: ATXN1; (-) strand; PAM type: NRG; PAM sequence: GGG
gcttcaatcttaataattgt

SEQ ID NO: 93888 - DNA, 20 bp, Artificial Sequence
  Description of Artificial Sequence: Synthetic oligonucleotide
  Target: ATXN1; (-) strand; PAM type: NRG; PAM sequence: TGG
agcttcaatcttaataattg

SEQ ID NO: 93889 - DNA, 20 bp, Artificial Sequence
  Description of Artificial Sequence: Synthetic oligonucleotide
  Target: ATXN1; (-) strand; PAM type: NRG; PAM sequence: TAG
taatgatataagaatgtctc

SEQ ID NO: 93890 - DNA, 20 bp, Artificial Sequence
  Description of Artificial Sequence: Synthetic oligonucleotide
  Target: ATXN1; (-) strand; PAM type: NRG; PAM sequence: AAG
tacattgttactaatgatat

SEQ ID NO: 93891 - DNA, 20 bp, Artificial Sequence
  Description of Artificial Sequence: Synthetic oligonucleotide
  Target: ATXN1; (-) strand; PAM type: NRG; PAM sequence: AGG
gctctgaattgctttctaaa

SEQ ID NO: 93892 - DNA, 20 bp, Artificial Sequence
  Description of Artificial Sequence: Synthetic oligonucleotide
  Target: ATXN1; (-) strand; PAM type: NRG; PAM sequence: AAG
tgctctgaattgctttctaa

SEQ ID NO: 93893 - DNA, 20 bp, Artificial Sequence
  Description of Artificial Sequence: Synthetic oligonucleotide
  Target: ATXN1; (-) strand; PAM type: NRG; PAM sequence: GAG
gctcaatactaagttagagg

SEQ ID NO: 93894 - DNA, 20 bp, Artificial Sequence
  Description of Artificial Sequence: Synthetic oligonucleotide
  Target: ATXN1; (-) strand; PAM type: NRG; PAM sequence: GGG
aggctcaatactaagttaga

SEQ ID NO: 93895 - DNA, 20 bp, Artificial Sequence
  Description of Artificial Sequence: Synthetic oligonucleotide
  Target: ATXN1; (-) strand; PAM type: NRG; PAM sequence: AGG
aaggctcaatactaagttag

SEQ ID NO: 93896 - DNA, 20 bp, Artificial Sequence
  Description of Artificial Sequence: Synthetic oligonucleotide
  Target: ATXN1; (-) strand; PAM type: NRG; PAM sequence: GAG
gaaggctcaatactaagtta

SEQ ID NO: 93897 - DNA, 20 bp, Artificial Sequence
  Description of Artificial Sequence: Synthetic oligonucleotide
  Target: ATXN1; (-) strand; PAM type: NRG; PAM sequence: TAG
cagaaggctcaatactaagt

SEQ ID NO: 93898 - DNA, 20 bp, Artificial Sequence
  Description of Artificial Sequence: Synthetic oligonucleotide
  Target: ATXN1; (-) strand; PAM type: NRG; PAM sequence: AAG
acatcagaaggctcaatact

SEQ ID NO: 93899 - DNA, 20 bp, Artificial Sequence
  Description of Artificial Sequence: Synthetic oligonucleotide
  Target: ATXN1; (-) strand; PAM type: NRG; PAM sequence: AGG
gaggacacactcacatcaga

SEQ ID NO: 93900 - DNA, 20 bp, Artificial Sequence
  Description of Artificial Sequence: Synthetic oligonucleotide
  Target: ATXN1; (-) strand; PAM type: NRG; PAM sequence: AAG
cgaggacacactcacatcag

SEQ ID NO: 93901 - DNA, 20 bp, Artificial Sequence
  Description of Artificial Sequence: Synthetic oligonucleotide
  Target: ATXN1; (-) strand; PAM type: NRG; PAM sequence: CAG
taccgaggacacactcacat

SEQ ID NO: 93902 - DNA, 20 bp, Artificial Sequence
  Description of Artificial Sequence: Synthetic oligonucleotide
  Target: ATXN1; (-) strand; PAM type: NRG; PAM sequence: AGG
ttgcacacaagtatttaccg

SEQ ID NO: 93903 - DNA, 20 bp, Artificial Sequence
  Description of Artificial Sequence: Synthetic oligonucleotide
  Target: ATXN1; (-) strand; PAM type: NRG; PAM sequence: GAG
tttgcacacaagtatttacc

SEQ ID NO: 93904 - DNA, 20 bp, Artificial Sequence
  Description of Artificial Sequence: Synthetic oligonucleotide
  Target: ATXN1; (-) strand; PAM type: NRG; PAM sequence: AAG
cagcgaatgtctttgcacac

SEQ ID NO: 93905 - DNA, 20 bp, Artificial Sequence
  Description of Artificial Sequence: Synthetic oligonucleotide
  Target: ATXN1; (-) strand; PAM type: NRG; PAM sequence: CAG
tgtttactgttgtaaagccg

SEQ ID NO: 93906 - DNA, 20 bp, Artificial Sequence
  Description of Artificial Sequence: Synthetic oligonucleotide
  Target: ATXN1; (-) strand; PAM type: NRG; PAM sequence: AAG
tctaattgtttactgttgta

SEQ ID NO: 93907 - DNA, 20 bp, Artificial Sequence
  Description of Artificial Sequence: Synthetic oligonucleotide
  Target: ATXN1; (-) strand; PAM type: NRG; PAM sequence: GAG
cctatcatttttggacattc

SEQ ID NO: 93908 - DNA, 20 bp, Artificial Sequence
  Description of Artificial Sequence: Synthetic oligonucleotide
  Target: ATXN1; (-) strand; PAM type: NRG; PAM sequence: TGG
tttaagtttcctatcatttt

SEQ ID NO: 93909 - DNA, 20 bp, Artificial Sequence
  Description of Artificial Sequence: Synthetic oligonucleotide
  Target: ATXN1; (-) strand; PAM type: NRG; PAM sequence: AAG
gttgttttatcttaattttt

SEQ ID NO: 93910 - DNA, 20 bp, Artificial Sequence
  Description of Artificial Sequence: Synthetic oligonucleotide
  Target: ATXN1; (-) strand; PAM type: NRG; PAM sequence: AGG
ggatcacataacattctatc

SEQ ID NO: 93911 - DNA, 20 bp, Artificial Sequence
  Description of Artificial Sequence: Synthetic oligonucleotide
  Target: ATXN1; (-) strand; PAM type: NRG; PAM sequence: CAG
aggatcacataacattctat

SEQ ID NO: 93912 - DNA, 20 bp, Artificial Sequence
  Description of Artificial Sequence: Synthetic oligonucleotide
  Target: ATXN1; (-) strand; PAM type: NRG; PAM sequence: AGG
ctatacagttctcatttgca

SEQ ID NO: 93913 - DNA, 20 bp, Artificial Sequence
  Description of Artificial Sequence: Synthetic oligonucleotide
  Target: ATXN1; (-) strand; PAM type: NRG; PAM sequence: AAG
gctatacagttctcatttgc

SEQ ID NO: 93914 - DNA, 20 bp, Artificial Sequence
  Description of Artificial Sequence: Synthetic oligonucleotide
  Target: ATXN1; (-) strand; PAM type: NRG; PAM sequence: CAG
tcttagtaacttcagctata

SEQ ID NO: 93915 - DNA, 20 bp, Artificial Sequence
  Description of Artificial Sequence: Synthetic oligonucleotide
  Target: ATXN1; (-) strand; PAM type: NRG; PAM sequence: CAG
ataaacattcttagtaactt

SEQ ID NO: 93916 - DNA, 20 bp, Artificial Sequence
  Description of Artificial Sequence: Synthetic oligonucleotide
  Target: ATXN1; (-) strand; PAM type: NRG; PAM sequence: TAG
ccatttagcataaacattct

SEQ ID NO: 93917 - DNA, 20 bp, Artificial Sequence
  Description of Artificial Sequence: Synthetic oligonucleotide
  Target: ATXN1; (-) strand; PAM type: NRG; PAM sequence: TAG
tcagttttgtgtttcccatt

SEQ ID NO: 93918 - DNA, 20 bp, Artificial Sequence
  Description of Artificial Sequence: Synthetic oligonucleotide
  Target: ATXN1; (-) strand; PAM type: NRG; PAM sequence: CAG
tgtaacttatatcttttttt

SEQ ID NO: 93919 - DNA, 20 bp, Artificial Sequence
  Description of Artificial Sequence: Synthetic oligonucleotide
  Target: ATXN1; (-) strand; PAM type: NRG; PAM sequence: TAG
catttttatgtgttgttttt

SEQ ID NO: 93920 - DNA, 20 bp, Artificial Sequence
  Description of Artificial Sequence: Synthetic oligonucleotide
  Target: ATXN1; (-) strand; PAM type: NRG; PAM sequence: AAG
accattccagtccataaatc

SEQ ID NO: 93921 - DNA, 20 bp, Artificial Sequence
  Description of Artificial Sequence: Synthetic oligonucleotide
  Target: ATXN1; (-) strand; PAM type: NRG; PAM sequence: CAG
tccctttgattccaccattc

SEQ ID NO: 93922 - DNA, 20 bp, Artificial Sequence
  Description of Artificial Sequence: Synthetic oligonucleotide
  Target: ATXN1; (-) strand; PAM type: NRG; PAM sequence: AAG
aggaaagccaataaaagcaa

SEQ ID NO: 93923 - DNA, 20 bp, Artificial Sequence
  Description of Artificial Sequence: Synthetic oligonucleotide
  Target: ATXN1; (-) strand; PAM type: NRG; PAM sequence: AAG
taataaaggaaagccaataa

SEQ ID NO: 93924 - DNA, 20 bp, Artificial Sequence
  Description of Artificial Sequence: Synthetic oligonucleotide
  Target: ATXN1; (-) strand; PAM type: NRG; PAM sequence: AAG
aaccttacaataataaagga

SEQ ID NO: 93925 - DNA, 20 bp, Artificial Sequence
  Description of Artificial Sequence: Synthetic oligonucleotide
  Target: ATXN1; (-) strand; PAM type: NRG; PAM sequence: AGG
cccaaaccttacaataataa

SEQ ID NO: 93926 - DNA, 20 bp, Artificial Sequence
  Description of Artificial Sequence: Synthetic oligonucleotide
  Target: ATXN1; (-) strand; PAM type: NRG; PAM sequence: AAG
gcccaaaccttacaataata

SEQ ID NO: 93927 - DNA, 20 bp, Artificial Sequence
  Description of Artificial Sequence: Synthetic oligonucleotide
  Target: ATXN1; (-) strand; PAM type: NRG; PAM sequence: GAG
tagctctgctctacagaaaa

SEQ ID NO: 93928 - DNA, 20 bp, Artificial Sequence
  Description of Artificial Sequence: Synthetic oligonucleotide
  Target: ATXN1; (-) strand; PAM type: NRG; PAM sequence: AAG
ggtagctctgctctacagaa

SEQ ID NO: 93929 - DNA, 20 bp, Artificial Sequence
  Description of Artificial Sequence: Synthetic oligonucleotide
  Target: ATXN1; (-) strand; PAM type: NRG; PAM sequence: CAG
ccgcaggtagctctgctcta

SEQ ID NO: 93930 - DNA, 20 bp, Artificial Sequence
  Description of Artificial Sequence: Synthetic oligonucleotide
  Target: ATXN1; (-) strand; PAM type: NRG; PAM sequence: TAG
gcagtgacgttttccgcagg

SEQ ID NO: 93931 - DNA, 20 bp, Artificial Sequence
  Description of Artificial Sequence: Synthetic oligonucleotide
  Target: ATXN1; (-) strand; PAM type: NRG; PAM sequence: AGG
ctggcagtgacgttttccgc

SEQ ID NO: 93932 - DNA, 20 bp, Artificial Sequence
  Description of Artificial Sequence: Synthetic oligonucleotide
  Target: ATXN1; (-) strand; PAM type: NRG; PAM sequence: CAG
cctggcagtgacgttttccg

SEQ ID NO: 93933 - DNA, 20 bp, Artificial Sequence
  Description of Artificial Sequence: Synthetic oligonucleotide
  Target: ATXN1; (-) strand; PAM type: NRG; PAM sequence: CAG
agcaccctccactaacctgg

SEQ ID NO: 93934 - DNA, 20 bp, Artificial Sequence
  Description of Artificial Sequence: Synthetic oligonucleotide
  Target: ATXN1; (-) strand; PAM type: NRG; PAM sequence: TGG
ctaagcaccctccactaacc

SEQ ID NO: 93935 - DNA, 20 bp, Artificial Sequence
  Description of Artificial Sequence: Synthetic oligonucleotide
  Target: ATXN1; (-) strand; PAM type: NRG; PAM sequence: AAG
ggtagctcttgggaaggact

SEQ ID NO: 93936 - DNA, 20 bp, Artificial Sequence
  Description of Artificial Sequence: Synthetic oligonucleotide
  Target: ATXN1; (-) strand; PAM type: NRG; PAM sequence: AGG
tctgcaggtagctcttggga

SEQ ID NO: 93937 - DNA, 20 bp, Artificial Sequence
  Description of Artificial Sequence: Synthetic oligonucleotide
  Target: ATXN1; (-) strand; PAM type: NRG; PAM sequence: AAG
ttctgcaggtagctcttggg

SEQ ID NO: 93938 - DNA, 20 bp, Artificial Sequence
  Description of Artificial Sequence: Synthetic oligonucleotide
  Target: ATXN1; (-) strand; PAM type: NRG; PAM sequence: GGG
gttttctgcaggtagctctt

SEQ ID NO: 93939 - DNA, 20 bp, Artificial Sequence
  Description of Artificial Sequence: Synthetic oligonucleotide
  Target: ATXN1; (-) strand; PAM type: NRG; PAM sequence: TGG
cgttttctgcaggtagctct

SEQ ID NO: 93940 - DNA, 20 bp, Artificial Sequence
  Description of Artificial Sequence: Synthetic oligonucleotide
  Target: ATXN1; (-) strand; PAM type: NRG; PAM sequence: TAG
tcagtgacgttttctgcagg

SEQ ID NO: 93941 - DNA, 20 bp, Artificial Sequence
  Description of Artificial Sequence: Synthetic oligonucleotide
  Target: ATXN1; (-) strand; PAM type: NRG; PAM sequence: AGG
ctgtcagtgacgttttctgc

SEQ ID NO: 93942 - DNA, 20 bp, Artificial Sequence
  Description of Artificial Sequence: Synthetic oligonucleotide
  Target: ATXN1; (-) strand; PAM type: NRG; PAM sequence: CAG
cctgtcagtgacgttttctg

SEQ ID NO: 93943 - DNA, 20 bp, Artificial Sequence
  Description of Artificial Sequence: Synthetic oligonucleotide
  Target: ATXN1; (-) strand; PAM type: NRG; PAM sequence: CAG
agcaccctccactaacctgt

SEQ ID NO: 93944 - DNA, 20 bp, Artificial Sequence
  Description of Artificial Sequence: Synthetic oligonucleotide
  Target: ATXN1; (-) strand; PAM type: NRG; PAM sequence: AAG
tttgaaatttgggaaggact

SEQ ID NO: 93945 - DNA, 20 bp, Artificial Sequence
  Description of Artificial Sequence: Synthetic oligonucleotide
  Target: ATXN1; (-) strand; PAM type: NRG; PAM sequence: AGG
aggacctttgaaatttggga

SEQ ID NO: 93946 - DNA, 20 bp, Artificial Sequence
  Description of Artificial Sequence: Synthetic oligonucleotide
  Target: ATXN1; (-) strand; PAM type: NRG; PAM sequence: AAG
aaggacctttgaaatttggg

SEQ ID NO: 93947 - DNA, 20 bp, Artificial Sequence
  Description of Artificial Sequence: Synthetic oligonucleotide
  Target: ATXN1; (-) strand; PAM type: NRG; PAM sequence: GGG
caaaaggacctttgaaattt

SEQ ID NO: 93948 - DNA, 20 bp, Artificial Sequence
  Description of Artificial Sequence: Synthetic oligonucleotide
  Target: ATXN1; (-) strand; PAM type: NRG; PAM sequence: TGG
tcaaaaggacctttgaaatt

SEQ ID NO: 93949 - DNA, 20 bp, Artificial Sequence
  Description of Artificial Sequence: Synthetic oligonucleotide
  Target: ATXN1; (-) strand; PAM type: NRG; PAM sequence: AGG
ggcagagtttgaatctcaaa

SEQ ID NO: 93950 - DNA, 20 bp, Artificial Sequence
  Description of Artificial Sequence: Synthetic oligonucleotide
  Target: ATXN1; (-) strand; PAM type: NRG; PAM sequence: AAG
aggcagagtttgaatctcaa

SEQ ID NO: 93951 - DNA, 20 bp, Artificial Sequence
  Description of Artificial Sequence: Synthetic oligonucleotide
  Target: ATXN1; (-) strand; PAM type: NRG; PAM sequence: GAG
gcagccagttttagtaggca

SEQ ID NO: 93952 - DNA, 20 bp, Artificial Sequence
  Description of Artificial Sequence: Synthetic oligonucleotide
  Target: ATXN1; (-) strand; PAM type: NRG; PAM sequence: CAG
gagcagccagttttagtagg

SEQ ID NO: 93953 - DNA, 20 bp, Artificial Sequence
  Description of Artificial Sequence: Synthetic oligonucleotide
  Target: ATXN1; (-) strand; PAM type: NRG; PAM sequence: AGG
tcagagcagccagttttagt

SEQ ID NO: 93954 - DNA, 20 bp, Artificial Sequence
  Description of Artificial Sequence: Synthetic oligonucleotide
  Target: ATXN1; (-) strand; PAM type: NRG; PAM sequence: TAG
ctcagagcagccagttttag

SEQ ID NO: 93955 - DNA, 20 bp, Artificial Sequence
  Description of Artificial Sequence: Synthetic oligonucleotide
  Target: ATXN1; (-) strand; PAM type: NRG; PAM sequence: TAG
cttctcagagcagccagttt

SEQ ID NO: 93956 - DNA, 20 bp, Artificial Sequence
  Description of Artificial Sequence: Synthetic oligonucleotide
  Target: ATXN1; (-) strand; PAM type: NRG; PAM sequence: CAG
gaggagcttctcagagcagc

SEQ ID NO: 93957 - DNA, 20 bp, Artificial Sequence
  Description of Artificial Sequence: Synthetic oligonucleotide
  Target: ATXN1; (-) strand; PAM type: NRG; PAM sequence: CAG
gtaggaggagcttctcagag

SEQ ID NO: 93958 - DNA, 20 bp, Artificial Sequence
  Description of Artificial Sequence: Synthetic oligonucleotide
  Target: ATXN1; (-) strand; PAM type: NRG; PAM sequence: GAG
agggtaggaggagcttctca

SEQ ID NO: 93959 - DNA, 20 bp, Artificial Sequence
  Description of Artificial Sequence: Synthetic oligonucleotide
  Target: ATXN1; (-) strand; PAM type: NRG; PAM sequence: CAG
tcagggtaggaggagcttct

SEQ ID NO: 93960 - DNA, 20 bp, Artificial Sequence
  Description of Artificial Sequence: Synthetic oligonucleotide
  Target: ATXN1; (-) strand; PAM type: NRG; PAM sequence: GAG
aggtatagtcagggtaggag

SEQ ID NO: 93961 - DNA, 20 bp, Artificial Sequence
  Description of Artificial Sequence: Synthetic oligonucleotide
  Target: ATXN1; (-) strand; PAM type: NRG; PAM sequence: AGG
tgaggtatagtcagggtagg

SEQ ID NO: 93962 - DNA, 20 bp, Artificial Sequence
  Description of Artificial Sequence: Synthetic oligonucleotide
  Target: ATXN1; (-) strand; PAM type: NRG; PAM sequence: GAG
ttgaggtatagtcagggtag

SEQ ID NO: 93963 - DNA, 20 bp, Artificial Sequence
  Description of Artificial Sequence: Synthetic oligonucleotide
  Target: ATXN1; (-) strand; PAM type: NRG; PAM sequence: AGG
atttgaggtatagtcagggt

SEQ ID NO: 93964 - DNA, 20 bp, Artificial Sequence
  Description of Artificial Sequence: Synthetic oligonucleotide
  Target: ATXN1; (-) strand; PAM type: NRG; PAM sequence: TAG
catttgaggtatagtcaggg

SEQ ID NO: 93965 - DNA, 20 bp, Artificial Sequence
  Description of Artificial Sequence: Synthetic oligonucleotide
  Target: ATXN1; (-) strand; PAM type: NRG; PAM sequence: GGG
ctgcatttgaggtatagtca

SEQ ID NO: 93966 - DNA, 20 bp, Artificial Sequence
  Description of Artificial Sequence: Synthetic oligonucleotide
  Target: ATXN1; (-) strand; PAM type: NRG; PAM sequence: AGG
gctgcatttgaggtatagtc

SEQ ID NO: 93967 - DNA, 20 bp, Artificial Sequence
  Description of Artificial Sequence: Synthetic oligonucleotide
  Target: ATXN1; (-) strand; PAM type: NRG; PAM sequence: CAG
tgctgcatttgaggtatagt

SEQ ID NO: 93968 - DNA, 20 bp, Artificial Sequence
  Description of Artificial Sequence: Synthetic oligonucleotide
  Target: ATXN1; (-) strand; PAM type: NRG; PAM sequence: TAG
aaagtgctgcatttgaggta

SEQ ID NO: 93969 - DNA, 20 bp, Artificial Sequence
  Description of Artificial Sequence: Synthetic oligonucleotide
  Target: ATXN1; (-) strand; PAM type: NRG; PAM sequence: AGG
aaaggaaagtgctgcatttg

SEQ ID NO: 93970 - DNA, 20 bp, Artificial Sequence
  Description of Artificial Sequence: Synthetic oligonucleotide
  Target: ATXN1; (-) strand; PAM type: NRG; PAM sequence: GAG
caaaggaaagtgctgcattt

SEQ ID NO: 93971 - DNA, 20 bp, Artificial Sequence
  Description of Artificial Sequence: Synthetic oligonucleotide
  Target: ATXN1; (-) strand; PAM type: NRG; PAM sequence: AAG
aaaaaagcaagaacaaagga

SEQ ID NO: 93972 - DNA, 20 bp, Artificial Sequence
  Description of Artificial Sequence: Synthetic oligonucleotide
  Target: ATXN1; (-) strand; PAM type: NRG; PAM sequence: AGG
aataaaaaaagcaagaacaa

SEQ ID NO: 93973 - DNA, 20 bp, Artificial Sequence
  Description of Artificial Sequence: Synthetic oligonucleotide
  Target: ATXN1; (-) strand; PAM type: NRG; PAM sequence: AAG
gaataaaaaaagcaagaaca

SEQ ID NO: 93974 - DNA, 20 bp, Artificial Sequence
  Description of Artificial Sequence: Synthetic oligonucleotide
  Target: ATXN1; (-) strand; PAM type: NRG; PAM sequence: AAG
aagagctgaataaaaaaagc

SEQ ID NO: 93975 - DNA, 20 bp, Artificial Sequence
  Description of Artificial Sequence: Synthetic oligonucleotide
  Target: ATXN1; (-) strand; PAM type: NRG; PAM sequence: AAG
atttaagagctgaataaaaa

SEQ ID NO: 93976 - DNA, 20 bp, Artificial Sequence
  Description of Artificial Sequence: Synthetic oligonucleotide
  Target: ATXN1; (-) strand; PAM type: NRG; PAM sequence: GAG
acggaaggcatagcatttaa

SEQ ID NO: 93977 - DNA, 20 bp, Artificial Sequence
  Description of Artificial Sequence: Synthetic oligonucleotide
  Target: ATXN1; (-) strand; PAM type: NRG; PAM sequence: AAG
acacggaaggcatagcattt

SEQ ID NO: 93978 - DNA, 20 bp, Artificial Sequence
  Description of Artificial Sequence: Synthetic oligonucleotide
  Target: ATXN1; (-) strand; PAM type: NRG; PAM sequence: TAG
acacacacacacggaaggca

SEQ ID NO: 93979 - DNA, 20 bp, Artificial Sequence
  Description of Artificial Sequence: Synthetic oligonucleotide
  Target: ATXN1; (-) strand; PAM type: NRG; PAM sequence: AGG
cacacacacacacacacgga

SEQ ID NO: 93980 - DNA, 20 bp, Artificial Sequence
  Description of Artificial Sequence: Synthetic oligonucleotide
  Target: ATXN1; (-) strand; PAM type: NRG; PAM sequence: AAG
acacacacacacacacacgg

SEQ ID NO: 93981 - DNA, 20 bp, Artificial Sequence
  Description of Artificial Sequence: Synthetic oligonucleotide
  Target: ATXN1; (-) strand; PAM type: NRG; PAM sequence: CGG
cacacacacacacacacaca

SEQ ID NO: 93982 - DNA, 20 bp, Artificial Sequence
  Description of Artificial Sequence: Synthetic oligonucleotide
  Target: ATXN1; (-) strand; PAM type: NRG; PAM sequence: CAG
atctcaataactaataaaaa

SEQ ID NO: 93983 - DNA, 20 bp, Artificial Sequence
  Description of Artificial Sequence: Synthetic oligonucleotide
  Target: ATXN1; (-) strand; PAM type: NRG; PAM sequence: TAG
tctctagatgttgcttatgg

SEQ ID NO: 93984 - DNA, 20 bp, Artificial Sequence
  Description of Artificial Sequence: Synthetic oligonucleotide
  Target: ATXN1; (-) strand; PAM type: NRG; PAM sequence: TGG
cactctctagatgttgctta

SEQ ID NO: 93985 - DNA, 20 bp, Artificial Sequence
  Description of Artificial Sequence: Synthetic oligonucleotide
  Target: ATXN1; (-) strand; PAM type: NRG; PAM sequence: TAG
ttaaatgtgcactcactctc

SEQ ID NO: 93986 - DNA, 20 bp, Artificial Sequence
  Description of Artificial Sequence: Synthetic oligonucleotide
  Target: ATXN1; (-) strand; PAM type: NRG; PAM sequence: AAG
taactcacagaatcactgga

SEQ ID NO: 93987 - DNA, 20 bp, Artificial Sequence
  Description of Artificial Sequence: Synthetic oligonucleotide
  Target: ATXN1; (-) strand; PAM type: NRG; PAM sequence: TGG
cacctaactcacagaatcac

SEQ ID NO: 93988 - DNA, 20 bp, Artificial Sequence
  Description of Artificial Sequence: Synthetic oligonucleotide
  Target: ATXN1; (-) strand; PAM type: NRG; PAM sequence: CAG
tgataatatcacctaactca

SEQ ID NO: 93989 - DNA, 20 bp, Artificial Sequence
  Description of Artificial Sequence: Synthetic oligonucleotide
  Target: ATXN1; (-) strand; PAM type: NRG; PAM sequence: GGG
atttcctcatctgttgaatg

SEQ ID NO: 93990 - DNA, 20 bp, Artificial Sequence
  Description of Artificial Sequence: Synthetic oligonucleotide
  Target: ATXN1; (-) strand; PAM type: NRG; PAM sequence: GGG
aatttcctcatctgttgaat

SEQ ID NO: 93991 - DNA, 20 bp, Artificial Sequence
  Description of Artificial Sequence: Synthetic oligonucleotide
  Target: ATXN1; (-) strand; PAM type: NRG; PAM sequence: TGG
caatttcctcatctgttgaa

SEQ ID NO: 93992 - DNA, 20 bp, Artificial Sequence
  Description of Artificial Sequence: Synthetic oligonucleotide
  Target: ATXN1; (-) strand; PAM type: NRG; PAM sequence: AGG
ggctcctggctttgtggtcc

SEQ ID NO: 93993 - DNA, 20 bp, Artificial Sequence
  Description of Artificial Sequence: Synthetic oligonucleotide
  Target: ATXN1; (-) strand; PAM type: NRG; PAM sequence: CAG
tggctcctggctttgtggtc

SEQ ID NO: 93994 - DNA, 20 bp, Artificial Sequence
  Description of Artificial Sequence: Synthetic oligonucleotide
  Target: ATXN1; (-) strand; PAM type: NRG; PAM sequence: TGG
ggctctggctcctggctttg

SEQ ID NO: 93995 - DNA, 20 bp, Artificial Sequence
  Description of Artificial Sequence: Synthetic oligonucleotide
  Target: ATXN1; (-) strand; PAM type: NRG; PAM sequence: TGG
atccttctggctctggctcc

SEQ ID NO: 93996 - DNA, 20 bp, Artificial Sequence
  Description of Artificial Sequence: Synthetic oligonucleotide
  Target: ATXN1; (-) strand; PAM type: NRG; PAM sequence: TGG
ggcttgaatccttctggctc

SEQ ID NO: 93997 - DNA, 20 bp, Artificial Sequence
  Description of Artificial Sequence: Synthetic oligonucleotide
  Target: ATXN1; (-) strand; PAM type: NRG; PAM sequence: TGG
gattgaggcttgaatccttc

SEQ ID NO: 93998 - DNA, 20 bp, Artificial Sequence
  Description of Artificial Sequence: Synthetic oligonucleotide
  Target: ATXN1; (-) strand; PAM type: NRG; PAM sequence: AGG
ctttaaagtcagggagattg

SEQ ID NO: 93999 - DNA, 20 bp, Artificial Sequence
  Description of Artificial Sequence: Synthetic oligonucleotide
  Target: ATXN1; (-) strand; PAM type: NRG; PAM sequence: GAG
gctttaaagtcagggagatt

SEQ ID NO: 94000 - DNA, 20 bp, Artificial Sequence
  Description of Artificial Sequence: Synthetic oligonucleotide
  Target: ATXN1; (-) strand; PAM type: NRG; PAM sequence: GAG
atgaaggctttaaagtcagg

SEQ ID NO: 94001 - DNA, 20 bp, Artificial Sequence
  Description of Artificial Sequence: Synthetic oligonucleotide
  Target: ATXN1; (-) strand; PAM type: NRG; PAM sequence: GGG
aaatgaaggctttaaagtca

SEQ ID NO: 94002 - DNA, 20 bp, Artificial Sequence
  Description of Artificial Sequence: Synthetic oligonucleotide
  Target: ATXN1; (-) strand; PAM type: NRG; PAM sequence: AGG
aaaatgaaggctttaaagtc

SEQ ID NO: 94003 - DNA, 20 bp, Artificial Sequence
  Description of Artificial Sequence: Synthetic oligonucleotide
  Target: ATXN1; (-) strand; PAM type: NRG; PAM sequence: CAG
gaaaatgaaggctttaaagt

SEQ ID NO: 94004 - DNA, 20 bp, Artificial Sequence
  Description of Artificial Sequence: Synthetic oligonucleotide
  Target: ATXN1; (-) strand; PAM type: NRG; PAM sequence: AAG
gggtgaaaatgaaggcttta

SEQ ID NO: 94005 - DNA, 20 bp, Artificial Sequence
  Description of Artificial Sequence: Synthetic oligonucleotide
  Target: ATXN1; (-) strand; PAM type: NRG; PAM sequence: AGG
gagagggagggtgaaaatga

SEQ ID NO: 94006 - DNA, 20 bp, Artificial Sequence
  Description of Artificial Sequence: Synthetic oligonucleotide
  Target: ATXN1; (-) strand; PAM type: NRG; PAM sequence: AAG
agagagggagggtgaaaatg

SEQ ID NO: 94007 - DNA, 20 bp, Artificial Sequence
  Description of Artificial Sequence: Synthetic oligonucleotide
  Target: ATXN1; (-) strand; PAM type: NRG; PAM sequence: GGG
gtttcatagacagagaggga

SEQ ID NO: 94008 - DNA, 20 bp, Artificial Sequence
  Description of Artificial Sequence: Synthetic oligonucleotide
  Target: ATXN1; (-) strand; PAM type: NRG; PAM sequence: AGG
tgtttcatagacagagaggg

SEQ ID NO: 94009 - DNA, 20 bp, Artificial Sequence
  Description of Artificial Sequence: Synthetic oligonucleotide
  Target: ATXN1; (-) strand; PAM type: NRG; PAM sequence: GAG
ttgtttcatagacagagagg

SEQ ID NO: 94010 - DNA, 20 bp, Artificial Sequence
  Description of Artificial Sequence: Synthetic oligonucleotide
  Target: ATXN1; (-) strand; PAM type: NRG; PAM sequence: GGG
atttgtttcatagacagaga

SEQ ID NO: 94011 - DNA, 20 bp, Artificial Sequence
  Description of Artificial Sequence: Synthetic oligonucleotide
  Target: ATXN1; (-) strand; PAM type: NRG; PAM sequence: AGG
tatttgtttcatagacagag

SEQ ID NO: 94012 - DNA, 20 bp, Artificial Sequence
  Description of Artificial Sequence: Synthetic oligonucleotide
  Target: ATXN1; (-) strand; PAM type: NRG; PAM sequence: GAG
ttatttgtttcatagacaga

SEQ ID NO: 94013 - DNA, 20 bp, Artificial Sequence
  Description of Artificial Sequence: Synthetic oligonucleotide
  Target: ATXN1; (-) strand; PAM type: NRG; PAM sequence: GAG
atttatttgtttcatagaca

SEQ ID NO: 94014 - DNA, 20 bp, Artificial Sequence
  Description of Artificial Sequence: Synthetic oligonucleotide
  Target: ATXN1; (-) strand; PAM type: NRG; PAM sequence: CAG
taatttatttgtttcataga

SEQ ID NO: 94015 - DNA, 20 bp, Artificial Sequence
  Description of Artificial Sequence: Synthetic oligonucleotide
  Target: ATXN1; (-) strand; PAM type: NRG; PAM sequence: TAG
gttttaatttatttgtttca

SEQ ID NO: 94016 - DNA, 20 bp, Artificial Sequence
  Description of Artificial Sequence: Synthetic oligonucleotide
  Target: ATXN1; (-) strand; PAM type: NRG; PAM sequence: GGG
agaaaaggtgacatttgaga

SEQ ID NO: 94017 - DNA, 20 bp, Artificial Sequence
  Description of Artificial Sequence: Synthetic oligonucleotide
  Target: ATXN1; (-) strand; PAM type: NRG; PAM sequence: AGG
tagaaaaggtgacatttgag

SEQ ID NO: 94018 - DNA, 20 bp, Artificial Sequence
  Description of Artificial Sequence: Synthetic oligonucleotide
  Target: ATXN1; (-) strand; PAM type: NRG; PAM sequence: GAG
atagaaaaggtgacatttga

SEQ ID NO: 94019 - DNA, 20 bp, Artificial Sequence
  Description of Artificial Sequence: Synthetic oligonucleotide
  Target: ATXN1; (-) strand; PAM type: NRG; PAM sequence: GAG
aaatagaaaaggtgacattt

SEQ ID NO: 94020 - DNA, 20 bp, Artificial Sequence
  Description of Artificial Sequence: Synthetic oligonucleotide
  Target: ATXN1; (-) strand; PAM type: NRG; PAM sequence: AGG
gcagctagtgcaaatagaaa

SEQ ID NO: 94021 - DNA, 20 bp, Artificial Sequence
  Description of Artificial Sequence: Synthetic oligonucleotide
  Target: ATXN1; (-) strand; PAM type: NRG; PAM sequence: AAG
ggcagctagtgcaaatagaa

SEQ ID NO: 94022 - DNA, 20 bp, Artificial Sequence
  Description of Artificial Sequence: Synthetic oligonucleotide
  Target: ATXN1; (-) strand; PAM type: NRG; PAM sequence: TAG
ctttaggcagctagtgcaaa

SEQ ID NO: 94023 - DNA, 20 bp, Artificial Sequence
  Description of Artificial Sequence: Synthetic oligonucleotide
  Target: ATXN1; (-) strand; PAM type: NRG; PAM sequence: TAG
taatagtttctttaggcagc

SEQ ID NO: 94024 - DNA, 20 bp, Artificial Sequence
  Description of Artificial Sequence: Synthetic oligonucleotide
  Target: ATXN1; (-) strand; PAM type: NRG; PAM sequence: CAG
ttattaatagtttctttagg

SEQ ID NO: 94025 - DNA, 20 bp, Artificial Sequence
  Description of Artificial Sequence: Synthetic oligonucleotide
  Target: ATXN1; (-) strand; PAM type: NRG; PAM sequence: AGG
caattattaatagtttcttt

SEQ ID NO: 94026 - DNA, 20 bp, Artificial Sequence
  Description of Artificial Sequence: Synthetic oligonucleotide
  Target: ATXN1; (-) strand; PAM type: NRG; PAM sequence: TAG
gcaattattaatagtttctt

SEQ ID NO: 94027 - DNA, 20 bp, Artificial Sequence
  Description of Artificial Sequence: Synthetic oligonucleotide
  Target: ATXN1; (-) strand; PAM type: NRG; PAM sequence: TAG
tgattcattgcaattattaa

SEQ ID NO: 94028 - DNA, 20 bp, Artificial Sequence
  Description of Artificial Sequence: Synthetic oligonucleotide
  Target: ATXN1; (-) strand; PAM type: NRG; PAM sequence: CAG
taattcataagcagttcata

SEQ ID NO: 94029 - DNA, 20 bp, Artificial Sequence
  Description of Artificial Sequence: Synthetic oligonucleotide
  Target: ATXN1; (-) strand; PAM type: NRG; PAM sequence: CAG
ctttttggttaattcataag

SEQ ID NO: 94030 - DNA, 20 bp, Artificial Sequence
  Description of Artificial Sequence: Synthetic oligonucleotide
  Target: ATXN1; (-) strand; PAM type: NRG; PAM sequence: AAG
tgtctttttggttaattcat

SEQ ID NO: 94031 - DNA, 20 bp, Artificial Sequence
  Description of Artificial Sequence: Synthetic oligonucleotide
  Target: ATXN1; (-) strand; PAM type: NRG; PAM sequence: TGG
gcagcattgccttgtctttt

SEQ ID NO: 94032 - DNA, 20 bp, Artificial Sequence
  Description of Artificial Sequence: Synthetic oligonucleotide
  Target: ATXN1; (-) strand; PAM type: NRG; PAM sequence: CAG
actttcccaattagtgtgtg

SEQ ID NO: 94033 - DNA, 20 bp, Artificial Sequence
  Description of Artificial Sequence: Synthetic oligonucleotide
  Target: ATXN1; (-) strand; PAM type: NRG; PAM sequence: TAG
tctgcgtcaactttcccaat

SEQ ID NO: 94034 - DNA, 20 bp, Artificial Sequence
  Description of Artificial Sequence: Synthetic oligonucleotide
  Target: ATXN1; (-) strand; PAM type: NRG; PAM sequence: AGG
aggtgcaggttttagtctct

SEQ ID NO: 94035 - DNA, 20 bp, Artificial Sequence
  Description of Artificial Sequence: Synthetic oligonucleotide
  Target: ATXN1; (-) strand; PAM type: NRG; PAM sequence: TAG
caggtgcaggttttagtctc

SEQ ID NO: 94036 - DNA, 20 bp, Artificial Sequence
  Description of Artificial Sequence: Synthetic oligonucleotide
  Target: ATXN1; (-) strand; PAM type: NRG; PAM sequence: TAG
ttacctgcaggtgcaggttt

SEQ ID NO: 94037 - DNA, 20 bp, Artificial Sequence
  Description of Artificial Sequence: Synthetic oligonucleotide
  Target: ATXN1; (-) strand; PAM type: NRG; PAM sequence: AGG
ttggttttacctgcaggtgc

SEQ ID NO: 94038 - DNA, 20 bp, Artificial Sequence
  Description of Artificial Sequence: Synthetic oligonucleotide
  Target: ATXN1; (-) strand; PAM type: NRG; PAM sequence: CAG
tttggttttacctgcaggtg

SEQ ID NO: 94039 - DNA, 20 bp, Artificial Sequence
  Description of Artificial Sequence: Synthetic oligonucleotide
  Target: ATXN1; (-) strand; PAM type: NRG; PAM sequence: AGG
tgtcatttggttttacctgc

SEQ ID NO: 94040 - DNA, 20 bp, Artificial Sequence
  Description of Artificial Sequence: Synthetic oligonucleotide
  Target: ATXN1; (-) strand; PAM type: NRG; PAM sequence: CAG
atgtcatttggttttacctg

SEQ ID NO: 94041 - DNA, 20 bp, Artificial Sequence
  Description of Artificial Sequence: Synthetic oligonucleotide
  Target: ATXN1; (-) strand; PAM type: NRG; PAM sequence: TGG
gaaatcgttttgatgtcatt

SEQ ID NO: 94042 - DNA, 20 bp, Artificial Sequence
  Description of Artificial Sequence: Synthetic oligonucleotide
  Target: ATXN1; (-) strand; PAM type: NRG; PAM sequence: TAG
ttctgcttttaatttgcaag

SEQ ID NO: 94043 - DNA, 20 bp, Artificial Sequence
  Description of Artificial Sequence: Synthetic oligonucleotide
  Target: ATXN1; (-) strand; PAM type: NRG; PAM sequence: AAG
atattctgcttttaatttgc

SEQ ID NO: 94044 - DNA, 20 bp, Artificial Sequence
  Description of Artificial Sequence: Synthetic oligonucleotide
  Target: ATXN1; (-) strand; PAM type: NRG; PAM sequence: GGG
tttctaagcagtaatatcaa

SEQ ID NO: 94045 - DNA, 20 bp, Artificial Sequence
  Description of Artificial Sequence: Synthetic oligonucleotide
  Target: ATXN1; (-) strand; PAM type: NRG; PAM sequence: AGG
ttttctaagcagtaatatca

SEQ ID NO: 94046 - DNA, 20 bp, Artificial Sequence
  Description of Artificial Sequence: Synthetic oligonucleotide
  Target: ATXN1; (-) strand; PAM type: NRG; PAM sequence: AAG
cttttctaagcagtaatatc

SEQ ID NO: 94047 - DNA, 20 bp, Artificial Sequence
  Description of Artificial Sequence: Synthetic oligonucleotide
  Target: ATXN1; (-) strand; PAM type: NRG; PAM sequence: CAG
agaagctctgcttttctaag

SEQ ID NO: 94048 - DNA, 20 bp, Artificial Sequence
  Description of Artificial Sequence: Synthetic oligonucleotide
  Target: ATXN1; (-) strand; PAM type: NRG; PAM sequence: AAG
tgcagaagctctgcttttct

SEQ ID NO: 94049 - DNA, 20 bp, Artificial Sequence
  Description of Artificial Sequence: Synthetic oligonucleotide
  Target: ATXN1; (-) strand; PAM type: NRG; PAM sequence: AAG
tttttgcaagaggagtgcag

SEQ ID NO: 94050 - DNA, 20 bp, Artificial Sequence
  Description of Artificial Sequence: Synthetic oligonucleotide
  Target: ATXN1; (-) strand; PAM type: NRG; PAM sequence: CAG
tattttttgcaagaggagtg

SEQ ID NO: 94051 - DNA, 20 bp, Artificial Sequence
  Description of Artificial Sequence: Synthetic oligonucleotide
  Target: ATXN1; (-) strand; PAM type: NRG; PAM sequence: GAG
gggattattttttgcaagag

SEQ ID NO: 94052 - DNA, 20 bp, Artificial Sequence
  Description of Artificial Sequence: Synthetic oligonucleotide
  Target: ATXN1; (-) strand; PAM type: NRG; PAM sequence: AGG
gtgggattattttttgcaag

SEQ ID NO: 94053 - DNA, 20 bp, Artificial Sequence
  Description of Artificial Sequence: Synthetic oligonucleotide
  Target: ATXN1; (-) strand; PAM type: NRG; PAM sequence: GAG
tgtgggattattttttgcaa

SEQ ID NO: 94054 - DNA, 20 bp, Artificial Sequence
  Description of Artificial Sequence: Synthetic oligonucleotide
  Target: ATXN1; (-) strand; PAM type: NRG; PAM sequence: AAG
attgtgggattattttttgc

SEQ ID NO: 94055 - DNA, 20 bp, Artificial Sequence
  Description of Artificial Sequence: Synthetic oligonucleotide
  Target: ATXN1; (-) strand; PAM type: NRG; PAM sequence: GGG
agaatctttcagctgattgt

SEQ ID NO: 94056 - DNA, 20 bp, Artificial Sequence
  Description of Artificial Sequence: Synthetic oligonucleotide
  Target: ATXN1; (-) strand; PAM type: NRG; PAM sequence: TGG
aagaatctttcagctgattg

SEQ ID NO: 94057 - DNA, 20 bp, Artificial Sequence
  Description of Artificial Sequence: Synthetic oligonucleotide
  Target: ATXN1; (-) strand; PAM type: NRG; PAM sequence: CAG
tataactggaaagaatcttt

SEQ ID NO: 94058 - DNA, 20 bp, Artificial Sequence
  Description of Artificial Sequence: Synthetic oligonucleotide
  Target: ATXN1; (-) strand; PAM type: NRG; PAM sequence: AAG
tggaatgcagtataactgga

SEQ ID NO: 94059 - DNA, 20 bp, Artificial Sequence
  Description of Artificial Sequence: Synthetic oligonucleotide
  Target: ATXN1; (-) strand; PAM type: NRG; PAM sequence: TGG
gaggtggaatgcagtataac

SEQ ID NO: 94060 - DNA, 20 bp, Artificial Sequence
  Description of Artificial Sequence: Synthetic oligonucleotide
  Target: ATXN1; (-) strand; PAM type: NRG; PAM sequence: CAG
ccatttctggaggtggaatg

SEQ ID NO: 94061 - DNA, 20 bp, Artificial Sequence
  Description of Artificial Sequence: Synthetic oligonucleotide
  Target: ATXN1; (-) strand; PAM type: NRG; PAM sequence: TGG
acaacatccatttctggagg

SEQ ID NO: 94062 - DNA, 20 bp, Artificial Sequence
  Description of Artificial Sequence: Synthetic oligonucleotide
  Target: ATXN1; (-) strand; PAM type: NRG; PAM sequence: AGG
caaacaacatccatttctgg

SEQ ID NO: 94063 - DNA, 20 bp, Artificial Sequence
  Description of Artificial Sequence: Synthetic oligonucleotide
  Target: ATXN1; (-) strand; PAM type: NRG; PAM sequence: GAG
ccaaacaacatccatttctg

SEQ ID NO: 94064 - DNA, 20 bp, Artificial Sequence
  Description of Artificial Sequence: Synthetic oligonucleotide
  Target: ATXN1; (-) strand; PAM type: NRG; PAM sequence: TGG
tcccaaacaacatccatttc

SEQ ID NO: 94065 - DNA, 20 bp, Artificial Sequence
  Description of Artificial Sequence: Synthetic oligonucleotide
  Target: ATXN1; (-) strand; PAM type: NRG; PAM sequence: TAG
atttatcaccccatctatat

SEQ ID NO: 94066 - DNA, 20 bp, Artificial Sequence
  Description of Artificial Sequence: Synthetic oligonucleotide
  Target: ATXN1; (-) strand; PAM type: NRG; PAM sequence: CGG
tttatagagtaagtcataag

SEQ ID NO: 94067 - DNA, 20 bp, Artificial Sequence
  Description of Artificial Sequence: Synthetic oligonucleotide
  Target: ATXN1; (-) strand; PAM type: NRG; PAM sequence: AAG
ttatttatagagtaagtcat

SEQ ID NO: 94068 - DNA, 20 bp, Artificial Sequence
  Description of Artificial Sequence: Synthetic oligonucleotide
  Target: ATXN1; (-) strand; PAM type: NRG; PAM sequence: AAG
tatgtcattatttatagagt

SEQ ID NO: 94069 - DNA, 20 bp, Artificial Sequence
  Description of Artificial Sequence: Synthetic oligonucleotide
  Target: ATXN1; (-) strand; PAM type: NRG; PAM sequence: GAG
ttattatgtcattatttata

SEQ ID NO: 94070 - DNA, 20 bp, Artificial Sequence
  Description of Artificial Sequence: Synthetic oligonucleotide
  Target: ATXN1; (-) strand; PAM type: NRG; PAM sequence: TAG
tattattatgtcattattta

SEQ ID NO: 94071 - DNA, 20 bp, Artificial Sequence
  Description of Artificial Sequence: Synthetic oligonucleotide
  Target: ATXN1; (-) strand; PAM type: NRG; PAM sequence: TAG
tttaattagaatttatattt

SEQ ID NO: 94072 - DNA, 20 bp, Artificial Sequence
  Description of Artificial Sequence: Synthetic oligonucleotide
  Target: ATXN1; (-) strand; PAM type: NRG; PAM sequence: TAG
tgttagattttgtatttaat

SEQ ID NO: 94073 - DNA, 20 bp, Artificial Sequence
  Description of Artificial Sequence: Synthetic oligonucleotide
  Target: ATXN1; (-) strand; PAM type: NRG; PAM sequence: TAG
ttgctgttgtttgactttgt

SEQ ID NO: 94074 - DNA, 20 bp, Artificial Sequence
  Description of Artificial Sequence: Synthetic oligonucleotide
  Target: ATXN1; (-) strand; PAM type: NRG; PAM sequence: AAG
ttcttgctcccggctccccc

SEQ ID NO: 94075 - DNA, 20 bp, Artificial Sequence
  Description of Artificial Sequence: Synthetic oligonucleotide
  Target: ATXN1; (-) strand; PAM type: NRG; PAM sequence: CGG
tttattgtaattcttgctcc

SEQ ID NO: 94076 - DNA, 20 bp, Artificial Sequence
  Description of Artificial Sequence: Synthetic oligonucleotide
  Target: ATXN1; (-) strand; PAM type: NRG; PAM sequence: TAG
acattgtacagttccatgaa

SEQ ID NO: 94077 - DNA, 20 bp, Artificial Sequence
  Description of Artificial Sequence: Synthetic oligonucleotide
  Target: ATXN1; (-) strand; PAM type: NRG; PAM sequence: CAG
cttctatctctgacattgta

SEQ ID NO: 94078 - DNA, 20 bp, Artificial Sequence
  Description of Artificial Sequence: Synthetic oligonucleotide
  Target: ATXN1; (-) strand; PAM type: NRG; PAM sequence: GGG
gttgaaagaaatgatctctc

SEQ ID NO: 94079 - DNA, 20 bp, Artificial Sequence
  Description of Artificial Sequence: Synthetic oligonucleotide
  Target: ATXN1; (-) strand; PAM type: NRG; PAM sequence: CGG
ggttgaaagaaatgatctct

SEQ ID NO: 94080 - DNA, 20 bp, Artificial Sequence
  Description of Artificial Sequence: Synthetic oligonucleotide
  Target: ATXN1; (-) strand; PAM type: NRG; PAM sequence: AAG
ccaaaacacaaggaggttga

SEQ ID NO: 94081 - DNA, 20 bp, Artificial Sequence
  Description of Artificial Sequence: Synthetic oligonucleotide
  Target: ATXN1; (-) strand; PAM type: NRG; PAM sequence: AGG
cctgtctccaaaacacaagg

SEQ ID NO: 94082 - DNA, 20 bp, Artificial Sequence
  Description of Artificial Sequence: Synthetic oligonucleotide
  Target: ATXN1; (-) strand; PAM type: NRG; PAM sequence: GAG
tcctgtctccaaaacacaag

SEQ ID NO: 94083 - DNA, 20 bp, Artificial Sequence
  Description of Artificial Sequence: Synthetic oligonucleotide
  Target: ATXN1; (-) strand; PAM type: NRG; PAM sequence: AGG
tttcctgtctccaaaacaca

SEQ ID NO: 94084 - DNA, 20 bp, Artificial Sequence
  Description of Artificial Sequence: Synthetic oligonucleotide
  Target: ATXN1; (-) strand; PAM type: NRG; PAM sequence: AAG
ttttcctgtctccaaaacac

SEQ ID NO: 94085 - DNA, 20 bp, Artificial Sequence
  Description of Artificial Sequence: Synthetic oligonucleotide
  Target: ATXN1; (-) strand; PAM type: NRG; PAM sequence: CAG
cactgtaccttgctgggtct

SEQ ID NO: 94086 - DNA, 20 bp, Artificial Sequence
  Description of Artificial Sequence: Synthetic oligonucleotide
  Target: ATXN1; (-) strand; PAM type: NRG; PAM sequence: GGG
gctactcactgtaccttgct

SEQ ID NO: 94087 - DNA, 20 bp, Artificial Sequence
  Description of Artificial Sequence: Synthetic oligonucleotide
  Target: ATXN1; (-) strand; PAM type: NRG; PAM sequence: TGG
tgctactcactgtaccttgc

SEQ ID NO: 94088 - DNA, 20 bp, Artificial Sequence
  Description of Artificial Sequence: Synthetic oligonucleotide
  Target: ATXN1; (-) strand; PAM type: NRG; PAM sequence: AGG
tctgttgcctgccctgcaac

SEQ ID NO: 94089 - DNA, 20 bp, Artificial Sequence
  Description of Artificial Sequence: Synthetic oligonucleotide
  Target: ATXN1; (-) strand; PAM type: NRG; PAM sequence: CAG
ttctgttgcctgccctgcaa

SEQ ID NO: 94090 - DNA, 20 bp, Artificial Sequence
  Description of Artificial Sequence: Synthetic oligonucleotide
  Target: ATXN1; (-) strand; PAM type: NRG; PAM sequence: CAG
ggactggtagtttggaggct

SEQ ID NO: 94091 - DNA, 20 bp, Artificial Sequence
  Description of Artificial Sequence: Synthetic oligonucleotide
  Target: ATXN1; (-) strand; PAM type: NRG; PAM sequence: AGG
ctgttggactggtagtttgg

SEQ ID NO: 94092 - DNA, 20 bp, Artificial Sequence
  Description of Artificial Sequence: Synthetic oligonucleotide
  Target: ATXN1; (-) strand; PAM type: NRG; PAM sequence: GAG
gctgttggactggtagtttg

SEQ ID NO: 94093 - DNA, 20 bp, Artificial Sequence
  Description of Artificial Sequence: Synthetic oligonucleotide
  Target: ATXN1; (-) strand; PAM type: NRG; PAM sequence: TGG
gtgctgttggactggtagtt

SEQ ID NO: 94094 - DNA, 20 bp, Artificial Sequence
  Description of Artificial Sequence: Synthetic oligonucleotide
  Target: ATXN1; (-) strand; PAM type: NRG; PAM sequence: TAG
atggtgtgctgttggactgg

SEQ ID NO: 94095 - DNA, 20 bp, Artificial Sequence
  Description of Artificial Sequence: Synthetic oligonucleotide
  Target: ATXN1; (-) strand; PAM type: NRG; PAM sequence: TGG
agtatggtgtgctgttggac

SEQ ID NO: 94096 - DNA, 20 bp, Artificial Sequence
  Description of Artificial Sequence: Synthetic oligonucleotide
  Target: ATXN1; (-) strand; PAM type: NRG; PAM sequence: TGG
gagtgagtatggtgtgctgt

SEQ ID NO: 94097 - DNA, 20 bp, Artificial Sequence
  Description of Artificial Sequence: Synthetic oligonucleotide
  Target: ATXN1; (-) strand; PAM type: NRG; PAM sequence: TGG
aggaccctacagagtgagta

SEQ ID NO: 94098 - DNA, 20 bp, Artificial Sequence
  Description of Artificial Sequence: Synthetic oligonucleotide
  Target: ATXN1; (-) strand; PAM type: NRG; PAM sequence: GAG
cttccaggaccctacagagt

SEQ ID NO: 94099 - DNA, 20 bp, Artificial Sequence
  Description of Artificial Sequence: Synthetic oligonucleotide
  Target: ATXN1; (-) strand; PAM type: NRG; PAM sequence: GAG
tagtcttccaggaccctaca

SEQ ID NO: 94100 - DNA, 20 bp, Artificial Sequence
  Description of Artificial Sequence: Synthetic oligonucleotide
  Target: ATXN1; (-) strand; PAM type: NRG; PAM sequence: CAG
agtagtcttccaggacccta

SEQ ID NO: 94101 - DNA, 20 bp, Artificial Sequence
  Description of Artificial Sequence: Synthetic oligonucleotide
  Target: ATXN1; (-) strand; PAM type: NRG; PAM sequence: AGG
ttcaaatggagtagtcttcc

SEQ ID NO: 94102 - DNA, 20 bp, Artificial Sequence
  Description of Artificial Sequence: Synthetic oligonucleotide
  Target: ATXN1; (-) strand; PAM type: NRG; PAM sequence: CAG
tttcaaatggagtagtcttc

SEQ ID NO: 94103 - DNA, 20 bp, Artificial Sequence
  Description of Artificial Sequence: Synthetic oligonucleotide
  Target: ATXN1; (-) strand; PAM type: NRG; PAM sequence: TAG
aaatatggtttcaaatggag

SEQ ID NO: 94104 - DNA, 20 bp, Artificial Sequence
  Description of Artificial Sequence: Synthetic oligonucleotide
  Target: ATXN1; (-) strand; PAM type: NRG; PAM sequence: GAG
tgaaaatatggtttcaaatg

SEQ ID NO: 94105 - DNA, 20 bp, Artificial Sequence
  Description of Artificial Sequence: Synthetic oligonucleotide
  Target: ATXN1; (-) strand; PAM type: NRG; PAM sequence: TGG
tttgaaaatatggtttcaaa

SEQ ID NO: 94106 - DNA, 20 bp, Artificial Sequence
  Description of Artificial Sequence: Synthetic oligonucleotide
  Target: ATXN1; (-) strand; PAM type: NRG; PAM sequence: TGG
ttaatgatcttttgaaaata

SEQ ID NO: 94107 - DNA, 20 bp, Artificial Sequence
  Description of Artificial Sequence: Synthetic oligonucleotide
  Target: ATXN1; (-) strand; PAM type: NRG; PAM sequence: TAG
aaaaaggaatttaatatgta

SEQ ID NO: 94108 - DNA, 20 bp, Artificial Sequence
  Description of Artificial Sequence: Synthetic oligonucleotide
  Target: ATXN1; (-) strand; PAM type: NRG; PAM sequence: AGG
gcattagaaaattattaaaa

SEQ ID NO: 94109 - DNA, 20 bp, Artificial Sequence
  Description of Artificial Sequence: Synthetic oligonucleotide
  Target: ATXN1; (-) strand; PAM type: NRG; PAM sequence: AAG
tgcattagaaaattattaaa

SEQ ID NO: 94110 - DNA, 20 bp, Artificial Sequence
  Description of Artificial Sequence: Synthetic oligonucleotide
  Target: ATXN1; (-) strand; PAM type: NRG; PAM sequence: TAG
taaaatgtgcccctgtgcat

SEQ ID NO: 94111 - DNA, 20 bp, Artificial Sequence
  Description of Artificial Sequence: Synthetic oligonucleotide
  Target: ATXN1; (-) strand; PAM type: NRG; PAM sequence: AGG
ttccaaaagaaatcaaaacc

SEQ ID NO: 94112 - DNA, 20 bp, Artificial Sequence
  Description of Artificial Sequence: Synthetic oligonucleotide
  Target: ATXN1; (-) strand; PAM type: NRG; PAM sequence: CAG
tttccaaaagaaatcaaaac

SEQ ID NO: 94113 - DNA, 20 bp, Artificial Sequence
  Description of Artificial Sequence: Synthetic oligonucleotide
  Target: ATXN1; (-) strand; PAM type: NRG; PAM sequence: AAG
agcagcgtgcagttttccaa

SEQ ID NO: 94114 - DNA, 20 bp, Artificial Sequence
  Description of Artificial Sequence: Synthetic oligonucleotide
  Target: ATXN1; (-) strand; PAM type: NRG; PAM sequence: CAG
attaaacaccgagcagcgtg

SEQ ID NO: 94115 - DNA, 20 bp, Artificial Sequence
  Description of Artificial Sequence: Synthetic oligonucleotide
  Target: ATXN1; (-) strand; PAM type: NRG; PAM sequence: CAG
ataccagattaaacaccgag

SEQ ID NO: 94116 - DNA, 20 bp, Artificial Sequence
  Description of Artificial Sequence: Synthetic oligonucleotide
  Target: ATXN1; (-) strand; PAM type: NRG; PAM sequence: GAG
tcaataccagattaaacacc

SEQ ID NO: 94117 - DNA, 20 bp, Artificial Sequence
  Description of Artificial Sequence: Synthetic oligonucleotide
  Target: ATXN1; (-) strand; PAM type: NRG; PAM sequence: CAG
gttaatatttcactcaatac

SEQ ID NO: 94118 - DNA, 20 bp, Artificial Sequence
  Description of Artificial Sequence: Synthetic oligonucleotide
  Target: ATXN1; (-) strand; PAM type: NRG; PAM sequence: TGG
ggaacagtgaaaccattata

SEQ ID NO: 94119 - DNA, 20 bp, Artificial Sequence
  Description of Artificial Sequence: Synthetic oligonucleotide
  Target: ATXN1; (-) strand; PAM type: NRG; PAM sequence: CAG
gtttagctttactgaaggaa

SEQ ID NO: 94120 - DNA, 20 bp, Artificial Sequence
  Description of Artificial Sequence: Synthetic oligonucleotide
  Target: ATXN1; (-) strand; PAM type: NRG; PAM sequence: AGG
gttctgtttagctttactga

SEQ ID NO: 94121 - DNA, 20 bp, Artificial Sequence
  Description of Artificial Sequence: Synthetic oligonucleotide
  Target: ATXN1; (-) strand; PAM type: NRG; PAM sequence: AAG
agttctgtttagctttactg

SEQ ID NO: 94122 - DNA, 20 bp, Artificial Sequence
  Description of Artificial Sequence: Synthetic oligonucleotide
  Target: ATXN1; (-) strand; PAM type: NRG; PAM sequence: TAG
tatgtttttcgagttctgtt

SEQ ID NO: 94123 - DNA, 20 bp, Artificial Sequence
  Description of Artificial Sequence: Synthetic oligonucleotide
  Target: ATXN1; (-) strand; PAM type: NRG; PAM sequence: GAG
gcctgggggatatgtttttc

SEQ ID NO: 94124 - DNA, 20 bp, Artificial Sequence
  Description of Artificial Sequence: Synthetic oligonucleotide
  Target: ATXN1; (-) strand; PAM type: NRG; PAM sequence: GGG
aaactccactgtaggcctgg

SEQ ID NO: 94125 - DNA, 20 bp, Artificial Sequence
  Description of Artificial Sequence: Synthetic oligonucleotide
  Target: ATXN1; (-) strand; PAM type: NRG; PAM sequence: GGG
gaaactccactgtaggcctg

SEQ ID NO: 94126 - DNA, 20 bp, Artificial Sequence
  Description of Artificial Sequence: Synthetic oligonucleotide
  Target: ATXN1; (-) strand; PAM type: NRG; PAM sequence: GGG
agaaactccactgtaggcct

SEQ ID NO: 94127 - DNA, 20 bp, Artificial Sequence
  Description of Artificial Sequence: Synthetic oligonucleotide
  Target: ATXN1; (-) strand; PAM type: NRG; PAM sequence: TGG
cagaaactccactgtaggcc

SEQ ID NO: 94128 - DNA, 20 bp, Artificial Sequence
  Description of Artificial Sequence: Synthetic oligonucleotide
  Target: ATXN1; (-) strand; PAM type: NRG; PAM sequence: AGG
tgctccagaaactccactgt

SEQ ID NO: 94129 - DNA, 20 bp, Artificial Sequence
  Description of Artificial Sequence: Synthetic oligonucleotide
  Target: ATXN1; (-) strand; PAM type: NRG; PAM sequence: TAG
gtgctccagaaactccactg

SEQ ID NO: 94130 - DNA, 20 bp, Artificial Sequence
  Description of Artificial Sequence: Synthetic oligonucleotide
  Target: ATXN1; (-) strand; PAM type: NRG; PAM sequence: CAG
gtggagtttaatgtgtgctc

SEQ ID NO: 94131 - DNA, 20 bp, Artificial Sequence
  Description of Artificial Sequence: Synthetic oligonucleotide
  Target: ATXN1; (-) strand; PAM type: NRG; PAM sequence: GAG
ggcttgttgagcagagcgtg

SEQ ID NO: 94132 - DNA, 20 bp, Artificial Sequence
  Description of Artificial Sequence: Synthetic oligonucleotide
  Target: ATXN1; (-) strand; PAM type: NRG; PAM sequence: TGG
tgggcttgttgagcagagcg

SEQ ID NO: 94133 - DNA, 20 bp, Artificial Sequence
  Description of Artificial Sequence: Synthetic oligonucleotide
  Target: ATXN1; (-) strand; PAM type: NRG; PAM sequence: GAG
agcgatgggcttgttgagca

SEQ ID NO: 94134 - DNA, 20 bp, Artificial Sequence
  Description of Artificial Sequence: Synthetic oligonucleotide
  Target: ATXN1; (-) strand; PAM type: NRG; PAM sequence: CAG
acagcgatgggcttgttgag

SEQ ID NO: 94135 - DNA, 20 bp, Artificial Sequence
  Description of Artificial Sequence: Synthetic oligonucleotide
  Target: ATXN1; (-) strand; PAM type: NRG; PAM sequence: GAG
ttaacagcgatgggcttgtt

SEQ ID NO: 94136 - DNA, 20 bp, Artificial Sequence
  Description of Artificial Sequence: Synthetic oligonucleotide
  Target: ATXN1; (-) strand; PAM type: NRG; PAM sequence: GGG
atgagttacttaacagcgat

SEQ ID NO: 94137 - DNA, 20 bp, Artificial Sequence
  Description of Artificial Sequence: Synthetic oligonucleotide
  Target: ATXN1; (-) strand; PAM type: NRG; PAM sequence: TGG
gatgagttacttaacagcga

SEQ ID NO: 94138 - DNA, 20 bp, Artificial Sequence
  Description of Artificial Sequence: Synthetic oligonucleotide
  Target: ATXN1; (-) strand; PAM type: NRG; PAM sequence: CAG
ttttctgatgagttacttaa

SEQ ID NO: 94139 - DNA, 20 bp, Artificial Sequence
  Description of Artificial Sequence: Synthetic oligonucleotide
  Target: ATXN1; (-) strand; PAM type: NRG; PAM sequence: GAG
ttccctctttattttctgat

SEQ ID NO: 94140 - DNA, 20 bp, Artificial Sequence
  Description of Artificial Sequence: Synthetic oligonucleotide
  Target: ATXN1; (-) strand; PAM type: NRG; PAM sequence: TGG
attgcttggcaattcccctt

SEQ ID NO: 94141 - DNA, 20 bp, Artificial Sequence
  Description of Artificial Sequence: Synthetic oligonucleotide
  Target: ATXN1; (-) strand; PAM type: NRG; PAM sequence: TGG
gcttcagagaactaattgct

SEQ ID NO: 94142 - DNA, 20 bp, Artificial Sequence
  Description of Artificial Sequence: Synthetic oligonucleotide
  Target: ATXN1; (-) strand; PAM type: NRG; PAM sequence: GAG
gttgtatgtcgtctgcttca

SEQ ID NO: 94143 - DNA, 20 bp, Artificial Sequence
  Description of Artificial Sequence: Synthetic oligonucleotide
  Target: ATXN1; (-) strand; PAM type: NRG; PAM sequence: CAG
cagttgtatgtcgtctgctt

SEQ ID NO: 94144 - DNA, 20 bp, Artificial Sequence
  Description of Artificial Sequence: Synthetic oligonucleotide
  Target: ATXN1; (-) strand; PAM type: NRG; PAM sequence: CAG
cgggaagctcctccctgtaa

SEQ ID NO: 94145 - DNA, 20 bp, Artificial Sequence
  Description of Artificial Sequence: Synthetic oligonucleotide
  Target: ATXN1; (-) strand; PAM type: NRG; PAM sequence: AAG
ctgacatatgactaaccggg

SEQ ID NO: 94146 - DNA, 20 bp, Artificial Sequence
  Description of Artificial Sequence: Synthetic oligonucleotide
  Target: ATXN1; (-) strand; PAM type: NRG; PAM sequence: GGG
actctgacatatgactaacc

SEQ ID NO: 94147 - DNA, 20 bp, Artificial Sequence
  Description of Artificial Sequence: Synthetic oligonucleotide
  Target: ATXN1; (-) strand; PAM type: NRG; PAM sequence: CGG
gactctgacatatgactaac

SEQ ID NO: 94148 - DNA, 20 bp, Artificial Sequence
  Description of Artificial Sequence: Synthetic oligonucleotide
  Target: ATXN1; (-) strand; PAM type: NRG; PAM sequence: AGG
atttttatttacagattagt

SEQ ID NO: 94149 - DNA, 20 bp, Artificial Sequence
  Description of Artificial Sequence: Synthetic oligonucleotide
  Target: ATXN1; (-) strand; PAM type: NRG; PAM sequence: TAG
catttttatttacagattag

SEQ ID NO: 94150 - DNA, 20 bp, Artificial Sequence
  Description of Artificial Sequence: Synthetic oligonucleotide
  Target: ATXN1; (-) strand; PAM type: NRG; PAM sequence: TAG
atgcatttttatttacagat

SEQ ID NO: 94151 - DNA, 20 bp, Artificial Sequence
  Description of Artificial Sequence: Synthetic oligonucleotide
  Target: ATXN1; (-) strand; PAM type: NRG; PAM sequence: CAG
atgtgatgcatttttattta

SEQ ID NO: 94152 - DNA, 20 bp, Artificial Sequence
  Description of Artificial Sequence: Synthetic oligonucleotide
  Target: ATXN1; (-) strand; PAM type: NRG; PAM sequence: CAG
ggcagcttcagcctacatca

SEQ ID NO: 94153 - DNA, 20 bp, Artificial Sequence
  Description of Artificial Sequence: Synthetic oligonucleotide
  Target: ATXN1; (-) strand; PAM type: NRG; PAM sequence: CAG
gtgccctagcctggcagctt

SEQ ID NO: 94154 - DNA, 20 bp, Artificial Sequence
  Description of Artificial Sequence: Synthetic oligonucleotide
  Target: ATXN1; (-) strand; PAM type: NRG; PAM sequence: CAG
ctattcgtgccctagcctgg

SEQ ID NO: 94155 - DNA, 20 bp, Artificial Sequence
  Description of Artificial Sequence: Synthetic oligonucleotide
  Target: ATXN1; (-) strand; PAM type: NRG; PAM sequence: TGG
ttactattcgtgccctagcc

SEQ ID NO: 94156 - DNA, 20 bp, Artificial Sequence
  Description of Artificial Sequence: Synthetic oligonucleotide
  Target: ATXN1; (-) strand; PAM type: NRG; PAM sequence: TAG
aagatttactattcgtgccc

SEQ ID NO: 94157 - DNA, 20 bp, Artificial Sequence
  Description of Artificial Sequence: Synthetic oligonucleotide
  Target: ATXN1; (-) strand; PAM type: NRG; PAM sequence: AAG
ggaaatcgagaagaggatgc

SEQ ID NO: 94158 - DNA, 20 bp, Artificial Sequence
  Description of Artificial Sequence: Synthetic oligonucleotide
  Target: ATXN1; (-) strand; PAM type: NRG; PAM sequence: AGG
gacccacggaaatcgagaag

SEQ ID NO: 94159 - DNA, 20 bp, Artificial Sequence
  Description of Artificial Sequence: Synthetic oligonucleotide
  Target: ATXN1; (-) strand; PAM type: NRG; PAM sequence: GAG
agacccacggaaatcgagaa

SEQ ID NO: 94160 - DNA, 20 bp, Artificial Sequence
  Description of Artificial Sequence: Synthetic oligonucleotide
  Target: ATXN1; (-) strand; PAM type: NRG; PAM sequence: AAG
acagacccacggaaatcgag

SEQ ID NO: 94161 - DNA, 20 bp, Artificial Sequence
  Description of Artificial Sequence: Synthetic oligonucleotide
  Target: ATXN1; (-) strand; PAM type: NRG; PAM sequence: GAG
tttacagacccacggaaatc

SEQ ID NO: 94162 - DNA, 20 bp, Artificial Sequence
  Description of Artificial Sequence: Synthetic oligonucleotide
  Target: ATXN1; (-) strand; PAM type: NRG; PAM sequence: CGG
ctcttgcttttacagaccca

SEQ ID NO: 94163 - DNA, 20 bp, Artificial Sequence
  Description of Artificial Sequence: Synthetic oligonucleotide
  Target: ATXN1; (-) strand; PAM type: NRG; PAM sequence: CAG
ggcaacatctcttgctttta

SEQ ID NO: 94164 - DNA, 20 bp, Artificial Sequence
  Description of Artificial Sequence: Synthetic oligonucleotide
  Target: ATXN1; (-) strand; PAM type: NRG; PAM sequence: AGG
ttttttttttttggtcttca

SEQ ID NO: 94165 - DNA, 20 bp, Artificial Sequence
  Description of Artificial Sequence: Synthetic oligonucleotide
  Target: ATXN1; (-) strand; PAM type: NRG; PAM sequence: AAG
tttttttttttttggtcttc

SEQ ID NO: 94166 - DNA, 20 bp, Artificial Sequence
  Description of Artificial Sequence: Synthetic oligonucleotide
  Target: ATXN1; (-) strand; PAM type: NRG; PAM sequence: TGG
acttttgttttttttttttt

SEQ ID NO: 94167 - DNA, 20 bp, Artificial Sequence
  Description of Artificial Sequence: Synthetic oligonucleotide
  Target: ATXN1; (-) strand; PAM type: NRG; PAM sequence: AGG
cactgagtgaaaaattactg

SEQ ID NO: 94168 - DNA, 20 bp, Artificial Sequence
  Description of Artificial Sequence: Synthetic oligonucleotide
  Target: ATXN1; (-) strand; PAM type: NRG; PAM sequence: GAG
acactgagtgaaaaattact

SEQ ID NO: 94169 - DNA, 20 bp, Artificial Sequence
  Description of Artificial Sequence: Synthetic oligonucleotide
  Target: ATXN1; (-) strand; PAM type: NRG; PAM sequence: GAG
cagattgtctttcttacact

SEQ ID NO: 94170 - DNA, 20 bp, Artificial Sequence
  Description of Artificial Sequence: Synthetic oligonucleotide
  Target: ATXN1; (-) strand; PAM type: NRG; PAM sequence: CAG
ttagctggcttagggaaggc

SEQ ID NO: 94171 - DNA, 20 bp, Artificial Sequence
  Description of Artificial Sequence: Synthetic oligonucleotide
  Target: ATXN1; (-) strand; PAM type: NRG; PAM sequence: AGG
tctcttagctggcttaggga

SEQ ID NO: 94172 - DNA, 20 bp, Artificial Sequence
  Description of Artificial Sequence: Synthetic oligonucleotide
  Target: ATXN1; (-) strand; PAM type: NRG; PAM sequence: AAG
ttctcttagctggcttaggg

SEQ ID NO: 94173 - DNA, 20 bp, Artificial Sequence
  Description of Artificial Sequence: Synthetic oligonucleotide
  Target: ATXN1; (-) strand; PAM type: NRG; PAM sequence: GGG
actttctcttagctggctta

SEQ ID NO: 94174 - DNA, 20 bp, Artificial Sequence
  Description of Artificial Sequence: Synthetic oligonucleotide
  Target: ATXN1; (-) strand; PAM type: NRG; PAM sequence: AGG
cactttctcttagctggctt

SEQ ID NO: 94175 - DNA, 20 bp, Artificial Sequence
  Description of Artificial Sequence: Synthetic oligonucleotide
  Target: ATXN1; (-) strand; PAM type: NRG; PAM sequence: TAG
tcactttctcttagctggct

SEQ ID NO: 94176 - DNA, 20 bp, Artificial Sequence
  Description of Artificial Sequence: Synthetic oligonucleotide
  Target: ATXN1; (-) strand; PAM type: NRG; PAM sequence: TGG
aaagatcactttctcttagc

SEQ ID NO: 94177 - DNA, 20 bp, Artificial Sequence
  Description of Artificial Sequence: Synthetic oligonucleotide
  Target: ATXN1; (-) strand; PAM type: NRG; PAM sequence: TAG
gaagaaagatcactttctct

SEQ ID NO: 94178 - DNA, 20 bp, Artificial Sequence
  Description of Artificial Sequence: Synthetic oligonucleotide
  Target: ATXN1; (-) strand; PAM type: NRG; PAM sequence: AAG
tgtcaagatgatagagaaga

SEQ ID NO: 94179 - DNA, 20 bp, Artificial Sequence
  Description of Artificial Sequence: Synthetic oligonucleotide
  Target: ATXN1; (-) strand; PAM type: NRG; PAM sequence: AAG
ttcatgtcaagatgatagag

SEQ ID NO: 94180 - DNA, 20 bp, Artificial Sequence
  Description of Artificial Sequence: Synthetic oligonucleotide
  Target: ATXN1; (-) strand; PAM type: NRG; PAM sequence: GAG
tcattcatgtcaagatgata

SEQ ID NO: 94181 - DNA, 20 bp, Artificial Sequence
  Description of Artificial Sequence: Synthetic oligonucleotide
  Target: ATXN1; (-) strand; PAM type: NRG; PAM sequence: TAG
gctcattcatgtcaagatga

SEQ ID NO: 94182 - DNA, 20 bp, Artificial Sequence
  Description of Artificial Sequence: Synthetic oligonucleotide
  Target: ATXN1; (-) strand; PAM type: NRG; PAM sequence: AAG
aatctgagctcattcatgtc

SEQ ID NO: 94183 - DNA, 20 bp, Artificial Sequence
  Description of Artificial Sequence: Synthetic oligonucleotide
  Target: ATXN1; (-) strand; PAM type: NRG; PAM sequence: GAG
ctagaacagtgaatgaatct

SEQ ID NO: 94184 - DNA, 20 bp, Artificial Sequence
  Description of Artificial Sequence: Synthetic oligonucleotide
  Target: ATXN1; (-) strand; PAM type: NRG; PAM sequence: CAG
ttttctctccttcactagaa

SEQ ID NO: 94185 - DNA, 20 bp, Artificial Sequence
  Description of Artificial Sequence: Synthetic oligonucleotide
  Target: ATXN1; (-) strand; PAM type: NRG; PAM sequence: TAG
tctcattttctctccttcac

SEQ ID NO: 94186 - DNA, 20 bp, Artificial Sequence
  Description of Artificial Sequence: Synthetic oligonucleotide
  Target: ATXN1; (-) strand; PAM type: NRG; PAM sequence: CAG
ccctctgcccctgcctcgcc

SEQ ID NO: 94187 - DNA, 20 bp, Artificial Sequence
  Description of Artificial Sequence: Synthetic oligonucleotide
  Target: ATXN1; (-) strand; PAM type: NRG; PAM sequence: TAG
agggtggccataaggaagct

SEQ ID NO: 94188 - DNA, 20 bp, Artificial Sequence
  Description of Artificial Sequence: Synthetic oligonucleotide
  Target: ATXN1; (-) strand; PAM type: NRG; PAM sequence: AAG
tagtcagggtggccataagg

SEQ ID NO: 94189 - DNA, 20 bp, Artificial Sequence
  Description of Artificial Sequence: Synthetic oligonucleotide
  Target: ATXN1; (-) strand; PAM type: NRG; PAM sequence: AGG
ctttagtcagggtggccata

SEQ ID NO: 94190 - DNA, 20 bp, Artificial Sequence
  Description of Artificial Sequence: Synthetic oligonucleotide
  Target: ATXN1; (-) strand; PAM type: NRG; PAM sequence: AAG
gctttagtcagggtggccat

SEQ ID NO: 94191 - DNA, 20 bp, Artificial Sequence
  Description of Artificial Sequence: Synthetic oligonucleotide
  Target: ATXN1; (-) strand; PAM type: NRG; PAM sequence: TGG
aggtcacgctttagtcaggg

SEQ ID NO: 94192 - DNA, 20 bp, Artificial Sequence
  Description of Artificial Sequence: Synthetic oligonucleotide
  Target: ATXN1; (-) strand; PAM type: NRG; PAM sequence: GGG
aggaggtcacgctttagtca

SEQ ID NO: 94193 - DNA, 20 bp, Artificial Sequence
  Description of Artificial Sequence: Synthetic oligonucleotide
  Target: ATXN1; (-) strand; PAM type: NRG; PAM sequence: AGG
aaggaggtcacgctttagtc

SEQ ID NO: 94194 - DNA, 20 bp, Artificial Sequence
  Description of Artificial Sequence: Synthetic oligonucleotide
  Target: ATXN1; (-) strand; PAM type: NRG; PAM sequence: CAG
aaaggaggtcacgctttagt

SEQ ID NO: 94195 - DNA, 20 bp, Artificial Sequence
  Description of Artificial Sequence: Synthetic oligonucleotide
  Target: ATXN1; (-) strand; PAM type: NRG; PAM sequence: TAG
agcaaaaggaggtcacgctt

SEQ ID NO: 94196 - DNA, 20 bp, Artificial Sequence
  Description of Artificial Sequence: Synthetic oligonucleotide
  Target: ATXN1; (-) strand; PAM type: NRG; PAM sequence: AGG
ataaaacgtgcagcaaaagg

SEQ ID NO: 94197 - DNA, 20 bp, Artificial Sequence
  Description of Artificial Sequence: Synthetic oligonucleotide
  Target: ATXN1; (-) strand; PAM type: NRG; PAM sequence: GAG
aataaaacgtgcagcaaaag

SEQ ID NO: 94198 - DNA, 20 bp, Artificial Sequence
  Description of Artificial Sequence: Synthetic oligonucleotide
  Target: ATXN1; (-) strand; PAM type: NRG; PAM sequence: AGG
agaataaaacgtgcagcaaa

SEQ ID NO: 94199 - DNA, 20 bp, Artificial Sequence
  Description of Artificial Sequence: Synthetic oligonucleotide
  Target: ATXN1; (-) strand; PAM type: NRG; PAM sequence: AAG
aagaataaaacgtgcagcaa

SEQ ID NO: 94200 - DNA, 20 bp, Artificial Sequence
  Description of Artificial Sequence: Synthetic oligonucleotide
  Target: ATXN1; (-) strand; PAM type: NRG; PAM sequence: CAG
agctctaagaataaaacgtg

SEQ ID NO: 94201 - DNA, 20 bp, Artificial Sequence
  Description of Artificial Sequence: Synthetic oligonucleotide
  Target: ATXN1; (-) strand; PAM type: NRG; PAM sequence: AAG
tggcgctgaacgcaagctct

SEQ ID NO: 94202 - DNA, 20 bp, Artificial Sequence
  Description of Artificial Sequence: Synthetic oligonucleotide
  Target: ATXN1; (-) strand; PAM type: NRG; PAM sequence: AAG
ggtggtgtggcgctgaacgc

SEQ ID NO: 94203 - DNA, 20 bp, Artificial Sequence
  Description of Artificial Sequence: Synthetic oligonucleotide
  Target: ATXN1; (-) strand; PAM type: NRG; PAM sequence: TGG
cagtgtgataggtggtggtg

SEQ ID NO: 94204 - DNA, 20 bp, Artificial Sequence
  Description of Artificial Sequence: Synthetic oligonucleotide
  Target: ATXN1; (-) strand; PAM type: NRG; PAM sequence: TGG
ctctccagtgtgataggtgg

SEQ ID NO: 94205 - DNA, 20 bp, Artificial Sequence
  Description of Artificial Sequence: Synthetic oligonucleotide
  Target: ATXN1; (-) strand; PAM type: NRG; PAM sequence: TGG
tgtctctccagtgtgatagg

SEQ ID NO: 94206 - DNA, 20 bp, Artificial Sequence
  Description of Artificial Sequence: Synthetic oligonucleotide
  Target: ATXN1; (-) strand; PAM type: NRG; PAM sequence: AGG
atttgtctctccagtgtgat

SEQ ID NO: 94207 - DNA, 20 bp, Artificial Sequence
  Description of Artificial Sequence: Synthetic oligonucleotide
  Target: ATXN1; (-) strand; PAM type: NRG; PAM sequence: TAG
tatttgtctctccagtgtga

SEQ ID NO: 94208 - DNA, 20 bp, Artificial Sequence
  Description of Artificial Sequence: Synthetic oligonucleotide
  Target: ATXN1; (-) strand; PAM type: NRG; PAM sequence: CAG
atatgaactatttgtctctc

SEQ ID NO: 94209 - DNA, 20 bp, Artificial Sequence
  Description of Artificial Sequence: Synthetic oligonucleotide
  Target: ATXN1; (-) strand; PAM type: NRG; PAM sequence: CAG
gctcagcttgcaagatttgg

SEQ ID NO: 94210 - DNA, 20 bp, Artificial Sequence
  Description of Artificial Sequence: Synthetic oligonucleotide
  Target: ATXN1; (-) strand; PAM type: NRG; PAM sequence: TGG
attgctcagcttgcaagatt

SEQ ID NO: 94211 - DNA, 20 bp, Artificial Sequence
  Description of Artificial Sequence: Synthetic oligonucleotide
  Target: ATXN1; (-) strand; PAM type: NRG; PAM sequence: AAG
tgggtcattgctcagcttgc

SEQ ID NO: 94212 - DNA, 20 bp, Artificial Sequence
  Description of Artificial Sequence: Synthetic oligonucleotide
  Target: ATXN1; (-) strand; PAM type: NRG; PAM sequence: CAG
aacttcactgggtcattgct

SEQ ID NO: 94213 - DNA, 20 bp, Artificial Sequence
  Description of Artificial Sequence: Synthetic oligonucleotide
  Target: ATXN1; (-) strand; PAM type: NRG; PAM sequence: GGG
actcttaaaagaacttcact

SEQ ID NO: 94214 - DNA, 20 bp, Artificial Sequence
  Description of Artificial Sequence: Synthetic oligonucleotide
  Target: ATXN1; (-) strand; PAM type: NRG; PAM sequence: TGG
gactcttaaaagaacttcac

SEQ ID NO: 94215 - DNA, 20 bp, Artificial Sequence
  Description of Artificial Sequence: Synthetic oligonucleotide
  Target: ATXN1; (-) strand; PAM type: NRG; PAM sequence: AAG
gatgaacttttgactcttaa

SEQ ID NO: 94216 - DNA, 20 bp, Artificial Sequence
  Description of Artificial Sequence: Synthetic oligonucleotide
  Target: ATXN1; (-) strand; PAM type: NRG; PAM sequence: GAG
tcagcatcaagagtctcagc

SEQ ID NO: 94217 - DNA, 20 bp, Artificial Sequence
  Description of Artificial Sequence: Synthetic oligonucleotide
  Target: ATXN1; (-) strand; PAM type: NRG; PAM sequence: CAG
ttattcagcatcaagagtct

SEQ ID NO: 94218 - DNA, 20 bp, Artificial Sequence
  Description of Artificial Sequence: Synthetic oligonucleotide
  Target: ATXN1; (-) strand; PAM type: NRG; PAM sequence: GAG
caaatgttattcagcatcaa

SEQ ID NO: 94219 - DNA, 20 bp, Artificial Sequence
  Description of Artificial Sequence: Synthetic oligonucleotide
  Target: ATXN1; (-) strand; PAM type: NRG; PAM sequence: AAG
tccaaatgttattcagcatc

SEQ ID NO: 94220 - DNA, 20 bp, Artificial Sequence
  Description of Artificial Sequence: Synthetic oligonucleotide
  Target: ATXN1; (-) strand; PAM type: NRG; PAM sequence: CAG
agttggatccaaatgttatt

SEQ ID NO: 94221 - DNA, 20 bp, Artificial Sequence
  Description of Artificial Sequence: Synthetic oligonucleotide
  Target: ATXN1; (-) strand; PAM type: NRG; PAM sequence: TGG
ttcaggggattggcttaagt

SEQ ID NO: 94222 - DNA, 20 bp, Artificial Sequence
  Description of Artificial Sequence: Synthetic oligonucleotide
  Target: ATXN1; (-) strand; PAM type: NRG; PAM sequence: AAG
ccgtttcaggggattggctt

SEQ ID NO: 94223 - DNA, 20 bp, Artificial Sequence
  Description of Artificial Sequence: Synthetic oligonucleotide
  Target: ATXN1; (-) strand; PAM type: NRG; PAM sequence: TGG
gcttatccgtttcaggggat

SEQ ID NO: 94224 - DNA, 20 bp, Artificial Sequence
  Description of Artificial Sequence: Synthetic oligonucleotide
  Target: ATXN1; (-) strand; PAM type: NRG; PAM sequence: GGG
aatttgcttatccgtttcag

SEQ ID NO: 94225 - DNA, 20 bp, Artificial Sequence
  Description of Artificial Sequence: Synthetic oligonucleotide
  Target: ATXN1; (-) strand; PAM type: NRG; PAM sequence: GGG
caatttgcttatccgtttca

SEQ ID NO: 94226 - DNA, 20 bp, Artificial Sequence
  Description of Artificial Sequence: Synthetic oligonucleotide
  Target: ATXN1; (-) strand; PAM type: NRG; PAM sequence: AGG
gcaatttgcttatccgtttc

SEQ ID NO: 94227 - DNA, 20 bp, Artificial Sequence
  Description of Artificial Sequence: Synthetic oligonucleotide
  Target: ATXN1; (-) strand; PAM type: NRG; PAM sequence: CAG
ggcaatttgcttatccgttt

SEQ ID NO: 94228 - DNA, 20 bp, Artificial Sequence
  Description of Artificial Sequence: Synthetic oligonucleotide
  Target: ATXN1; (-) strand; PAM type: NRG; PAM sequence: TGG
attgaagaaaatgatgacag

SEQ ID NO: 94229 - DNA, 20 bp, Artificial Sequence
  Description of Artificial Sequence: Synthetic oligonucleotide
  Target: ATXN1; (-) strand; PAM type: NRG; PAM sequence: CAG
ttaattgaagaaaatgatga

SEQ ID NO: 94230 - DNA, 20 bp, Artificial Sequence
  Description of Artificial Sequence: Synthetic oligonucleotide
  Target: ATXN1; (-) strand; PAM type: NRG; PAM sequence: AAG
ctttcaataattattaattg

SEQ ID NO: 94231 - DNA, 20 bp, Artificial Sequence
  Description of Artificial Sequence: Synthetic oligonucleotide
  Target: ATXN1; (-) strand; PAM type: NRG; PAM sequence: GAG
actcttactcatatctcctt

SEQ ID NO: 94232 - DNA, 20 bp, Artificial Sequence
  Description of Artificial Sequence: Synthetic oligonucleotide
  Target: ATXN1; (-) strand; PAM type: NRG; PAM sequence: TGG
gctgtcccatgcaggctttg

SEQ ID NO: 94233 - DNA, 20 bp, Artificial Sequence
  Description of Artificial Sequence: Synthetic oligonucleotide
  Target: ATXN1; (-) strand; PAM type: NRG; PAM sequence: AGG
tgacacaggctgtcccatgc

SEQ ID NO: 94234 - DNA, 20 bp, Artificial Sequence
  Description of Artificial Sequence: Synthetic oligonucleotide
  Target: ATXN1; (-) strand; PAM type: NRG; PAM sequence: CAG
ctgacacaggctgtcccatg

SEQ ID NO: 94235 - DNA, 20 bp, Artificial Sequence
  Description of Artificial Sequence: Synthetic oligonucleotide
  Target: ATXN1; (-) strand; PAM type: NRG; PAM sequence: AGG
acatatgagctttctgacac

SEQ ID NO: 94236 - DNA, 20 bp, Artificial Sequence
  Description of Artificial Sequence: Synthetic oligonucleotide
  Target: ATXN1; (-) strand; PAM type: NRG; PAM sequence: CAG
cacatatgagctttctgaca

SEQ ID NO: 94237 - DNA, 20 bp, Artificial Sequence
  Description of Artificial Sequence: Synthetic oligonucleotide
  Target: ATXN1; (-) strand; PAM type: NRG; PAM sequence: GAG
ctgtctgttcagtcacatat

SEQ ID NO: 94238 - DNA, 20 bp, Artificial Sequence
  Description of Artificial Sequence: Synthetic oligonucleotide
  Target: ATXN1; (-) strand; PAM type: NRG; PAM sequence: CAG
ttgatgcctgcctgtctgtt

SEQ ID NO: 94239 - DNA, 20 bp, Artificial Sequence
  Description of Artificial Sequence: Synthetic oligonucleotide
  Target: ATXN1; (-) strand; PAM type: NRG; PAM sequence: GAG
caaggaagggtccttccttg

SEQ ID NO: 94240 - DNA, 20 bp, Artificial Sequence
  Description of Artificial Sequence: Synthetic oligonucleotide
  Target: ATXN1; (-) strand; PAM type: NRG; PAM sequence: TGG
atcaaggaagggtccttcct

SEQ ID NO: 94241 - DNA, 20 bp, Artificial Sequence
  Description of Artificial Sequence: Synthetic oligonucleotide
  Target: ATXN1; (-) strand; PAM type: NRG; PAM sequence: GGG
aggaagtcaggatcaaggaa

SEQ ID NO: 94242 - DNA, 20 bp, Artificial Sequence
  Description of Artificial Sequence: Synthetic oligonucleotide
  Target: ATXN1; (-) strand; PAM type: NRG; PAM sequence: AGG
taggaagtcaggatcaagga

SEQ ID NO: 94243 - DNA, 20 bp, Artificial Sequence
  Description of Artificial Sequence: Synthetic oligonucleotide
  Target: ATXN1; (-) strand; PAM type: NRG; PAM sequence: AAG
ctaggaagtcaggatcaagg

SEQ ID NO: 94244 - DNA, 20 bp, Artificial Sequence
  Description of Artificial Sequence: Synthetic oligonucleotide
  Target: ATXN1; (-) strand; PAM type: NRG; PAM sequence: AGG
agtctaggaagtcaggatca

SEQ ID NO: 94245 - DNA, 20 bp, Artificial Sequence
  Description of Artificial Sequence: Synthetic oligonucleotide
  Target: ATXN1; (-) strand; PAM type: NRG; PAM sequence: AAG
cagtctaggaagtcaggatc

SEQ ID NO: 94246 - DNA, 20 bp, Artificial Sequence
  Description of Artificial Sequence: Synthetic oligonucleotide
  Target: ATXN1; (-) strand; PAM type: NRG; PAM sequence: AGG
gtaacacagtctaggaagtc

SEQ ID NO: 94247 - DNA, 20 bp, Artificial Sequence
  Description of Artificial Sequence: Synthetic oligonucleotide
  Target: ATXN1; (-) strand; PAM type: NRG; PAM sequence: CAG
ggtaacacagtctaggaagt

SEQ ID NO: 94248 - DNA, 20 bp, Artificial Sequence
  Description of Artificial Sequence: Synthetic oligonucleotide
  Target: ATXN1; (-) strand; PAM type: NRG; PAM sequence: AAG
cacaggtaacacagtctagg

SEQ ID NO: 94249 - DNA, 20 bp, Artificial Sequence
  Description of Artificial Sequence: Synthetic oligonucleotide
  Target: ATXN1; (-) strand; PAM type: NRG; PAM sequence: AGG
tgacacaggtaacacagtct

SEQ ID NO: 94250 - DNA, 20 bp, Artificial Sequence
  Description of Artificial Sequence: Synthetic oligonucleotide
  Target: ATXN1; (-) strand; PAM type: NRG; PAM sequence: TAG
atgacacaggtaacacagtc

SEQ ID NO: 94251 - DNA, 20 bp, Artificial Sequence
  Description of Artificial Sequence: Synthetic oligonucleotide
  Target: ATXN1; (-) strand; PAM type: NRG; PAM sequence: CAG
gagccatgacacaggtaaca

SEQ ID NO: 94252 - DNA, 20 bp, Artificial Sequence
  Description of Artificial Sequence: Synthetic oligonucleotide
  Target: ATXN1; (-) strand; PAM type: NRG; PAM sequence: AGG
tatttaaagagccatgacac

SEQ ID NO: 94253 - DNA, 20 bp, Artificial Sequence
  Description of Artificial Sequence: Synthetic oligonucleotide
  Target: ATXN1; (-) strand; PAM type: NRG; PAM sequence: CAG
atatttaaagagccatgaca

SEQ ID NO: 94254 - DNA, 20 bp, Artificial Sequence
  Description of Artificial Sequence: Synthetic oligonucleotide
  Target: ATXN1; (-) strand; PAM type: NRG; PAM sequence: GAG
ggcttggagtaatatttaaa

SEQ ID NO: 94255 - DNA, 20 bp, Artificial Sequence
  Description of Artificial Sequence: Synthetic oligonucleotide
  Target: ATXN1; (-) strand; PAM type: NRG; PAM sequence: AAG
atggcttggagtaatattta

SEQ ID NO: 94256 - DNA, 20 bp, Artificial Sequence
  Description of Artificial Sequence: Synthetic oligonucleotide
  Target: ATXN1; (-) strand; PAM type: NRG; PAM sequence: GAG
ataaggcaaggcatggcttg

SEQ ID NO: 94257 - DNA, 20 bp, Artificial Sequence
  Description of Artificial Sequence: Synthetic oligonucleotide
  Target: ATXN1; (-) strand; PAM type: NRG; PAM sequence: TGG
gcataaggcaaggcatggct

SEQ ID NO: 94258 - DNA, 20 bp, Artificial Sequence
  Description of Artificial Sequence: Synthetic oligonucleotide
  Target: ATXN1; (-) strand; PAM type: NRG; PAM sequence: TGG
cgagtgcataaggcaaggca

SEQ ID NO: 94259 - DNA, 20 bp, Artificial Sequence
  Description of Artificial Sequence: Synthetic oligonucleotide
  Target: ATXN1; (-) strand; PAM type: NRG; PAM sequence: AGG
acagtcgagtgcataaggca

SEQ ID NO: 94260 - DNA, 20 bp, Artificial Sequence
  Description of Artificial Sequence: Synthetic oligonucleotide
  Target: ATXN1; (-) strand; PAM type: NRG; PAM sequence: AAG
tacagtcgagtgcataaggc

SEQ ID NO: 94261 - DNA, 20 bp, Artificial Sequence
  Description of Artificial Sequence: Synthetic oligonucleotide
  Target: ATXN1; (-) strand; PAM type: NRG; PAM sequence: AGG
agcttacagtcgagtgcata

SEQ ID NO: 94262 - DNA, 20 bp, Artificial Sequence
  Description of Artificial Sequence: Synthetic oligonucleotide
  Target: ATXN1; (-) strand; PAM type: NRG; PAM sequence: AAG
aagcttacagtcgagtgcat

SEQ ID NO: 94263 - DNA, 20 bp, Artificial Sequence
  Description of Artificial Sequence: Synthetic oligonucleotide
  Target: ATXN1; (-) strand; PAM type: NRG; PAM sequence: GAG
tccttaagaagcttacagtc

SEQ ID NO: 94264 - DNA, 20 bp, Artificial Sequence
  Description of Artificial Sequence: Synthetic oligonucleotide
  Target: ATXN1; (-) strand; PAM type: NRG; PAM sequence: CAG
ccctgtccttaagaagctta

SEQ ID NO: 94265 - DNA, 20 bp, Artificial Sequence
  Description of Artificial Sequence: Synthetic oligonucleotide
  Target: ATXN1; (-) strand; PAM type: NRG; PAM sequence: AAG
ccttaagccctgtccttaag

SEQ ID NO: 94266 - DNA, 20 bp, Artificial Sequence
  Description of Artificial Sequence: Synthetic oligonucleotide
  Target: ATXN1; (-) strand; PAM type: NRG; PAM sequence: AAG
gttccttaagccctgtcctt

SEQ ID NO: 94267 - DNA, 20 bp, Artificial Sequence
  Description of Artificial Sequence: Synthetic oligonucleotide
  Target: ATXN1; (-) strand; PAM type: NRG; PAM sequence: AAG
cactctcagccctgttcctt

SEQ ID NO: 94268 - DNA, 20 bp, Artificial Sequence
  Description of Artificial Sequence: Synthetic oligonucleotide
  Target: ATXN1; (-) strand; PAM type: NRG; PAM sequence: CAG
tggatcccagtctacactct

SEQ ID NO: 94269 - DNA, 20 bp, Artificial Sequence
  Description of Artificial Sequence: Synthetic oligonucleotide
  Target: ATXN1; (-) strand; PAM type: NRG; PAM sequence: CAG
atagaatcgtgcttggatcc

SEQ ID NO: 94270 - DNA, 20 bp, Artificial Sequence
  Description of Artificial Sequence: Synthetic oligonucleotide
  Target: ATXN1; (-) strand; PAM type: NRG; PAM sequence: TGG
ttaagtgatagaatcgtgct

SEQ ID NO: 94271 - DNA, 20 bp, Artificial Sequence
  Description of Artificial Sequence: Synthetic oligonucleotide
  Target: ATXN1; (-) strand; PAM type: NRG; PAM sequence: TAG
gtttcccagctgttaagtga

SEQ ID NO: 94272 - DNA, 20 bp, Artificial Sequence
  Description of Artificial Sequence: Synthetic oligonucleotide
  Target: ATXN1; (-) strand; PAM type: NRG; PAM sequence: AAG
cccaaggtttcccagctgtt

SEQ ID NO: 94273 - DNA, 20 bp, Artificial Sequence
  Description of Artificial Sequence: Synthetic oligonucleotide
  Target: ATXN1; (-) strand; PAM type: NRG; PAM sequence: CAG
ataatttccccaaggtttcc

SEQ ID NO: 94274 - DNA, 20 bp, Artificial Sequence
  Description of Artificial Sequence: Synthetic oligonucleotide
  Target: ATXN1; (-) strand; PAM type: NRG; PAM sequence: AGG
gagggtgaataatttcccca

SEQ ID NO: 94275 - DNA, 20 bp, Artificial Sequence
  Description of Artificial Sequence: Synthetic oligonucleotide
  Target: ATXN1; (-) strand; PAM type: NRG; PAM sequence: AAG
agagggtgaataatttcccc

SEQ ID NO: 94276 - DNA, 20 bp, Artificial Sequence
  Description of Artificial Sequence: Synthetic oligonucleotide
  Target: ATXN1; (-) strand; PAM type: NRG; PAM sequence: GGG
aggaaactgtggcacagaga

SEQ ID NO: 94277 - DNA, 20 bp, Artificial Sequence
  Description of Artificial Sequence: Synthetic oligonucleotide
  Target: ATXN1; (-) strand; PAM type: NRG; PAM sequence: AGG
gaggaaactgtggcacagag

SEQ ID NO: 94278 - DNA, 20 bp, Artificial Sequence
  Description of Artificial Sequence: Synthetic oligonucleotide
  Target: ATXN1; (-) strand; PAM type: NRG; PAM sequence: GAG
cgaggaaactgtggcacaga

SEQ ID NO: 94279 - DNA, 20 bp, Artificial Sequence
  Description of Artificial Sequence: Synthetic oligonucleotide
  Target: ATXN1; (-) strand; PAM type: NRG; PAM sequence: GAG
ggcgaggaaactgtggcaca

SEQ ID NO: 94280 - DNA, 20 bp, Artificial Sequence
  Description of Artificial Sequence: Synthetic oligonucleotide
  Target: ATXN1; (-) strand; PAM type: NRG; PAM sequence: CAG
caggcgaggaaactgtggca

SEQ ID NO: 94281 - DNA, 20 bp, Artificial Sequence
  Description of Artificial Sequence: Synthetic oligonucleotide
  Target: ATXN1; (-) strand; PAM type: NRG; PAM sequence: TGG
ttgcacaggcgaggaaactg

SEQ ID NO: 94282 - DNA, 20 bp, Artificial Sequence
  Description of Artificial Sequence: Synthetic oligonucleotide
  Target: ATXN1; (-) strand; PAM type: NRG; PAM sequence: AGG
ttttctccattgcacaggcg

SEQ ID NO: 94283 - DNA, 20 bp, Artificial Sequence
  Description of Artificial Sequence: Synthetic oligonucleotide
  Target: ATXN1; (-) strand; PAM type: NRG; PAM sequence: GAG
attttctccattgcacaggc

SEQ ID NO: 94284 - DNA, 20 bp, Artificial Sequence
  Description of Artificial Sequence: Synthetic oligonucleotide
  Target: ATXN1; (-) strand; PAM type: NRG; PAM sequence: AGG
cattattttctccattgcac

SEQ ID NO: 94285 - DNA, 20 bp, Artificial Sequence
  Description of Artificial Sequence: Synthetic oligonucleotide
  Target: ATXN1; (-) strand; PAM type: NRG; PAM sequence: CAG
tcattattttctccattgca

SEQ ID NO: 94286 - DNA, 20 bp, Artificial Sequence
  Description of Artificial Sequence: Synthetic oligonucleotide
  Target: ATXN1; (-) strand; PAM type: NRG; PAM sequence: AGG
tcattacagtcctttgaggt

SEQ ID NO: 94287 - DNA, 20 bp, Artificial Sequence
  Description of Artificial Sequence: Synthetic oligonucleotide
  Target: ATXN1; (-) strand; PAM type: NRG; PAM sequence: TAG
ctcattacagtcctttgagg

SEQ ID NO: 94288 - DNA, 20 bp, Artificial Sequence
  Description of Artificial Sequence: Synthetic oligonucleotide
  Target: ATXN1; (-) strand; PAM type: NRG; PAM sequence: AGG
atcctcattacagtcctttg

SEQ ID NO: 94289 - DNA, 20 bp, Artificial Sequence
  Description of Artificial Sequence: Synthetic oligonucleotide
  Target: ATXN1; (-) strand; PAM type: NRG; PAM sequence: GAG
aatcctcattacagtccttt

SEQ ID NO: 94290 - DNA, 20 bp, Artificial Sequence
  Description of Artificial Sequence: Synthetic oligonucleotide
  Target: ATXN1; (-) strand; PAM type: NRG; PAM sequence: CAG
aacttattgaatcctcatta

SEQ ID NO: 94291 - DNA, 20 bp, Artificial Sequence
  Description of Artificial Sequence: Synthetic oligonucleotide
  Target: ATXN1; (-) strand; PAM type: NRG; PAM sequence: TAG
gggaatatggagatgatcaa

SEQ ID NO: 94292 - DNA, 20 bp, Artificial Sequence
  Description of Artificial Sequence: Synthetic oligonucleotide
  Target: ATXN1; (-) strand; PAM type: NRG; PAM sequence: GAG
aaggccctctagggaatatg

SEQ ID NO: 94293 - DNA, 20 bp, Artificial Sequence
  Description of Artificial Sequence: Synthetic oligonucleotide
  Target: ATXN1; (-) strand; PAM type: NRG; PAM sequence: TGG
acaaggccctctagggaata

SEQ ID NO: 94294 - DNA, 20 bp, Artificial Sequence
  Description of Artificial Sequence: Synthetic oligonucleotide
  Target: ATXN1; (-) strand; PAM type: NRG; PAM sequence: GGG
tatgccaacaaggccctcta

SEQ ID NO: 94295 - DNA, 20 bp, Artificial Sequence
  Description of Artificial Sequence: Synthetic oligonucleotide
  Target: ATXN1; (-) strand; PAM type: NRG; PAM sequence: AGG
ttatgccaacaaggccctct

SEQ ID NO: 94296 - DNA, 20 bp, Artificial Sequence
  Description of Artificial Sequence: Synthetic oligonucleotide
  Target: ATXN1; (-) strand; PAM type: NRG; PAM sequence: TAG
attatgccaacaaggccctc

SEQ ID NO: 94297 - DNA, 20 bp, Artificial Sequence
  Description of Artificial Sequence: Synthetic oligonucleotide
  Target: ATXN1; (-) strand; PAM type: NRG; PAM sequence: AGG
tgagacgcattatgccaaca

SEQ ID NO: 94298 - DNA, 20 bp, Artificial Sequence
  Description of Artificial Sequence: Synthetic oligonucleotide
  Target: ATXN1; (-) strand; PAM type: NRG; PAM sequence: AAG
atgagacgcattatgccaac

SEQ ID NO: 94299 - DNA, 20 bp, Artificial Sequence
  Description of Artificial Sequence: Synthetic oligonucleotide
  Target: ATXN1; (-) strand; PAM type: NRG; PAM sequence: GAG
ttaatgagcatctaatgtat

SEQ ID NO: 94300 - DNA, 20 bp, Artificial Sequence
  Description of Artificial Sequence: Synthetic oligonucleotide
  Target: ATXN1; (-) strand; PAM type: NRG; PAM sequence: GAG
cttgtctgcaattatttaat

SEQ ID NO: 94301 - DNA, 20 bp, Artificial Sequence
  Description of Artificial Sequence: Synthetic oligonucleotide
  Target: ATXN1; (-) strand; PAM type: NRG; PAM sequence: CAG
ggagcaaacaactccagggg

SEQ ID NO: 94302 - DNA, 20 bp, Artificial Sequence
  Description of Artificial Sequence: Synthetic oligonucleotide
  Target: ATXN1; (-) strand; PAM type: NRG; PAM sequence: GGG
gatggagcaaacaactccag

SEQ ID NO: 94303 - DNA, 20 bp, Artificial Sequence
  Description of Artificial Sequence: Synthetic oligonucleotide
  Target: ATXN1; (-) strand; PAM type: NRG; PAM sequence: GGG
ggatggagcaaacaactcca

SEQ ID NO: 94304 - DNA, 20 bp, Artificial Sequence
  Description of Artificial Sequence: Synthetic oligonucleotide
  Target: ATXN1; (-) strand; PAM type: NRG; PAM sequence: AGG
gggatggagcaaacaactcc

SEQ ID NO: 94305 - DNA, 20 bp, Artificial Sequence
  Description of Artificial Sequence: Synthetic oligonucleotide
  Target: ATXN1; (-) strand; PAM type: NRG; PAM sequence: CAG
agggatggagcaaacaactc

SEQ ID NO: 94306 - DNA, 20 bp, Artificial Sequence
  Description of Artificial Sequence: Synthetic oligonucleotide
  Target: ATXN1; (-) strand; PAM type: NRG; PAM sequence: GAG
agacaggaacaagagggatg

SEQ ID NO: 94307 - DNA, 20 bp, Artificial Sequence
  Description of Artificial Sequence: Synthetic oligonucleotide
  Target: ATXN1; (-) strand; PAM type: NRG; PAM sequence: TGG
taagacaggaacaagaggga

SEQ ID NO: 94308 - DNA, 20 bp, Artificial Sequence
  Description of Artificial Sequence: Synthetic oligonucleotide
  Target: ATXN1; (-) strand; PAM type: NRG; PAM sequence: GGG
aggttaagacaggaacaaga

SEQ ID NO: 94309 - DNA, 20 bp, Artificial Sequence
  Description of Artificial Sequence: Synthetic oligonucleotide
  Target: ATXN1; (-) strand; PAM type: NRG; PAM sequence: AGG
aaggttaagacaggaacaag

SEQ ID NO: 94310 - DNA, 20 bp, Artificial Sequence
  Description of Artificial Sequence: Synthetic oligonucleotide
  Target: ATXN1; (-) strand; PAM type: NRG; PAM sequence: GAG
gaaggttaagacaggaacaa

SEQ ID NO: 94311 - DNA, 20 bp, Artificial Sequence
  Description of Artificial Sequence: Synthetic oligonucleotide
  Target: ATXN1; (-) strand; PAM type: NRG; PAM sequence: AAG
aagaaggttaagacaggaac

SEQ ID NO: 94312 - DNA, 20 bp, Artificial Sequence
  Description of Artificial Sequence: Synthetic oligonucleotide
  Target: ATXN1; (-) strand; PAM type: NRG; PAM sequence: AGG
aaagacaagaaggttaagac

SEQ ID NO: 94313 - DNA, 20 bp, Artificial Sequence
  Description of Artificial Sequence: Synthetic oligonucleotide
  Target: ATXN1; (-) strand; PAM type: NRG; PAM sequence: CAG
caaagacaagaaggttaaga

SEQ ID NO: 94314 - DNA, 20 bp, Artificial Sequence
  Description of Artificial Sequence: Synthetic oligonucleotide
  Target: ATXN1; (-) strand; PAM type: NRG; PAM sequence: AAG
tcatcaaagacaagaaggtt

SEQ ID NO: 94315 - DNA, 20 bp, Artificial Sequence
  Description of Artificial Sequence: Synthetic oligonucleotide
  Target: ATXN1; (-) strand; PAM type: NRG; PAM sequence: AGG
aactttcatcaaagacaaga

SEQ ID NO: 94316 - DNA, 20 bp, Artificial Sequence
  Description of Artificial Sequence: Synthetic oligonucleotide
  Target: ATXN1; (-) strand; PAM type: NRG; PAM sequence: AAG
taactttcatcaaagacaag

SEQ ID NO: 94317 - DNA, 20 bp, Artificial Sequence
  Description of Artificial Sequence: Synthetic oligonucleotide
  Target: ATXN1; (-) strand; PAM type: NRG; PAM sequence: AAG
atttaactttcatcaaagac

SEQ ID NO: 94318 - DNA, 20 bp, Artificial Sequence
  Description of Artificial Sequence: Synthetic oligonucleotide
  Target: ATXN1; (-) strand; PAM type: NRG; PAM sequence: AAG
gacttatttaactttcatca

SEQ ID NO: 94319 - DNA, 20 bp, Artificial Sequence
  Description of Artificial Sequence: Synthetic oligonucleotide
  Target: ATXN1; (-) strand; PAM type: NRG; PAM sequence: CAG
aaaagggctcagaataaaag

SEQ ID NO: 94320 - DNA, 20 bp, Artificial Sequence
  Description of Artificial Sequence: Synthetic oligonucleotide
  Target: ATXN1; (-) strand; PAM type: NRG; PAM sequence: AAG
cccaaaagggctcagaataa

SEQ ID NO: 94321 - DNA, 20 bp, Artificial Sequence
  Description of Artificial Sequence: Synthetic oligonucleotide
  Target: ATXN1; (-) strand; PAM type: NRG; PAM sequence: CAG
ctgtgtagcccaaaagggct

SEQ ID NO: 94322 - DNA, 20 bp, Artificial Sequence
  Description of Artificial Sequence: Synthetic oligonucleotide
  Target: ATXN1; (-) strand; PAM type: NRG; PAM sequence: GGG
gctctctgtgtagcccaaaa

SEQ ID NO: 94323 - DNA, 20 bp, Artificial Sequence
  Description of Artificial Sequence: Synthetic oligonucleotide
  Target: ATXN1; (-) strand; PAM type: NRG; PAM sequence: AGG
ggctctctgtgtagcccaaa

SEQ ID NO: 94324 - DNA, 20 bp, Artificial Sequence
  Description of Artificial Sequence: Synthetic oligonucleotide
  Target: ATXN1; (-) strand; PAM type: NRG; PAM sequence: AAG
gggctctctgtgtagcccaa

SEQ ID NO: 94325 - DNA, 20 bp, Artificial Sequence
  Description of Artificial Sequence: Synthetic oligonucleotide
  Target: ATXN1; (-) strand; PAM type: NRG; PAM sequence: TAG
gttaggatgggctctctgtg

SEQ ID NO: 94326 - DNA, 20 bp, Artificial Sequence
  Description of Artificial Sequence: Synthetic oligonucleotide
  Target: ATXN1; (-) strand; PAM type: NRG; PAM sequence: GGG
ggtgctgagttagttaggat

SEQ ID NO: 94327 - DNA, 20 bp, Artificial Sequence
  Description of Artificial Sequence: Synthetic oligonucleotide
  Target: ATXN1; (-) strand; PAM type: NRG; PAM sequence: TGG
tggtgctgagttagttagga

SEQ ID NO: 94328 - DNA, 20 bp, Artificial Sequence
  Description of Artificial Sequence: Synthetic oligonucleotide
  Target: ATXN1; (-) strand; PAM type: NRG; PAM sequence: AGG
tttttggtgctgagttagtt

SEQ ID NO: 94329 - DNA, 20 bp, Artificial Sequence
  Description of Artificial Sequence: Synthetic oligonucleotide
  Target: ATXN1; (-) strand; PAM type: NRG; PAM sequence: TAG
ttttttggtgctgagttagt

SEQ ID NO: 94330 - DNA, 20 bp, Artificial Sequence
  Description of Artificial Sequence: Synthetic oligonucleotide
  Target: ATXN1; (-) strand; PAM type: NRG; PAM sequence: TAG
ttttttttttggtgctgagt

SEQ ID NO: 94331 - DNA, 20 bp, Artificial Sequence
  Description of Artificial Sequence: Synthetic oligonucleotide
  Target: ATXN1; (-) strand; PAM type: NRG; PAM sequence: GAG
tggtttttttttttggtgct

SEQ ID NO: 94332 - DNA, 20 bp, Artificial Sequence
  Description of Artificial Sequence: Synthetic oligonucleotide
  Target: ATXN1; (-) strand; PAM type: NRG; PAM sequence: TGG
taagttgtggtttttttttt

SEQ ID NO: 94333 - DNA, 20 bp, Artificial Sequence
  Description of Artificial Sequence: Synthetic oligonucleotide
  Target: ATXN1; (-) strand; PAM type: NRG; PAM sequence: TGG
aaaatttgaggattaagttg

SEQ ID NO: 94334 - DNA, 20 bp, Artificial Sequence
  Description of Artificial Sequence: Synthetic oligonucleotide
  Target: ATXN1; (-) strand; PAM type: NRG; PAM sequence: AAG
tgagagaaaatttgaggatt

SEQ ID NO: 94335 - DNA, 20 bp, Artificial Sequence
  Description of Artificial Sequence: Synthetic oligonucleotide
  Target: ATXN1; (-) strand; PAM type: NRG; PAM sequence: AGG
atgtaatgagagaaaatttg

SEQ ID NO: 94336 - DNA, 20 bp, Artificial Sequence
  Description of Artificial Sequence: Synthetic oligonucleotide
  Target: ATXN1; (-) strand; PAM type: NRG; PAM sequence: GAG
aatgtaatgagagaaaattt

SEQ ID NO: 94337 - DNA, 20 bp, Artificial Sequence
  Description of Artificial Sequence: Synthetic oligonucleotide
  Target: ATXN1; (-) strand; PAM type: NRG; PAM sequence: GAG
agtctgatttaatgtaatga

SEQ ID NO: 94338 - DNA, 20 bp, Artificial Sequence
  Description of Artificial Sequence: Synthetic oligonucleotide
  Target: ATXN1; (-) strand; PAM type: NRG; PAM sequence: GAG
gcagtctgatttaatgtaat

SEQ ID NO: 94339 - DNA, 20 bp, Artificial Sequence
  Description of Artificial Sequence: Synthetic oligonucleotide
  Target: ATXN1; (-) strand; PAM type: NRG; PAM sequence: CAG
gttacgatgatgttagtgag

SEQ ID NO: 94340 - DNA, 20 bp, Artificial Sequence
  Description of Artificial Sequence: Synthetic oligonucleotide
  Target: ATXN1; (-) strand; PAM type: NRG; PAM sequence: GAG
gatgttacgatgatgttagt

SEQ ID NO: 94341 - DNA, 20 bp, Artificial Sequence
  Description of Artificial Sequence: Synthetic oligonucleotide
  Target: ATXN1; (-) strand; PAM type: NRG; PAM sequence: TAG
agatgatgttacgatgatgt

SEQ ID NO: 94342 - DNA, 20 bp, Artificial Sequence
  Description of Artificial Sequence: Synthetic oligonucleotide
  Target: ATXN1; (-) strand; PAM type: NRG; PAM sequence: GAG
taaagtgaaagagaaggctg

SEQ ID NO: 94343 - DNA, 20 bp, Artificial Sequence
  Description of Artificial Sequence: Synthetic oligonucleotide
  Target: ATXN1; (-) strand; PAM type: NRG; PAM sequence: TGG
tgtaaagtgaaagagaaggc

SEQ ID NO: 94344 - DNA, 20 bp, Artificial Sequence
  Description of Artificial Sequence: Synthetic oligonucleotide
  Target: ATXN1; (-) strand; PAM type: NRG; PAM sequence: AGG
ctgatgtaaagtgaaagaga

SEQ ID NO: 94345 - DNA, 20 bp, Artificial Sequence
  Description of Artificial Sequence: Synthetic oligonucleotide
  Target: ATXN1; (-) strand; PAM type: NRG; PAM sequence: AAG
cctgatgtaaagtgaaagag

SEQ ID NO: 94346 - DNA, 20 bp, Artificial Sequence
  Description of Artificial Sequence: Synthetic oligonucleotide
  Target: ATXN1; (-) strand; PAM type: NRG; PAM sequence: GAG
cttcctgatgtaaagtgaaa

SEQ ID NO: 94347 - DNA, 20 bp, Artificial Sequence
  Description of Artificial Sequence: Synthetic oligonucleotide
  Target: ATXN1; (-) strand; PAM type: NRG; PAM sequence: AAG
gacttcctgatgtaaagtga

SEQ ID NO: 94348 - DNA, 20 bp, Artificial Sequence
  Description of Artificial Sequence: Synthetic oligonucleotide
  Target: ATXN1; (-) strand; PAM type: NRG; PAM sequence: AAG
gtctaagacttcctgatgta

SEQ ID NO: 94349 - DNA, 20 bp, Artificial Sequence
  Description of Artificial Sequence: Synthetic oligonucleotide
  Target: ATXN1; (-) strand; PAM type: NRG; PAM sequence: AAG
tctggggagaaagttagtct

SEQ ID NO: 94350 - DNA, 20 bp, Artificial Sequence
  Description of Artificial Sequence: Synthetic oligonucleotide
  Target: ATXN1; (-) strand; PAM type: NRG; PAM sequence: TAG
cttgggtctggggagaaagt

SEQ ID NO: 94351 - DNA, 20 bp, Artificial Sequence
  Description of Artificial Sequence: Synthetic oligonucleotide
  Target: ATXN1; (-) strand; PAM type: NRG; PAM sequence: AAG
gaatcttgggtctggggaga

SEQ ID NO: 94352 - DNA, 20 bp, Artificial Sequence
  Description of Artificial Sequence: Synthetic oligonucleotide
  Target: ATXN1; (-) strand; PAM type: NRG; PAM sequence: GAG
tggtgaatcttgggtctggg

SEQ ID NO: 94353 - DNA, 20 bp, Artificial Sequence
  Description of Artificial Sequence: Synthetic oligonucleotide
  Target: ATXN1; (-) strand; PAM type: NRG; PAM sequence: GGG
attggtgaatcttgggtctg

SEQ ID NO: 94354 - DNA, 20 bp, Artificial Sequence
  Description of Artificial Sequence: Synthetic oligonucleotide
  Target: ATXN1; (-) strand; PAM type: NRG; PAM sequence: GGG
aattggtgaatcttgggtct

SEQ ID NO: 94355 - DNA, 20 bp, Artificial Sequence
  Description of Artificial Sequence: Synthetic oligonucleotide
  Target: ATXN1; (-) strand; PAM type: NRG; PAM sequence: TGG
gaattggtgaatcttgggtc

SEQ ID NO: 94356 - DNA, 20 bp, Artificial Sequence
  Description of Artificial Sequence: Synthetic oligonucleotide
  Target: ATXN1; (-) strand; PAM type: NRG; PAM sequence: GGG
atatagaattggtgaatctt

SEQ ID NO: 94357 - DNA, 20 bp, Artificial Sequence
  Description of Artificial Sequence: Synthetic oligonucleotide
  Target: ATXN1; (-) strand; PAM type: NRG; PAM sequence: TGG
gatatagaattggtgaatct

SEQ ID NO: 94358 - DNA, 20 bp, Artificial Sequence
  Description of Artificial Sequence: Synthetic oligonucleotide
  Target: ATXN1; (-) strand; PAM type: NRG; PAM sequence: TGG
aaaataaagagatatagaat

SEQ ID NO: 94359 - DNA, 20 bp, Artificial Sequence
  Description of Artificial Sequence: Synthetic oligonucleotide
  Target: ATXN1; (-) strand; PAM type: NRG; PAM sequence: TAG
ttatagaaaataaagagata

SEQ ID NO: 94360 - DNA, 20 bp, Artificial Sequence
  Description of Artificial Sequence: Synthetic oligonucleotide
  Target: ATXN1; (-) strand; PAM type: NRG; PAM sequence: GAG
tatactttatagaaaataaa

SEQ ID NO: 94361 - DNA, 20 bp, Artificial Sequence
  Description of Artificial Sequence: Synthetic oligonucleotide
  Target: ATXN1; (-) strand; PAM type: NRG; PAM sequence: AAG
tttatactttatagaaaata

SEQ ID NO: 94362 - DNA, 20 bp, Artificial Sequence
  Description of Artificial Sequence: Synthetic oligonucleotide
  Target: ATXN1; (-) strand; PAM type: NRG; PAM sequence: TAG
ggcttcccatttatacttta

SEQ ID NO: 94363 - DNA, 20 bp, Artificial Sequence
  Description of Artificial Sequence: Synthetic oligonucleotide
  Target: ATXN1; (-) strand; PAM type: NRG; PAM sequence: TGG
acacagctctttgaacaatt

SEQ ID NO: 94364 - DNA, 20 bp, Artificial Sequence
  Description of Artificial Sequence: Synthetic oligonucleotide
  Target: ATXN1; (-) strand; PAM type: NRG; PAM sequence: CAG
atatacctagctactagaca

SEQ ID NO: 94365 - DNA, 20 bp, Artificial Sequence
  Description of Artificial Sequence: Synthetic oligonucleotide
  Target: ATXN1; (-) strand; PAM type: NRG; PAM sequence: TAG
tactgtatatacctagctac

SEQ ID NO: 94366 - DNA, 20 bp, Artificial Sequence
  Description of Artificial Sequence: Synthetic oligonucleotide
  Target: ATXN1; (-) strand; PAM type: NRG; PAM sequence: TAG
gcgtgtatactgtatatacc

SEQ ID NO: 94367 - DNA, 20 bp, Artificial Sequence
  Description of Artificial Sequence: Synthetic oligonucleotide
  Target: ATXN1; (-) strand; PAM type: NRG; PAM sequence: GAG
ctgcagactctttaaaatgt

SEQ ID NO: 94368 - DNA, 20 bp, Artificial Sequence
  Description of Artificial Sequence: Synthetic oligonucleotide
  Target: ATXN1; (-) strand; PAM type: NRG; PAM sequence: CAG
gattccctggaggctttctg

SEQ ID NO: 94369 - DNA, 20 bp, Artificial Sequence
  Description of Artificial Sequence: Synthetic oligonucleotide
  Target: ATXN1; (-) strand; PAM type: NRG; PAM sequence: AGG
aactttagaggattccctgg

SEQ ID NO: 94370 - DNA, 20 bp, Artificial Sequence
  Description of Artificial Sequence: Synthetic oligonucleotide
  Target: ATXN1; (-) strand; PAM type: NRG; PAM sequence: GAG
taactttagaggattccctg

SEQ ID NO: 94371 - DNA, 20 bp, Artificial Sequence
  Description of Artificial Sequence: Synthetic oligonucleotide
  Target: ATXN1; (-) strand; PAM type: NRG; PAM sequence: TGG
tgtaactttagaggattccc

SEQ ID NO: 94372 - DNA, 20 bp, Artificial Sequence
  Description of Artificial Sequence: Synthetic oligonucleotide
  Target: ATXN1; (-) strand; PAM type: NRG; PAM sequence: AGG
ggtgtgttttgtaactttag

SEQ ID NO: 94373 - DNA, 20 bp, Artificial Sequence
  Description of Artificial Sequence: Synthetic oligonucleotide
  Target: ATXN1; (-) strand; PAM type: NRG; PAM sequence: GAG
gggtgtgttttgtaacttta

SEQ ID NO: 94374 - DNA, 20 bp, Artificial Sequence
  Description of Artificial Sequence: Synthetic oligonucleotide
  Target: ATXN1; (-) strand; PAM type: NRG; PAM sequence: TAG
ttgggtgtgttttgtaactt

SEQ ID NO: 94375 - DNA, 20 bp, Artificial Sequence
  Description of Artificial Sequence: Synthetic oligonucleotide
  Target: ATXN1; (-) strand; PAM type: NRG; PAM sequence: GGG
ttgataaaccacattaattt

SEQ ID NO: 94376 - DNA, 20 bp, Artificial Sequence
  Description of Artificial Sequence: Synthetic oligonucleotide
  Target: ATXN1; (-) strand; PAM type: NRG; PAM sequence: TGG
tttgataaaccacattaatt

SEQ ID NO: 94377 - DNA, 20 bp, Artificial Sequence
  Description of Artificial Sequence: Synthetic oligonucleotide
  Target: ATXN1; (-) strand; PAM type: NRG; PAM sequence: TGG
ctgtagcaattgttcatttg

SEQ ID NO: 94378 - DNA, 20 bp, Artificial Sequence
  Description of Artificial Sequence: Synthetic oligonucleotide
  Target: ATXN1; (-) strand; PAM type: NRG; PAM sequence: TAG
gtgccatctacttgactctg

SEQ ID NO: 94379 - DNA, 20 bp, Artificial Sequence
  Description of Artificial Sequence: Synthetic oligonucleotide
  Target: ATXN1; (-) strand; PAM type: NRG; PAM sequence: CAG
gtacgttttaacaacaattc

SEQ ID NO: 94380 - DNA, 20 bp, Artificial Sequence
  Description of Artificial Sequence: Synthetic oligonucleotide
  Target: ATXN1; (-) strand; PAM type: NRG; PAM sequence: AAG
ttttattaagattttcagtg

SEQ ID NO: 94381 - DNA, 20 bp, Artificial Sequence
  Description of Artificial Sequence: Synthetic oligonucleotide
  Target: ATXN1; (-) strand; PAM type: NRG; PAM sequence: CAG
aacagttttattaagatttt

SEQ ID NO: 94382 - DNA, 20 bp, Artificial Sequence
  Description of Artificial Sequence: Synthetic oligonucleotide
  Target: ATXN1; (-) strand; PAM type: NRG; PAM sequence: AAG
ttcctctaaacagttttatt

SEQ ID NO: 94383 - DNA, 20 bp, Artificial Sequence
  Description of Artificial Sequence: Synthetic oligonucleotide
  Target: ATXN1; (-) strand; PAM type: NRG; PAM sequence: CAG
tccttctattttcctctaaa

SEQ ID NO: 94384 - DNA, 20 bp, Artificial Sequence
  Description of Artificial Sequence: Synthetic oligonucleotide
  Target: ATXN1; (-) strand; PAM type: NRG; PAM sequence: CGG
cgtttgaaattcagcgtatg

SEQ ID NO: 94385 - DNA, 20 bp, Artificial Sequence
  Description of Artificial Sequence: Synthetic oligonucleotide
  Target: ATXN1; (-) strand; PAM type: NRG; PAM sequence: CAG
tgaatgctgcgtttgaaatt

SEQ ID NO: 94386 - DNA, 20 bp, Artificial Sequence
  Description of Artificial Sequence: Synthetic oligonucleotide
  Target: ATXN1; (-) strand; PAM type: NRG; PAM sequence: TAG
ataggaacttgagctaattt

SEQ ID NO: 94387 - DNA, 20 bp, Artificial Sequence
  Description of Artificial Sequence: Synthetic oligonucleotide
  Target: ATXN1; (-) strand; PAM type: NRG; PAM sequence: GAG
ctttaaaaaaataggaactt

SEQ ID NO: 94388 - DNA, 20 bp, Artificial Sequence
  Description of Artificial Sequence: Synthetic oligonucleotide
  Target: ATXN1; (-) strand; PAM type: NRG; PAM sequence: AGG
tttaagacctttaaaaaaat

SEQ ID NO: 94389 - DNA, 20 bp, Artificial Sequence
  Description of Artificial Sequence: Synthetic oligonucleotide
  Target: ATXN1; (-) strand; PAM type: NRG; PAM sequence: TAG
ctttaagacctttaaaaaaa

SEQ ID NO: 94390 - DNA, 20 bp, Artificial Sequence
  Description of Artificial Sequence: Synthetic oligonucleotide
  Target: ATXN1; (-) strand; PAM type: NRG; PAM sequence: AAG
gtcaaaacctctcttccttt

SEQ ID NO: 94391 - DNA, 20 bp, Artificial Sequence
  Description of Artificial Sequence: Synthetic oligonucleotide
  Target: ATXN1; (-) strand; PAM type: NRG; PAM sequence: CAG
ggaaactcagtgctgaacta

SEQ ID NO: 94392 - DNA, 20 bp, Artificial Sequence
  Description of Artificial Sequence: Synthetic oligonucleotide
  Target: ATXN1; (-) strand; PAM type: NRG; PAM sequence: CAG
gctcaggcaccttggaaact

SEQ ID NO: 94393 - DNA, 20 bp, Artificial Sequence
  Description of Artificial Sequence: Synthetic oligonucleotide
  Target: ATXN1; (-) strand; PAM type: NRG; PAM sequence: TGG
cttctgcagctcaggcacct

SEQ ID NO: 94394 - DNA, 20 bp, Artificial Sequence
  Description of Artificial Sequence: Synthetic oligonucleotide
  Target: ATXN1; (-) strand; PAM type: NRG; PAM sequence: AGG
taaggactcttctgcagctc

SEQ ID NO: 94395 - DNA, 20 bp, Artificial Sequence
  Description of Artificial Sequence: Synthetic oligonucleotide
  Target: ATXN1; (-) strand; PAM type: NRG; PAM sequence: CAG
ataaggactcttctgcagct

SEQ ID NO: 94396 - DNA, 20 bp, Artificial Sequence
  Description of Artificial Sequence: Synthetic oligonucleotide
  Target: ATXN1; (-) strand; PAM type: NRG; PAM sequence: CAG
gggccataaggactcttctg

SEQ ID NO: 94397 - DNA, 20 bp, Artificial Sequence
  Description of Artificial Sequence: Synthetic oligonucleotide
  Target: ATXN1; (-) strand; PAM type: NRG; PAM sequence: AGG
tgatgtatgcgtgggccata

SEQ ID NO: 94398 - DNA, 20 bp, Artificial Sequence
  Description of Artificial Sequence: Synthetic oligonucleotide
  Target: ATXN1; (-) strand; PAM type: NRG; PAM sequence: AAG
gtgatgtatgcgtgggccat

SEQ ID NO: 94399 - DNA, 20 bp, Artificial Sequence
  Description of Artificial Sequence: Synthetic oligonucleotide
  Target: ATXN1; (-) strand; PAM type: NRG; PAM sequence: GGG
gagttgggtgatgtatgcgt

SEQ ID NO: 94400 - DNA, 20 bp, Artificial Sequence
  Description of Artificial Sequence: Synthetic oligonucleotide
  Target: ATXN1; (-) strand; PAM type: NRG; PAM sequence: TGG
ggagttgggtgatgtatgcg

SEQ ID NO: 94401 - DNA, 20 bp, Artificial Sequence
  Description of Artificial Sequence: Synthetic oligonucleotide
  Target: ATXN1; (-) strand; PAM type: NRG; PAM sequence: GGG
gctgggtggctggaggagtt

SEQ ID NO: 94402 - DNA, 20 bp, Artificial Sequence
  Description of Artificial Sequence: Synthetic oligonucleotide
  Target: ATXN1; (-) strand; PAM type: NRG; PAM sequence: TGG
ggctgggtggctggaggagt

SEQ ID NO: 94403 - DNA, 20 bp, Artificial Sequence
  Description of Artificial Sequence: Synthetic oligonucleotide
  Target: ATXN1; (-) strand; PAM type: NRG; PAM sequence: GAG
aggaggctgggtggctggag

SEQ ID NO: 94404 - DNA, 20 bp, Artificial Sequence
  Description of Artificial Sequence: Synthetic oligonucleotide
  Target: ATXN1; (-) strand; PAM type: NRG; PAM sequence: AGG
gaaggaggctgggtggctgg

SEQ ID NO: 94405 - DNA, 20 bp, Artificial Sequence
  Description of Artificial Sequence: Synthetic oligonucleotide
  Target: ATXN1; (-) strand; PAM type: NRG; PAM sequence: GAG
tgaaggaggctgggtggctg

SEQ ID NO: 94406 - DNA, 20 bp, Artificial Sequence
  Description of Artificial Sequence: Synthetic oligonucleotide
  Target: ATXN1; (-) strand; PAM type: NRG; PAM sequence: TGG
ggtgaaggaggctgggtggc

SEQ ID NO: 94407 - DNA, 20 bp, Artificial Sequence
  Description of Artificial Sequence: Synthetic oligonucleotide
  Target: ATXN1; (-) strand; PAM type: NRG; PAM sequence: TGG
ctggggtgaaggaggctggg

SEQ ID NO: 94408 - DNA, 20 bp, Artificial Sequence
  Description of Artificial Sequence: Synthetic oligonucleotide
  Target: ATXN1; (-) strand; PAM type: NRG; PAM sequence: GGG
gatctggggtgaaggaggct

SEQ ID NO: 94409 - DNA, 20 bp, Artificial Sequence
  Description of Artificial Sequence: Synthetic oligonucleotide
  Target: ATXN1; (-) strand; PAM type: NRG; PAM sequence: TGG
tgatctggggtgaaggaggc

SEQ ID NO: 94410 - DNA, 20 bp, Artificial Sequence
  Description of Artificial Sequence: Synthetic oligonucleotide
  Target: ATXN1; (-) strand; PAM type: NRG; PAM sequence: AGG
ttcatgatctggggtgaagg

SEQ ID NO: 94411 - DNA, 20 bp, Artificial Sequence
  Description of Artificial Sequence: Synthetic oligonucleotide
  Target: ATXN1; (-) strand; PAM type: NRG; PAM sequence: GAG
tttcatgatctggggtgaag

SEQ ID NO: 94412 - DNA, 20 bp, Artificial Sequence
  Description of Artificial Sequence: Synthetic oligonucleotide
  Target: ATXN1; (-) strand; PAM type: NRG; PAM sequence: AGG
cttttcatgatctggggtga

SEQ ID NO: 94413 - DNA, 20 bp, Artificial Sequence
  Description of Artificial Sequence: Synthetic oligonucleotide
  Target: ATXN1; (-) strand; PAM type: NRG; PAM sequence: AAG
tcttttcatgatctggggtg

SEQ ID NO: 94414 - DNA, 20 bp, Artificial Sequence
  Description of Artificial Sequence: Synthetic oligonucleotide
  Target: ATXN1; (-) strand; PAM type: NRG; PAM sequence: GGG
tgccttcttttcatgatctg

SEQ ID NO: 94415 - DNA, 20 bp, Artificial Sequence
  Description of Artificial Sequence: Synthetic oligonucleotide
  Target: ATXN1; (-) strand; PAM type: NRG; PAM sequence: GGG
ctgccttcttttcatgatct

SEQ ID NO: 94416 - DNA, 20 bp, Artificial Sequence
  Description of Artificial Sequence: Synthetic oligonucleotide
  Target: ATXN1; (-) strand; PAM type: NRG; PAM sequence: TGG
tctgccttcttttcatgatc

SEQ ID NO: 94417 - DNA, 20 bp, Artificial Sequence
  Description of Artificial Sequence: Synthetic oligonucleotide
  Target: ATXN1; (-) strand; PAM type: NRG; PAM sequence: TGG
gcttcaacattgatgtggca

SEQ ID NO: 94418 - DNA, 20 bp, Artificial Sequence
  Description of Artificial Sequence: Synthetic oligonucleotide
  Target: ATXN1; (-) strand; PAM type: NRG; PAM sequence: TGG
gagtagcttcaacattgatg

SEQ ID NO: 94419 - DNA, 20 bp, Artificial Sequence
  Description of Artificial Sequence: Synthetic oligonucleotide
  Target: ATXN1; (-) strand; PAM type: NRG; PAM sequence: TAG
aggtaagaggcagcggagag

SEQ ID NO: 94420 - DNA, 20 bp, Artificial Sequence
  Description of Artificial Sequence: Synthetic oligonucleotide
  Target: ATXN1; (-) strand; PAM type: NRG; PAM sequence: GAG
agaaggtaagaggcagcgga

SEQ ID NO: 94421 - DNA, 20 bp, Artificial Sequence
  Description of Artificial Sequence: Synthetic oligonucleotide
  Target: ATXN1; (-) strand; PAM type: NRG; PAM sequence: GAG
agagaaggtaagaggcagcg

SEQ ID NO: 94422 - DNA, 20 bp, Artificial Sequence
  Description of Artificial Sequence: Synthetic oligonucleotide
  Target: ATXN1; (-) strand; PAM type: NRG; PAM sequence: CGG
agagagaaggtaagaggcag

SEQ ID NO: 94423 - DNA, 20 bp, Artificial Sequence
  Description of Artificial Sequence: Synthetic oligonucleotide
  Target: ATXN1; (-) strand; PAM type: NRG; PAM sequence: CAG
tgtagagagaaggtaagagg

SEQ ID NO: 94424 - DNA, 20 bp, Artificial Sequence
  Description of Artificial Sequence: Synthetic oligonucleotide
  Target: ATXN1; (-) strand; PAM type: NRG; PAM sequence: AGG
atgtgtagagagaaggtaag

SEQ ID NO: 94425 - DNA, 20 bp, Artificial Sequence
  Description of Artificial Sequence: Synthetic oligonucleotide
  Target: ATXN1; (-) strand; PAM type: NRG; PAM sequence: GAG
aatgtgtagagagaaggtaa

SEQ ID NO: 94426 - DNA, 20 bp, Artificial Sequence
  Description of Artificial Sequence: Synthetic oligonucleotide
  Target: ATXN1; (-) strand; PAM type: NRG; PAM sequence: AAG
agaatgtgtagagagaaggt

SEQ ID NO: 94427 - DNA, 20 bp, Artificial Sequence
  Description of Artificial Sequence: Synthetic oligonucleotide
  Target: ATXN1; (-) strand; PAM type: NRG; PAM sequence: AGG
gtgtagaatgtgtagagaga

SEQ ID NO: 94428 - DNA, 20 bp, Artificial Sequence
  Description of Artificial Sequence: Synthetic oligonucleotide
  Target: ATXN1; (-) strand; PAM type: NRG; PAM sequence: AAG
ggtgtagaatgtgtagagag

SEQ ID NO: 94429 - DNA, 20 bp, Artificial Sequence
  Description of Artificial Sequence: Synthetic oligonucleotide
  Target: ATXN1; (-) strand; PAM type: NRG; PAM sequence: GAG
gctggtgtagaatgtgtaga

SEQ ID NO: 94430 - DNA, 20 bp, Artificial Sequence
  Description of Artificial Sequence: Synthetic oligonucleotide
  Target: ATXN1; (-) strand; PAM type: NRG; PAM sequence: GAG
cagctggtgtagaatgtgta

SEQ ID NO: 94431 - DNA, 20 bp, Artificial Sequence
  Description of Artificial Sequence: Synthetic oligonucleotide
  Target: ATXN1; (-) strand; PAM type: NRG; PAM sequence: TAG
gtcagctggtgtagaatgtg

SEQ ID NO: 94432 - DNA, 20 bp, Artificial Sequence
  Description of Artificial Sequence: Synthetic oligonucleotide
  Target: ATXN1; (-) strand; PAM type: NRG; PAM sequence: TAG
agggatgacgtcagctggtg

SEQ ID NO: 94433 - DNA, 20 bp, Artificial Sequence
  Description of Artificial Sequence: Synthetic oligonucleotide
  Target: ATXN1; (-) strand; PAM type: NRG; PAM sequence: TGG
aattcagggatgacgtcagc

SEQ ID NO: 94434 - DNA, 20 bp, Artificial Sequence
  Description of Artificial Sequence: Synthetic oligonucleotide
  Target: ATXN1; (-) strand; PAM type: NRG; PAM sequence: CAG
actgaattcagggatgacgt

SEQ ID NO: 94435 - DNA, 20 bp, Artificial Sequence
  Description of Artificial Sequence: Synthetic oligonucleotide
  Target: ATXN1; (-) strand; PAM type: NRG; PAM sequence: GGG
gagggggatgactgaattca

SEQ ID NO: 94436 - DNA, 20 bp, Artificial Sequence
  Description of Artificial Sequence: Synthetic oligonucleotide
  Target: ATXN1; (-) strand; PAM type: NRG; PAM sequence: AGG
ggagggggatgactgaattc

SEQ ID NO: 94437 - DNA, 20 bp, Artificial Sequence
  Description of Artificial Sequence: Synthetic oligonucleotide
  Target: ATXN1; (-) strand; PAM type: NRG; PAM sequence: CAG
aggagggggatgactgaatt

SEQ ID NO: 94438 - DNA, 20 bp, Artificial Sequence
  Description of Artificial Sequence: Synthetic oligonucleotide
  Target: ATXN1; (-) strand; PAM type: NRG; PAM sequence: GGG
aaagtttgacacccaggagg

SEQ ID NO: 94439 - DNA, 20 bp, Artificial Sequence
  Description of Artificial Sequence: Synthetic oligonucleotide
  Target: ATXN1; (-) strand; PAM type: NRG; PAM sequence: GGG
aaaagtttgacacccaggag

SEQ ID NO: 94440 - DNA, 20 bp, Artificial Sequence
  Description of Artificial Sequence: Synthetic oligonucleotide
  Target: ATXN1; (-) strand; PAM type: NRG; PAM sequence: GGG
aaaaagtttgacacccagga

SEQ ID NO: 94441 - DNA, 20 bp, Artificial Sequence
  Description of Artificial Sequence: Synthetic oligonucleotide
  Target: ATXN1; (-) strand; PAM type: NRG; PAM sequence: AGG
caaaaagtttgacacccagg

SEQ ID NO: 94442 - DNA, 20 bp, Artificial Sequence
  Description of Artificial Sequence: Synthetic oligonucleotide
  Target: ATXN1; (-) strand; PAM type: NRG; PAM sequence: GAG
gcaaaaagtttgacacccag

SEQ ID NO: 94443 - DNA, 20 bp, Artificial Sequence
  Description of Artificial Sequence: Synthetic oligonucleotide
  Target: ATXN1; (-) strand; PAM type: NRG; PAM sequence: AGG
tggcaaaaagtttgacaccc

SEQ ID NO: 94444 - DNA, 20 bp, Artificial Sequence
  Description of Artificial Sequence: Synthetic oligonucleotide
  Target: ATXN1; (-) strand; PAM type: NRG; PAM sequence: CAG
ctggcaaaaagtttgacacc

SEQ ID NO: 94445 - DNA, 20 bp, Artificial Sequence
  Description of Artificial Sequence: Synthetic oligonucleotide
  Target: ATXN1; (-) strand; PAM type: NRG; PAM sequence: AAG
gggttcttgggcctggcaaa

SEQ ID NO: 94446 - DNA, 20 bp, Artificial Sequence
  Description of Artificial Sequence: Synthetic oligonucleotide
  Target: ATXN1; (-) strand; PAM type: NRG; PAM sequence: TGG
tgaaattgggttcttgggcc

SEQ ID NO: 94447 - DNA, 20 bp, Artificial Sequence
  Description of Artificial Sequence: Synthetic oligonucleotide
  Target: ATXN1; (-) strand; PAM type: NRG; PAM sequence: GGG
atctttgaaattgggttctt

SEQ ID NO: 94448 - DNA, 20 bp, Artificial Sequence
  Description of Artificial Sequence: Synthetic oligonucleotide
  Target: ATXN1; (-) strand; PAM type: NRG; PAM sequence: TGG
gatctttgaaattgggttct

SEQ ID NO: 94449 - DNA, 20 bp, Artificial Sequence
  Description of Artificial Sequence: Synthetic oligonucleotide
  Target: ATXN1; (-) strand; PAM type: NRG; PAM sequence: GGG
taaaagtgatctttgaaatt

SEQ ID NO: 94450 - DNA, 20 bp, Artificial Sequence
  Description of Artificial Sequence: Synthetic oligonucleotide
  Target: ATXN1; (-) strand; PAM type: NRG; PAM sequence: TGG
ataaaagtgatctttgaaat

SEQ ID NO: 94451 - DNA, 20 bp, Artificial Sequence
  Description of Artificial Sequence: Synthetic oligonucleotide
  Target: ATXN1; (-) strand; PAM type: NRG; PAM sequence: AAG
tggaggagtccttggcataa

SEQ ID NO: 94452 - DNA, 20 bp, Artificial Sequence
  Description of Artificial Sequence: Synthetic oligonucleotide
  Target: ATXN1; (-) strand; PAM type: NRG; PAM sequence: TGG
gataaatttggaggagtcct

SEQ ID NO: 94453 - DNA, 20 bp, Artificial Sequence
  Description of Artificial Sequence: Synthetic oligonucleotide
  Target: ATXN1; (-) strand; PAM type: NRG; PAM sequence: GAG
gtctgaagataaatttggag

SEQ ID NO: 94454 - DNA, 20 bp, Artificial Sequence
  Description of Artificial Sequence: Synthetic oligonucleotide
  Target: ATXN1; (-) strand; PAM type: NRG; PAM sequence: AGG
aagtctgaagataaatttgg

SEQ ID NO: 94455 - DNA, 20 bp, Artificial Sequence
  Description of Artificial Sequence: Synthetic oligonucleotide
  Target: ATXN1; (-) strand; PAM type: NRG; PAM sequence: GAG
caagtctgaagataaatttg

SEQ ID NO: 94456 - DNA, 20 bp, Artificial Sequence
  Description of Artificial Sequence: Synthetic oligonucleotide
  Target: ATXN1; (-) strand; PAM type: NRG; PAM sequence: TGG
gtcaagtctgaagataaatt

SEQ ID NO: 94457 - DNA, 20 bp, Artificial Sequence
  Description of Artificial Sequence: Synthetic oligonucleotide
  Target: ATXN1; (-) strand; PAM type: NRG; PAM sequence: AAG
ctgccgagaggtcaagtctg

SEQ ID NO: 94458 - DNA, 20 bp, Artificial Sequence
  Description of Artificial Sequence: Synthetic oligonucleotide
  Target: ATXN1; (-) strand; PAM type: NRG; PAM sequence: AAG
aataaaactgccgagaggtc

SEQ ID NO: 94459 - DNA, 20 bp, Artificial Sequence
  Description of Artificial Sequence: Synthetic oligonucleotide
  Target: ATXN1; (-) strand; PAM type: NRG; PAM sequence: AGG
atgggaataaaactgccgag

SEQ ID NO: 94460 - DNA, 20 bp, Artificial Sequence
  Description of Artificial Sequence: Synthetic oligonucleotide
  Target: ATXN1; (-) strand; PAM type: NRG; PAM sequence: GAG
tatgggaataaaactgccga

SEQ ID NO: 94461 - DNA, 20 bp, Artificial Sequence
  Description of Artificial Sequence: Synthetic oligonucleotide
  Target: ATXN1; (-) strand; PAM type: NRG; PAM sequence: GAG
agtatgggaataaaactgcc

SEQ ID NO: 94462 - DNA, 20 bp, Artificial Sequence
  Description of Artificial Sequence: Synthetic oligonucleotide
  Target: ATXN1; (-) strand; PAM type: NRG; PAM sequence: GGG
gagcagacagtagagagtat

SEQ ID NO: 94463 - DNA, 20 bp, Artificial Sequence
  Description of Artificial Sequence: Synthetic oligonucleotide
  Target: ATXN1; (-) strand; PAM type: NRG; PAM sequence: TGG
cgagcagacagtagagagta

SEQ ID NO: 94464 - DNA, 20 bp, Artificial Sequence
  Description of Artificial Sequence: Synthetic oligonucleotide
  Target: ATXN1; (-) strand; PAM type: NRG; PAM sequence: GAG
ggattcgagcagacagtaga

SEQ ID NO: 94465 - DNA, 20 bp, Artificial Sequence
  Description of Artificial Sequence: Synthetic oligonucleotide
  Target: ATXN1; (-) strand; PAM type: NRG; PAM sequence: GAG
ctggattcgagcagacagta

SEQ ID NO: 94466 - DNA, 20 bp, Artificial Sequence
  Description of Artificial Sequence: Synthetic oligonucleotide
  Target: ATXN1; (-) strand; PAM type: NRG; PAM sequence: TAG
ttctggattcgagcagacag

SEQ ID NO: 94467 - DNA, 20 bp, Artificial Sequence
  Description of Artificial Sequence: Synthetic oligonucleotide
  Target: ATXN1; (-) strand; PAM type: NRG; PAM sequence: CAG
aatttctggattcgagcaga

SEQ ID NO: 94468 - DNA, 20 bp, Artificial Sequence
  Description of Artificial Sequence: Synthetic oligonucleotide
  Target: ATXN1; (-) strand; PAM type: NRG; PAM sequence: CAG
tctgaatttctggattcgag

SEQ ID NO: 94469 - DNA, 20 bp, Artificial Sequence
  Description of Artificial Sequence: Synthetic oligonucleotide
  Target: ATXN1; (-) strand; PAM type: NRG; PAM sequence: GAG
acatctgaatttctggattc

SEQ ID NO: 94470 - DNA, 20 bp, Artificial Sequence
  Description of Artificial Sequence: Synthetic oligonucleotide
  Target: ATXN1; (-) strand; PAM type: NRG; PAM sequence: TGG
ctggtggacatctgaatttc

SEQ ID NO: 94471 - DNA, 20 bp, Artificial Sequence
  Description of Artificial Sequence: Synthetic oligonucleotide
  Target: ATXN1; (-) strand; PAM type: NRG; PAM sequence: TGG
gactgaagcctaggtgctgg

SEQ ID NO: 94472 - DNA, 20 bp, Artificial Sequence
  Description of Artificial Sequence: Synthetic oligonucleotide
  Target: ATXN1; (-) strand; PAM type: NRG; PAM sequence: TGG
tttgactgaagcctaggtgc

SEQ ID NO: 94473 - DNA, 20 bp, Artificial Sequence
  Description of Artificial Sequence: Synthetic oligonucleotide
  Target: ATXN1; (-) strand; PAM type: NRG; PAM sequence: AGG
ggacattttgactgaagcct

SEQ ID NO: 94474 - DNA, 20 bp, Artificial Sequence
  Description of Artificial Sequence: Synthetic oligonucleotide
  Target: ATXN1; (-) strand; PAM type: NRG; PAM sequence: TAG
aggacattttgactgaagcc

SEQ ID NO: 94475 - DNA, 20 bp, Artificial Sequence
  Description of Artificial Sequence: Synthetic oligonucleotide
  Target: ATXN1; (-) strand; PAM type: NRG; PAM sequence: AAG
tgaccaggacattttgactg

SEQ ID NO: 94476 - DNA, 20 bp, Artificial Sequence
  Description of Artificial Sequence: Synthetic oligonucleotide
  Target: ATXN1; (-) strand; PAM type: NRG; PAM sequence: AGG
tgcacggtatgtaactgacc

SEQ ID NO: 94477 - DNA, 20 bp, Artificial Sequence
  Description of Artificial Sequence: Synthetic oligonucleotide
  Target: ATXN1; (-) strand; PAM type: NRG; PAM sequence: CAG
atgcacggtatgtaactgac

SEQ ID NO: 94478 - DNA, 20 bp, Artificial Sequence
  Description of Artificial Sequence: Synthetic oligonucleotide
  Target: ATXN1; (-) strand; PAM type: NRG; PAM sequence: CGG
ggacataacaagccaatgca

SEQ ID NO: 94479 - DNA, 20 bp, Artificial Sequence
  Description of Artificial Sequence: Synthetic oligonucleotide
  Target: ATXN1; (-) strand; PAM type: NRG; PAM sequence: AAG
gtgtgtgtctgggacataac

SEQ ID NO: 94480 - DNA, 20 bp, Artificial Sequence
  Description of Artificial Sequence: Synthetic oligonucleotide
  Target: ATXN1; (-) strand; PAM type: NRG; PAM sequence: GGG
ggaaggccatgtgtgtgtct

SEQ ID NO: 94481 - DNA, 20 bp, Artificial Sequence
  Description of Artificial Sequence: Synthetic oligonucleotide
  Target: ATXN1; (-) strand; PAM type: NRG; PAM sequence: TGG
aggaaggccatgtgtgtgtc

SEQ ID NO: 94482 - DNA, 20 bp, Artificial Sequence
  Description of Artificial Sequence: Synthetic oligonucleotide
  Target: ATXN1; (-) strand; PAM type: NRG; PAM sequence: AGG
agatggatggagcatgagga

SEQ ID NO: 94483 - DNA, 20 bp, Artificial Sequence
  Description of Artificial Sequence: Synthetic oligonucleotide
  Target: ATXN1; (-) strand; PAM type: NRG; PAM sequence: AAG
gagatggatggagcatgagg

SEQ ID NO: 94484 - DNA, 20 bp, Artificial Sequence
  Description of Artificial Sequence: Synthetic oligonucleotide
  Target: ATXN1; (-) strand; PAM type: NRG; PAM sequence: AGG
gaagagatggatggagcatg

SEQ ID NO: 94485 - DNA, 20 bp, Artificial Sequence
  Description of Artificial Sequence: Synthetic oligonucleotide
  Target: ATXN1; (-) strand; PAM type: NRG; PAM sequence: GAG
ggaagagatggatggagcat

SEQ ID NO: 94486 - DNA, 20 bp, Artificial Sequence
  Description of Artificial Sequence: Synthetic oligonucleotide
  Target: ATXN1; (-) strand; PAM type: NRG; PAM sequence: GAG
tctgtgggaagagatggatg

SEQ ID NO: 94487 - DNA, 20 bp, Artificial Sequence
  Description of Artificial Sequence: Synthetic oligonucleotide
  Target: ATXN1; (-) strand; PAM type: NRG; PAM sequence: TGG
tttctgtgggaagagatgga

SEQ ID NO: 94488 - DNA, 20 bp, Artificial Sequence
  Description of Artificial Sequence: Synthetic oligonucleotide
  Target: ATXN1; (-) strand; PAM type: NRG; PAM sequence: TGG
tgcatttctgtgggaagaga

SEQ ID NO: 94489 - DNA, 20 bp, Artificial Sequence
  Description of Artificial Sequence: Synthetic oligonucleotide
  Target: ATXN1; (-) strand; PAM type: NRG; PAM sequence: GAG
agattgcatttctgtgggaa

SEQ ID NO: 94490 - DNA, 20 bp, Artificial Sequence
  Description of Artificial Sequence: Synthetic oligonucleotide
  Target: ATXN1; (-) strand; PAM type: NRG; PAM sequence: AAG
ctagattgcatttctgtggg

SEQ ID NO: 94491 - DNA, 20 bp, Artificial Sequence
  Description of Artificial Sequence: Synthetic oligonucleotide
  Target: ATXN1; (-) strand; PAM type: NRG; PAM sequence: GGG
tgactagattgcatttctgt

SEQ ID NO: 94492 - DNA, 20 bp, Artificial Sequence
  Description of Artificial Sequence: Synthetic oligonucleotide
  Target: ATXN1; (-) strand; PAM type: NRG; PAM sequence: TGG
ctgactagattgcatttctg

SEQ ID NO: 94493 - DNA, 20 bp, Artificial Sequence
  Description of Artificial Sequence: Synthetic oligonucleotide
  Target: ATXN1; (-) strand; PAM type: NRG; PAM sequence: TAG
ttgagttgagctctgctgac

SEQ ID NO: 94494 - DNA, 20 bp, Artificial Sequence
  Description of Artificial Sequence: Synthetic oligonucleotide
  Target: ATXN1; (-) strand; PAM type: NRG; PAM sequence: GAG
gaggagggatcacttgagtt

SEQ ID NO: 94495 - DNA, 20 bp, Artificial Sequence
  Description of Artificial Sequence: Synthetic oligonucleotide
  Target: ATXN1; (-) strand; PAM type: NRG; PAM sequence: GAG
ttgaggaggagggatcactt

SEQ ID NO: 94496 - DNA, 20 bp, Artificial Sequence
  Description of Artificial Sequence: Synthetic oligonucleotide
  Target: ATXN1; (-) strand; PAM type: NRG; PAM sequence: GGG
aggaaagactttgaggagga

SEQ ID NO: 94497 - DNA, 20 bp, Artificial Sequence
  Description of Artificial Sequence: Synthetic oligonucleotide
  Target: ATXN1; (-) strand; PAM type: NRG; PAM sequence: AGG
caggaaagactttgaggagg

SEQ ID NO: 94498 - DNA, 20 bp, Artificial Sequence
  Description of Artificial Sequence: Synthetic oligonucleotide
  Target: ATXN1; (-) strand; PAM type: NRG; PAM sequence: GAG
tcaggaaagactttgaggag

SEQ ID NO: 94499 - DNA, 20 bp, Artificial Sequence
  Description of Artificial Sequence: Synthetic oligonucleotide
  Target: ATXN1; (-) strand; PAM type: NRG; PAM sequence: AGG
gatcaggaaagactttgagg

SEQ ID NO: 94500 - DNA, 20 bp, Artificial Sequence
  Description of Artificial Sequence: Synthetic oligonucleotide
  Target: ATXN1; (-) strand; PAM type: NRG; PAM sequence: GAG
tgatcaggaaagactttgag

SEQ ID NO: 94501 - DNA, 20 bp, Artificial Sequence
  Description of Artificial Sequence: Synthetic oligonucleotide
  Target: ATXN1; (-) strand; PAM type: NRG; PAM sequence: AGG
agtgatcaggaaagactttg

SEQ ID NO: 94502 - DNA, 20 bp, Artificial Sequence
  Description of Artificial Sequence: Synthetic oligonucleotide
  Target: ATXN1; (-) strand; PAM type: NRG; PAM sequence: GAG
gagtgatcaggaaagacttt

SEQ ID NO: 94503 - DNA, 20 bp, Artificial Sequence
  Description of Artificial Sequence: Synthetic oligonucleotide
  Target: ATXN1; (-) strand; PAM type: NRG; PAM sequence: AAG
ctgagtaggagtgatcagga

SEQ ID NO: 94504 - DNA, 20 bp, Artificial Sequence
  Description of Artificial Sequence: Synthetic oligonucleotide
  Target: ATXN1; (-) strand; PAM type: NRG; PAM sequence: AGG
gacgctgagtaggagtgatc

SEQ ID NO: 94505 - DNA, 20 bp, Artificial Sequence
  Description of Artificial Sequence: Synthetic oligonucleotide
  Target: ATXN1; (-) strand; PAM type: NRG; PAM sequence: CAG
tgacgctgagtaggagtgat

SEQ ID NO: 94506 - DNA, 20 bp, Artificial Sequence
  Description of Artificial Sequence: Synthetic oligonucleotide
  Target: ATXN1; (-) strand; PAM type: NRG; PAM sequence: GAG
agaagagtgacgctgagtag

SEQ ID NO: 94507 - DNA, 20 bp, Artificial Sequence
  Description of Artificial Sequence: Synthetic oligonucleotide
  Target: ATXN1; (-) strand; PAM type: NRG; PAM sequence: AGG
tcagaagagtgacgctgagt

SEQ ID NO: 94508 - DNA, 20 bp, Artificial Sequence
  Description of Artificial Sequence: Synthetic oligonucleotide
  Target: ATXN1; (-) strand; PAM type: NRG; PAM sequence: TAG
ttcagaagagtgacgctgag

SEQ ID NO: 94509 - DNA, 20 bp, Artificial Sequence
  Description of Artificial Sequence: Synthetic oligonucleotide
  Target: ATXN1; (-) strand; PAM type: NRG; PAM sequence: GAG
gaattcagaagagtgacgct

SEQ ID NO: 94510 - DNA, 20 bp, Artificial Sequence
  Description of Artificial Sequence: Synthetic oligonucleotide
  Target: ATXN1; (-) strand; PAM type: NRG; PAM sequence: GAG
aacagtgaaggaattcagaa

SEQ ID NO: 94511 - DNA, 20 bp, Artificial Sequence
  Description of Artificial Sequence: Synthetic oligonucleotide
  Target: ATXN1; (-) strand; PAM type: NRG; PAM sequence: AAG
ctaacagtgaaggaattcag

SEQ ID NO: 94512 - DNA, 20 bp, Artificial Sequence
  Description of Artificial Sequence: Synthetic oligonucleotide
  Target: ATXN1; (-) strand; PAM type: NRG; PAM sequence: CAG
gttctaacagtgaaggaatt

SEQ ID NO: 94513 - DNA, 20 bp, Artificial Sequence
  Description of Artificial Sequence: Synthetic oligonucleotide
  Target: ATXN1; (-) strand; PAM type: NRG; PAM sequence: AGG
taacagtgttctaacagtga

SEQ ID NO: 94514 - DNA, 20 bp, Artificial Sequence
  Description of Artificial Sequence: Synthetic oligonucleotide
  Target: ATXN1; (-) strand; PAM type: NRG; PAM sequence: AAG
ctaacagtgttctaacagtg

SEQ ID NO: 94515 - DNA, 20 bp, Artificial Sequence
  Description of Artificial Sequence: Synthetic oligonucleotide
  Target: ATXN1; (-) strand; PAM type: NRG; PAM sequence: CAG
gggttctaacagtgttctaa

SEQ ID NO: 94516 - DNA, 20 bp, Artificial Sequence
  Description of Artificial Sequence: Synthetic oligonucleotide
  Target: ATXN1; (-) strand; PAM type: NRG; PAM sequence: CAG
cgaatagaatggggttctaa

SEQ ID NO: 94517 - DNA, 20 bp, Artificial Sequence
  Description of Artificial Sequence: Synthetic oligonucleotide
  Target: ATXN1; (-) strand; PAM type: NRG; PAM sequence: GGG
taatgaatacgaatagaatg

SEQ ID NO: 94518 - DNA, 20 bp, Artificial Sequence
  Description of Artificial Sequence: Synthetic oligonucleotide
  Target: ATXN1; (-) strand; PAM type: NRG; PAM sequence: GGG
ataatgaatacgaatagaat

SEQ ID NO: 94519 - DNA, 20 bp, Artificial Sequence
  Description of Artificial Sequence: Synthetic oligonucleotide
  Target: ATXN1; (-) strand; PAM type: NRG; PAM sequence: TGG
aataatgaatacgaatagaa

SEQ ID NO: 94520 - DNA, 20 bp, Artificial Sequence
  Description of Artificial Sequence: Synthetic oligonucleotide
  Target: ATXN1; (-) strand; PAM type: NRG; PAM sequence: TAG
tctgaaataatgaatacgaa

SEQ ID NO: 94521 - DNA, 20 bp, Artificial Sequence
  Description of Artificial Sequence: Synthetic oligonucleotide
  Target: ATXN1; (-) strand; PAM type: NRG; PAM sequence: AAG
cctggtcaggcaggggaaag

SEQ ID NO: 94522 - DNA, 20 bp, Artificial Sequence
  Description of Artificial Sequence: Synthetic oligonucleotide
  Target: ATXN1; (-) strand; PAM type: NRG; PAM sequence: AAG
cttcctggtcaggcagggga

SEQ ID NO: 94523 - DNA, 20 bp, Artificial Sequence
  Description of Artificial Sequence: Synthetic oligonucleotide
  Target: ATXN1; (-) strand; PAM type: NRG; PAM sequence: GGG
ttttcttcctggtcaggcag

SEQ ID NO: 94524 - DNA, 20 bp, Artificial Sequence
  Description of Artificial Sequence: Synthetic oligonucleotide
  Target: ATXN1; (-) strand; PAM type: NRG; PAM sequence: GGG
attttcttcctggtcaggca

SEQ ID NO: 94525 - DNA, 20 bp, Artificial Sequence
  Description of Artificial Sequence: Synthetic oligonucleotide
  Target: ATXN1; (-) strand; PAM type: NRG; PAM sequence: AGG
tattttcttcctggtcaggc

SEQ ID NO: 94526 - DNA, 20 bp, Artificial Sequence
  Description of Artificial Sequence: Synthetic oligonucleotide
  Target: ATXN1; (-) strand; PAM type: NRG; PAM sequence: CAG
ttattttcttcctggtcagg

SEQ ID NO: 94527 - DNA, 20 bp, Artificial Sequence
  Description of Artificial Sequence: Synthetic oligonucleotide
  Target: ATXN1; (-) strand; PAM type: NRG; PAM sequence: AGG
cagttattttcttcctggtc

SEQ ID NO: 94528 - DNA, 20 bp, Artificial Sequence
  Description of Artificial Sequence: Synthetic oligonucleotide
  Target: ATXN1; (-) strand; PAM type: NRG; PAM sequence: CAG
gcagttattttcttcctggt

SEQ ID NO: 94529 - DNA, 20 bp, Artificial Sequence
  Description of Artificial Sequence: Synthetic oligonucleotide
  Target: ATXN1; (-) strand; PAM type: NRG; PAM sequence: TGG
gaaggcagttattttcttcc

SEQ ID NO: 94530 - DNA, 20 bp, Artificial Sequence
  Description of Artificial Sequence: Synthetic oligonucleotide
  Target: ATXN1; (-) strand; PAM type: NRG; PAM sequence: CAG
gaataagagctaccggaagg

SEQ ID NO: 94531 - DNA, 20 bp, Artificial Sequence
  Description of Artificial Sequence: Synthetic oligonucleotide
  Target: ATXN1; (-) strand; PAM type: NRG; PAM sequence: AGG
agtgaataagagctaccgga

SEQ ID NO: 94532 - DNA, 20 bp, Artificial Sequence
  Description of Artificial Sequence: Synthetic oligonucleotide
  Target: ATXN1; (-) strand; PAM type: NRG; PAM sequence: AAG
aagtgaataagagctaccgg

SEQ ID NO: 94533 - DNA, 20 bp, Artificial Sequence
  Description of Artificial Sequence: Synthetic oligonucleotide
  Target: ATXN1; (-) strand; PAM type: NRG; PAM sequence: CGG
tggaagtgaataagagctac

SEQ ID NO: 94534 - DNA, 20 bp, Artificial Sequence
  Description of Artificial Sequence: Synthetic oligonucleotide
  Target: ATXN1; (-) strand; PAM type: NRG; PAM sequence: GAG
gtgggaatggaagtgaataa

SEQ ID NO: 94535 - DNA, 20 bp, Artificial Sequence
  Description of Artificial Sequence: Synthetic oligonucleotide
  Target: ATXN1; (-) strand; PAM type: NRG; PAM sequence: AAG
ctgtgggaatggaagtgaat

SEQ ID NO: 94536 - DNA, 20 bp, Artificial Sequence
  Description of Artificial Sequence: Synthetic oligonucleotide
  Target: ATXN1; (-) strand; PAM type: NRG; PAM sequence: AAG
gcatggtgctgtgggaatgg

SEQ ID NO: 94537 - DNA, 20 bp, Artificial Sequence
  Description of Artificial Sequence: Synthetic oligonucleotide
  Target: ATXN1; (-) strand; PAM type: NRG; PAM sequence: TGG
actgcatggtgctgtgggaa

SEQ ID NO: 94538 - DNA, 20 bp, Artificial Sequence
  Description of Artificial Sequence: Synthetic oligonucleotide
  Target: ATXN1; (-) strand; PAM type: NRG; PAM sequence: GGG
aaactactgcatggtgctgt

SEQ ID NO: 94539 - DNA, 20 bp, Artificial Sequence
  Description of Artificial Sequence: Synthetic oligonucleotide
  Target: ATXN1; (-) strand; PAM type: NRG; PAM sequence: TGG
aaaactactgcatggtgctg

SEQ ID NO: 94540 - DNA, 20 bp, Artificial Sequence
  Description of Artificial Sequence: Synthetic oligonucleotide
  Target: ATXN1; (-) strand; PAM type: NRG; PAM sequence: TGG
atttttttaaaactactgca

SEQ ID NO: 94541 - DNA, 20 bp, Artificial Sequence
  Description of Artificial Sequence: Synthetic oligonucleotide
  Target: ATXN1; (-) strand; PAM type: NRG; PAM sequence: AAG
tcacagtcactatttatgta

SEQ ID NO: 94542 - DNA, 20 bp, Artificial Sequence
  Description of Artificial Sequence: Synthetic oligonucleotide
  Target: ATXN1; (-) strand; PAM type: NRG; PAM sequence: CAG
gttatgacctaacttgttca

SEQ ID NO: 94543 - DNA, 20 bp, Artificial Sequence
  Description of Artificial Sequence: Synthetic oligonucleotide
  Target: ATXN1; (-) strand; PAM type: NRG; PAM sequence: AAG
aaatatgatacagctatagc

SEQ ID NO: 94544 - DNA, 20 bp, Artificial Sequence
  Description of Artificial Sequence: Synthetic oligonucleotide
  Target: ATXN1; (-) strand; PAM type: NRG; PAM sequence: TAG
ttataaatatgatacagcta

SEQ ID NO: 94545 - DNA, 20 bp, Artificial Sequence
  Description of Artificial Sequence: Synthetic oligonucleotide
  Target: ATXN1; (-) strand; PAM type: NRG; PAM sequence: CAG
gttattttataaatatgata

SEQ ID NO: 94546 - DNA, 20 bp, Artificial Sequence
  Description of Artificial Sequence: Synthetic oligonucleotide
  Target: ATXN1; (-) strand; PAM type: NRG; PAM sequence: TAG
attatagttctttctggttc

SEQ ID NO: 94547 - DNA, 20 bp, Artificial Sequence
  Description of Artificial Sequence: Synthetic oligonucleotide
  Target: ATXN1; (-) strand; PAM type: NRG; PAM sequence: TGG
acctacattatagttctttc

SEQ ID NO: 94548 - DNA, 20 bp, Artificial Sequence
  Description of Artificial Sequence: Synthetic oligonucleotide
  Target: ATXN1; (-) strand; PAM type: NRG; PAM sequence: TAG
tttttcttaaacctacatta

SEQ ID NO: 94549 - DNA, 20 bp, Artificial Sequence
  Description of Artificial Sequence: Synthetic oligonucleotide
  Target: ATXN1; (-) strand; PAM type: NRG; PAM sequence: CAG
tgtactcttttatattcatt

SEQ ID NO: 94550 - DNA, 20 bp, Artificial Sequence
  Description of Artificial Sequence: Synthetic oligonucleotide
  Target: ATXN1; (-) strand; PAM type: NRG; PAM sequence: TAG
gctcaacgtaggcagaaaaa

SEQ ID NO: 94551 - DNA, 20 bp, Artificial Sequence
  Description of Artificial Sequence: Synthetic oligonucleotide
  Target: ATXN1; (-) strand; PAM type: NRG; PAM sequence: CAG
gattgacggctcaacgtagg

SEQ ID NO: 94552 - DNA, 20 bp, Artificial Sequence
  Description of Artificial Sequence: Synthetic oligonucleotide
  Target: ATXN1; (-) strand; PAM type: NRG; PAM sequence: AGG
cacgattgacggctcaacgt

SEQ ID NO: 94553 - DNA, 20 bp, Artificial Sequence
  Description of Artificial Sequence: Synthetic oligonucleotide
  Target: ATXN1; (-) strand; PAM type: NRG; PAM sequence: TAG
tcacgattgacggctcaacg

SEQ ID NO: 94554 - DNA, 20 bp, Artificial Sequence
  Description of Artificial Sequence: Synthetic oligonucleotide
  Target: ATXN1; (-) strand; PAM type: NRG; PAM sequence: CGG
attacagtcctcacgattga

SEQ ID NO: 94555 - DNA, 20 bp, Artificial Sequence
  Description of Artificial Sequence: Synthetic oligonucleotide
  Target: ATXN1; (-) strand; PAM type: NRG; PAM sequence: CAG
catcaataatggcctcatta

SEQ ID NO: 94556 - DNA, 20 bp, Artificial Sequence
  Description of Artificial Sequence: Synthetic oligonucleotide
  Target: ATXN1; (-) strand; PAM type: NRG; PAM sequence: TGG
taaacattttgcatcaataa

SEQ ID NO: 94557 - DNA, 20 bp, Artificial Sequence
  Description of Artificial Sequence: Synthetic oligonucleotide
  Target: ATXN1; (-) strand; PAM type: NRG; PAM sequence: AAG
tgcatttaaagaaagcttat

SEQ ID NO: 94558 - DNA, 20 bp, Artificial Sequence
  Description of Artificial Sequence: Synthetic oligonucleotide
  Target: ATXN1; (-) strand; PAM type: NRG; PAM sequence: AAG
tctatgattgcatttaaaga

SEQ ID NO: 94559 - DNA, 20 bp, Artificial Sequence
  Description of Artificial Sequence: Synthetic oligonucleotide
  Target: ATXN1; (-) strand; PAM type: NRG; PAM sequence: AAG
attttctatgattgcattta

SEQ ID NO: 94560 - DNA, 20 bp, Artificial Sequence
  Description of Artificial Sequence: Synthetic oligonucleotide
  Target: ATXN1; (-) strand; PAM type: NRG; PAM sequence: AAG
gcaaagtcaccttgaatttt

SEQ ID NO: 94561 - DNA, 20 bp, Artificial Sequence
  Description of Artificial Sequence: Synthetic oligonucleotide
  Target: ATXN1; (-) strand; PAM type: NRG; PAM sequence: AAG
aatactgacgaagtagcgca

SEQ ID NO: 94562 - DNA, 20 bp, Artificial Sequence
  Description of Artificial Sequence: Synthetic oligonucleotide
  Target: ATXN1; (-) strand; PAM type: NRG; PAM sequence: TAG
atactaaaatactgacgaag

SEQ ID NO: 94563 - DNA, 20 bp, Artificial Sequence
  Description of Artificial Sequence: Synthetic oligonucleotide
  Target: ATXN1; (-) strand; PAM type: NRG; PAM sequence: AAG
tgaatactaaaatactgacg

SEQ ID NO: 94564 - DNA, 20 bp, Artificial Sequence
  Description of Artificial Sequence: Synthetic oligonucleotide
  Target: ATXN1; (-) strand; PAM type: NRG; PAM sequence: AAG
ataatatgttaggcaagttt

SEQ ID NO: 94565 - DNA, 20 bp, Artificial Sequence
  Description of Artificial Sequence: Synthetic oligonucleotide
  Target: ATXN1; (-) strand; PAM type: NRG; PAM sequence: AAG
gtttttataatatgttaggc

SEQ ID NO: 94566 - DNA, 20 bp, Artificial Sequence
  Description of Artificial Sequence: Synthetic oligonucleotide
  Target: ATXN1; (-) strand; PAM type: NRG; PAM sequence: AGG
ctaggtttttataatatgtt

SEQ ID NO: 94567 - DNA, 20 bp, Artificial Sequence
  Description of Artificial Sequence: Synthetic oligonucleotide
  Target: ATXN1; (-) strand; PAM type: NRG; PAM sequence: TAG
cctaggtttttataatatgt

SEQ ID NO: 94568 - DNA, 20 bp, Artificial Sequence
  Description of Artificial Sequence: Synthetic oligonucleotide
  Target: ATXN1; (-) strand; PAM type: NRG; PAM sequence: AGG
agcttattgagaagagacct

SEQ ID NO: 94569 - DNA, 20 bp, Artificial Sequence
  Description of Artificial Sequence: Synthetic oligonucleotide
  Target: ATXN1; (-) strand; PAM type: NRG; PAM sequence: TAG
cagcttattgagaagagacc

SEQ ID NO: 94570 - DNA, 20 bp, Artificial Sequence
  Description of Artificial Sequence: Synthetic oligonucleotide
  Target: ATXN1; (-) strand; PAM type: NRG; PAM sequence: GAG
tatgggcagcttattgagaa

SEQ ID NO: 94571 - DNA, 20 bp, Artificial Sequence
  Description of Artificial Sequence: Synthetic oligonucleotide
  Target: ATXN1; (-) strand; PAM type: NRG; PAM sequence: AAG
aatatgggcagcttattgag

SEQ ID NO: 94572 - DNA, 20 bp, Artificial Sequence
  Description of Artificial Sequence: Synthetic oligonucleotide
  Target: ATXN1; (-) strand; PAM type: NRG; PAM sequence: GAG
gtcaatatgggcagcttatt

SEQ ID NO: 94573 - DNA, 20 bp, Artificial Sequence
  Description of Artificial Sequence: Synthetic oligonucleotide
  Target: ATXN1; (-) strand; PAM type: NRG; PAM sequence: CAG
tatctcttggtcaatatggg

SEQ ID NO: 94574 - DNA, 20 bp, Artificial Sequence
  Description of Artificial Sequence: Synthetic oligonucleotide
  Target: ATXN1; (-) strand; PAM type: NRG; PAM sequence: GGG
tcatatctcttggtcaatat

SEQ ID NO: 94575 - DNA, 20 bp, Artificial Sequence
  Description of Artificial Sequence: Synthetic oligonucleotide
  Target: ATXN1; (-) strand; PAM type: NRG; PAM sequence: TGG
gtcatatctcttggtcaata

SEQ ID NO: 94576 - DNA, 20 bp, Artificial Sequence
  Description of Artificial Sequence: Synthetic oligonucleotide
  Target: ATXN1; (-) strand; PAM type: NRG; PAM sequence: TGG
cagcaaaaagtcatatctct

SEQ ID NO: 94577 - DNA, 20 bp, Artificial Sequence
  Description of Artificial Sequence: Synthetic oligonucleotide
  Target: ATXN1; (-) strand; PAM type: NRG; PAM sequence: AAG
gtgaaaaaacaggcagcaaa

SEQ ID NO: 94578 - DNA, 20 bp, Artificial Sequence
  Description of Artificial Sequence: Synthetic oligonucleotide
  Target: ATXN1; (-) strand; PAM type: NRG; PAM sequence: CAG
ttttattgtgaaaaaacagg

SEQ ID NO: 94579 - DNA, 20 bp, Artificial Sequence
  Description of Artificial Sequence: Synthetic oligonucleotide
  Target: ATXN1; (-) strand; PAM type: NRG; PAM sequence: AGG
gaattttattgtgaaaaaac

SEQ ID NO: 94580 - DNA, 20 bp, Artificial Sequence
  Description of Artificial Sequence: Synthetic oligonucleotide
  Target: ATXN1; (-) strand; PAM type: NRG; PAM sequence: CAG
agaattttattgtgaaaaaa

SEQ ID NO: 94581 - DNA, 20 bp, Artificial Sequence
  Description of Artificial Sequence: Synthetic oligonucleotide
  Target: ATXN1; (-) strand; PAM type: NRG; PAM sequence: AAG
tgtgataacagaaatatctc

SEQ ID NO: 94582 - DNA, 20 bp, Artificial Sequence
  Description of Artificial Sequence: Synthetic oligonucleotide
  Target: ATXN1; (-) strand; PAM type: NRG; PAM sequence: CAG
aagggagtcatttgtgataa

SEQ ID NO: 94583 - DNA, 20 bp, Artificial Sequence
  Description of Artificial Sequence: Synthetic oligonucleotide
  Target: ATXN1; (-) strand; PAM type: NRG; PAM sequence: GAG
taacctgtggtgttgaaagg

SEQ ID NO: 94584 - DNA, 20 bp, Artificial Sequence
  Description of Artificial Sequence: Synthetic oligonucleotide
  Target: ATXN1; (-) strand; PAM type: NRG; PAM sequence: GGG
tttaacctgtggtgttgaaa

SEQ ID NO: 94585 - DNA, 20 bp, Artificial Sequence
  Description of Artificial Sequence: Synthetic oligonucleotide
  Target: ATXN1; (-) strand; PAM type: NRG; PAM sequence: AGG
ttttaacctgtggtgttgaa

SEQ ID NO: 94586 - DNA, 20 bp, Artificial Sequence
  Description of Artificial Sequence: Synthetic oligonucleotide
  Target: ATXN1; (-) strand; PAM type: NRG; PAM sequence: AAG
tttttaacctgtggtgttga

SEQ ID NO: 94587 - DNA, 20 bp, Artificial Sequence
  Description of Artificial Sequence: Synthetic oligonucleotide
  Target: ATXN1; (-) strand; PAM type: NRG; PAM sequence: TGG
cgtgcattttttttaacctg

SEQ ID NO: 94588 - DNA, 20 bp, Artificial Sequence
  Description of Artificial Sequence: Synthetic oligonucleotide
  Target: ATXN1; (-) strand; PAM type: NRG; PAM sequence: GAG
agtttaattgcaaatgggtt

SEQ ID NO: 94589 - DNA, 20 bp, Artificial Sequence
  Description of Artificial Sequence: Synthetic oligonucleotide
  Target: ATXN1; (-) strand; PAM type: NRG; PAM sequence: GGG
gaaatagtttaattgcaaat

SEQ ID NO: 94590 - DNA, 20 bp, Artificial Sequence
  Description of Artificial Sequence: Synthetic oligonucleotide
  Target: ATXN1; (-) strand; PAM type: NRG; PAM sequence: TGG
ggaaatagtttaattgcaaa

SEQ ID NO: 94591 - DNA, 20 bp, Artificial Sequence
  Description of Artificial Sequence: Synthetic oligonucleotide
  Target: ATXN1; (-) strand; PAM type: NRG; PAM sequence: TAG
catttagatctttggggaaa

SEQ ID NO: 94592 - DNA, 20 bp, Artificial Sequence
  Description of Artificial Sequence: Synthetic oligonucleotide
  Target: ATXN1; (-) strand; PAM type: NRG; PAM sequence: GGG
tcctcacatttagatctttg

SEQ ID NO: 94593 - DNA, 20 bp, Artificial Sequence
  Description of Artificial Sequence: Synthetic oligonucleotide
  Target: ATXN1; (-) strand; PAM type: NRG; PAM sequence: GGG
atcctcacatttagatcttt

SEQ ID NO: 94594 - DNA, 20 bp, Artificial Sequence
  Description of Artificial Sequence: Synthetic oligonucleotide
  Target: ATXN1; (-) strand; PAM type: NRG; PAM sequence: TGG
aatcctcacatttagatctt

SEQ ID NO: 94595 - DNA, 20 bp, Artificial Sequence
  Description of Artificial Sequence: Synthetic oligonucleotide
  Target: ATXN1; (-) strand; PAM type: NRG; PAM sequence: TAG
aggctgaaaatcctcacatt

SEQ ID NO: 94596 - DNA, 20 bp, Artificial Sequence
  Description of Artificial Sequence: Synthetic oligonucleotide
  Target: ATXN1; (-) strand; PAM type: NRG; PAM sequence: AGG
cattttaacggttatgtgct

SEQ ID NO: 94597 - DNA, 20 bp, Artificial Sequence
  Description of Artificial Sequence: Synthetic oligonucleotide
  Target: ATXN1; (-) strand; PAM type: NRG; PAM sequence: TAG
tcattttaacggttatgtgc

SEQ ID NO: 94598 - DNA, 20 bp, Artificial Sequence
  Description of Artificial Sequence: Synthetic oligonucleotide
  Target: ATXN1; (-) strand; PAM type: NRG; PAM sequence: CGG
agggatgatactcattttaa

SEQ ID NO: 94599 - DNA, 20 bp, Artificial Sequence
  Description of Artificial Sequence: Synthetic oligonucleotide
  Target: ATXN1; (-) strand; PAM type: NRG; PAM sequence: GGG
tactgctactttatctctta

SEQ ID NO: 94600 - DNA, 20 bp, Artificial Sequence
  Description of Artificial Sequence: Synthetic oligonucleotide
  Target: ATXN1; (-) strand; PAM type: NRG; PAM sequence: AGG
ttactgctactttatctctt

SEQ ID NO: 94601 - DNA, 20 bp, Artificial Sequence
  Description of Artificial Sequence: Synthetic oligonucleotide
  Target: ATXN1; (-) strand; PAM type: NRG; PAM sequence: TAG
cttactgctactttatctct

SEQ ID NO: 94602 - DNA, 20 bp, Artificial Sequence
  Description of Artificial Sequence: Synthetic oligonucleotide
  Target: ATXN1; (-) strand; PAM type: NRG; PAM sequence: GAG
ggaaagaaaagaaaaaggta

SEQ ID NO: 94603 - DNA, 20 bp, Artificial Sequence
  Description of Artificial Sequence: Synthetic oligonucleotide
  Target: ATXN1; (-) strand; PAM type: NRG; PAM sequence: TAG
gaggaaagaaaagaaaaagg

SEQ ID NO: 94604 - DNA, 20 bp, Artificial Sequence
  Description of Artificial Sequence: Synthetic oligonucleotide
  Target: ATXN1; (-) strand; PAM type: NRG; PAM sequence: AGG
agagaggaaagaaaagaaaa

SEQ ID NO: 94605 - DNA, 20 bp, Artificial Sequence
  Description of Artificial Sequence: Synthetic oligonucleotide
  Target: ATXN1; (-) strand; PAM type: NRG; PAM sequence: AAG
aagagaggaaagaaaagaaa

SEQ ID NO: 94606 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaagagaggaaagaa

SEQ ID NO: 94607 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaagagagga

SEQ ID NO: 94608 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaaaaaagag

SEQ ID NO: 94609 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaaaaaaaaaga

SEQ ID NO: 94610 - DNA, 20 bp, Artificial Sequence
  Description of Artificial Sequence: Synthetic oligonucleotide
  Target: ATXN1; (-) strand; PAM type: NRG; PAM sequence: GAG
tcaaaaaaaaaaaaaaaaaa

SEQ ID NO: 94611 - DNA, 20 bp, Artificial Sequence
  Description of Artificial Sequence: Synthetic oligonucleotide
  Target: ATXN1; (-) strand; PAM type: NRG; PAM sequence: AAG
tctcaaaaaaaaaaaaaaaa

SEQ ID NO: 94612 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcgacagagt

SEQ ID NO: 94613 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 94614 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 94615 - DNA, 20 bp, Artificial Sequence
  Description of Artificial Sequence: Synthetic oligonucleotide
  Target: ATXN1; (-) strand; PAM type: NRG; PAM sequence: GGG
tcgccactgcactccagcct

SEQ ID NO: 94616 - DNA, 20 bp, Artificial Sequence
  Description of Artificial Sequence: Synthetic oligonucleotide
  Target: ATXN1; (-) strand; PAM type: NRG; PAM sequence: TGG
ctcgccactgcactccagcc

SEQ ID NO: 94617 - DNA, 20 bp, Artificial Sequence
  Description of Artificial Sequence: Synthetic oligonucleotide
  Target: ATXN1; (-) strand; PAM type: NRG; PAM sequence: CAG
caggtctcgccactgcactc

SEQ ID NO: 94618 - DNA, 20 bp, Artificial Sequence
  Description of Artificial Sequence: Synthetic oligonucleotide
  Target: ATXN1; (-) strand; PAM type: NRG; PAM sequence: AGG
gcagaggttgcagtgagccc

SEQ ID NO: 94619 - DNA, 20 bp, Artificial Sequence
  Description of Artificial Sequence: Synthetic oligonucleotide
  Target: ATXN1; (-) strand; PAM type: NRG; PAM sequence: CAG
ggcagaggttgcagtgagcc

SEQ ID NO: 94620 - DNA, 20 bp, Artificial Sequence
  Description of Artificial Sequence: Synthetic oligonucleotide
  Target: ATXN1; (-) strand; PAM type: NRG; PAM sequence: GAG
ctggaggcagaggttgcagt

SEQ ID NO: 94621 - DNA, 20 bp, Artificial Sequence
  Description of Artificial Sequence: Synthetic oligonucleotide
  Target: ATXN1; (-) strand; PAM type: NRG; PAM sequence: CAG
aatcctggaggcagaggttg

SEQ ID NO: 94622 - DNA, 20 bp, Artificial Sequence
  Description of Artificial Sequence: Synthetic oligonucleotide
  Target: ATXN1; (-) strand; PAM type: NRG; PAM sequence: AGG
cgcttgaatcctggaggcag

SEQ ID NO: 94623 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaatcctggaggca

SEQ ID NO: 94624 - DNA, 20 bp, Artificial Sequence
  Description of Artificial Sequence: Synthetic oligonucleotide
  Target: ATXN1; (-) strand; PAM type: NRG; PAM sequence: CAG
aatcgcttgaatcctggagg

SEQ ID NO: 94625 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaatcctgg

SEQ ID NO: 94626 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaatcctg

SEQ ID NO: 94627 - DNA, 20 bp, Artificial Sequence
  Description of Artificial Sequence: Synthetic oligonucleotide
  Target: ATXN1; (-) strand; PAM type: NRG; PAM sequence: TGG
caggagaatcgcttgaatcc

SEQ ID NO: 94628 - DNA, 20 bp, Artificial Sequence
  Description of Artificial Sequence: Synthetic oligonucleotide
  Target: ATXN1; (-) strand; PAM type: NRG; PAM sequence: GAG
tacttgggacactgaggcag

SEQ ID NO: 94629 - DNA, 20 bp, Artificial Sequence
  Description of Artificial Sequence: Synthetic oligonucleotide
  Target: ATXN1; (-) strand; PAM type: NRG; PAM sequence: AGG
gctacttgggacactgaggc

SEQ ID NO: 94630 - DNA, 20 bp, Artificial Sequence
  Description of Artificial Sequence: Synthetic oligonucleotide
  Target: ATXN1; (-) strand; PAM type: NRG; PAM sequence: CAG
agctacttgggacactgagg

SEQ ID NO: 94631 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggacactg

SEQ ID NO: 94632 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggacact

SEQ ID NO: 94633 - DNA, 20 bp, Artificial Sequence
  Description of Artificial Sequence: Synthetic oligonucleotide
  Target: ATXN1; (-) strand; PAM type: NRG; PAM sequence: GGG
tcctgtaatcccagctactt

SEQ ID NO: 94634 - DNA, 20 bp, Artificial Sequence
  Description of Artificial Sequence: Synthetic oligonucleotide
  Target: ATXN1; (-) strand; PAM type: NRG; PAM sequence: TGG
ttcctgtaatcccagctact

SEQ ID NO: 94635 - DNA, 20 bp, Artificial Sequence
  Description of Artificial Sequence: Synthetic oligonucleotide
  Target: ATXN1; (-) strand; PAM type: NRG; PAM sequence: CAG
gtggcaggttcctgtaatcc

SEQ ID NO: 94636 - DNA, 20 bp, Artificial Sequence
  Description of Artificial Sequence: Synthetic oligonucleotide
  Target: ATXN1; (-) strand; PAM type: NRG; PAM sequence: AGG
aattagccaggcattgtggc

SEQ ID NO: 94637 - DNA, 20 bp, Artificial Sequence
  Description of Artificial Sequence: Synthetic oligonucleotide
  Target: ATXN1; (-) strand; PAM type: NRG; PAM sequence: CAG
aaattagccaggcattgtgg

SEQ ID NO: 94638 - DNA, 20 bp, Artificial Sequence
  Description of Artificial Sequence: Synthetic oligonucleotide
  Target: ATXN1; (-) strand; PAM type: NRG; PAM sequence: TGG
taaaaattagccaggcattg

SEQ ID NO: 94639 - DNA, 20 bp, Artificial Sequence
  Description of Artificial Sequence: Synthetic oligonucleotide
  Target: ATXN1; (-) strand; PAM type: NRG; PAM sequence: AGG
taaaaatataaaaattagcc

SEQ ID NO: 94640 - DNA, 20 bp, Artificial Sequence
  Description of Artificial Sequence: Synthetic oligonucleotide
  Target: ATXN1; (-) strand; PAM type: NRG; PAM sequence: CAG
ctaaaaatataaaaattagc

SEQ ID NO: 94641 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatataaaaat

SEQ ID NO: 94642 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagaccagcc

SEQ ID NO: 94643 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagtttgagac

SEQ ID NO: 94644 - DNA, 20 bp, Artificial Sequence
  Description of Artificial Sequence: Synthetic oligonucleotide
  Target: ATXN1; (-) strand; PAM type: NRG; PAM sequence: GAG
tcacttgaggtcaggagttt

SEQ ID NO: 94645 - DNA, 20 bp, Artificial Sequence
  Description of Artificial Sequence: Synthetic oligonucleotide
  Target: ATXN1; (-) strand; PAM type: NRG; PAM sequence: GAG
ggtgaatcacttgaggtcag

SEQ ID NO: 94646 - DNA, 20 bp, Artificial Sequence
  Description of Artificial Sequence: Synthetic oligonucleotide
  Target: ATXN1; (-) strand; PAM type: NRG; PAM sequence: AGG
tgggtgaatcacttgaggtc

SEQ ID NO: 94647 - DNA, 20 bp, Artificial Sequence
  Description of Artificial Sequence: Synthetic oligonucleotide
  Target: ATXN1; (-) strand; PAM type: NRG; PAM sequence: CAG
gtgggtgaatcacttgaggt

SEQ ID NO: 94648 - DNA, 20 bp, Artificial Sequence
  Description of Artificial Sequence: Synthetic oligonucleotide
  Target: ATXN1; (-) strand; PAM type: NRG; PAM sequence: AGG
tgaggtgggtgaatcacttg

SEQ ID NO: 94649 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggtgaatcactt

SEQ ID NO: 94650 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggctgaggt

SEQ ID NO: 94651 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggctgagg

SEQ ID NO: 94652 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggctg

SEQ ID NO: 94653 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggct

SEQ ID NO: 94654 - DNA, 20 bp, Artificial Sequence
  Description of Artificial Sequence: Synthetic oligonucleotide
  Target: ATXN1; (-) strand; PAM type: NRG; PAM sequence: AGG
tttaatcccagcactttggg

SEQ ID NO: 94655 - DNA, 20 bp, Artificial Sequence
  Description of Artificial Sequence: Synthetic oligonucleotide
  Target: ATXN1; (-) strand; PAM type: NRG; PAM sequence: GAG
ctttaatcccagcactttgg

SEQ ID NO: 94656 - DNA, 20 bp, Artificial Sequence
  Description of Artificial Sequence: Synthetic oligonucleotide
  Target: ATXN1; (-) strand; PAM type: NRG; PAM sequence: GGG
gcctttaatcccagcacttt

SEQ ID NO: 94657 - DNA, 20 bp, Artificial Sequence
  Description of Artificial Sequence: Synthetic oligonucleotide
  Target: ATXN1; (-) strand; PAM type: NRG; PAM sequence: TGG
tgcctttaatcccagcactt

SEQ ID NO: 94658 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctttaatcc

SEQ ID NO: 94659 - DNA, 20 bp, Artificial Sequence
  Description of Artificial Sequence: Synthetic oligonucleotide
  Target: ATXN1; (-) strand; PAM type: NRG; PAM sequence: TGG
gtagggtgggccaggcacag

SEQ ID NO: 94660 - DNA, 20 bp, Artificial Sequence
  Description of Artificial Sequence: Synthetic oligonucleotide
  Target: ATXN1; (-) strand; PAM type: NRG; PAM sequence: CAG
aaggtagggtgggccaggca

SEQ ID NO: 94661 - DNA, 20 bp, Artificial Sequence
  Description of Artificial Sequence: Synthetic oligonucleotide
  Target: ATXN1; (-) strand; PAM type: NRG; PAM sequence: AGG
tgaaaaaggtagggtgggcc

SEQ ID NO: 94662 - DNA, 20 bp, Artificial Sequence
  Description of Artificial Sequence: Synthetic oligonucleotide
  Target: ATXN1; (-) strand; PAM type: NRG; PAM sequence: CAG
atgaaaaaggtagggtgggc

SEQ ID NO: 94663 - DNA, 20 bp, Artificial Sequence
  Description of Artificial Sequence: Synthetic oligonucleotide
  Target: ATXN1; (-) strand; PAM type: NRG; PAM sequence: GGG
ctgaatgaaaaaggtagggt

SEQ ID NO: 94664 - DNA, 20 bp, Artificial Sequence
  Description of Artificial Sequence: Synthetic oligonucleotide
  Target: ATXN1; (-) strand; PAM type: NRG; PAM sequence: TGG
gctgaatgaaaaaggtaggg

SEQ ID NO: 94665 - DNA, 20 bp, Artificial Sequence
  Description of Artificial Sequence: Synthetic oligonucleotide
  Target: ATXN1; (-) strand; PAM type: NRG; PAM sequence: GGG
tcagctgaatgaaaaaggta

SEQ ID NO: 94666 - DNA, 20 bp, Artificial Sequence
  Description of Artificial Sequence: Synthetic oligonucleotide
  Target: ATXN1; (-) strand; PAM type: NRG; PAM sequence: AGG
gtcagctgaatgaaaaaggt

SEQ ID NO: 94667 - DNA, 20 bp, Artificial Sequence
  Description of Artificial Sequence: Synthetic oligonucleotide
  Target: ATXN1; (-) strand; PAM type: NRG; PAM sequence: TAG
tgtcagctgaatgaaaaagg

SEQ ID NO: 94668 - DNA, 20 bp, Artificial Sequence
  Description of Artificial Sequence: Synthetic oligonucleotide
  Target: ATXN1; (-) strand; PAM type: NRG; PAM sequence: AGG
aagtgtcagctgaatgaaaa

SEQ ID NO: 94669 - DNA, 20 bp, Artificial Sequence
  Description of Artificial Sequence: Synthetic oligonucleotide
  Target: ATXN1; (-) strand; PAM type: NRG; PAM sequence: AAG
caagtgtcagctgaatgaaa

SEQ ID NO: 94670 - DNA, 20 bp, Artificial Sequence
  Description of Artificial Sequence: Synthetic oligonucleotide
  Target: ATXN1; (-) strand; PAM type: NRG; PAM sequence: CAG
ctcttaagatctacaagtgt

SEQ ID NO: 94671 - DNA, 20 bp, Artificial Sequence
  Description of Artificial Sequence: Synthetic oligonucleotide
  Target: ATXN1; (-) strand; PAM type: NRG; PAM sequence: AAG
gtaagcctcttaagatctac

SEQ ID NO: 94672 - DNA, 20 bp, Artificial Sequence
  Description of Artificial Sequence: Synthetic oligonucleotide
  Target: ATXN1; (-) strand; PAM type: NRG; PAM sequence: AAG
catgcaaaggtaagcctctt

SEQ ID NO: 94673 - DNA, 20 bp, Artificial Sequence
  Description of Artificial Sequence: Synthetic oligonucleotide
  Target: ATXN1; (-) strand; PAM type: NRG; PAM sequence: AAG
ctaaagttacatgcaaaggt

SEQ ID NO: 94674 - DNA, 20 bp, Artificial Sequence
  Description of Artificial Sequence: Synthetic oligonucleotide
  Target: ATXN1; (-) strand; PAM type: NRG; PAM sequence: AGG
taacctaaagttacatgcaa

SEQ ID NO: 94675 - DNA, 20 bp, Artificial Sequence
  Description of Artificial Sequence: Synthetic oligonucleotide
  Target: ATXN1; (-) strand; PAM type: NRG; PAM sequence: AAG
gtaacctaaagttacatgca

SEQ ID NO: 94676 - DNA, 20 bp, Artificial Sequence
  Description of Artificial Sequence: Synthetic oligonucleotide
  Target: ATXN1; (-) strand; PAM type: NRG; PAM sequence: AAG
ttaagtggaaatgtaaccta

SEQ ID NO: 94677 - DNA, 20 bp, Artificial Sequence
  Description of Artificial Sequence: Synthetic oligonucleotide
  Target: ATXN1; (-) strand; PAM type: NRG; PAM sequence: TGG
ttagagaggtgttctttaag

SEQ ID NO: 94678 - DNA, 20 bp, Artificial Sequence
  Description of Artificial Sequence: Synthetic oligonucleotide
  Target: ATXN1; (-) strand; PAM type: NRG; PAM sequence: AAG
ggattagagaggtgttcttt

SEQ ID NO: 94679 - DNA, 20 bp, Artificial Sequence
  Description of Artificial Sequence: Synthetic oligonucleotide
  Target: ATXN1; (-) strand; PAM type: NRG; PAM sequence: AGG
ttattggctgtggattagag

SEQ ID NO: 94680 - DNA, 20 bp, Artificial Sequence
  Description of Artificial Sequence: Synthetic oligonucleotide
  Target: ATXN1; (-) strand; PAM type: NRG; PAM sequence: GAG
tttattggctgtggattaga

SEQ ID NO: 94681 - DNA, 20 bp, Artificial Sequence
  Description of Artificial Sequence: Synthetic oligonucleotide
  Target: ATXN1; (-) strand; PAM type: NRG; PAM sequence: GAG
attttattggctgtggatta

SEQ ID NO: 94682 - DNA, 20 bp, Artificial Sequence
  Description of Artificial Sequence: Synthetic oligonucleotide
  Target: ATXN1; (-) strand; PAM type: NRG; PAM sequence: TAG
acattttattggctgtggat

SEQ ID NO: 94683 - DNA, 20 bp, Artificial Sequence
  Description of Artificial Sequence: Synthetic oligonucleotide
  Target: ATXN1; (-) strand; PAM type: NRG; PAM sequence: TGG
tccttacattttattggctg

SEQ ID NO: 94684 - DNA, 20 bp, Artificial Sequence
  Description of Artificial Sequence: Synthetic oligonucleotide
  Target: ATXN1; (-) strand; PAM type: NRG; PAM sequence: TGG
ctggattccttacattttat

SEQ ID NO: 94685 - DNA, 20 bp, Artificial Sequence
  Description of Artificial Sequence: Synthetic oligonucleotide
  Target: ATXN1; (-) strand; PAM type: NRG; PAM sequence: TGG
actcttgtaaaatatggaac

SEQ ID NO: 94686 - DNA, 20 bp, Artificial Sequence
  Description of Artificial Sequence: Synthetic oligonucleotide
  Target: ATXN1; (-) strand; PAM type: NRG; PAM sequence: TGG
cacgatactcttgtaaaata

SEQ ID NO: 94687 - DNA, 20 bp, Artificial Sequence
  Description of Artificial Sequence: Synthetic oligonucleotide
  Target: ATXN1; (-) strand; PAM type: NRG; PAM sequence: CAG
ggaggagggaagagtcatca

SEQ ID NO: 94688 - DNA, 20 bp, Artificial Sequence
  Description of Artificial Sequence: Synthetic oligonucleotide
  Target: ATXN1; (-) strand; PAM type: NRG; PAM sequence: GAG
ggacaaggtggaggagggaa

SEQ ID NO: 94689 - DNA, 20 bp, Artificial Sequence
  Description of Artificial Sequence: Synthetic oligonucleotide
  Target: ATXN1; (-) strand; PAM type: NRG; PAM sequence: AAG
ggggacaaggtggaggaggg

SEQ ID NO: 94690 - DNA, 20 bp, Artificial Sequence
  Description of Artificial Sequence: Synthetic oligonucleotide
  Target: ATXN1; (-) strand; PAM type: NRG; PAM sequence: GGG
gtgggggacaaggtggagga

SEQ ID NO: 94691 - DNA, 20 bp, Artificial Sequence
  Description of Artificial Sequence: Synthetic oligonucleotide
  Target: ATXN1; (-) strand; PAM type: NRG; PAM sequence: AGG
agtgggggacaaggtggagg

SEQ ID NO: 94692 - DNA, 20 bp, Artificial Sequence
  Description of Artificial Sequence: Synthetic oligonucleotide
  Target: ATXN1; (-) strand; PAM type: NRG; PAM sequence: GAG
cagtgggggacaaggtggag

SEQ ID NO: 94693 - DNA, 20 bp, Artificial Sequence
  Description of Artificial Sequence: Synthetic oligonucleotide
  Target: ATXN1; (-) strand; PAM type: NRG; PAM sequence: AGG
cccagtgggggacaaggtgg

SEQ ID NO: 94694 - DNA, 20 bp, Artificial Sequence
  Description of Artificial Sequence: Synthetic oligonucleotide
  Target: ATXN1; (-) strand; PAM type: NRG; PAM sequence: GAG
tcccagtgggggacaaggtg

SEQ ID NO: 94695 - DNA, 20 bp, Artificial Sequence
  Description of Artificial Sequence: Synthetic oligonucleotide
  Target: ATXN1; (-) strand; PAM type: NRG; PAM sequence: TGG
agtcccagtgggggacaagg

SEQ ID NO: 94696 - DNA, 20 bp, Artificial Sequence
  Description of Artificial Sequence: Synthetic oligonucleotide
  Target: ATXN1; (-) strand; PAM type: NRG; PAM sequence: AGG
aaaagtcccagtgggggaca

SEQ ID NO: 94697 - DNA, 20 bp, Artificial Sequence
  Description of Artificial Sequence: Synthetic oligonucleotide
  Target: ATXN1; (-) strand; PAM type: NRG; PAM sequence: AAG
aaaaagtcccagtgggggac

SEQ ID NO: 94698 - DNA, 20 bp, Artificial Sequence
  Description of Artificial Sequence: Synthetic oligonucleotide
  Target: ATXN1; (-) strand; PAM type: NRG; PAM sequence: GGG
agccaaaaaagtcccagtgg

SEQ ID NO: 94699 - DNA, 20 bp, Artificial Sequence
  Description of Artificial Sequence: Synthetic oligonucleotide
  Target: ATXN1; (-) strand; PAM type: NRG; PAM sequence: GGG
cagccaaaaaagtcccagtg

SEQ ID NO: 94700 - DNA, 20 bp, Artificial Sequence
  Description of Artificial Sequence: Synthetic oligonucleotide
  Target: ATXN1; (-) strand; PAM type: NRG; PAM sequence: GGG
acagccaaaaaagtcccagt

SEQ ID NO: 94701 - DNA, 20 bp, Artificial Sequence
  Description of Artificial Sequence: Synthetic oligonucleotide
  Target: ATXN1; (-) strand; PAM type: NRG; PAM sequence: TGG
aacagccaaaaaagtcccag

SEQ ID NO: 94702 - DNA, 20 bp, Artificial Sequence
  Description of Artificial Sequence: Synthetic oligonucleotide
  Target: ATXN1; (-) strand; PAM type: NRG; PAM sequence: CAG
aaaaacagccaaaaaagtcc

SEQ ID NO: 94703 - DNA, 20 bp, Artificial Sequence
  Description of Artificial Sequence: Synthetic oligonucleotide
  Target: ATXN1; (-) strand; PAM type: NRG; PAM sequence: AAG
ctcaggaaaaacagccaaaa

SEQ ID NO: 94704 - DNA, 20 bp, Artificial Sequence
  Description of Artificial Sequence: Synthetic oligonucleotide
  Target: ATXN1; (-) strand; PAM type: NRG; PAM sequence: CAG
gtattatgcctcaggaaaaa

SEQ ID NO: 94705 - DNA, 20 bp, Artificial Sequence
  Description of Artificial Sequence: Synthetic oligonucleotide
  Target: ATXN1; (-) strand; PAM type: NRG; PAM sequence: AGG
tgactgaagtattatgcctc

SEQ ID NO: 94706 - DNA, 20 bp, Artificial Sequence
  Description of Artificial Sequence: Synthetic oligonucleotide
  Target: ATXN1; (-) strand; PAM type: NRG; PAM sequence: CAG
gtgactgaagtattatgcct

SEQ ID NO: 94707 - DNA, 20 bp, Artificial Sequence
  Description of Artificial Sequence: Synthetic oligonucleotide
  Target: ATXN1; (-) strand; PAM type: NRG; PAM sequence: AAG
aacaaaaacctgagtgactg

SEQ ID NO: 94708 - DNA, 20 bp, Artificial Sequence
  Description of Artificial Sequence: Synthetic oligonucleotide
  Target: ATXN1; (-) strand; PAM type: NRG; PAM sequence: GAG
gtaaaaataaacaaaaacct

SEQ ID NO: 94709 - DNA, 20 bp, Artificial Sequence
  Description of Artificial Sequence: Synthetic oligonucleotide
  Target: ATXN1; (-) strand; PAM type: NRG; PAM sequence: GAG
aatgtggttatttgtggtct

SEQ ID NO: 94710 - DNA, 20 bp, Artificial Sequence
  Description of Artificial Sequence: Synthetic oligonucleotide
  Target: ATXN1; (-) strand; PAM type: NRG; PAM sequence: TGG
tgcataaatgtggttatttg

SEQ ID NO: 94711 - DNA, 20 bp, Artificial Sequence
  Description of Artificial Sequence: Synthetic oligonucleotide
  Target: ATXN1; (-) strand; PAM type: NRG; PAM sequence: TGG
atgaattgcatgcataaatg

SEQ ID NO: 94712 - DNA, 20 bp, Artificial Sequence
  Description of Artificial Sequence: Synthetic oligonucleotide
  Target: ATXN1; (-) strand; PAM type: NRG; PAM sequence: TAG
atgtgtggtttttttttttt

SEQ ID NO: 94713 - DNA, 20 bp, Artificial Sequence
  Description of Artificial Sequence: Synthetic oligonucleotide
  Target: ATXN1; (-) strand; PAM type: NRG; PAM sequence: TGG
tgactgatgggatgcatgtg

SEQ ID NO: 94714 - DNA, 20 bp, Artificial Sequence
  Description of Artificial Sequence: Synthetic oligonucleotide
  Target: ATXN1; (-) strand; PAM type: NRG; PAM sequence: GGG
atcacaactctctgactgat

SEQ ID NO: 94715 - DNA, 20 bp, Artificial Sequence
  Description of Artificial Sequence: Synthetic oligonucleotide
  Target: ATXN1; (-) strand; PAM type: NRG; PAM sequence: TGG
tatcacaactctctgactga

SEQ ID NO: 94716 - DNA, 20 bp, Artificial Sequence
  Description of Artificial Sequence: Synthetic oligonucleotide
  Target: ATXN1; (-) strand; PAM type: NRG; PAM sequence: GAG
tacggctctgcaaagccaag

SEQ ID NO: 94717 - DNA, 20 bp, Artificial Sequence
  Description of Artificial Sequence: Synthetic oligonucleotide
  Target: ATXN1; (-) strand; PAM type: NRG; PAM sequence: AGG
tctacggctctgcaaagcca

SEQ ID NO: 94718 - DNA, 20 bp, Artificial Sequence
  Description of Artificial Sequence: Synthetic oligonucleotide
  Target: ATXN1; (-) strand; PAM type: NRG; PAM sequence: AAG
atctacggctctgcaaagcc

SEQ ID NO: 94719 - DNA, 20 bp, Artificial Sequence
  Description of Artificial Sequence: Synthetic oligonucleotide
  Target: ATXN1; (-) strand; PAM type: NRG; PAM sequence: AAG
tagacatctacggctctgca

SEQ ID NO: 94720 - DNA, 20 bp, Artificial Sequence
  Description of Artificial Sequence: Synthetic oligonucleotide
  Target: ATXN1; (-) strand; PAM type: NRG; PAM sequence: CGG
acccaccctgtagacatcta

SEQ ID NO: 94721 - DNA, 20 bp, Artificial Sequence
  Description of Artificial Sequence: Synthetic oligonucleotide
  Target: ATXN1; (-) strand; PAM type: NRG; PAM sequence: TAG
tggtctttggacccaccctg

SEQ ID NO: 94722 - DNA, 20 bp, Artificial Sequence
  Description of Artificial Sequence: Synthetic oligonucleotide
  Target: ATXN1; (-) strand; PAM type: NRG; PAM sequence: TGG
tatacctggaccttggtctt

SEQ ID NO: 94723 - DNA, 20 bp, Artificial Sequence
  Description of Artificial Sequence: Synthetic oligonucleotide
  Target: ATXN1; (-) strand; PAM type: NRG; PAM sequence: TGG
atgtaaatatacctggacct

SEQ ID NO: 94724 - DNA, 20 bp, Artificial Sequence
  Description of Artificial Sequence: Synthetic oligonucleotide
  Target: ATXN1; (-) strand; PAM type: NRG; PAM sequence: TGG
tagaaatatgtaaatatacc

SEQ ID NO: 94725 - DNA, 20 bp, Artificial Sequence
  Description of Artificial Sequence: Synthetic oligonucleotide
  Target: ATXN1; (-) strand; PAM type: NRG; PAM sequence: TAG
gctcctgaaccatacatgac

SEQ ID NO: 94726 - DNA, 20 bp, Artificial Sequence
  Description of Artificial Sequence: Synthetic oligonucleotide
  Target: ATXN1; (-) strand; PAM type: NRG; PAM sequence: TGG
gttatggtcatgttttatga

SEQ ID NO: 94727 - DNA, 20 bp, Artificial Sequence
  Description of Artificial Sequence: Synthetic oligonucleotide
  Target: ATXN1; (-) strand; PAM type: NRG; PAM sequence: TGG
cctcaacaggttgattgtta

SEQ ID NO: 94728 - DNA, 20 bp, Artificial Sequence
  Description of Artificial Sequence: Synthetic oligonucleotide
  Target: ATXN1; (-) strand; PAM type: NRG; PAM sequence: AGG
caagtaacttatccctcaac

SEQ ID NO: 94729 - DNA, 20 bp, Artificial Sequence
  Description of Artificial Sequence: Synthetic oligonucleotide
  Target: ATXN1; (-) strand; PAM type: NRG; PAM sequence: CAG
tcaagtaacttatccctcaa

SEQ ID NO: 94730 - DNA, 20 bp, Artificial Sequence
  Description of Artificial Sequence: Synthetic oligonucleotide
  Target: ATXN1; (-) strand; PAM type: NRG; PAM sequence: AAG
atcttttaacagatgctatc

SEQ ID NO: 94731 - DNA, 20 bp, Artificial Sequence
  Description of Artificial Sequence: Synthetic oligonucleotide
  Target: ATXN1; (-) strand; PAM type: NRG; PAM sequence: CAG
gtatggtttgtatcttttaa

SEQ ID NO: 94732 - DNA, 20 bp, Artificial Sequence
  Description of Artificial Sequence: Synthetic oligonucleotide
  Target: ATXN1; (-) strand; PAM type: NRG; PAM sequence: TGG
gtagaatagtacctggtgta

SEQ ID NO: 94733 - DNA, 20 bp, Artificial Sequence
  Description of Artificial Sequence: Synthetic oligonucleotide
  Target: ATXN1; (-) strand; PAM type: NRG; PAM sequence: TGG
actgtgggtagaatagtacc

SEQ ID NO: 94734 - DNA, 20 bp, Artificial Sequence
  Description of Artificial Sequence: Synthetic oligonucleotide
  Target: ATXN1; (-) strand; PAM type: NRG; PAM sequence: TAG
tagatatactgtgggtagaa

SEQ ID NO: 94735 - DNA, 20 bp, Artificial Sequence
  Description of Artificial Sequence: Synthetic oligonucleotide
  Target: ATXN1; (-) strand; PAM type: NRG; PAM sequence: TAG
aatagtagatatactgtggg

SEQ ID NO: 94736 - DNA, 20 bp, Artificial Sequence
  Description of Artificial Sequence: Synthetic oligonucleotide
  Target: ATXN1; (-) strand; PAM type: NRG; PAM sequence: GGG
taaaatagtagatatactgt

SEQ ID NO: 94737 - DNA, 20 bp, Artificial Sequence
  Description of Artificial Sequence: Synthetic oligonucleotide
  Target: ATXN1; (-) strand; PAM type: NRG; PAM sequence: TGG
gtaaaatagtagatatactg

SEQ ID NO: 94738 - DNA, 20 bp, Artificial Sequence
  Description of Artificial Sequence: Synthetic oligonucleotide
  Target: ATXN1; (-) strand; PAM type: NRG; PAM sequence: TAG
gatggactggagtaaaatag

SEQ ID NO: 94739 - DNA, 20 bp, Artificial Sequence
  Description of Artificial Sequence: Synthetic oligonucleotide
  Target: ATXN1; (-) strand; PAM type: NRG; PAM sequence: TAG
gaggatggactggagtaaaa

SEQ ID NO: 94740 - DNA, 20 bp, Artificial Sequence
  Description of Artificial Sequence: Synthetic oligonucleotide
  Target: ATXN1; (-) strand; PAM type: NRG; PAM sequence: GAG
gctgctgtgaggatggactg

SEQ ID NO: 94741 - DNA, 20 bp, Artificial Sequence
  Description of Artificial Sequence: Synthetic oligonucleotide
  Target: ATXN1; (-) strand; PAM type: NRG; PAM sequence: TGG
gggctgctgtgaggatggac

SEQ ID NO: 94742 - DNA, 20 bp, Artificial Sequence
  Description of Artificial Sequence: Synthetic oligonucleotide
  Target: ATXN1; (-) strand; PAM type: NRG; PAM sequence: TGG
ttatagggctgctgtgagga

SEQ ID NO: 94743 - DNA, 20 bp, Artificial Sequence
  Description of Artificial Sequence: Synthetic oligonucleotide
  Target: ATXN1; (-) strand; PAM type: NRG; PAM sequence: AGG
tttcttatagggctgctgtg

SEQ ID NO: 94744 - DNA, 20 bp, Artificial Sequence
  Description of Artificial Sequence: Synthetic oligonucleotide
  Target: ATXN1; (-) strand; PAM type: NRG; PAM sequence: GAG
ctttcttatagggctgctgt

SEQ ID NO: 94745 - DNA, 20 bp, Artificial Sequence
  Description of Artificial Sequence: Synthetic oligonucleotide
  Target: ATXN1; (-) strand; PAM type: NRG; PAM sequence: GGG
aatattagaactttcttata

SEQ ID NO: 94746 - DNA, 20 bp, Artificial Sequence
  Description of Artificial Sequence: Synthetic oligonucleotide
  Target: ATXN1; (-) strand; PAM type: NRG; PAM sequence: AGG
taatattagaactttcttat

SEQ ID NO: 94747 - DNA, 20 bp, Artificial Sequence
  Description of Artificial Sequence: Synthetic oligonucleotide
  Target: ATXN1; (-) strand; PAM type: NRG; PAM sequence: TAG
gtaatattagaactttctta

SEQ ID NO: 94748 - DNA, 20 bp, Artificial Sequence
  Description of Artificial Sequence: Synthetic oligonucleotide
  Target: ATXN1; (-) strand; PAM type: NRG; PAM sequence: TAG
gtataagatggaggtaatat

SEQ ID NO: 94749 - DNA, 20 bp, Artificial Sequence
  Description of Artificial Sequence: Synthetic oligonucleotide
  Target: ATXN1; (-) strand; PAM type: NRG; PAM sequence: AGG
tttattcatgtataagatgg

SEQ ID NO: 94750 - DNA, 20 bp, Artificial Sequence
  Description of Artificial Sequence: Synthetic oligonucleotide
  Target: ATXN1; (-) strand; PAM type: NRG; PAM sequence: GAG
gtttattcatgtataagatg

SEQ ID NO: 94751 - DNA, 20 bp, Artificial Sequence
  Description of Artificial Sequence: Synthetic oligonucleotide
  Target: ATXN1; (-) strand; PAM type: NRG; PAM sequence: TGG
cagtttattcatgtataaga

SEQ ID NO: 94752 - DNA, 20 bp, Artificial Sequence
  Description of Artificial Sequence: Synthetic oligonucleotide
  Target: ATXN1; (-) strand; PAM type: NRG; PAM sequence: AAG
gcctcagtttattcatgtat

SEQ ID NO: 94753 - DNA, 20 bp, Artificial Sequence
  Description of Artificial Sequence: Synthetic oligonucleotide
  Target: ATXN1; (-) strand; PAM type: NRG; PAM sequence: CAG
cctatgtcctttcaatgcct

SEQ ID NO: 94754 - DNA, 20 bp, Artificial Sequence
  Description of Artificial Sequence: Synthetic oligonucleotide
  Target: ATXN1; (-) strand; PAM type: NRG; PAM sequence: TAG
gctgccactatgaccttgag

SEQ ID NO: 94755 - DNA, 20 bp, Artificial Sequence
  Description of Artificial Sequence: Synthetic oligonucleotide
  Target: ATXN1; (-) strand; PAM type: NRG; PAM sequence: GAG
ggagctgccactatgacctt

SEQ ID NO: 94756 - DNA, 20 bp, Artificial Sequence
  Description of Artificial Sequence: Synthetic oligonucleotide
  Target: ATXN1; (-) strand; PAM type: NRG; PAM sequence: GAG
ccatctggacttaagatctg

SEQ ID NO: 94757 - DNA, 20 bp, Artificial Sequence
  Description of Artificial Sequence: Synthetic oligonucleotide
  Target: ATXN1; (-) strand; PAM type: NRG; PAM sequence: TGG
acccatctggacttaagatc

SEQ ID NO: 94758 - DNA, 20 bp, Artificial Sequence
  Description of Artificial Sequence: Synthetic oligonucleotide
  Target: ATXN1; (-) strand; PAM type: NRG; PAM sequence: AAG
taatcaacccatctggactt

SEQ ID NO: 94759 - DNA, 20 bp, Artificial Sequence
  Description of Artificial Sequence: Synthetic oligonucleotide
  Target: ATXN1; (-) strand; PAM type: NRG; PAM sequence: TGG
agctccgtaatcaacccatc

SEQ ID NO: 94760 - DNA, 20 bp, Artificial Sequence
  Description of Artificial Sequence: Synthetic oligonucleotide
  Target: ATXN1; (-) strand; PAM type: NRG; PAM sequence: GAG
gcatcttagataagagcatg

SEQ ID NO: 94761 - DNA, 20 bp, Artificial Sequence
  Description of Artificial Sequence: Synthetic oligonucleotide
  Target: ATXN1; (-) strand; PAM type: NRG; PAM sequence: TGG
tggcatcttagataagagca

SEQ ID NO: 94762 - DNA, 20 bp, Artificial Sequence
  Description of Artificial Sequence: Synthetic oligonucleotide
  Target: ATXN1; (-) strand; PAM type: NRG; PAM sequence: GAG
ttctctggcatcttagataa

SEQ ID NO: 94763 - DNA, 20 bp, Artificial Sequence
  Description of Artificial Sequence: Synthetic oligonucleotide
  Target: ATXN1; (-) strand; PAM type: NRG; PAM sequence: AAG
aattctctggcatcttagat

SEQ ID NO: 94764 - DNA, 20 bp, Artificial Sequence
  Description of Artificial Sequence: Synthetic oligonucleotide
  Target: ATXN1; (-) strand; PAM type: NRG; PAM sequence: TAG
atataaattctctggcatct

SEQ ID NO: 94765 - DNA, 20 bp, Artificial Sequence
  Description of Artificial Sequence: Synthetic oligonucleotide
  Target: ATXN1; (-) strand; PAM type: NRG; PAM sequence: TGG
taagttacatataaattctc

SEQ ID NO: 94766 - DNA, 20 bp, Artificial Sequence
  Description of Artificial Sequence: Synthetic oligonucleotide
  Target: ATXN1; (-) strand; PAM type: NRG; PAM sequence: AAG
taccgtaagagccaattttt

SEQ ID NO: 94767 - DNA, 20 bp, Artificial Sequence
  Description of Artificial Sequence: Synthetic oligonucleotide
  Target: ATXN1; (-) strand; PAM type: NRG; PAM sequence: GAG
gagctgcctctttaccgtaa

SEQ ID NO: 94768 - DNA, 20 bp, Artificial Sequence
  Description of Artificial Sequence: Synthetic oligonucleotide
  Target: ATXN1; (-) strand; PAM type: NRG; PAM sequence: AAG
aagagctgcctctttaccgt

SEQ ID NO: 94769 - DNA, 20 bp, Artificial Sequence
  Description of Artificial Sequence: Synthetic oligonucleotide
  Target: ATXN1; (-) strand; PAM type: NRG; PAM sequence: GAG
accagatttctttgaagaaa

SEQ ID NO: 94770 - DNA, 20 bp, Artificial Sequence
  Description of Artificial Sequence: Synthetic oligonucleotide
  Target: ATXN1; (-) strand; PAM type: NRG; PAM sequence: AAG
tgaccagatttctttgaaga

SEQ ID NO: 94771 - DNA, 20 bp, Artificial Sequence
  Description of Artificial Sequence: Synthetic oligonucleotide
  Target: ATXN1; (-) strand; PAM type: NRG; PAM sequence: AAG
taattgaccagatttctttg

SEQ ID NO: 94772 - DNA, 20 bp, Artificial Sequence
  Description of Artificial Sequence: Synthetic oligonucleotide
  Target: ATXN1; (-) strand; PAM type: NRG; PAM sequence: CAG
tcatttaaacaataattgac

SEQ ID NO: 94773 - DNA, 20 bp, Artificial Sequence
  Description of Artificial Sequence: Synthetic oligonucleotide
  Target: ATXN1; (-) strand; PAM type: NRG; PAM sequence: AGG
atggatatttgctttataac

SEQ ID NO: 94774 - DNA, 20 bp, Artificial Sequence
  Description of Artificial Sequence: Synthetic oligonucleotide
  Target: ATXN1; (-) strand; PAM type: NRG; PAM sequence: CAG
gatggatatttgctttataa

SEQ ID NO: 94775 - DNA, 20 bp, Artificial Sequence
  Description of Artificial Sequence: Synthetic oligonucleotide
  Target: ATXN1; (-) strand; PAM type: NRG; PAM sequence: TGG
ctcatttttcaagaggtaga

SEQ ID NO: 94776 - DNA, 20 bp, Artificial Sequence
  Description of Artificial Sequence: Synthetic oligonucleotide
  Target: ATXN1; (-) strand; PAM type: NRG; PAM sequence: TAG
aaaactcatttttcaagagg

SEQ ID NO: 94777 - DNA, 20 bp, Artificial Sequence
  Description of Artificial Sequence: Synthetic oligonucleotide
  Target: ATXN1; (-) strand; PAM type: NRG; PAM sequence: AGG
ttcaaaactcatttttcaag

SEQ ID NO: 94778 - DNA, 20 bp, Artificial Sequence
  Description of Artificial Sequence: Synthetic oligonucleotide
  Target: ATXN1; (-) strand; PAM type: NRG; PAM sequence: GAG
tttcaaaactcatttttcaa

SEQ ID NO: 94779 - DNA, 20 bp, Artificial Sequence
  Description of Artificial Sequence: Synthetic oligonucleotide
  Target: ATXN1; (-) strand; PAM type: NRG; PAM sequence: AAG
attttcaaaactcatttttc

SEQ ID NO: 94780 - DNA, 20 bp, Artificial Sequence
  Description of Artificial Sequence: Synthetic oligonucleotide
  Target: ATXN1; (-) strand; PAM type: NRG; PAM sequence: TAG
tgagaagctcattctacttt

SEQ ID NO: 94781 - DNA, 20 bp, Artificial Sequence
  Description of Artificial Sequence: Synthetic oligonucleotide
  Target: ATXN1; (-) strand; PAM type: NRG; PAM sequence: AAG
ctgtagacttagttggtgag

SEQ ID NO: 94782 - DNA, 20 bp, Artificial Sequence
  Description of Artificial Sequence: Synthetic oligonucleotide
  Target: ATXN1; (-) strand; PAM type: NRG; PAM sequence: GAG
gttctgtagacttagttggt

SEQ ID NO: 94783 - DNA, 20 bp, Artificial Sequence
  Description of Artificial Sequence: Synthetic oligonucleotide
  Target: ATXN1; (-) strand; PAM type: NRG; PAM sequence: TGG
ttatgttctgtagacttagt

SEQ ID NO: 94784 - DNA, 20 bp, Artificial Sequence
  Description of Artificial Sequence: Synthetic oligonucleotide
  Target: ATXN1; (-) strand; PAM type: NRG; PAM sequence: TAG
taagttatgttctgtagact

SEQ ID NO: 94785 - DNA, 20 bp, Artificial Sequence
  Description of Artificial Sequence: Synthetic oligonucleotide
  Target: ATXN1; (-) strand; PAM type: NRG; PAM sequence: TAG
tcttcctaagttatgttctg

SEQ ID NO: 94786 - DNA, 20 bp, Artificial Sequence
  Description of Artificial Sequence: Synthetic oligonucleotide
  Target: ATXN1; (-) strand; PAM type: NRG; PAM sequence: AAG
gtcttccagcaactcttcct

SEQ ID NO: 94787 - DNA, 20 bp, Artificial Sequence
  Description of Artificial Sequence: Synthetic oligonucleotide
  Target: ATXN1; (-) strand; PAM type: NRG; PAM sequence: CAG
ccctgggtcggccggtcttc

SEQ ID NO: 94788 - DNA, 20 bp, Artificial Sequence
  Description of Artificial Sequence: Synthetic oligonucleotide
  Target: ATXN1; (-) strand; PAM type: NRG; PAM sequence: CGG
ttgggaacccctgggtcggc

SEQ ID NO: 94789 - DNA, 20 bp, Artificial Sequence
  Description of Artificial Sequence: Synthetic oligonucleotide
  Target: ATXN1; (-) strand; PAM type: NRG; PAM sequence: CGG
aggtttgggaacccctgggt

SEQ ID NO: 94790 - DNA, 20 bp, Artificial Sequence
  Description of Artificial Sequence: Synthetic oligonucleotide
  Target: ATXN1; (-) strand; PAM type: NRG; PAM sequence: GGG
ccacaggtttgggaacccct

SEQ ID NO: 94791 - DNA, 20 bp, Artificial Sequence
  Description of Artificial Sequence: Synthetic oligonucleotide
  Target: ATXN1; (-) strand; PAM type: NRG; PAM sequence: TGG
tccacaggtttgggaacccc

SEQ ID NO: 94792 - DNA, 20 bp, Artificial Sequence
  Description of Artificial Sequence: Synthetic oligonucleotide
  Target: ATXN1; (-) strand; PAM type: NRG; PAM sequence: GGG
cactgatgctccacaggttt

SEQ ID NO: 94793 - DNA, 20 bp, Artificial Sequence
  Description of Artificial Sequence: Synthetic oligonucleotide
  Target: ATXN1; (-) strand; PAM type: NRG; PAM sequence: TGG
gcactgatgctccacaggtt

SEQ ID NO: 94794 - DNA, 20 bp, Artificial Sequence
  Description of Artificial Sequence: Synthetic oligonucleotide
  Target: ATXN1; (-) strand; PAM type: NRG; PAM sequence: AGG
tctaggcactgatgctccac

SEQ ID NO: 94795 - DNA, 20 bp, Artificial Sequence
  Description of Artificial Sequence: Synthetic oligonucleotide
  Target: ATXN1; (-) strand; PAM type: NRG; PAM sequence: CAG
gtctaggcactgatgctcca

SEQ ID NO: 94796 - DNA, 20 bp, Artificial Sequence
  Description of Artificial Sequence: Synthetic oligonucleotide
  Target: ATXN1; (-) strand; PAM type: NRG; PAM sequence: AGG
ctggaatcattgatctgtct

SEQ ID NO: 94797 - DNA, 20 bp, Artificial Sequence
  Description of Artificial Sequence: Synthetic oligonucleotide
  Target: ATXN1; (-) strand; PAM type: NRG; PAM sequence: TAG
gctggaatcattgatctgtc

SEQ ID NO: 94798 - DNA, 20 bp, Artificial Sequence
  Description of Artificial Sequence: Synthetic oligonucleotide
  Target: ATXN1; (-) strand; PAM type: NRG; PAM sequence: TGG
tgaatcagaatgtttcctgc

SEQ ID NO: 94799 - DNA, 20 bp, Artificial Sequence
  Description of Artificial Sequence: Synthetic oligonucleotide
  Target: ATXN1; (-) strand; PAM type: NRG; PAM sequence: CAG
ccaccctagacttgatgaat

SEQ ID NO: 94800 - DNA, 20 bp, Artificial Sequence
  Description of Artificial Sequence: Synthetic oligonucleotide
  Target: ATXN1; (-) strand; PAM type: NRG; PAM sequence: TAG
tagaatttggagctccaccc

SEQ ID NO: 94801 - DNA, 20 bp, Artificial Sequence
  Description of Artificial Sequence: Synthetic oligonucleotide
  Target: ATXN1; (-) strand; PAM type: NRG; PAM sequence: GAG
gcttaaaaaaatagaatttg

SEQ ID NO: 94802 - DNA, 20 bp, Artificial Sequence
  Description of Artificial Sequence: Synthetic oligonucleotide
  Target: ATXN1; (-) strand; PAM type: NRG; PAM sequence: TGG
gagcttaaaaaaatagaatt

SEQ ID NO: 94803 - DNA, 20 bp, Artificial Sequence
  Description of Artificial Sequence: Synthetic oligonucleotide
  Target: ATXN1; (-) strand; PAM type: NRG; PAM sequence: TAG
acctggagagcttaaaaaaa

SEQ ID NO: 94804 - DNA, 20 bp, Artificial Sequence
  Description of Artificial Sequence: Synthetic oligonucleotide
  Target: ATXN1; (-) strand; PAM type: NRG; PAM sequence: GAG
aggcaacagaatcacctgga

SEQ ID NO: 94805 - DNA, 20 bp, Artificial Sequence
  Description of Artificial Sequence: Synthetic oligonucleotide
  Target: ATXN1; (-) strand; PAM type: NRG; PAM sequence: GAG
ctaggcaacagaatcacctg

SEQ ID NO: 94806 - DNA, 20 bp, Artificial Sequence
  Description of Artificial Sequence: Synthetic oligonucleotide
  Target: ATXN1; (-) strand; PAM type: NRG; PAM sequence: TGG
ggctaggcaacagaatcacc

SEQ ID NO: 94807 - DNA, 20 bp, Artificial Sequence
  Description of Artificial Sequence: Synthetic oligonucleotide
  Target: ATXN1; (-) strand; PAM type: NRG; PAM sequence: CAG
tcccaagcctggctaggcaa

SEQ ID NO: 94808 - DNA, 20 bp, Artificial Sequence
  Description of Artificial Sequence: Synthetic oligonucleotide
  Target: ATXN1; (-) strand; PAM type: NRG; PAM sequence: AGG
agaggttcccaagcctggct

SEQ ID NO: 94809 - DNA, 20 bp, Artificial Sequence
  Description of Artificial Sequence: Synthetic oligonucleotide
  Target: ATXN1; (-) strand; PAM type: NRG; PAM sequence: TAG
tagaggttcccaagcctggc

SEQ ID NO: 94810 - DNA, 20 bp, Artificial Sequence
  Description of Artificial Sequence: Synthetic oligonucleotide
  Target: ATXN1; (-) strand; PAM type: NRG; PAM sequence: TGG
agattagaggttcccaagcc

SEQ ID NO: 94811 - DNA, 20 bp, Artificial Sequence
  Description of Artificial Sequence: Synthetic oligonucleotide
  Target: ATXN1; (-) strand; PAM type: NRG; PAM sequence: AAG
agactagattagaggttccc

SEQ ID NO: 94812 - DNA, 20 bp, Artificial Sequence
  Description of Artificial Sequence: Synthetic oligonucleotide
  Target: ATXN1; (-) strand; PAM type: NRG; PAM sequence: AGG
gtgaagacagactagattag

SEQ ID NO: 94813 - DNA, 20 bp, Artificial Sequence
  Description of Artificial Sequence: Synthetic oligonucleotide
  Target: ATXN1; (-) strand; PAM type: NRG; PAM sequence: GAG
tgtgaagacagactagatta

SEQ ID NO: 94814 - DNA, 20 bp, Artificial Sequence
  Description of Artificial Sequence: Synthetic oligonucleotide
  Target: ATXN1; (-) strand; PAM type: NRG; PAM sequence: TAG
actgtgaagacagactagat

SEQ ID NO: 94815 - DNA, 20 bp, Artificial Sequence
  Description of Artificial Sequence: Synthetic oligonucleotide
  Target: ATXN1; (-) strand; PAM type: NRG; PAM sequence: TAG
ttgaaactgtgaagacagac

SEQ ID NO: 94816 - DNA, 20 bp, Artificial Sequence
  Description of Artificial Sequence: Synthetic oligonucleotide
  Target: ATXN1; (-) strand; PAM type: NRG; PAM sequence: CAG
cctgcttgaaactgtgaaga

SEQ ID NO: 94817 - DNA, 20 bp, Artificial Sequence
  Description of Artificial Sequence: Synthetic oligonucleotide
  Target: ATXN1; (-) strand; PAM type: NRG; PAM sequence: AAG
tggacctgcttgaaactgtg

SEQ ID NO: 94818 - DNA, 20 bp, Artificial Sequence
  Description of Artificial Sequence: Synthetic oligonucleotide
  Target: ATXN1; (-) strand; PAM type: NRG; PAM sequence: TGG
atttctatttgccttggaaa

SEQ ID NO: 94819 - DNA, 20 bp, Artificial Sequence
  Description of Artificial Sequence: Synthetic oligonucleotide
  Target: ATXN1; (-) strand; PAM type: NRG; PAM sequence: TGG
ggatcaatttctatttgcct

SEQ ID NO: 94820 - DNA, 20 bp, Artificial Sequence
  Description of Artificial Sequence: Synthetic oligonucleotide
  Target: ATXN1; (-) strand; PAM type: NRG; PAM sequence: GGG
gattgtgaaatagaaaatag

SEQ ID NO: 94821 - DNA, 20 bp, Artificial Sequence
  Description of Artificial Sequence: Synthetic oligonucleotide
  Target: ATXN1; (-) strand; PAM type: NRG; PAM sequence: GGG
agattgtgaaatagaaaata

SEQ ID NO: 94822 - DNA, 20 bp, Artificial Sequence
  Description of Artificial Sequence: Synthetic oligonucleotide
  Target: ATXN1; (-) strand; PAM type: NRG; PAM sequence: AGG
gagattgtgaaatagaaaat

SEQ ID NO: 94823 - DNA, 20 bp, Artificial Sequence
  Description of Artificial Sequence: Synthetic oligonucleotide
  Target: ATXN1; (-) strand; PAM type: NRG; PAM sequence: TAG
ggagattgtgaaatagaaaa

SEQ ID NO: 94824 - DNA, 20 bp, Artificial Sequence
  Description of Artificial Sequence: Synthetic oligonucleotide
  Target: ATXN1; (-) strand; PAM type: NRG; PAM sequence: TAG
aaccaagggagattgtgaaa

SEQ ID NO: 94825 - DNA, 20 bp, Artificial Sequence
  Description of Artificial Sequence: Synthetic oligonucleotide
  Target: ATXN1; (-) strand; PAM type: NRG; PAM sequence: GAG
ttgagtgtatgtaaccaagg

SEQ ID NO: 94826 - DNA, 20 bp, Artificial Sequence
  Description of Artificial Sequence: Synthetic oligonucleotide
  Target: ATXN1; (-) strand; PAM type: NRG; PAM sequence: GGG
gtttgagtgtatgtaaccaa

SEQ ID NO: 94827 - DNA, 20 bp, Artificial Sequence
  Description of Artificial Sequence: Synthetic oligonucleotide
  Target: ATXN1; (-) strand; PAM type: NRG; PAM sequence: AGG
ggtttgagtgtatgtaacca

SEQ ID NO: 94828 - DNA, 20 bp, Artificial Sequence
  Description of Artificial Sequence: Synthetic oligonucleotide
  Target: ATXN1; (-) strand; PAM type: NRG; PAM sequence: AAG
gggtttgagtgtatgtaacc

SEQ ID NO: 94829 - DNA, 20 bp, Artificial Sequence
  Description of Artificial Sequence: Synthetic oligonucleotide
  Target: ATXN1; (-) strand; PAM type: NRG; PAM sequence: GAG
gcttgggaacacaagggttt

SEQ ID NO: 94830 - DNA, 20 bp, Artificial Sequence
  Description of Artificial Sequence: Synthetic oligonucleotide
  Target: ATXN1; (-) strand; PAM type: NRG; PAM sequence: GGG
gtaagggcttgggaacacaa

SEQ ID NO: 94831 - DNA, 20 bp, Artificial Sequence
  Description of Artificial Sequence: Synthetic oligonucleotide
  Target: ATXN1; (-) strand; PAM type: NRG; PAM sequence: AGG
agtaagggcttgggaacaca

SEQ ID NO: 94832 - DNA, 20 bp, Artificial Sequence
  Description of Artificial Sequence: Synthetic oligonucleotide
  Target: ATXN1; (-) strand; PAM type: NRG; PAM sequence: AAG
cagtaagggcttgggaacac

SEQ ID NO: 94833 - DNA, 20 bp, Artificial Sequence
  Description of Artificial Sequence: Synthetic oligonucleotide
  Target: ATXN1; (-) strand; PAM type: NRG; PAM sequence: GGG
acttggggcagtaagggctt

SEQ ID NO: 94834 - DNA, 20 bp, Artificial Sequence
  Description of Artificial Sequence: Synthetic oligonucleotide
  Target: ATXN1; (-) strand; PAM type: NRG; PAM sequence: TGG
aacttggggcagtaagggct

SEQ ID NO: 94835 - DNA, 20 bp, Artificial Sequence
  Description of Artificial Sequence: Synthetic oligonucleotide
  Target: ATXN1; (-) strand; PAM type: NRG; PAM sequence: GGG
gctagaacttggggcagtaa

SEQ ID NO: 94836 - DNA, 20 bp, Artificial Sequence
  Description of Artificial Sequence: Synthetic oligonucleotide
  Target: ATXN1; (-) strand; PAM type: NRG; PAM sequence: AGG
tgctagaacttggggcagta

SEQ ID NO: 94837 - DNA, 20 bp, Artificial Sequence
  Description of Artificial Sequence: Synthetic oligonucleotide
  Target: ATXN1; (-) strand; PAM type: NRG; PAM sequence: AAG
ttgctagaacttggggcagt

SEQ ID NO: 94838 - DNA, 20 bp, Artificial Sequence
  Description of Artificial Sequence: Synthetic oligonucleotide
  Target: ATXN1; (-) strand; PAM type: NRG; PAM sequence: CAG
aggtttgctagaacttgggg

SEQ ID NO: 94839 - DNA, 20 bp, Artificial Sequence
  Description of Artificial Sequence: Synthetic oligonucleotide
  Target: ATXN1; (-) strand; PAM type: NRG; PAM sequence: GGG
aagaggtttgctagaacttg

SEQ ID NO: 94840 - DNA, 20 bp, Artificial Sequence
  Description of Artificial Sequence: Synthetic oligonucleotide
  Target: ATXN1; (-) strand; PAM type: NRG; PAM sequence: GGG
aaagaggtttgctagaactt

SEQ ID NO: 94841 - DNA, 20 bp, Artificial Sequence
  Description of Artificial Sequence: Synthetic oligonucleotide
  Target: ATXN1; (-) strand; PAM type: NRG; PAM sequence: TGG
aaaagaggtttgctagaact

SEQ ID NO: 94842 - DNA, 20 bp, Artificial Sequence
  Description of Artificial Sequence: Synthetic oligonucleotide
  Target: ATXN1; (-) strand; PAM type: NRG; PAM sequence: TAG
ggaaggaaaaagaggtttgc

SEQ ID NO: 94843 - DNA, 20 bp, Artificial Sequence
  Description of Artificial Sequence: Synthetic oligonucleotide
  Target: ATXN1; (-) strand; PAM type: NRG; PAM sequence: AGG
ttaaatcaggaaggaaaaag

SEQ ID NO: 94844 - DNA, 20 bp, Artificial Sequence
  Description of Artificial Sequence: Synthetic oligonucleotide
  Target: ATXN1; (-) strand; PAM type: NRG; PAM sequence: GAG
attaaatcaggaaggaaaaa

SEQ ID NO: 94845 - DNA, 20 bp, Artificial Sequence
  Description of Artificial Sequence: Synthetic oligonucleotide
  Target: ATXN1; (-) strand; PAM type: NRG; PAM sequence: AAG
aaattaaatcaggaaggaaa

SEQ ID NO: 94846 - DNA, 20 bp, Artificial Sequence
  Description of Artificial Sequence: Synthetic oligonucleotide
  Target: ATXN1; (-) strand; PAM type: NRG; PAM sequence: AGG
tgcctcaaattaaatcagga

SEQ ID NO: 94847 - DNA, 20 bp, Artificial Sequence
  Description of Artificial Sequence: Synthetic oligonucleotide
  Target: ATXN1; (-) strand; PAM type: NRG; PAM sequence: AAG
ttgcctcaaattaaatcagg

SEQ ID NO: 94848 - DNA, 20 bp, Artificial Sequence
  Description of Artificial Sequence: Synthetic oligonucleotide
  Target: ATXN1; (-) strand; PAM type: NRG; PAM sequence: AGG
atattgcctcaaattaaatc

SEQ ID NO: 94849 - DNA, 20 bp, Artificial Sequence
  Description of Artificial Sequence: Synthetic oligonucleotide
  Target: ATXN1; (-) strand; PAM type: NRG; PAM sequence: CAG
gatattgcctcaaattaaat

SEQ ID NO: 94850 - DNA, 20 bp, Artificial Sequence
  Description of Artificial Sequence: Synthetic oligonucleotide
  Target: ATXN1; (-) strand; PAM type: NRG; PAM sequence: AGG
tctattgaagaaagggccag

SEQ ID NO: 94851 - DNA, 20 bp, Artificial Sequence
  Description of Artificial Sequence: Synthetic oligonucleotide
  Target: ATXN1; (-) strand; PAM type: NRG; PAM sequence: GAG
ctctattgaagaaagggcca

SEQ ID NO: 94852 - DNA, 20 bp, Artificial Sequence
  Description of Artificial Sequence: Synthetic oligonucleotide
  Target: ATXN1; (-) strand; PAM type: NRG; PAM sequence: CAG
ttctctattgaagaaagggc

SEQ ID NO: 94853 - DNA, 20 bp, Artificial Sequence
  Description of Artificial Sequence: Synthetic oligonucleotide
  Target: ATXN1; (-) strand; PAM type: NRG; PAM sequence: GGG
atggttctctattgaagaaa

SEQ ID NO: 94854 - DNA, 20 bp, Artificial Sequence
  Description of Artificial Sequence: Synthetic oligonucleotide
  Target: ATXN1; (-) strand; PAM type: NRG; PAM sequence: AGG
catggttctctattgaagaa

SEQ ID NO: 94855 - DNA, 20 bp, Artificial Sequence
  Description of Artificial Sequence: Synthetic oligonucleotide
  Target: ATXN1; (-) strand; PAM type: NRG; PAM sequence: AAG
tcatggttctctattgaaga

SEQ ID NO: 94856 - DNA, 20 bp, Artificial Sequence
  Description of Artificial Sequence: Synthetic oligonucleotide
  Target: ATXN1; (-) strand; PAM type: NRG; PAM sequence: AAG
tgactcatggttctctattg

SEQ ID NO: 94857 - DNA, 20 bp, Artificial Sequence
  Description of Artificial Sequence: Synthetic oligonucleotide
  Target: ATXN1; (-) strand; PAM type: NRG; PAM sequence: TGG
tatgcaatggtgatgactca

SEQ ID NO: 94858 - DNA, 20 bp, Artificial Sequence
  Description of Artificial Sequence: Synthetic oligonucleotide
  Target: ATXN1; (-) strand; PAM type: NRG; PAM sequence: TGG
cagacatagggtgtatgcaa

SEQ ID NO: 94859 - DNA, 20 bp, Artificial Sequence
  Description of Artificial Sequence: Synthetic oligonucleotide
  Target: ATXN1; (-) strand; PAM type: NRG; PAM sequence: GGG
tggagagtcatgcagacata

SEQ ID NO: 94860 - DNA, 20 bp, Artificial Sequence
  Description of Artificial Sequence: Synthetic oligonucleotide
  Target: ATXN1; (-) strand; PAM type: NRG; PAM sequence: AGG
ctggagagtcatgcagacat

SEQ ID NO: 94861 - DNA, 20 bp, Artificial Sequence
  Description of Artificial Sequence: Synthetic oligonucleotide
  Target: ATXN1; (-) strand; PAM type: NRG; PAM sequence: TAG
cctggagagtcatgcagaca

SEQ ID NO: 94862 - DNA, 20 bp, Artificial Sequence
  Description of Artificial Sequence: Synthetic oligonucleotide
  Target: ATXN1; (-) strand; PAM type: NRG; PAM sequence: CAG
ttctggcctggagagtcatg

SEQ ID NO: 94863 - DNA, 20 bp, Artificial Sequence
  Description of Artificial Sequence: Synthetic oligonucleotide
  Target: ATXN1; (-) strand; PAM type: NRG; PAM sequence: GAG
gtaagtttttctggcctgga

SEQ ID NO: 94864 - DNA, 20 bp, Artificial Sequence
  Description of Artificial Sequence: Synthetic oligonucleotide
  Target: ATXN1; (-) strand; PAM type: NRG; PAM sequence: GAG
cagtaagtttttctggcctg

SEQ ID NO: 94865 - DNA, 20 bp, Artificial Sequence
  Description of Artificial Sequence: Synthetic oligonucleotide
  Target: ATXN1; (-) strand; PAM type: NRG; PAM sequence: TGG
tacagtaagtttttctggcc

SEQ ID NO: 94866 - DNA, 20 bp, Artificial Sequence
  Description of Artificial Sequence: Synthetic oligonucleotide
  Target: ATXN1; (-) strand; PAM type: NRG; PAM sequence: TGG
ccacgtacagtaagtttttc

SEQ ID NO: 94867 - DNA, 20 bp, Artificial Sequence
  Description of Artificial Sequence: Synthetic oligonucleotide
  Target: ATXN1; (-) strand; PAM type: NRG; PAM sequence: AAG
ctgattttcccacgtacagt

SEQ ID NO: 94868 - DNA, 20 bp, Artificial Sequence
  Description of Artificial Sequence: Synthetic oligonucleotide
  Target: ATXN1; (-) strand; PAM type: NRG; PAM sequence: CAG
cttcctgattttcccacgta

SEQ ID NO: 94869 - DNA, 20 bp, Artificial Sequence
  Description of Artificial Sequence: Synthetic oligonucleotide
  Target: ATXN1; (-) strand; PAM type: NRG; PAM sequence: TGG
tgaatttctttgtgtctgtt

SEQ ID NO: 94870 - DNA, 20 bp, Artificial Sequence
  Description of Artificial Sequence: Synthetic oligonucleotide
  Target: ATXN1; (-) strand; PAM type: NRG; PAM sequence: CAG
acctatttgtttaggggaac

SEQ ID NO: 94871 - DNA, 20 bp, Artificial Sequence
  Description of Artificial Sequence: Synthetic oligonucleotide
  Target: ATXN1; (-) strand; PAM type: NRG; PAM sequence: GGG
acagagacctatttgtttag

SEQ ID NO: 94872 - DNA, 20 bp, Artificial Sequence
  Description of Artificial Sequence: Synthetic oligonucleotide
  Target: ATXN1; (-) strand; PAM type: NRG; PAM sequence: GGG
aacagagacctatttgttta

SEQ ID NO: 94873 - DNA, 20 bp, Artificial Sequence
  Description of Artificial Sequence: Synthetic oligonucleotide
  Target: ATXN1; (-) strand; PAM type: NRG; PAM sequence: AGG
aaacagagacctatttgttt

SEQ ID NO: 94874 - DNA, 20 bp, Artificial Sequence
  Description of Artificial Sequence: Synthetic oligonucleotide
  Target: ATXN1; (-) strand; PAM type: NRG; PAM sequence: TAG
aaaacagagacctatttgtt

SEQ ID NO: 94875 - DNA, 20 bp, Artificial Sequence
  Description of Artificial Sequence: Synthetic oligonucleotide
  Target: ATXN1; (-) strand; PAM type: NRG; PAM sequence: GAG
aatatgtgcgtagcaaaaca

SEQ ID NO: 94876 - DNA, 20 bp, Artificial Sequence
  Description of Artificial Sequence: Synthetic oligonucleotide
  Target: ATXN1; (-) strand; PAM type: NRG; PAM sequence: CAG
ataatatgtgcgtagcaaaa

SEQ ID NO: 94877 - DNA, 20 bp, Artificial Sequence
  Description of Artificial Sequence: Synthetic oligonucleotide
  Target: ATXN1; (-) strand; PAM type: NRG; PAM sequence: TAG
gttgtagtataatatgtgcg

SEQ ID NO: 94878 - DNA, 20 bp, Artificial Sequence
  Description of Artificial Sequence: Synthetic oligonucleotide
  Target: ATXN1; (-) strand; PAM type: NRG; PAM sequence: TAG
tgcattttagattactgttg

SEQ ID NO: 94879 - DNA, 20 bp, Artificial Sequence
  Description of Artificial Sequence: Synthetic oligonucleotide
  Target: ATXN1; (-) strand; PAM type: NRG; PAM sequence: TAG
aagtcacagtttttgcattt

SEQ ID NO: 94880 - DNA, 20 bp, Artificial Sequence
  Description of Artificial Sequence: Synthetic oligonucleotide
  Target: ATXN1; (-) strand; PAM type: NRG; PAM sequence: CAG
ctaccagatatcttaagtca

SEQ ID NO: 94881 - DNA, 20 bp, Artificial Sequence
  Description of Artificial Sequence: Synthetic oligonucleotide
  Target: ATXN1; (-) strand; PAM type: NRG; PAM sequence: AAG
gctatgctaccagatatctt

SEQ ID NO: 94882 - DNA, 20 bp, Artificial Sequence
  Description of Artificial Sequence: Synthetic oligonucleotide
  Target: ATXN1; (-) strand; PAM type: NRG; PAM sequence: CAG
aattaagaatgctatgctac

SEQ ID NO: 94883 - DNA, 20 bp, Artificial Sequence
  Description of Artificial Sequence: Synthetic oligonucleotide
  Target: ATXN1; (-) strand; PAM type: NRG; PAM sequence: AAG
cagttttccttaatacaatt

SEQ ID NO: 94884 - DNA, 20 bp, Artificial Sequence
  Description of Artificial Sequence: Synthetic oligonucleotide
  Target: ATXN1; (-) strand; PAM type: NRG; PAM sequence: CAG
aacctcatcattttaattgt

SEQ ID NO: 94885 - DNA, 20 bp, Artificial Sequence
  Description of Artificial Sequence: Synthetic oligonucleotide
  Target: ATXN1; (-) strand; PAM type: NRG; PAM sequence: GGG
tgattgataattgccaattg

SEQ ID NO: 94886 - DNA, 20 bp, Artificial Sequence
  Description of Artificial Sequence: Synthetic oligonucleotide
  Target: ATXN1; (-) strand; PAM type: NRG; PAM sequence: GGG
atgattgataattgccaatt

SEQ ID NO: 94887 - DNA, 20 bp, Artificial Sequence
  Description of Artificial Sequence: Synthetic oligonucleotide
  Target: ATXN1; (-) strand; PAM type: NRG; PAM sequence: TGG
gatgattgataattgccaat

SEQ ID NO: 94888 - DNA, 20 bp, Artificial Sequence
  Description of Artificial Sequence: Synthetic oligonucleotide
  Target: ATXN1; (-) strand; PAM type: NRG; PAM sequence: AAG
gtttaatctatatgttcatg

SEQ ID NO: 94889 - DNA, 20 bp, Artificial Sequence
  Description of Artificial Sequence: Synthetic oligonucleotide
  Target: ATXN1; (-) strand; PAM type: NRG; PAM sequence: TGG
gattaaagtatctatctatt

SEQ ID NO: 94890 - DNA, 20 bp, Artificial Sequence
  Description of Artificial Sequence: Synthetic oligonucleotide
  Target: ATXN1; (-) strand; PAM type: NRG; PAM sequence: AAG
gttttttaaaacttcgatta

SEQ ID NO: 94891 - DNA, 20 bp, Artificial Sequence
  Description of Artificial Sequence: Synthetic oligonucleotide
  Target: ATXN1; (-) strand; PAM type: NRG; PAM sequence: AAG
tgggaagttgagaaattgcc

SEQ ID NO: 94892 - DNA, 20 bp, Artificial Sequence
  Description of Artificial Sequence: Synthetic oligonucleotide
  Target: ATXN1; (-) strand; PAM type: NRG; PAM sequence: GAG
tgggcatagtgtgggaagtt

SEQ ID NO: 94893 - DNA, 20 bp, Artificial Sequence
  Description of Artificial Sequence: Synthetic oligonucleotide
  Target: ATXN1; (-) strand; PAM type: NRG; PAM sequence: AAG
ctgtttgggcatagtgtggg

SEQ ID NO: 94894 - DNA, 20 bp, Artificial Sequence
  Description of Artificial Sequence: Synthetic oligonucleotide
  Target: ATXN1; (-) strand; PAM type: NRG; PAM sequence: GGG
actctgtttgggcatagtgt

SEQ ID NO: 94895 - DNA, 20 bp, Artificial Sequence
  Description of Artificial Sequence: Synthetic oligonucleotide
  Target: ATXN1; (-) strand; PAM type: NRG; PAM sequence: TGG
aactctgtttgggcatagtg

SEQ ID NO: 94896 - DNA, 20 bp, Artificial Sequence
  Description of Artificial Sequence: Synthetic oligonucleotide
  Target: ATXN1; (-) strand; PAM type: NRG; PAM sequence: TAG
ttgcaaactctgtttgggca

SEQ ID NO: 94897 - DNA, 20 bp, Artificial Sequence
  Description of Artificial Sequence: Synthetic oligonucleotide
  Target: ATXN1; (-) strand; PAM type: NRG; PAM sequence: GGG
tttctttgcaaactctgttt

SEQ ID NO: 94898 - DNA, 20 bp, Artificial Sequence
  Description of Artificial Sequence: Synthetic oligonucleotide
  Target: ATXN1; (-) strand; PAM type: NRG; PAM sequence: TGG
ttttctttgcaaactctgtt

SEQ ID NO: 94899 - DNA, 20 bp, Artificial Sequence
  Description of Artificial Sequence: Synthetic oligonucleotide
  Target: ATXN1; (-) strand; PAM type: NRG; PAM sequence: TGG
gccatgctcccttactttgt

SEQ ID NO: 94900 - DNA, 20 bp, Artificial Sequence
  Description of Artificial Sequence: Synthetic oligonucleotide
  Target: ATXN1; (-) strand; PAM type: NRG; PAM sequence: TAG
tgacctggaaaattgcctcc

SEQ ID NO: 94901 - DNA, 20 bp, Artificial Sequence
  Description of Artificial Sequence: Synthetic oligonucleotide
  Target: ATXN1; (-) strand; PAM type: NRG; PAM sequence: TGG
ctgaggataaagtcctgacc

SEQ ID NO: 94902 - DNA, 20 bp, Artificial Sequence
  Description of Artificial Sequence: Synthetic oligonucleotide
  Target: ATXN1; (-) strand; PAM type: NRG; PAM sequence: AAG
ctgttttccatctgaggata

SEQ ID NO: 94903 - DNA, 20 bp, Artificial Sequence
  Description of Artificial Sequence: Synthetic oligonucleotide
  Target: ATXN1; (-) strand; PAM type: NRG; PAM sequence: AGG
tgctctctgttttccatctg

SEQ ID NO: 94904 - DNA, 20 bp, Artificial Sequence
  Description of Artificial Sequence: Synthetic oligonucleotide
  Target: ATXN1; (-) strand; PAM type: NRG; PAM sequence: GAG
atgctctctgttttccatct

SEQ ID NO: 94905 - DNA, 20 bp, Artificial Sequence
  Description of Artificial Sequence: Synthetic oligonucleotide
  Target: ATXN1; (-) strand; PAM type: NRG; PAM sequence: GAG
gtgcatcacatgtcaggtga

SEQ ID NO: 94906 - DNA, 20 bp, Artificial Sequence
  Description of Artificial Sequence: Synthetic oligonucleotide
  Target: ATXN1; (-) strand; PAM type: NRG; PAM sequence: GAG
aagtgcatcacatgtcaggt

SEQ ID NO: 94907 - DNA, 20 bp, Artificial Sequence
  Description of Artificial Sequence: Synthetic oligonucleotide
  Target: ATXN1; (-) strand; PAM type: NRG; PAM sequence: AGG
agggaagtgcatcacatgtc

SEQ ID NO: 94908 - DNA, 20 bp, Artificial Sequence
  Description of Artificial Sequence: Synthetic oligonucleotide
  Target: ATXN1; (-) strand; PAM type: NRG; PAM sequence: CAG
cagggaagtgcatcacatgt

SEQ ID NO: 94909 - DNA, 20 bp, Artificial Sequence
  Description of Artificial Sequence: Synthetic oligonucleotide
  Target: ATXN1; (-) strand; PAM type: NRG; PAM sequence: AAG
cctccactgccactacaggg

SEQ ID NO: 94910 - DNA, 20 bp, Artificial Sequence
  Description of Artificial Sequence: Synthetic oligonucleotide
  Target: ATXN1; (-) strand; PAM type: NRG; PAM sequence: GGG
cctcctccactgccactaca

SEQ ID NO: 94911 - DNA, 20 bp, Artificial Sequence
  Description of Artificial Sequence: Synthetic oligonucleotide
  Target: ATXN1; (-) strand; PAM type: NRG; PAM sequence: AGG
tcctcctccactgccactac

SEQ ID NO: 94912 - DNA, 20 bp, Artificial Sequence
  Description of Artificial Sequence: Synthetic oligonucleotide
  Target: ATXN1; (-) strand; PAM type: NRG; PAM sequence: CAG
ctcctcctccactgccacta

SEQ ID NO: 94913 - DNA, 20 bp, Artificial Sequence
  Description of Artificial Sequence: Synthetic oligonucleotide
  Target: ATXN1; (-) strand; PAM type: NRG; PAM sequence: CAG
atttgtttgtcatccttgta

SEQ ID NO: 94914 - DNA, 20 bp, Artificial Sequence
  Description of Artificial Sequence: Synthetic oligonucleotide
  Target: ATXN1; (-) strand; PAM type: NRG; PAM sequence: CAG
agggtggtccattcaagctg

SEQ ID NO: 94915 - DNA, 20 bp, Artificial Sequence
  Description of Artificial Sequence: Synthetic oligonucleotide
  Target: ATXN1; (-) strand; PAM type: NRG; PAM sequence: AAG
gtcaccagggtggtccattc

SEQ ID NO: 94916 - DNA, 20 bp, Artificial Sequence
  Description of Artificial Sequence: Synthetic oligonucleotide
  Target: ATXN1; (-) strand; PAM type: NRG; PAM sequence: TGG
cgtgcatcaagtcaccaggg

SEQ ID NO: 94917 - DNA, 20 bp, Artificial Sequence
  Description of Artificial Sequence: Synthetic oligonucleotide
  Target: ATXN1; (-) strand; PAM type: NRG; PAM sequence: GGG
catcgtgcatcaagtcacca

SEQ ID NO: 94918 - DNA, 20 bp, Artificial Sequence
  Description of Artificial Sequence: Synthetic oligonucleotide
  Target: ATXN1; (-) strand; PAM type: NRG; PAM sequence: AGG
gcatcgtgcatcaagtcacc

SEQ ID NO: 94919 - DNA, 20 bp, Artificial Sequence
  Description of Artificial Sequence: Synthetic oligonucleotide
  Target: ATXN1; (-) strand; PAM type: NRG; PAM sequence: CAG
agcatcgtgcatcaagtcac

SEQ ID NO: 94920 - DNA, 20 bp, Artificial Sequence
  Description of Artificial Sequence: Synthetic oligonucleotide
  Target: ATXN1; (-) strand; PAM type: NRG; PAM sequence: AAG
ttgcaggagcatcgtgcatc

SEQ ID NO: 94921 - DNA, 20 bp, Artificial Sequence
  Description of Artificial Sequence: Synthetic oligonucleotide
  Target: ATXN1; (-) strand; PAM type: NRG; PAM sequence: GAG
cactccctcgaccattgcag

SEQ ID NO: 94922 - DNA, 20 bp, Artificial Sequence
  Description of Artificial Sequence: Synthetic oligonucleotide
  Target: ATXN1; (-) strand; PAM type: NRG; PAM sequence: AGG
tgcactccctcgaccattgc

SEQ ID NO: 94923 - DNA, 20 bp, Artificial Sequence
  Description of Artificial Sequence: Synthetic oligonucleotide
  Target: ATXN1; (-) strand; PAM type: NRG; PAM sequence: CAG
ctgcactccctcgaccattg

SEQ ID NO: 94924 - DNA, 20 bp, Artificial Sequence
  Description of Artificial Sequence: Synthetic oligonucleotide
  Target: ATXN1; (-) strand; PAM type: NRG; PAM sequence: TGG
gtctattctgtttttcattt

SEQ ID NO: 94925 - DNA, 20 bp, Artificial Sequence
  Description of Artificial Sequence: Synthetic oligonucleotide
  Target: ATXN1; (-) strand; PAM type: NRG; PAM sequence: CAG
ggtggacttattttttaaag

SEQ ID NO: 94926 - DNA, 20 bp, Artificial Sequence
  Description of Artificial Sequence: Synthetic oligonucleotide
  Target: ATXN1; (-) strand; PAM type: NRG; PAM sequence: AAG
taaggtggacttatttttta

SEQ ID NO: 94927 - DNA, 20 bp, Artificial Sequence
  Description of Artificial Sequence: Synthetic oligonucleotide
  Target: ATXN1; (-) strand; PAM type: NRG; PAM sequence: TGG
cggtgcatagacacttaagg

SEQ ID NO: 94928 - DNA, 20 bp, Artificial Sequence
  Description of Artificial Sequence: Synthetic oligonucleotide
  Target: ATXN1; (-) strand; PAM type: NRG; PAM sequence: AGG
tttcggtgcatagacactta

SEQ ID NO: 94929 - DNA, 20 bp, Artificial Sequence
  Description of Artificial Sequence: Synthetic oligonucleotide
  Target: ATXN1; (-) strand; PAM type: NRG; PAM sequence: AAG
atttcggtgcatagacactt

SEQ ID NO: 94930 - DNA, 20 bp, Artificial Sequence
  Description of Artificial Sequence: Synthetic oligonucleotide
  Target: ATXN1; (-) strand; PAM type: NRG; PAM sequence: TAG
aaaatttgtatttcggtgca

SEQ ID NO: 94931 - DNA, 20 bp, Artificial Sequence
  Description of Artificial Sequence: Synthetic oligonucleotide
  Target: ATXN1; (-) strand; PAM type: NRG; PAM sequence: CGG
tgttcttaaaatttgtattt

SEQ ID NO: 94932 - DNA, 20 bp, Artificial Sequence
  Description of Artificial Sequence: Synthetic oligonucleotide
  Target: ATXN1; (-) strand; PAM type: NRG; PAM sequence: CAG
tctgtgtaattctcatacaa

SEQ ID NO: 94933 - DNA, 20 bp, Artificial Sequence
  Description of Artificial Sequence: Synthetic oligonucleotide
  Target: ATXN1; (-) strand; PAM type: NRG; PAM sequence: GGG
acctgccttttgagctggct

SEQ ID NO: 94934 - DNA, 20 bp, Artificial Sequence
  Description of Artificial Sequence: Synthetic oligonucleotide
  Target: ATXN1; (-) strand; PAM type: NRG; PAM sequence: TGG
gacctgccttttgagctggc

SEQ ID NO: 94935 - DNA, 20 bp, Artificial Sequence
  Description of Artificial Sequence: Synthetic oligonucleotide
  Target: ATXN1; (-) strand; PAM type: NRG; PAM sequence: TGG
accagacctgccttttgagc

SEQ ID NO: 94936 - DNA, 20 bp, Artificial Sequence
  Description of Artificial Sequence: Synthetic oligonucleotide
  Target: ATXN1; (-) strand; PAM type: NRG; PAM sequence: GAG
taaaaccagacctgcctttt

SEQ ID NO: 94937 - DNA, 20 bp, Artificial Sequence
  Description of Artificial Sequence: Synthetic oligonucleotide
  Target: ATXN1; (-) strand; PAM type: NRG; PAM sequence: CAG
tgagccttgttgagtaaaac

SEQ ID NO: 94938 - DNA, 20 bp, Artificial Sequence
  Description of Artificial Sequence: Synthetic oligonucleotide
  Target: ATXN1; (-) strand; PAM type: NRG; PAM sequence: GAG
gcctccctctgagccttgtt

SEQ ID NO: 94939 - DNA, 20 bp, Artificial Sequence
  Description of Artificial Sequence: Synthetic oligonucleotide
  Target: ATXN1; (-) strand; PAM type: NRG; PAM sequence: GAG
ttgtatgttggcctccctct

SEQ ID NO: 94940 - DNA, 20 bp, Artificial Sequence
  Description of Artificial Sequence: Synthetic oligonucleotide
  Target: ATXN1; (-) strand; PAM type: NRG; PAM sequence: TGG
gggatgacctttttgtatgt

SEQ ID NO: 94941 - DNA, 20 bp, Artificial Sequence
  Description of Artificial Sequence: Synthetic oligonucleotide
  Target: ATXN1; (-) strand; PAM type: NRG; PAM sequence: GGG
atcctcttaatttgatggaa

SEQ ID NO: 94942 - DNA, 20 bp, Artificial Sequence
  Description of Artificial Sequence: Synthetic oligonucleotide
  Target: ATXN1; (-) strand; PAM type: NRG; PAM sequence: AGG
catcctcttaatttgatgga

SEQ ID NO: 94943 - DNA, 20 bp, Artificial Sequence
  Description of Artificial Sequence: Synthetic oligonucleotide
  Target: ATXN1; (-) strand; PAM type: NRG; PAM sequence: AAG
ccatcctcttaatttgatgg

SEQ ID NO: 94944 - DNA, 20 bp, Artificial Sequence
  Description of Artificial Sequence: Synthetic oligonucleotide
  Target: ATXN1; (-) strand; PAM type: NRG; PAM sequence: TGG
agaccatcctcttaatttga

SEQ ID NO: 94945 - DNA, 20 bp, Artificial Sequence
  Description of Artificial Sequence: Synthetic oligonucleotide
  Target: ATXN1; (-) strand; PAM type: NRG; PAM sequence: GAG
cagcggctggctcaaatggg

SEQ ID NO: 94946 - DNA, 20 bp, Artificial Sequence
  Description of Artificial Sequence: Synthetic oligonucleotide
  Target: ATXN1; (-) strand; PAM type: NRG; PAM sequence: GGG
gacagcggctggctcaaatg

SEQ ID NO: 94947 - DNA, 20 bp, Artificial Sequence
  Description of Artificial Sequence: Synthetic oligonucleotide
  Target: ATXN1; (-) strand; PAM type: NRG; PAM sequence: GGG
tgacagcggctggctcaaat

SEQ ID NO: 94948 - DNA, 20 bp, Artificial Sequence
  Description of Artificial Sequence: Synthetic oligonucleotide
  Target: ATXN1; (-) strand; PAM type: NRG; PAM sequence: TGG
atgacagcggctggctcaaa

SEQ ID NO: 94949 - DNA, 20 bp, Artificial Sequence
  Description of Artificial Sequence: Synthetic oligonucleotide
  Target: ATXN1; (-) strand; PAM type: NRG; PAM sequence: TGG
gagaaaagaatgacagcggc

SEQ ID NO: 94950 - DNA, 20 bp, Artificial Sequence
  Description of Artificial Sequence: Synthetic oligonucleotide
  Target: ATXN1; (-) strand; PAM type: NRG; PAM sequence: CGG
attggagaaaagaatgacag

SEQ ID NO: 94951 - DNA, 20 bp, Artificial Sequence
  Description of Artificial Sequence: Synthetic oligonucleotide
  Target: ATXN1; (-) strand; PAM type: NRG; PAM sequence: CAG
atcattggagaaaagaatga

SEQ ID NO: 94952 - DNA, 20 bp, Artificial Sequence
  Description of Artificial Sequence: Synthetic oligonucleotide
  Target: ATXN1; (-) strand; PAM type: NRG; PAM sequence: AAG
tggctagaatcattggagaa

SEQ ID NO: 94953 - DNA, 20 bp, Artificial Sequence
  Description of Artificial Sequence: Synthetic oligonucleotide
  Target: ATXN1; (-) strand; PAM type: NRG; PAM sequence: GAG
atgattggctagaatcattg

SEQ ID NO: 94954 - DNA, 20 bp, Artificial Sequence
  Description of Artificial Sequence: Synthetic oligonucleotide
  Target: ATXN1; (-) strand; PAM type: NRG; PAM sequence: TGG
agatgattggctagaatcat

SEQ ID NO: 94955 - DNA, 20 bp, Artificial Sequence
  Description of Artificial Sequence: Synthetic oligonucleotide
  Target: ATXN1; (-) strand; PAM type: NRG; PAM sequence: TAG
gtgtttatcagatgattggc

SEQ ID NO: 94956 - DNA, 20 bp, Artificial Sequence
  Description of Artificial Sequence: Synthetic oligonucleotide
  Target: ATXN1; (-) strand; PAM type: NRG; PAM sequence: TGG
gcatgtgtttatcagatgat

SEQ ID NO: 94957 - DNA, 20 bp, Artificial Sequence
  Description of Artificial Sequence: Synthetic oligonucleotide
  Target: ATXN1; (-) strand; PAM type: NRG; PAM sequence: CAG
agttaccagcatgtgtttat

SEQ ID NO: 94958 - DNA, 20 bp, Artificial Sequence
  Description of Artificial Sequence: Synthetic oligonucleotide
  Target: ATXN1; (-) strand; PAM type: NRG; PAM sequence: CAG
ctgatactccttgtagttac

SEQ ID NO: 94959 - DNA, 20 bp, Artificial Sequence
  Description of Artificial Sequence: Synthetic oligonucleotide
  Target: ATXN1; (-) strand; PAM type: NRG; PAM sequence: TAG
ttttcacctgatactccttg

SEQ ID NO: 94960 - DNA, 20 bp, Artificial Sequence
  Description of Artificial Sequence: Synthetic oligonucleotide
  Target: ATXN1; (-) strand; PAM type: NRG; PAM sequence: TGG
gccacattaaaattaggctt

SEQ ID NO: 94961 - DNA, 20 bp, Artificial Sequence
  Description of Artificial Sequence: Synthetic oligonucleotide
  Target: ATXN1; (-) strand; PAM type: NRG; PAM sequence: AGG
atatatgccacattaaaatt

SEQ ID NO: 94962 - DNA, 20 bp, Artificial Sequence
  Description of Artificial Sequence: Synthetic oligonucleotide
  Target: ATXN1; (-) strand; PAM type: NRG; PAM sequence: TAG
aatatatgccacattaaaat

SEQ ID NO: 94963 - DNA, 20 bp, Artificial Sequence
  Description of Artificial Sequence: Synthetic oligonucleotide
  Target: ATXN1; (-) strand; PAM type: NRG; PAM sequence: TAG
tgtttcaagttgcatgttga

SEQ ID NO: 94964 - DNA, 20 bp, Artificial Sequence
  Description of Artificial Sequence: Synthetic oligonucleotide
  Target: ATXN1; (-) strand; PAM type: NRG; PAM sequence: AAG
cactttcatcattgtgtttc

SEQ ID NO: 94965 - DNA, 20 bp, Artificial Sequence
  Description of Artificial Sequence: Synthetic oligonucleotide
  Target: ATXN1; (-) strand; PAM type: NRG; PAM sequence: TAG
ccattggactggtatgctaa

SEQ ID NO: 94966 - DNA, 20 bp, Artificial Sequence
  Description of Artificial Sequence: Synthetic oligonucleotide
  Target: ATXN1; (-) strand; PAM type: NRG; PAM sequence: TGG
tttcttctattccattggac

SEQ ID NO: 94967 - DNA, 20 bp, Artificial Sequence
  Description of Artificial Sequence: Synthetic oligonucleotide
  Target: ATXN1; (-) strand; PAM type: NRG; PAM sequence: TGG
tttcctttcttctattccat

SEQ ID NO: 94968 - DNA, 20 bp, Artificial Sequence
  Description of Artificial Sequence: Synthetic oligonucleotide
  Target: ATXN1; (-) strand; PAM type: NRG; PAM sequence: TAG
ataaagtttagtggaaagtt

SEQ ID NO: 94969 - DNA, 20 bp, Artificial Sequence
  Description of Artificial Sequence: Synthetic oligonucleotide
  Target: ATXN1; (-) strand; PAM type: NRG; PAM sequence: AAG
tttaaataaagtttagtgga

SEQ ID NO: 94970 - DNA, 20 bp, Artificial Sequence
  Description of Artificial Sequence: Synthetic oligonucleotide
  Target: ATXN1; (-) strand; PAM type: NRG; PAM sequence: TGG
agtatttaaataaagtttag

SEQ ID NO: 94971 - DNA, 20 bp, Artificial Sequence
  Description of Artificial Sequence: Synthetic oligonucleotide
  Target: ATXN1; (-) strand; PAM type: NRG; PAM sequence: TAG
ttcagtatttaaataaagtt

SEQ ID NO: 94972 - DNA, 20 bp, Artificial Sequence
  Description of Artificial Sequence: Synthetic oligonucleotide
  Target: ATXN1; (-) strand; PAM type: NRG; PAM sequence: AAG
gtacattcagtatttaaata

SEQ ID NO: 94973 - DNA, 20 bp, Artificial Sequence
  Description of Artificial Sequence: Synthetic oligonucleotide
  Target: ATXN1; (-) strand; PAM type: NRG; PAM sequence: CAG
atgaaaatgagatgtacatt

SEQ ID NO: 94974 - DNA, 20 bp, Artificial Sequence
  Description of Artificial Sequence: Synthetic oligonucleotide
  Target: ATXN1; (-) strand; PAM type: NRG; PAM sequence: GAG
aattgtggcaaaatgaaaat

SEQ ID NO: 94975 - DNA, 20 bp, Artificial Sequence
  Description of Artificial Sequence: Synthetic oligonucleotide
  Target: ATXN1; (-) strand; PAM type: NRG; PAM sequence: TGG
taaccatgtgcaaggaattg

SEQ ID NO: 94976 - DNA, 20 bp, Artificial Sequence
  Description of Artificial Sequence: Synthetic oligonucleotide
  Target: ATXN1; (-) strand; PAM type: NRG; PAM sequence: AGG
tttttacttaaccatgtgca

SEQ ID NO: 94977 - DNA, 20 bp, Artificial Sequence
  Description of Artificial Sequence: Synthetic oligonucleotide
  Target: ATXN1; (-) strand; PAM type: NRG; PAM sequence: AAG
atttttacttaaccatgtgc

SEQ ID NO: 94978 - DNA, 20 bp, Artificial Sequence
  Description of Artificial Sequence: Synthetic oligonucleotide
  Target: ATXN1; (-) strand; PAM type: NRG; PAM sequence: TGG
ttcactcattcatcatacaa

SEQ ID NO: 94979 - DNA, 20 bp, Artificial Sequence
  Description of Artificial Sequence: Synthetic oligonucleotide
  Target: ATXN1; (-) strand; PAM type: NRG; PAM sequence: AAG
cctgatggaaaggtatatgg

SEQ ID NO: 94980 - DNA, 20 bp, Artificial Sequence
  Description of Artificial Sequence: Synthetic oligonucleotide
  Target: ATXN1; (-) strand; PAM type: NRG; PAM sequence: TGG
ctccctgatggaaaggtata

SEQ ID NO: 94981 - DNA, 20 bp, Artificial Sequence
  Description of Artificial Sequence: Synthetic oligonucleotide
  Target: ATXN1; (-) strand; PAM type: NRG; PAM sequence: AGG
caccaagctccctgatggaa

SEQ ID NO: 94982 - DNA, 20 bp, Artificial Sequence
  Description of Artificial Sequence: Synthetic oligonucleotide
  Target: ATXN1; (-) strand; PAM type: NRG; PAM sequence: AAG
gcaccaagctccctgatgga

SEQ ID NO: 94983 - DNA, 20 bp, Artificial Sequence
  Description of Artificial Sequence: Synthetic oligonucleotide
  Target: ATXN1; (-) strand; PAM type: NRG; PAM sequence: TGG
acaagcaccaagctccctga

SEQ ID NO: 94984 - DNA, 20 bp, Artificial Sequence
  Description of Artificial Sequence: Synthetic oligonucleotide
  Target: ATXN1; (-) strand; PAM type: NRG; PAM sequence: AAG
caaaaactactacaagcacc

SEQ ID NO: 94985 - DNA, 20 bp, Artificial Sequence
  Description of Artificial Sequence: Synthetic oligonucleotide
  Target: ATXN1; (-) strand; PAM type: NRG; PAM sequence: AAG
tacctcacaaaaactactac

SEQ ID NO: 94986 - DNA, 20 bp, Artificial Sequence
  Description of Artificial Sequence: Synthetic oligonucleotide
  Target: ATXN1; (-) strand; PAM type: NRG; PAM sequence: AGG
cttcttccgtttctatgcat

SEQ ID NO: 94987 - DNA, 20 bp, Artificial Sequence
  Description of Artificial Sequence: Synthetic oligonucleotide
  Target: ATXN1; (-) strand; PAM type: NRG; PAM sequence: TAG
acttcttccgtttctatgca

SEQ ID NO: 94988 - DNA, 20 bp, Artificial Sequence
  Description of Artificial Sequence: Synthetic oligonucleotide
  Target: ATXN1; (-) strand; PAM type: NRG; PAM sequence: GAG
aaaaaatacgttagcagatc

SEQ ID NO: 94989 - DNA, 20 bp, Artificial Sequence
  Description of Artificial Sequence: Synthetic oligonucleotide
  Target: ATXN1; (-) strand; PAM type: NRG; PAM sequence: CAG
gggctaaaaaaatacgttag

SEQ ID NO: 94990 - DNA, 20 bp, Artificial Sequence
  Description of Artificial Sequence: Synthetic oligonucleotide
  Target: ATXN1; (-) strand; PAM type: NRG; PAM sequence: TAG
atagggctaaaaaaatacgt

SEQ ID NO: 94991 - DNA, 20 bp, Artificial Sequence
  Description of Artificial Sequence: Synthetic oligonucleotide
  Target: ATXN1; (-) strand; PAM type: NRG; PAM sequence: GGG
gaatataattttaatggata

SEQ ID NO: 94992 - DNA, 20 bp, Artificial Sequence
  Description of Artificial Sequence: Synthetic oligonucleotide
  Target: ATXN1; (-) strand; PAM type: NRG; PAM sequence: AGG
agaatataattttaatggat

SEQ ID NO: 94993 - DNA, 20 bp, Artificial Sequence
  Description of Artificial Sequence: Synthetic oligonucleotide
  Target: ATXN1; (-) strand; PAM type: NRG; PAM sequence: TAG
aagaatataattttaatgga

SEQ ID NO: 94994 - DNA, 20 bp, Artificial Sequence
  Description of Artificial Sequence: Synthetic oligonucleotide
  Target: ATXN1; (-) strand; PAM type: NRG; PAM sequence: TGG
atttaagaatataattttaa

SEQ ID NO: 94995 - DNA, 20 bp, Artificial Sequence
  Description of Artificial Sequence: Synthetic oligonucleotide
  Target: ATXN1; (-) strand; PAM type: NRG; PAM sequence: AAG
attggtaattaccggtattt

SEQ ID NO: 94996 - DNA, 20 bp, Artificial Sequence
  Description of Artificial Sequence: Synthetic oligonucleotide
  Target: ATXN1; (-) strand; PAM type: NRG; PAM sequence: CGG
tgtggataattggtaattac

SEQ ID NO: 94997 - DNA, 20 bp, Artificial Sequence
  Description of Artificial Sequence: Synthetic oligonucleotide
  Target: ATXN1; (-) strand; PAM type: NRG; PAM sequence: TGG
ttctgtttaatgtggataat

SEQ ID NO: 94998 - DNA, 20 bp, Artificial Sequence
  Description of Artificial Sequence: Synthetic oligonucleotide
  Target: ATXN1; (-) strand; PAM type: NRG; PAM sequence: TGG
atttttttttctgtttaatg

SEQ ID NO: 94999 - DNA, 20 bp, Artificial Sequence
  Description of Artificial Sequence: Synthetic oligonucleotide
  Target: ATXN1; (-) strand; PAM type: NRG; PAM sequence: TAG
ctagtttggggatgatttta

SEQ ID NO: 95000 - DNA, 20 bp, Artificial Sequence
  Description of Artificial Sequence: Synthetic oligonucleotide
  Target: ATXN1; (-) strand; PAM type: NRG; PAM sequence: GGG
gtccagcattcactagtttg

SEQ ID NO: 95001 - DNA, 20 bp, Artificial Sequence
  Description of Artificial Sequence: Synthetic oligonucleotide
  Target: ATXN1; (-) strand; PAM type: NRG; PAM sequence: GGG
agtccagcattcactagttt

SEQ ID NO: 95002 - DNA, 20 bp, Artificial Sequence
  Description of Artificial Sequence: Synthetic oligonucleotide
  Target: ATXN1; (-) strand; PAM type: NRG; PAM sequence: TGG
cagtccagcattcactagtt

SEQ ID NO: 95003 - DNA, 20 bp, Artificial Sequence
  Description of Artificial Sequence: Synthetic oligonucleotide
  Target: ATXN1; (-) strand; PAM type: NRG; PAM sequence: TAG
aaaatcagtccagcattcac

SEQ ID NO: 95004 - DNA, 20 bp, Artificial Sequence
  Description of Artificial Sequence: Synthetic oligonucleotide
  Target: ATXN1; (-) strand; PAM type: NRG; PAM sequence: CAG
tcaaagactgaaaatcagtc

SEQ ID NO: 95005 - DNA, 20 bp, Artificial Sequence
  Description of Artificial Sequence: Synthetic oligonucleotide
  Target: ATXN1; (-) strand; PAM type: NRG; PAM sequence: CAG
agtaatcaaagactgaaaat

SEQ ID NO: 95006 - DNA, 20 bp, Artificial Sequence
  Description of Artificial Sequence: Synthetic oligonucleotide
  Target: ATXN1; (-) strand; PAM type: NRG; PAM sequence: AAG
cagatcagctccagtaatca

SEQ ID NO: 95007 - DNA, 20 bp, Artificial Sequence
  Description of Artificial Sequence: Synthetic oligonucleotide
  Target: ATXN1; (-) strand; PAM type: NRG; PAM sequence: CAG
gcaaatgtgcagatcagctc

SEQ ID NO: 95008 - DNA, 20 bp, Artificial Sequence
  Description of Artificial Sequence: Synthetic oligonucleotide
  Target: ATXN1; (-) strand; PAM type: NRG; PAM sequence: CAG
gcctaagcaaatgtgcagat

SEQ ID NO: 95009 - DNA, 20 bp, Artificial Sequence
  Description of Artificial Sequence: Synthetic oligonucleotide
  Target: ATXN1; (-) strand; PAM type: NRG; PAM sequence: CAG
aatcagcctaagcaaatgtg

SEQ ID NO: 95010 - DNA, 20 bp, Artificial Sequence
  Description of Artificial Sequence: Synthetic oligonucleotide
  Target: ATXN1; (-) strand; PAM type: NRG; PAM sequence: AAG
actaagtttaaaatcagcct

SEQ ID NO: 95011 - DNA, 20 bp, Artificial Sequence
  Description of Artificial Sequence: Synthetic oligonucleotide
  Target: ATXN1; (-) strand; PAM type: NRG; PAM sequence: CAG
acccaaactaagtttaaaat

SEQ ID NO: 95012 - DNA, 20 bp, Artificial Sequence
  Description of Artificial Sequence: Synthetic oligonucleotide
  Target: ATXN1; (-) strand; PAM type: NRG; PAM sequence: AAG
gagcttaggaaacccaaact

SEQ ID NO: 95013 - DNA, 20 bp, Artificial Sequence
  Description of Artificial Sequence: Synthetic oligonucleotide
  Target: ATXN1; (-) strand; PAM type: NRG; PAM sequence: AGG
ctgttacctggcgtgagctt

SEQ ID NO: 95014 - DNA, 20 bp, Artificial Sequence
  Description of Artificial Sequence: Synthetic oligonucleotide
  Target: ATXN1; (-) strand; PAM type: NRG; PAM sequence: TAG
actgttacctggcgtgagct

SEQ ID NO: 95015 - DNA, 20 bp, Artificial Sequence
  Description of Artificial Sequence: Synthetic oligonucleotide
  Target: ATXN1; (-) strand; PAM type: NRG; PAM sequence: GAG
ttcctactgttacctggcgt

SEQ ID NO: 95016 - DNA, 20 bp, Artificial Sequence
  Description of Artificial Sequence: Synthetic oligonucleotide
  Target: ATXN1; (-) strand; PAM type: NRG; PAM sequence: TGG
tccttcttcctactgttacc

SEQ ID NO: 95017 - DNA, 20 bp, Artificial Sequence
  Description of Artificial Sequence: Synthetic oligonucleotide
  Target: ATXN1; (-) strand; PAM type: NRG; PAM sequence: GGG
ctgacatccaatataaacct

SEQ ID NO: 95018 - DNA, 20 bp, Artificial Sequence
  Description of Artificial Sequence: Synthetic oligonucleotide
  Target: ATXN1; (-) strand; PAM type: NRG; PAM sequence: TGG
tctgacatccaatataaacc

SEQ ID NO: 95019 - DNA, 20 bp, Artificial Sequence
  Description of Artificial Sequence: Synthetic oligonucleotide
  Target: ATXN1; (-) strand; PAM type: NRG; PAM sequence: TAG
tcatattcatagctccagaa

SEQ ID NO: 95020 - DNA, 20 bp, Artificial Sequence
  Description of Artificial Sequence: Synthetic oligonucleotide
  Target: ATXN1; (-) strand; PAM type: NRG; PAM sequence: CAG
ggagatcatattcatagctc

SEQ ID NO: 95021 - DNA, 20 bp, Artificial Sequence
  Description of Artificial Sequence: Synthetic oligonucleotide
  Target: ATXN1; (-) strand; PAM type: NRG; PAM sequence: TAG
cacattggagatcatattca

SEQ ID NO: 95022 - DNA, 20 bp, Artificial Sequence
  Description of Artificial Sequence: Synthetic oligonucleotide
  Target: ATXN1; (-) strand; PAM type: NRG; PAM sequence: GAG
tttacggattattcacattg

SEQ ID NO: 95023 - DNA, 20 bp, Artificial Sequence
  Description of Artificial Sequence: Synthetic oligonucleotide
  Target: ATXN1; (-) strand; PAM type: NRG; PAM sequence: TGG
tgtttacggattattcacat

SEQ ID NO: 95024 - DNA, 20 bp, Artificial Sequence
  Description of Artificial Sequence: Synthetic oligonucleotide
  Target: ATXN1; (-) strand; PAM type: NRG; PAM sequence: CGG
ttggctcacttacctgttta

SEQ ID NO: 95025 - DNA, 20 bp, Artificial Sequence
  Description of Artificial Sequence: Synthetic oligonucleotide
  Target: ATXN1; (-) strand; PAM type: NRG; PAM sequence: TGG
gccatgtacccaaggataat

SEQ ID NO: 95026 - DNA, 20 bp, Artificial Sequence
  Description of Artificial Sequence: Synthetic oligonucleotide
  Target: ATXN1; (-) strand; PAM type: NRG; PAM sequence: AGG
gatgtgttgccatgtaccca

SEQ ID NO: 95027 - DNA, 20 bp, Artificial Sequence
  Description of Artificial Sequence: Synthetic oligonucleotide
  Target: ATXN1; (-) strand; PAM type: NRG; PAM sequence: AAG
agatgtgttgccatgtaccc

SEQ ID NO: 95028 - DNA, 20 bp, Artificial Sequence
  Description of Artificial Sequence: Synthetic oligonucleotide
  Target: ATXN1; (-) strand; PAM type: NRG; PAM sequence: GAG
tgaaaataatcatgagtacc

SEQ ID NO: 95029 - DNA, 20 bp, Artificial Sequence
  Description of Artificial Sequence: Synthetic oligonucleotide
  Target: ATXN1; (-) strand; PAM type: NRG; PAM sequence: GAG
gtatggatgaaaataatcat

SEQ ID NO: 95030 - DNA, 20 bp, Artificial Sequence
  Description of Artificial Sequence: Synthetic oligonucleotide
  Target: ATXN1; (-) strand; PAM type: NRG; PAM sequence: TGG
ttaaaaatagtgagtgtgta

SEQ ID NO: 95031 - DNA, 20 bp, Artificial Sequence
  Description of Artificial Sequence: Synthetic oligonucleotide
  Target: ATXN1; (-) strand; PAM type: NRG; PAM sequence: GAG
gctgtgctcttaaaaatagt

SEQ ID NO: 95032 - DNA, 20 bp, Artificial Sequence
  Description of Artificial Sequence: Synthetic oligonucleotide
  Target: ATXN1; (-) strand; PAM type: NRG; PAM sequence: TAG
ctgggctgtgctcttaaaaa

SEQ ID NO: 95033 - DNA, 20 bp, Artificial Sequence
  Description of Artificial Sequence: Synthetic oligonucleotide
  Target: ATXN1; (-) strand; PAM type: NRG; PAM sequence: GGG
agttattttcctttccagct

SEQ ID NO: 95034 - DNA, 20 bp, Artificial Sequence
  Description of Artificial Sequence: Synthetic oligonucleotide
  Target: ATXN1; (-) strand; PAM type: NRG; PAM sequence: TGG
aagttattttcctttccagc

SEQ ID NO: 95035 - DNA, 20 bp, Artificial Sequence
  Description of Artificial Sequence: Synthetic oligonucleotide
  Target: ATXN1; (-) strand; PAM type: NRG; PAM sequence: CAG
gtggaagttattttcctttc

SEQ ID NO: 95036 - DNA, 20 bp, Artificial Sequence
  Description of Artificial Sequence: Synthetic oligonucleotide
  Target: ATXN1; (-) strand; PAM type: NRG; PAM sequence: AAG
aaagtgctggaaagaagtgg

SEQ ID NO: 95037 - DNA, 20 bp, Artificial Sequence
  Description of Artificial Sequence: Synthetic oligonucleotide
  Target: ATXN1; (-) strand; PAM type: NRG; PAM sequence: TGG
tgaaaagtgctggaaagaag

SEQ ID NO: 95038 - DNA, 20 bp, Artificial Sequence
  Description of Artificial Sequence: Synthetic oligonucleotide
  Target: ATXN1; (-) strand; PAM type: NRG; PAM sequence: AAG
ctttgaaaagtgctggaaag

SEQ ID NO: 95039 - DNA, 20 bp, Artificial Sequence
  Description of Artificial Sequence: Synthetic oligonucleotide
  Target: ATXN1; (-) strand; PAM type: NRG; PAM sequence: AAG
ttactttgaaaagtgctgga

SEQ ID NO: 95040 - DNA, 20 bp, Artificial Sequence
  Description of Artificial Sequence: Synthetic oligonucleotide
  Target: ATXN1; (-) strand; PAM type: NRG; PAM sequence: TGG
ttcattactttgaaaagtgc

SEQ ID NO: 95041 - DNA, 20 bp, Artificial Sequence
  Description of Artificial Sequence: Synthetic oligonucleotide
  Target: ATXN1; (-) strand; PAM type: NRG; PAM sequence: AAG
ctactgttcattactttgaa

SEQ ID NO: 95042 - DNA, 20 bp, Artificial Sequence
  Description of Artificial Sequence: Synthetic oligonucleotide
  Target: ATXN1; (-) strand; PAM type: NRG; PAM sequence: TGG
agttagaagtaagaacattt

SEQ ID NO: 95043 - DNA, 20 bp, Artificial Sequence
  Description of Artificial Sequence: Synthetic oligonucleotide
  Target: ATXN1; (-) strand; PAM type: NRG; PAM sequence: AAG
tgaatggattagttagaagt

SEQ ID NO: 95044 - DNA, 20 bp, Artificial Sequence
  Description of Artificial Sequence: Synthetic oligonucleotide
  Target: ATXN1; (-) strand; PAM type: NRG; PAM sequence: AAG
ttggtgaatggattagttag

SEQ ID NO: 95045 - DNA, 20 bp, Artificial Sequence
  Description of Artificial Sequence: Synthetic oligonucleotide
  Target: ATXN1; (-) strand; PAM type: NRG; PAM sequence: TAG
tgcttggtgaatggattagt

SEQ ID NO: 95046 - DNA, 20 bp, Artificial Sequence
  Description of Artificial Sequence: Synthetic oligonucleotide
  Target: ATXN1; (-) strand; PAM type: NRG; PAM sequence: TAG
taaatgcttggtgaatggat

SEQ ID NO: 95047 - DNA, 20 bp, Artificial Sequence
  Description of Artificial Sequence: Synthetic oligonucleotide
  Target: ATXN1; (-) strand; PAM type: NRG; PAM sequence: TGG
ttaaataaatgcttggtgaa

SEQ ID NO: 95048 - DNA, 20 bp, Artificial Sequence
  Description of Artificial Sequence: Synthetic oligonucleotide
  Target: ATXN1; (-) strand; PAM type: NRG; PAM sequence: TGG
tcaatgcttaaataaatgct

SEQ ID NO: 95049 - DNA, 20 bp, Artificial Sequence
  Description of Artificial Sequence: Synthetic oligonucleotide
  Target: ATXN1; (-) strand; PAM type: NRG; PAM sequence: AGG
tttgcatatcagtcctcggc

SEQ ID NO: 95050 - DNA, 20 bp, Artificial Sequence
  Description of Artificial Sequence: Synthetic oligonucleotide
  Target: ATXN1; (-) strand; PAM type: NRG; PAM sequence: CAG
ttttgcatatcagtcctcgg

SEQ ID NO: 95051 - DNA, 20 bp, Artificial Sequence
  Description of Artificial Sequence: Synthetic oligonucleotide
  Target: ATXN1; (-) strand; PAM type: NRG; PAM sequence: CGG
ttcttttgcatatcagtcct

SEQ ID NO: 95052 - DNA, 20 bp, Artificial Sequence
  Description of Artificial Sequence: Synthetic oligonucleotide
  Target: ATXN1; (-) strand; PAM type: NRG; PAM sequence: CAG
gaattccttcttttgcatat

SEQ ID NO: 95053 - DNA, 20 bp, Artificial Sequence
  Description of Artificial Sequence: Synthetic oligonucleotide
  Target: ATXN1; (-) strand; PAM type: NRG; PAM sequence: AAG
gtggggaaaccaaggactac

SEQ ID NO: 95054 - DNA, 20 bp, Artificial Sequence
  Description of Artificial Sequence: Synthetic oligonucleotide
  Target: ATXN1; (-) strand; PAM type: NRG; PAM sequence: AGG
gatcacatgtggggaaacca

SEQ ID NO: 95055 - DNA, 20 bp, Artificial Sequence
  Description of Artificial Sequence: Synthetic oligonucleotide
  Target: ATXN1; (-) strand; PAM type: NRG; PAM sequence: AAG
agatcacatgtggggaaacc

SEQ ID NO: 95056 - DNA, 20 bp, Artificial Sequence
  Description of Artificial Sequence: Synthetic oligonucleotide
  Target: ATXN1; (-) strand; PAM type: NRG; PAM sequence: GGG
gtacgcacagatcacatgtg

SEQ ID NO: 95057 - DNA, 20 bp, Artificial Sequence
  Description of Artificial Sequence: Synthetic oligonucleotide
  Target: ATXN1; (-) strand; PAM type: NRG; PAM sequence: GGG
tgtacgcacagatcacatgt

SEQ ID NO: 95058 - DNA, 20 bp, Artificial Sequence
  Description of Artificial Sequence: Synthetic oligonucleotide
  Target: ATXN1; (-) strand; PAM type: NRG; PAM sequence: TGG
ctgtacgcacagatcacatg

SEQ ID NO: 95059 - DNA, 20 bp, Artificial Sequence
  Description of Artificial Sequence: Synthetic oligonucleotide
  Target: ATXN1; (-) strand; PAM type: NRG; PAM sequence: CAG
accttccttctctgtacgca

SEQ ID NO: 95060 - DNA, 20 bp, Artificial Sequence
  Description of Artificial Sequence: Synthetic oligonucleotide
  Target: ATXN1; (-) strand; PAM type: NRG; PAM sequence: CAG
aaagaccttatagtgtataa

SEQ ID NO: 95061 - DNA, 20 bp, Artificial Sequence
  Description of Artificial Sequence: Synthetic oligonucleotide
  Target: ATXN1; (-) strand; PAM type: NRG; PAM sequence: TAG
taaagatctgaaagacctta

SEQ ID NO: 95062 - DNA, 20 bp, Artificial Sequence
  Description of Artificial Sequence: Synthetic oligonucleotide
  Target: ATXN1; (-) strand; PAM type: NRG; PAM sequence: AAG
tgtgccttctaaagatctga

SEQ ID NO: 95063 - DNA, 20 bp, Artificial Sequence
  Description of Artificial Sequence: Synthetic oligonucleotide
  Target: ATXN1; (-) strand; PAM type: NRG; PAM sequence: AAG
tggagggactgtgccttcta

SEQ ID NO: 95064 - DNA, 20 bp, Artificial Sequence
  Description of Artificial Sequence: Synthetic oligonucleotide
  Target: ATXN1; (-) strand; PAM type: NRG; PAM sequence: GGG
tcaacaggcttcttggtgga

SEQ ID NO: 95065 - DNA, 20 bp, Artificial Sequence
  Description of Artificial Sequence: Synthetic oligonucleotide
  Target: ATXN1; (-) strand; PAM type: NRG; PAM sequence: AGG
ctcaacaggcttcttggtgg

SEQ ID NO: 95066 - DNA, 20 bp, Artificial Sequence
  Description of Artificial Sequence: Synthetic oligonucleotide
  Target: ATXN1; (-) strand; PAM type: NRG; PAM sequence: GAG
actcaacaggcttcttggtg

SEQ ID NO: 95067 - DNA, 20 bp, Artificial Sequence
  Description of Artificial Sequence: Synthetic oligonucleotide
  Target: ATXN1; (-) strand; PAM type: NRG; PAM sequence: TGG
taactcaacaggcttcttgg

SEQ ID NO: 95068 - DNA, 20 bp, Artificial Sequence
  Description of Artificial Sequence: Synthetic oligonucleotide
  Target: ATXN1; (-) strand; PAM type: NRG; PAM sequence: TGG
ttgtaactcaacaggcttct

SEQ ID NO: 95069 - DNA, 20 bp, Artificial Sequence
  Description of Artificial Sequence: Synthetic oligonucleotide
  Target: ATXN1; (-) strand; PAM type: NRG; PAM sequence: AGG
atttatatttgtaactcaac

SEQ ID NO: 95070 - DNA, 20 bp, Artificial Sequence
  Description of Artificial Sequence: Synthetic oligonucleotide
  Target: ATXN1; (-) strand; PAM type: NRG; PAM sequence: CAG
tatttatatttgtaactcaa

SEQ ID NO: 95071 - DNA, 20 bp, Artificial Sequence
  Description of Artificial Sequence: Synthetic oligonucleotide
  Target: ATXN1; (-) strand; PAM type: NRG; PAM sequence: TGG
ttgtcaacttctacttaact

SEQ ID NO: 95072 - DNA, 20 bp, Artificial Sequence
  Description of Artificial Sequence: Synthetic oligonucleotide
  Target: ATXN1; (-) strand; PAM type: NRG; PAM sequence: TAG
aaagaagtactaagattaaa

SEQ ID NO: 95073 - DNA, 20 bp, Artificial Sequence
  Description of Artificial Sequence: Synthetic oligonucleotide
  Target: ATXN1; (-) strand; PAM type: NRG; PAM sequence: AAG
ctcatccttaaagaagtact

SEQ ID NO: 95074 - DNA, 20 bp, Artificial Sequence
  Description of Artificial Sequence: Synthetic oligonucleotide
  Target: ATXN1; (-) strand; PAM type: NRG; PAM sequence: AAG
ctgcttcctcatccttaaag

SEQ ID NO: 95075 - DNA, 20 bp, Artificial Sequence
  Description of Artificial Sequence: Synthetic oligonucleotide
  Target: ATXN1; (-) strand; PAM type: NRG; PAM sequence: AAG
tccctgcttcctcatcctta

SEQ ID NO: 95076 - DNA, 20 bp, Artificial Sequence
  Description of Artificial Sequence: Synthetic oligonucleotide
  Target: ATXN1; (-) strand; PAM type: NRG; PAM sequence: GAG
agtattttgatgcttaattt

SEQ ID NO: 95077 - DNA, 20 bp, Artificial Sequence
  Description of Artificial Sequence: Synthetic oligonucleotide
  Target: ATXN1; (-) strand; PAM type: NRG; PAM sequence: AAG
ctgcacctcatttgagaatc

SEQ ID NO: 95078 - DNA, 20 bp, Artificial Sequence
  Description of Artificial Sequence: Synthetic oligonucleotide
  Target: ATXN1; (-) strand; PAM type: NRG; PAM sequence: GAG
atggtacctgcacctcattt

SEQ ID NO: 95079 - DNA, 20 bp, Artificial Sequence
  Description of Artificial Sequence: Synthetic oligonucleotide
  Target: ATXN1; (-) strand; PAM type: NRG; PAM sequence: TGG
aagcactgtctgtaaattta

SEQ ID NO: 95080 - DNA, 20 bp, Artificial Sequence
  Description of Artificial Sequence: Synthetic oligonucleotide
  Target: ATXN1; (-) strand; PAM type: NRG; PAM sequence: AAG
ccaactggtgagctcataaa

SEQ ID NO: 95081 - DNA, 20 bp, Artificial Sequence
  Description of Artificial Sequence: Synthetic oligonucleotide
  Target: ATXN1; (-) strand; PAM type: NRG; PAM sequence: GAG
caaacactctcccaactggt

SEQ ID NO: 95082 - DNA, 20 bp, Artificial Sequence
  Description of Artificial Sequence: Synthetic oligonucleotide
  Target: ATXN1; (-) strand; PAM type: NRG; PAM sequence: TGG
taggcaaacactctcccaac

SEQ ID NO: 95083 - DNA, 20 bp, Artificial Sequence
  Description of Artificial Sequence: Synthetic oligonucleotide
  Target: ATXN1; (-) strand; PAM type: NRG; PAM sequence: AGG
gtgcacacacattgtcatat

SEQ ID NO: 95084 - DNA, 20 bp, Artificial Sequence
  Description of Artificial Sequence: Synthetic oligonucleotide
  Target: ATXN1; (-) strand; PAM type: NRG; PAM sequence: TAG
tgtgcacacacattgtcata

SEQ ID NO: 95085 - DNA, 20 bp, Artificial Sequence
  Description of Artificial Sequence: Synthetic oligonucleotide
  Target: ATXN1; (-) strand; PAM type: NRG; PAM sequence: AGG
ctgccaggtgatatgtaaac

SEQ ID NO: 95086 - DNA, 20 bp, Artificial Sequence
  Description of Artificial Sequence: Synthetic oligonucleotide
  Target: ATXN1; (-) strand; PAM type: NRG; PAM sequence: CAG
tctgccaggtgatatgtaaa

SEQ ID NO: 95087 - DNA, 20 bp, Artificial Sequence
  Description of Artificial Sequence: Synthetic oligonucleotide
  Target: ATXN1; (-) strand; PAM type: NRG; PAM sequence: AGG
tctataaaaccttatctgcc

SEQ ID NO: 95088 - DNA, 20 bp, Artificial Sequence
  Description of Artificial Sequence: Synthetic oligonucleotide
  Target: ATXN1; (-) strand; PAM type: NRG; PAM sequence: CAG
ctctataaaaccttatctgc

SEQ ID NO: 95089 - DNA, 20 bp, Artificial Sequence
  Description of Artificial Sequence: Synthetic oligonucleotide
  Target: ATXN1; (-) strand; PAM type: NRG; PAM sequence: TGG
actaggaggaggttgtaact

SEQ ID NO: 95090 - DNA, 20 bp, Artificial Sequence
  Description of Artificial Sequence: Synthetic oligonucleotide
  Target: ATXN1; (-) strand; PAM type: NRG; PAM sequence: AGG
cacttcagcaaactaggagg

SEQ ID NO: 95091 - DNA, 20 bp, Artificial Sequence
  Description of Artificial Sequence: Synthetic oligonucleotide
  Target: ATXN1; (-) strand; PAM type: NRG; PAM sequence: GAG
gcacttcagcaaactaggag

SEQ ID NO: 95092 - DNA, 20 bp, Artificial Sequence
  Description of Artificial Sequence: Synthetic oligonucleotide
  Target: ATXN1; (-) strand; PAM type: NRG; PAM sequence: AGG
ctgcacttcagcaaactagg

SEQ ID NO: 95093 - DNA, 20 bp, Artificial Sequence
  Description of Artificial Sequence: Synthetic oligonucleotide
  Target: ATXN1; (-) strand; PAM type: NRG; PAM sequence: GAG
tctgcacttcagcaaactag

SEQ ID NO: 95094 - DNA, 20 bp, Artificial Sequence
  Description of Artificial Sequence: Synthetic oligonucleotide
  Target: ATXN1; (-) strand; PAM type: NRG; PAM sequence: AGG
cctctgcacttcagcaaact

SEQ ID NO: 95095 - DNA, 20 bp, Artificial Sequence
  Description of Artificial Sequence: Synthetic oligonucleotide
  Target: ATXN1; (-) strand; PAM type: NRG; PAM sequence: TAG
tcctctgcacttcagcaaac

SEQ ID NO: 95096 - DNA, 20 bp, Artificial Sequence
  Description of Artificial Sequence: Synthetic oligonucleotide
  Target: ATXN1; (-) strand; PAM type: NRG; PAM sequence: CAG
tttgaccctcctctgcactt

SEQ ID NO: 95097 - DNA, 20 bp, Artificial Sequence
  Description of Artificial Sequence: Synthetic oligonucleotide
  Target: ATXN1; (-) strand; PAM type: NRG; PAM sequence: TGG
aagagtaaagtaatcttcta

SEQ ID NO: 95098 - DNA, 20 bp, Artificial Sequence
  Description of Artificial Sequence: Synthetic oligonucleotide
  Target: ATXN1; (-) strand; PAM type: NRG; PAM sequence: AAG
agcatactcatgcaagagta

SEQ ID NO: 95099 - DNA, 20 bp, Artificial Sequence
  Description of Artificial Sequence: Synthetic oligonucleotide
  Target: ATXN1; (-) strand; PAM type: NRG; PAM sequence: GAG
aagaaagcatactcatgcaa

SEQ ID NO: 95100 - DNA, 20 bp, Artificial Sequence
  Description of Artificial Sequence: Synthetic oligonucleotide
  Target: ATXN1; (-) strand; PAM type: NRG; PAM sequence: AAG
ataagaaagcatactcatgc

SEQ ID NO: 95101 - DNA, 20 bp, Artificial Sequence
  Description of Artificial Sequence: Synthetic oligonucleotide
  Target: ATXN1; (-) strand; PAM type: NRG; PAM sequence: AAG
caaatacttttgaaataaga

SEQ ID NO: 95102 - DNA, 20 bp, Artificial Sequence
  Description of Artificial Sequence: Synthetic oligonucleotide
  Target: ATXN1; (-) strand; PAM type: NRG; PAM sequence: AAG
aacacaaatacttttgaaat

SEQ ID NO: 95103 - DNA, 20 bp, Artificial Sequence
  Description of Artificial Sequence: Synthetic oligonucleotide
  Target: ATXN1; (-) strand; PAM type: NRG; PAM sequence: CAG
ctgtattatcctaactagtg

SEQ ID NO: 95104 - DNA, 20 bp, Artificial Sequence
  Description of Artificial Sequence: Synthetic oligonucleotide
  Target: ATXN1; (-) strand; PAM type: NRG; PAM sequence: TAG
actctctgtattatcctaac

SEQ ID NO: 95105 - DNA, 20 bp, Artificial Sequence
  Description of Artificial Sequence: Synthetic oligonucleotide
  Target: ATXN1; (-) strand; PAM type: NRG; PAM sequence: AAG
tcttccctctgatggaatac

SEQ ID NO: 95106 - DNA, 20 bp, Artificial Sequence
  Description of Artificial Sequence: Synthetic oligonucleotide
  Target: ATXN1; (-) strand; PAM type: NRG; PAM sequence: TGG
tcttgccttcttccctctga

SEQ ID NO: 95107 - DNA, 20 bp, Artificial Sequence
  Description of Artificial Sequence: Synthetic oligonucleotide
  Target: ATXN1; (-) strand; PAM type: NRG; PAM sequence: CAG
tattattttgtaagtttttg

SEQ ID NO: 95108 - DNA, 20 bp, Artificial Sequence
  Description of Artificial Sequence: Synthetic oligonucleotide
  Target: ATXN1; (-) strand; PAM type: NRG; PAM sequence: AAG
tttctggtatattattttgt

SEQ ID NO: 95109 - DNA, 20 bp, Artificial Sequence
  Description of Artificial Sequence: Synthetic oligonucleotide
  Target: ATXN1; (-) strand; PAM type: NRG; PAM sequence: TGG
atgtcctataaattattttc

SEQ ID NO: 95110 - DNA, 20 bp, Artificial Sequence
  Description of Artificial Sequence: Synthetic oligonucleotide
  Target: ATXN1; (-) strand; PAM type: NRG; PAM sequence: TGG
aatattgagtattccatttt

SEQ ID NO: 95111 - DNA, 20 bp, Artificial Sequence
  Description of Artificial Sequence: Synthetic oligonucleotide
  Target: ATXN1; (-) strand; PAM type: NRG; PAM sequence: GAG
tgctgggttttaaaaatatt

SEQ ID NO: 95112 - DNA, 20 bp, Artificial Sequence
  Description of Artificial Sequence: Synthetic oligonucleotide
  Target: ATXN1; (-) strand; PAM type: NRG; PAM sequence: GGG
ttgtattatgttgctctgct

SEQ ID NO: 95113 - DNA, 20 bp, Artificial Sequence
  Description of Artificial Sequence: Synthetic oligonucleotide
  Target: ATXN1; (-) strand; PAM type: NRG; PAM sequence: TGG
attgtattatgttgctctgc

SEQ ID NO: 95114 - DNA, 20 bp, Artificial Sequence
  Description of Artificial Sequence: Synthetic oligonucleotide
  Target: ATXN1; (-) strand; PAM type: NRG; PAM sequence: TAG
tgttaatcttccaatattaa

SEQ ID NO: 95115 - DNA, 20 bp, Artificial Sequence
  Description of Artificial Sequence: Synthetic oligonucleotide
  Target: ATXN1; (-) strand; PAM type: NRG; PAM sequence: AGG
ccattacctcagttttgttt

SEQ ID NO: 95116 - DNA, 20 bp, Artificial Sequence
  Description of Artificial Sequence: Synthetic oligonucleotide
  Target: ATXN1; (-) strand; PAM type: NRG; PAM sequence: TAG
accattacctcagttttgtt

SEQ ID NO: 95117 - DNA, 20 bp, Artificial Sequence
  Description of Artificial Sequence: Synthetic oligonucleotide
  Target: ATXN1; (-) strand; PAM type: NRG; PAM sequence: CAG
gtacttactgaccattacct

SEQ ID NO: 95118 - DNA, 20 bp, Artificial Sequence
  Description of Artificial Sequence: Synthetic oligonucleotide
  Target: ATXN1; (-) strand; PAM type: NRG; PAM sequence: TGG
ccctttctcacattatctcc

SEQ ID NO: 95119 - DNA, 20 bp, Artificial Sequence
  Description of Artificial Sequence: Synthetic oligonucleotide
  Target: ATXN1; (-) strand; PAM type: NRG; PAM sequence: TGG
tatttttctgtcactgtgta

SEQ ID NO: 95120 - DNA, 20 bp, Artificial Sequence
  Description of Artificial Sequence: Synthetic oligonucleotide
  Target: ATXN1; (-) strand; PAM type: NRG; PAM sequence: AAG
atctatccttctaacgttca

SEQ ID NO: 95121 - DNA, 20 bp, Artificial Sequence
  Description of Artificial Sequence: Synthetic oligonucleotide
  Target: ATXN1; (-) strand; PAM type: NRG; PAM sequence: TAG
ttattgtagctactaaccta

SEQ ID NO: 95122 - DNA, 20 bp, Artificial Sequence
  Description of Artificial Sequence: Synthetic oligonucleotide
  Target: ATXN1; (-) strand; PAM type: NRG; PAM sequence: TAG
gtttttcgtgacagttattg

SEQ ID NO: 95123 - DNA, 20 bp, Artificial Sequence
  Description of Artificial Sequence: Synthetic oligonucleotide
  Target: ATXN1; (-) strand; PAM type: NRG; PAM sequence: CAG
gtagcagaagtttttcgtga

SEQ ID NO: 95124 - DNA, 20 bp, Artificial Sequence
  Description of Artificial Sequence: Synthetic oligonucleotide
  Target: ATXN1; (-) strand; PAM type: NRG; PAM sequence: AAG
ttgaatgagttaggtagcag

SEQ ID NO: 95125 - DNA, 20 bp, Artificial Sequence
  Description of Artificial Sequence: Synthetic oligonucleotide
  Target: ATXN1; (-) strand; PAM type: NRG; PAM sequence: CAG
gttttgaatgagttaggtag

SEQ ID NO: 95126 - DNA, 20 bp, Artificial Sequence
  Description of Artificial Sequence: Synthetic oligonucleotide
  Target: ATXN1; (-) strand; PAM type: NRG; PAM sequence: TAG
caagttttgaatgagttagg

SEQ ID NO: 95127 - DNA, 20 bp, Artificial Sequence
  Description of Artificial Sequence: Synthetic oligonucleotide
  Target: ATXN1; (-) strand; PAM type: NRG; PAM sequence: AGG
tgacaagttttgaatgagtt

SEQ ID NO: 95128 - DNA, 20 bp, Artificial Sequence
  Description of Artificial Sequence: Synthetic oligonucleotide
  Target: ATXN1; (-) strand; PAM type: NRG; PAM sequence: TAG
atgacaagttttgaatgagt

SEQ ID NO: 95129 - DNA, 20 bp, Artificial Sequence
  Description of Artificial Sequence: Synthetic oligonucleotide
  Target: ATXN1; (-) strand; PAM type: NRG; PAM sequence: GAG
taacatgacaagttttgaat

SEQ ID NO: 95130 - DNA, 20 bp, Artificial Sequence
  Description of Artificial Sequence: Synthetic oligonucleotide
  Target: ATXN1; (-) strand; PAM type: NRG; PAM sequence: AAG
taggtgccctttaacatgac

SEQ ID NO: 95131 - DNA, 20 bp, Artificial Sequence
  Description of Artificial Sequence: Synthetic oligonucleotide
  Target: ATXN1; (-) strand; PAM type: NRG; PAM sequence: AGG
ttttttttttttttacactt

SEQ ID NO: 95132 - DNA, 20 bp, Artificial Sequence
  Description of Artificial Sequence: Synthetic oligonucleotide
  Target: ATXN1; (-) strand; PAM type: NRG; PAM sequence: TAG
tttttttttttttttacact

SEQ ID NO: 95133 - DNA, 20 bp, Artificial Sequence
  Description of Artificial Sequence: Synthetic oligonucleotide
  Target: ATXN1; (-) strand; PAM type: NRG; PAM sequence: AGG
atgttttgatttgggctaag

SEQ ID NO: 95134 - DNA, 20 bp, Artificial Sequence
  Description of Artificial Sequence: Synthetic oligonucleotide
  Target: ATXN1; (-) strand; PAM type: NRG; PAM sequence: GAG
gatgttttgatttgggctaa

SEQ ID NO: 95135 - DNA, 20 bp, Artificial Sequence
  Description of Artificial Sequence: Synthetic oligonucleotide
  Target: ATXN1; (-) strand; PAM type: NRG; PAM sequence: AAG
gtgatgttttgatttgggct

SEQ ID NO: 95136 - DNA, 20 bp, Artificial Sequence
  Description of Artificial Sequence: Synthetic oligonucleotide
  Target: ATXN1; (-) strand; PAM type: NRG; PAM sequence: GGG
cgattgtgatgttttgattt

SEQ ID NO: 95137 - DNA, 20 bp, Artificial Sequence
  Description of Artificial Sequence: Synthetic oligonucleotide
  Target: ATXN1; (-) strand; PAM type: NRG; PAM sequence: TGG
ccgattgtgatgttttgatt

SEQ ID NO: 95138 - DNA, 20 bp, Artificial Sequence
  Description of Artificial Sequence: Synthetic oligonucleotide
  Target: ATXN1; (-) strand; PAM type: NRG; PAM sequence: AGG
tttgagactcaagagggcag

SEQ ID NO: 95139 - DNA, 20 bp, Artificial Sequence
  Description of Artificial Sequence: Synthetic oligonucleotide
  Target: ATXN1; (-) strand; PAM type: NRG; PAM sequence: GAG
atttgagactcaagagggca

SEQ ID NO: 95140 - DNA, 20 bp, Artificial Sequence
  Description of Artificial Sequence: Synthetic oligonucleotide
  Target: ATXN1; (-) strand; PAM type: NRG; PAM sequence: CAG
gaatttgagactcaagaggg

SEQ ID NO: 95141 - DNA, 20 bp, Artificial Sequence
  Description of Artificial Sequence: Synthetic oligonucleotide
  Target: ATXN1; (-) strand; PAM type: NRG; PAM sequence: GGG
tcagaatttgagactcaaga

SEQ ID NO: 95142 - DNA, 20 bp, Artificial Sequence
  Description of Artificial Sequence: Synthetic oligonucleotide
  Target: ATXN1; (-) strand; PAM type: NRG; PAM sequence: AGG
ctcagaatttgagactcaag

SEQ ID NO: 95143 - DNA, 20 bp, Artificial Sequence
  Description of Artificial Sequence: Synthetic oligonucleotide
  Target: ATXN1; (-) strand; PAM type: NRG; PAM sequence: GAG
actcagaatttgagactcaa

SEQ ID NO: 95144 - DNA, 20 bp, Artificial Sequence
  Description of Artificial Sequence: Synthetic oligonucleotide
  Target: ATXN1; (-) strand; PAM type: NRG; PAM sequence: AAG
gtactcagaatttgagactc

SEQ ID NO: 95145 - DNA, 20 bp, Artificial Sequence
  Description of Artificial Sequence: Synthetic oligonucleotide
  Target: ATXN1; (-) strand; PAM type: NRG; PAM sequence: GAG
tggtagtgtactcagaattt

SEQ ID NO: 95146 - DNA, 20 bp, Artificial Sequence
  Description of Artificial Sequence: Synthetic oligonucleotide
  Target: ATXN1; (-) strand; PAM type: NRG; PAM sequence: CAG
aaaattcatggtagtgtact

SEQ ID NO: 95147 - DNA, 20 bp, Artificial Sequence
  Description of Artificial Sequence: Synthetic oligonucleotide
  Target: ATXN1; (-) strand; PAM type: NRG; PAM sequence: TAG
actttccagaaaattcatgg

SEQ ID NO: 95148 - DNA, 20 bp, Artificial Sequence
  Description of Artificial Sequence: Synthetic oligonucleotide
  Target: ATXN1; (-) strand; PAM type: NRG; PAM sequence: TGG
attactttccagaaaattca

SEQ ID NO: 95149 - DNA, 20 bp, Artificial Sequence
  Description of Artificial Sequence: Synthetic oligonucleotide
  Target: ATXN1; (-) strand; PAM type: NRG; PAM sequence: CAG
cctacctgaaaattactttc

SEQ ID NO: 95150 - DNA, 20 bp, Artificial Sequence
  Description of Artificial Sequence: Synthetic oligonucleotide
  Target: ATXN1; (-) strand; PAM type: NRG; PAM sequence: AAG
aatgataattgccacaatgt

SEQ ID NO: 95151 - DNA, 20 bp, Artificial Sequence
  Description of Artificial Sequence: Synthetic oligonucleotide
  Target: ATXN1; (-) strand; PAM type: NRG; PAM sequence: GAG
tttaatgcatcccatttgtg

SEQ ID NO: 95152 - DNA, 20 bp, Artificial Sequence
  Description of Artificial Sequence: Synthetic oligonucleotide
  Target: ATXN1; (-) strand; PAM type: NRG; PAM sequence: TGG
cttttaatgcatcccatttg

SEQ ID NO: 95153 - DNA, 20 bp, Artificial Sequence
  Description of Artificial Sequence: Synthetic oligonucleotide
  Target: ATXN1; (-) strand; PAM type: NRG; PAM sequence: CAG
tttgacatatttcatgttag

SEQ ID NO: 95154 - DNA, 20 bp, Artificial Sequence
  Description of Artificial Sequence: Synthetic oligonucleotide
  Target: ATXN1; (-) strand; PAM type: NRG; PAM sequence: TAG
ttgtttgacatatttcatgt

SEQ ID NO: 95155 - DNA, 20 bp, Artificial Sequence
  Description of Artificial Sequence: Synthetic oligonucleotide
  Target: ATXN1; (-) strand; PAM type: NRG; PAM sequence: AAG
attatggacaaaaaagcaac

SEQ ID NO: 95156 - DNA, 20 bp, Artificial Sequence
  Description of Artificial Sequence: Synthetic oligonucleotide
  Target: ATXN1; (-) strand; PAM type: NRG; PAM sequence: AAG
gagaacaattatggacaaaa

SEQ ID NO: 95157 - DNA, 20 bp, Artificial Sequence
  Description of Artificial Sequence: Synthetic oligonucleotide
  Target: ATXN1; (-) strand; PAM type: NRG; PAM sequence: TGG
acgtttagagagaacaatta

SEQ ID NO: 95158 - DNA, 20 bp, Artificial Sequence
  Description of Artificial Sequence: Synthetic oligonucleotide
  Target: ATXN1; (-) strand; PAM type: NRG; PAM sequence: GAG
tgtaccaaaacacgtttaga

SEQ ID NO: 95159 - DNA, 20 bp, Artificial Sequence
  Description of Artificial Sequence: Synthetic oligonucleotide
  Target: ATXN1; (-) strand; PAM type: NRG; PAM sequence: GAG
aatgtaccaaaacacgttta

SEQ ID NO: 95160 - DNA, 20 bp, Artificial Sequence
  Description of Artificial Sequence: Synthetic oligonucleotide
  Target: ATXN1; (-) strand; PAM type: NRG; PAM sequence: TAG
caaatgtaccaaaacacgtt

SEQ ID NO: 95161 - DNA, 20 bp, Artificial Sequence
  Description of Artificial Sequence: Synthetic oligonucleotide
  Target: ATXN1; (-) strand; PAM type: NRG; PAM sequence: AGG
cgctcataatttgaactttc

SEQ ID NO: 95162 - DNA, 20 bp, Artificial Sequence
  Description of Artificial Sequence: Synthetic oligonucleotide
  Target: ATXN1; (-) strand; PAM type: NRG; PAM sequence: CAG
acgctcataatttgaacttt

SEQ ID NO: 95163 - DNA, 20 bp, Artificial Sequence
  Description of Artificial Sequence: Synthetic oligonucleotide
  Target: ATXN1; (-) strand; PAM type: NRG; PAM sequence: TAG
gatatttgtctttattagtg

SEQ ID NO: 95164 - DNA, 20 bp, Artificial Sequence
  Description of Artificial Sequence: Synthetic oligonucleotide
  Target: ATXN1; (-) strand; PAM type: NRG; PAM sequence: TAG
ttatggatatttgtctttat

SEQ ID NO: 95165 - DNA, 20 bp, Artificial Sequence
  Description of Artificial Sequence: Synthetic oligonucleotide
  Target: ATXN1; (-) strand; PAM type: NRG; PAM sequence: TGG
ttcttttataattatattta

SEQ ID NO: 95166 - DNA, 20 bp, Artificial Sequence
  Description of Artificial Sequence: Synthetic oligonucleotide
  Target: ATXN1; (-) strand; PAM type: NRG; PAM sequence: AAG
ttttagacaaatcttatgga

SEQ ID NO: 95167 - DNA, 20 bp, Artificial Sequence
  Description of Artificial Sequence: Synthetic oligonucleotide
  Target: ATXN1; (-) strand; PAM type: NRG; PAM sequence: TGG
atggttttagacaaatctta

SEQ ID NO: 95168 - DNA, 20 bp, Artificial Sequence
  Description of Artificial Sequence: Synthetic oligonucleotide
  Target: ATXN1; (-) strand; PAM type: NRG; PAM sequence: TAG
agtaataaaaagaatggttt

SEQ ID NO: 95169 - DNA, 20 bp, Artificial Sequence
  Description of Artificial Sequence: Synthetic oligonucleotide
  Target: ATXN1; (-) strand; PAM type: NRG; PAM sequence: TGG
tacagaagtaataaaaagaa

SEQ ID NO: 95170 - DNA, 20 bp, Artificial Sequence
  Description of Artificial Sequence: Synthetic oligonucleotide
  Target: ATXN1; (-) strand; PAM type: NRG; PAM sequence: AAG
aaaattacagaagtaataaa

SEQ ID NO: 95171 - DNA, 20 bp, Artificial Sequence
  Description of Artificial Sequence: Synthetic oligonucleotide
  Target: ATXN1; (-) strand; PAM type: NRG; PAM sequence: AAG
ataaatgcttaaaattacag

SEQ ID NO: 95172 - DNA, 20 bp, Artificial Sequence
  Description of Artificial Sequence: Synthetic oligonucleotide
  Target: ATXN1; (-) strand; PAM type: NRG; PAM sequence: CAG
tatataaatgcttaaaatta

SEQ ID NO: 95173 - DNA, 20 bp, Artificial Sequence
  Description of Artificial Sequence: Synthetic oligonucleotide
  Target: ATXN1; (-) strand; PAM type: NRG; PAM sequence: GAG
gaaagaacggtaattacatt

SEQ ID NO: 95174 - DNA, 20 bp, Artificial Sequence
  Description of Artificial Sequence: Synthetic oligonucleotide
  Target: ATXN1; (-) strand; PAM type: NRG; PAM sequence: CGG
ttaaatgttggctgaaagaa

SEQ ID NO: 95175 - DNA, 20 bp, Artificial Sequence
  Description of Artificial Sequence: Synthetic oligonucleotide
  Target: ATXN1; (-) strand; PAM type: NRG; PAM sequence: AAG
attttttaaatgttggctga

SEQ ID NO: 95176 - DNA, 20 bp, Artificial Sequence
  Description of Artificial Sequence: Synthetic oligonucleotide
  Target: ATXN1; (-) strand; PAM type: NRG; PAM sequence: TGG
ttacagaattttttaaatgt

SEQ ID NO: 95177 - DNA, 20 bp, Artificial Sequence
  Description of Artificial Sequence: Synthetic oligonucleotide
  Target: ATXN1; (-) strand; PAM type: NRG; PAM sequence: CAG
gatatacagtgtcagtttta

SEQ ID NO: 95178 - DNA, 20 bp, Artificial Sequence
  Description of Artificial Sequence: Synthetic oligonucleotide
  Target: ATXN1; (-) strand; PAM type: NRG; PAM sequence: CAG
taagaagtgatatacagtgt

SEQ ID NO: 95179 - DNA, 20 bp, Artificial Sequence
  Description of Artificial Sequence: Synthetic oligonucleotide
  Target: ATXN1; (-) strand; PAM type: NRG; PAM sequence: CAG
tttttttaagaagtgatata

SEQ ID NO: 95180 - DNA, 20 bp, Artificial Sequence
  Description of Artificial Sequence: Synthetic oligonucleotide
  Target: ATXN1; (-) strand; PAM type: NRG; PAM sequence: AAG
tcattcaaaatttttttaag

SEQ ID NO: 95181 - DNA, 20 bp, Artificial Sequence
  Description of Artificial Sequence: Synthetic oligonucleotide
  Target: ATXN1; (-) strand; PAM type: NRG; PAM sequence: AAG
tactcattcaaaattttttt

SEQ ID NO: 95182 - DNA, 20 bp, Artificial Sequence
  Description of Artificial Sequence: Synthetic oligonucleotide
  Target: ATXN1; (-) strand; PAM type: NRG; PAM sequence: TAG
cattttattttcatgtaatt

SEQ ID NO: 95183 - DNA, 20 bp, Artificial Sequence
  Description of Artificial Sequence: Synthetic oligonucleotide
  Target: ATXN1; (-) strand; PAM type: NRG; PAM sequence: AAG
ttttctaagataagaatttt

SEQ ID NO: 95184 - DNA, 20 bp, Artificial Sequence
  Description of Artificial Sequence: Synthetic oligonucleotide
  Target: ATXN1; (-) strand; PAM type: NRG; PAM sequence: AAG
agaacttccttttctaagat

SEQ ID NO: 95185 - DNA, 20 bp, Artificial Sequence
  Description of Artificial Sequence: Synthetic oligonucleotide
  Target: ATXN1; (-) strand; PAM type: NRG; PAM sequence: AAG
catatagaacttccttttct

SEQ ID NO: 95186 - DNA, 20 bp, Artificial Sequence
  Description of Artificial Sequence: Synthetic oligonucleotide
  Target: ATXN1; (-) strand; PAM type: NRG; PAM sequence: TAG
ctgttttaggaccttacata

SEQ ID NO: 95187 - DNA, 20 bp, Artificial Sequence
  Description of Artificial Sequence: Synthetic oligonucleotide
  Target: ATXN1; (-) strand; PAM type: NRG; PAM sequence: AGG
gaaataataatttctgtttt

SEQ ID NO: 95188 - DNA, 20 bp, Artificial Sequence
  Description of Artificial Sequence: Synthetic oligonucleotide
  Target: ATXN1; (-) strand; PAM type: NRG; PAM sequence: TAG
agaaataataatttctgttt

SEQ ID NO: 95189 - DNA, 20 bp, Artificial Sequence
  Description of Artificial Sequence: Synthetic oligonucleotide
  Target: ATXN1; (-) strand; PAM type: NRG; PAM sequence: TAG
atacattgtagaaatggtaa

SEQ ID NO: 95190 - DNA, 20 bp, Artificial Sequence
  Description of Artificial Sequence: Synthetic oligonucleotide
  Target: ATXN1; (-) strand; PAM type: NRG; PAM sequence: TGG
aaagcaatacattgtagaaa

SEQ ID NO: 95191 - DNA, 20 bp, Artificial Sequence
  Description of Artificial Sequence: Synthetic oligonucleotide
  Target: ATXN1; (-) strand; PAM type: NRG; PAM sequence: TAG
gcattgaaagcaatacattg

SEQ ID NO: 95192 - DNA, 20 bp, Artificial Sequence
  Description of Artificial Sequence: Synthetic oligonucleotide
  Target: ATXN1; (-) strand; PAM type: NRG; PAM sequence: AAG
tattttgataaaagcattga

SEQ ID NO: 95193 - DNA, 20 bp, Artificial Sequence
  Description of Artificial Sequence: Synthetic oligonucleotide
  Target: ATXN1; (-) strand; PAM type: NRG; PAM sequence: AAG
ggccctccttattttgataa

SEQ ID NO: 95194 - DNA, 20 bp, Artificial Sequence
  Description of Artificial Sequence: Synthetic oligonucleotide
  Target: ATXN1; (-) strand; PAM type: NRG; PAM sequence: AGG
cttccaaggttatcagaagc

SEQ ID NO: 95195 - DNA, 20 bp, Artificial Sequence
  Description of Artificial Sequence: Synthetic oligonucleotide
  Target: ATXN1; (-) strand; PAM type: NRG; PAM sequence: CAG
acttccaaggttatcagaag

SEQ ID NO: 95196 - DNA, 20 bp, Artificial Sequence
  Description of Artificial Sequence: Synthetic oligonucleotide
  Target: ATXN1; (-) strand; PAM type: NRG; PAM sequence: AAG
catacttccaaggttatcag

SEQ ID NO: 95197 - DNA, 20 bp, Artificial Sequence
  Description of Artificial Sequence: Synthetic oligonucleotide
  Target: ATXN1; (-) strand; PAM type: NRG; PAM sequence: CAG
ggtcatacttccaaggttat

SEQ ID NO: 95198 - DNA, 20 bp, Artificial Sequence
  Description of Artificial Sequence: Synthetic oligonucleotide
  Target: ATXN1; (-) strand; PAM type: NRG; PAM sequence: AGG
tagttctggtcatacttcca

SEQ ID NO: 95199 - DNA, 20 bp, Artificial Sequence
  Description of Artificial Sequence: Synthetic oligonucleotide
  Target: ATXN1; (-) strand; PAM type: NRG; PAM sequence: AAG
ttagttctggtcatacttcc

SEQ ID NO: 95200 - DNA, 20 bp, Artificial Sequence
  Description of Artificial Sequence: Synthetic oligonucleotide
  Target: ATXN1; (-) strand; PAM type: NRG; PAM sequence: TGG
tcaaataacagatttagttc

SEQ ID NO: 95201 - DNA, 20 bp, Artificial Sequence
  Description of Artificial Sequence: Synthetic oligonucleotide
  Target: ATXN1; (-) strand; PAM type: NRG; PAM sequence: TAG
attgcttcaaataacagatt

SEQ ID NO: 95202 - DNA, 20 bp, Artificial Sequence
  Description of Artificial Sequence: Synthetic oligonucleotide
  Target: ATXN1; (-) strand; PAM type: NRG; PAM sequence: CAG
agcttaattgcttcaaataa

SEQ ID NO: 95203 - DNA, 20 bp, Artificial Sequence
  Description of Artificial Sequence: Synthetic oligonucleotide
  Target: ATXN1; (-) strand; PAM type: NRG; PAM sequence: CAG
gtgagagatttagatctgtg

SEQ ID NO: 95204 - DNA, 20 bp, Artificial Sequence
  Description of Artificial Sequence: Synthetic oligonucleotide
  Target: ATXN1; (-) strand; PAM type: NRG; PAM sequence: TAG
attagtttctgtgagagatt

SEQ ID NO: 95205 - DNA, 20 bp, Artificial Sequence
  Description of Artificial Sequence: Synthetic oligonucleotide
  Target: ATXN1; (-) strand; PAM type: NRG; PAM sequence: GAG
cgaatgattagtttctgtga

SEQ ID NO: 95206 - DNA, 20 bp, Artificial Sequence
  Description of Artificial Sequence: Synthetic oligonucleotide
  Target: ATXN1; (-) strand; PAM type: NRG; PAM sequence: GAG
ttcgaatgattagtttctgt

SEQ ID NO: 95207 - DNA, 20 bp, Artificial Sequence
  Description of Artificial Sequence: Synthetic oligonucleotide
  Target: ATXN1; (-) strand; PAM type: NRG; PAM sequence: TAG
aattcaatagttcgaatgat

SEQ ID NO: 95208 - DNA, 20 bp, Artificial Sequence
  Description of Artificial Sequence: Synthetic oligonucleotide
  Target: ATXN1; (-) strand; PAM type: NRG; PAM sequence: TAG
gtattttcagagtaattcaa

SEQ ID NO: 95209 - DNA, 20 bp, Artificial Sequence
  Description of Artificial Sequence: Synthetic oligonucleotide
  Target: ATXN1; (-) strand; PAM type: NRG; PAM sequence: GAG
ttccttgctctgtattttca

SEQ ID NO: 95210 - DNA, 20 bp, Artificial Sequence
  Description of Artificial Sequence: Synthetic oligonucleotide
  Target: ATXN1; (-) strand; PAM type: NRG; PAM sequence: CAG
ctttccttgctctgtatttt

SEQ ID NO: 95211 - DNA, 20 bp, Artificial Sequence
  Description of Artificial Sequence: Synthetic oligonucleotide
  Target: ATXN1; (-) strand; PAM type: NRG; PAM sequence: TAG
tattatttttaggggagaga

SEQ ID NO: 95212 - DNA, 20 bp, Artificial Sequence
  Description of Artificial Sequence: Synthetic oligonucleotide
  Target: ATXN1; (-) strand; PAM type: NRG; PAM sequence: GAG
aggctattatttttagggga

SEQ ID NO: 95213 - DNA, 20 bp, Artificial Sequence
  Description of Artificial Sequence: Synthetic oligonucleotide
  Target: ATXN1; (-) strand; PAM type: NRG; PAM sequence: GAG
acaggctattatttttaggg

SEQ ID NO: 95214 - DNA, 20 bp, Artificial Sequence
  Description of Artificial Sequence: Synthetic oligonucleotide
  Target: ATXN1; (-) strand; PAM type: NRG; PAM sequence: GGG
agacaggctattatttttag

SEQ ID NO: 95215 - DNA, 20 bp, Artificial Sequence
  Description of Artificial Sequence: Synthetic oligonucleotide
  Target: ATXN1; (-) strand; PAM type: NRG; PAM sequence: GGG
aagacaggctattattttta

SEQ ID NO: 95216 - DNA, 20 bp, Artificial Sequence
  Description of Artificial Sequence: Synthetic oligonucleotide
  Target: ATXN1; (-) strand; PAM type: NRG; PAM sequence: AGG
taagacaggctattattttt

SEQ ID NO: 95217 - DNA, 20 bp, Artificial Sequence
  Description of Artificial Sequence: Synthetic oligonucleotide
  Target: ATXN1; (-) strand; PAM type: NRG; PAM sequence: TAG
gtaagacaggctattatttt

SEQ ID NO: 95218 - DNA, 20 bp, Artificial Sequence
  Description of Artificial Sequence: Synthetic oligonucleotide
  Target: ATXN1; (-) strand; PAM type: NRG; PAM sequence: AGG
tgacaatagtgaagtaagac

SEQ ID NO: 95219 - DNA, 20 bp, Artificial Sequence
  Description of Artificial Sequence: Synthetic oligonucleotide
  Target: ATXN1; (-) strand; PAM type: NRG; PAM sequence: CAG
gtgacaatagtgaagtaaga

SEQ ID NO: 95220 - DNA, 20 bp, Artificial Sequence
  Description of Artificial Sequence: Synthetic oligonucleotide
  Target: ATXN1; (-) strand; PAM type: NRG; PAM sequence: AAG
taaagtgacaatagtgaagt

SEQ ID NO: 95221 - DNA, 20 bp, Artificial Sequence
  Description of Artificial Sequence: Synthetic oligonucleotide
  Target: ATXN1; (-) strand; PAM type: NRG; PAM sequence: AAG
tcggtaaagtgacaatagtg

SEQ ID NO: 95222 - DNA, 20 bp, Artificial Sequence
  Description of Artificial Sequence: Synthetic oligonucleotide
  Target: ATXN1; (-) strand; PAM type: NRG; PAM sequence: TAG
ttgcatcggtaaagtgacaa

SEQ ID NO: 95223 - DNA, 20 bp, Artificial Sequence
  Description of Artificial Sequence: Synthetic oligonucleotide
  Target: ATXN1; (-) strand; PAM type: NRG; PAM sequence: AAG
cttaaatacttgcatcggta

SEQ ID NO: 95224 - DNA, 20 bp, Artificial Sequence
  Description of Artificial Sequence: Synthetic oligonucleotide
  Target: ATXN1; (-) strand; PAM type: NRG; PAM sequence: CGG
aacagcttaaatacttgcat

SEQ ID NO: 95225 - DNA, 20 bp, Artificial Sequence
  Description of Artificial Sequence: Synthetic oligonucleotide
  Target: ATXN1; (-) strand; PAM type: NRG; PAM sequence: CAG
cacatagattaggatctgaa

SEQ ID NO: 95226 - DNA, 20 bp, Artificial Sequence
  Description of Artificial Sequence: Synthetic oligonucleotide
  Target: ATXN1; (-) strand; PAM type: NRG; PAM sequence: AGG
ctgaaaataacacatagatt

SEQ ID NO: 95227 - DNA, 20 bp, Artificial Sequence
  Description of Artificial Sequence: Synthetic oligonucleotide
  Target: ATXN1; (-) strand; PAM type: NRG; PAM sequence: TAG
tctgaaaataacacatagat

SEQ ID NO: 95228 - DNA, 20 bp, Artificial Sequence
  Description of Artificial Sequence: Synthetic oligonucleotide
  Target: ATXN1; (-) strand; PAM type: NRG; PAM sequence: TAG
agttatctgaaaataacaca

SEQ ID NO: 95229 - DNA, 20 bp, Artificial Sequence
  Description of Artificial Sequence: Synthetic oligonucleotide
  Target: ATXN1; (-) strand; PAM type: NRG; PAM sequence: TAG
aatgttaattctttaaactg

SEQ ID NO: 95230 - DNA, 20 bp, Artificial Sequence
  Description of Artificial Sequence: Synthetic oligonucleotide
  Target: ATXN1; (-) strand; PAM type: NRG; PAM sequence: GAG
acgtaagtaggtaaatgtgg

SEQ ID NO: 95231 - DNA, 20 bp, Artificial Sequence
  Description of Artificial Sequence: Synthetic oligonucleotide
  Target: ATXN1; (-) strand; PAM type: NRG; PAM sequence: GGG
tcacgtaagtaggtaaatgt

SEQ ID NO: 95232 - DNA, 20 bp, Artificial Sequence
  Description of Artificial Sequence: Synthetic oligonucleotide
  Target: ATXN1; (-) strand; PAM type: NRG; PAM sequence: TGG
ctcacgtaagtaggtaaatg

SEQ ID NO: 95233 - DNA, 20 bp, Artificial Sequence
  Description of Artificial Sequence: Synthetic oligonucleotide
  Target: ATXN1; (-) strand; PAM type: NRG; PAM sequence: AGG
attctgaaactcacgtaagt

SEQ ID NO: 95234 - DNA, 20 bp, Artificial Sequence
  Description of Artificial Sequence: Synthetic oligonucleotide
  Target: ATXN1; (-) strand; PAM type: NRG; PAM sequence: TAG
aattctgaaactcacgtaag

SEQ ID NO: 95235 - DNA, 20 bp, Artificial Sequence
  Description of Artificial Sequence: Synthetic oligonucleotide
  Target: ATXN1; (-) strand; PAM type: NRG; PAM sequence: AAG
taaaattctgaaactcacgt

SEQ ID NO: 95236 - DNA, 20 bp, Artificial Sequence
  Description of Artificial Sequence: Synthetic oligonucleotide
  Target: ATXN1; (-) strand; PAM type: NRG; PAM sequence: AAG
tttgtttcctattaaaagtt

SEQ ID NO: 95237 - DNA, 20 bp, Artificial Sequence
  Description of Artificial Sequence: Synthetic oligonucleotide
  Target: ATXN1; (-) strand; PAM type: NRG; PAM sequence: AAG
ctcattttgtttcctattaa

SEQ ID NO: 95238 - DNA, 20 bp, Artificial Sequence
  Description of Artificial Sequence: Synthetic oligonucleotide
  Target: ATXN1; (-) strand; PAM type: NRG; PAM sequence: CAG
tttgcacataccttgagtga

SEQ ID NO: 95239 - DNA, 20 bp, Artificial Sequence
  Description of Artificial Sequence: Synthetic oligonucleotide
  Target: ATXN1; (-) strand; PAM type: NRG; PAM sequence: GAG
tacttttttgcacatacctt

SEQ ID NO: 95240 - DNA, 20 bp, Artificial Sequence
  Description of Artificial Sequence: Synthetic oligonucleotide
  Target: ATXN1; (-) strand; PAM type: NRG; PAM sequence: TGG
tttcattctgaaatgtcaag

SEQ ID NO: 95241 - DNA, 20 bp, Artificial Sequence
  Description of Artificial Sequence: Synthetic oligonucleotide
  Target: ATXN1; (-) strand; PAM type: NRG; PAM sequence: AAG
gtttttcattctgaaatgtc

SEQ ID NO: 95242 - DNA, 20 bp, Artificial Sequence
  Description of Artificial Sequence: Synthetic oligonucleotide
  Target: ATXN1; (-) strand; PAM type: NRG; PAM sequence: AGG
tgttgtcattatggagtcca

SEQ ID NO: 95243 - DNA, 20 bp, Artificial Sequence
  Description of Artificial Sequence: Synthetic oligonucleotide
  Target: ATXN1; (-) strand; PAM type: NRG; PAM sequence: AAG
ttgttgtcattatggagtcc

SEQ ID NO: 95244 - DNA, 20 bp, Artificial Sequence
  Description of Artificial Sequence: Synthetic oligonucleotide
  Target: ATXN1; (-) strand; PAM type: NRG; PAM sequence: GAG
ctgtttttgttgtcattatg

SEQ ID NO: 95245 - DNA, 20 bp, Artificial Sequence
  Description of Artificial Sequence: Synthetic oligonucleotide
  Target: ATXN1; (-) strand; PAM type: NRG; PAM sequence: TGG
tcctgtttttgttgtcatta

SEQ ID NO: 95246 - DNA, 20 bp, Artificial Sequence
  Description of Artificial Sequence: Synthetic oligonucleotide
  Target: ATXN1; (-) strand; PAM type: NRG; PAM sequence: TAG
tgctgagattattgaaatat

SEQ ID NO: 95247 - DNA, 20 bp, Artificial Sequence
  Description of Artificial Sequence: Synthetic oligonucleotide
  Target: ATXN1; (-) strand; PAM type: NRG; PAM sequence: GAG
tcctgggaaaggccagtgct

SEQ ID NO: 95248 - DNA, 20 bp, Artificial Sequence
  Description of Artificial Sequence: Synthetic oligonucleotide
  Target: ATXN1; (-) strand; PAM type: NRG; PAM sequence: CAG
ctaggagtcctgggaaaggc

SEQ ID NO: 95249 - DNA, 20 bp, Artificial Sequence
  Description of Artificial Sequence: Synthetic oligonucleotide
  Target: ATXN1; (-) strand; PAM type: NRG; PAM sequence: AGG
ttgcctaggagtcctgggaa

SEQ ID NO: 95250 - DNA, 20 bp, Artificial Sequence
  Description of Artificial Sequence: Synthetic oligonucleotide
  Target: ATXN1; (-) strand; PAM type: NRG; PAM sequence: AAG
gttgcctaggagtcctggga

SEQ ID NO: 95251 - DNA, 20 bp, Artificial Sequence
  Description of Artificial Sequence: Synthetic oligonucleotide
  Target: ATXN1; (-) strand; PAM type: NRG; PAM sequence: GGG
gtcagttgcctaggagtcct

SEQ ID NO: 95252 - DNA, 20 bp, Artificial Sequence
  Description of Artificial Sequence: Synthetic oligonucleotide
  Target: ATXN1; (-) strand; PAM type: NRG; PAM sequence: TGG
agtcagttgcctaggagtcc

SEQ ID NO: 95253 - DNA, 20 bp, Artificial Sequence
  Description of Artificial Sequence: Synthetic oligonucleotide
  Target: ATXN1; (-) strand; PAM type: NRG; PAM sequence: GAG
tacctaagtcagttgcctag

SEQ ID NO: 95254 - DNA, 20 bp, Artificial Sequence
  Description of Artificial Sequence: Synthetic oligonucleotide
  Target: ATXN1; (-) strand; PAM type: NRG; PAM sequence: AGG
catacctaagtcagttgcct

SEQ ID NO: 95255 - DNA, 20 bp, Artificial Sequence
  Description of Artificial Sequence: Synthetic oligonucleotide
  Target: ATXN1; (-) strand; PAM type: NRG; PAM sequence: TAG
acatacctaagtcagttgcc

SEQ ID NO: 95256 - DNA, 20 bp, Artificial Sequence
  Description of Artificial Sequence: Synthetic oligonucleotide
  Target: ATXN1; (-) strand; PAM type: NRG; PAM sequence: CAG
aagtttcaacatacctaagt

SEQ ID NO: 95257 - DNA, 20 bp, Artificial Sequence
  Description of Artificial Sequence: Synthetic oligonucleotide
  Target: ATXN1; (-) strand; PAM type: NRG; PAM sequence: AAG
ctgtaagtttcaacatacct

SEQ ID NO: 95258 - DNA, 20 bp, Artificial Sequence
  Description of Artificial Sequence: Synthetic oligonucleotide
  Target: ATXN1; (-) strand; PAM type: NRG; PAM sequence: AAG
attacatgtcaaatgcctgt

SEQ ID NO: 95259 - DNA, 20 bp, Artificial Sequence
  Description of Artificial Sequence: Synthetic oligonucleotide
  Target: ATXN1; (-) strand; PAM type: NRG; PAM sequence: AAG
aacagaaactctttagccac

SEQ ID NO: 95260 - DNA, 20 bp, Artificial Sequence
  Description of Artificial Sequence: Synthetic oligonucleotide
  Target: ATXN1; (-) strand; PAM type: NRG; PAM sequence: TAG
aagattaaacagaaactctt

SEQ ID NO: 95261 - DNA, 20 bp, Artificial Sequence
  Description of Artificial Sequence: Synthetic oligonucleotide
  Target: ATXN1; (-) strand; PAM type: NRG; PAM sequence: CAG
acacttagaggaagattaaa

SEQ ID NO: 95262 - DNA, 20 bp, Artificial Sequence
  Description of Artificial Sequence: Synthetic oligonucleotide
  Target: ATXN1; (-) strand; PAM type: NRG; PAM sequence: AAG
ttgtcttttacacttagagg

SEQ ID NO: 95263 - DNA, 20 bp, Artificial Sequence
  Description of Artificial Sequence: Synthetic oligonucleotide
  Target: ATXN1; (-) strand; PAM type: NRG; PAM sequence: AGG
gaattgtcttttacacttag

SEQ ID NO: 95264 - DNA, 20 bp, Artificial Sequence
  Description of Artificial Sequence: Synthetic oligonucleotide
  Target: ATXN1; (-) strand; PAM type: NRG; PAM sequence: GAG
tgaattgtcttttacactta

SEQ ID NO: 95265 - DNA, 20 bp, Artificial Sequence
  Description of Artificial Sequence: Synthetic oligonucleotide
  Target: ATXN1; (-) strand; PAM type: NRG; PAM sequence: TAG
tctgaattgtcttttacact

SEQ ID NO: 95266 - DNA, 20 bp, Artificial Sequence
  Description of Artificial Sequence: Synthetic oligonucleotide
  Target: ATXN1; (-) strand; PAM type: NRG; PAM sequence: AGG
aaatgttacgactagacttc

SEQ ID NO: 95267 - DNA, 20 bp, Artificial Sequence
  Description of Artificial Sequence: Synthetic oligonucleotide
  Target: ATXN1; (-) strand; PAM type: NRG; PAM sequence: CAG
aaaatgttacgactagactt

SEQ ID NO: 95268 - DNA, 20 bp, Artificial Sequence
  Description of Artificial Sequence: Synthetic oligonucleotide
  Target: ATXN1; (-) strand; PAM type: NRG; PAM sequence: TAG
tttgtcaaaaatgttacgac

SEQ ID NO: 95269 - DNA, 20 bp, Artificial Sequence
  Description of Artificial Sequence: Synthetic oligonucleotide
  Target: ATXN1; (-) strand; PAM type: NRG; PAM sequence: AAG
taagagggtttggtaaacag

SEQ ID NO: 95270 - DNA, 20 bp, Artificial Sequence
  Description of Artificial Sequence: Synthetic oligonucleotide
  Target: ATXN1; (-) strand; PAM type: NRG; PAM sequence: CAG
ttttaagagggtttggtaaa

SEQ ID NO: 95271 - DNA, 20 bp, Artificial Sequence
  Description of Artificial Sequence: Synthetic oligonucleotide
  Target: ATXN1; (-) strand; PAM type: NRG; PAM sequence: TGG
gatttcgttttaagagggtt

SEQ ID NO: 95272 - DNA, 20 bp, Artificial Sequence
  Description of Artificial Sequence: Synthetic oligonucleotide
  Target: ATXN1; (-) strand; PAM type: NRG; PAM sequence: GGG
ttgcggatttcgttttaaga

SEQ ID NO: 95273 - DNA, 20 bp, Artificial Sequence
  Description of Artificial Sequence: Synthetic oligonucleotide
  Target: ATXN1; (-) strand; PAM type: NRG; PAM sequence: AGG
cttgcggatttcgttttaag

SEQ ID NO: 95274 - DNA, 20 bp, Artificial Sequence
  Description of Artificial Sequence: Synthetic oligonucleotide
  Target: ATXN1; (-) strand; PAM type: NRG; PAM sequence: GAG
ccttgcggatttcgttttaa

SEQ ID NO: 95275 - DNA, 20 bp, Artificial Sequence
  Description of Artificial Sequence: Synthetic oligonucleotide
  Target: ATXN1; (-) strand; PAM type: NRG; PAM sequence: AAG
ttccttgcggatttcgtttt

SEQ ID NO: 95276 - DNA, 20 bp, Artificial Sequence
  Description of Artificial Sequence: Synthetic oligonucleotide
  Target: ATXN1; (-) strand; PAM type: NRG; PAM sequence: CGG
aaaggcaatatttttccttg

SEQ ID NO: 95277 - DNA, 20 bp, Artificial Sequence
  Description of Artificial Sequence: Synthetic oligonucleotide
  Target: ATXN1; (-) strand; PAM type: NRG; PAM sequence: AGG
tacctggtgggaaccgccaa

SEQ ID NO: 95278 - DNA, 20 bp, Artificial Sequence
  Description of Artificial Sequence: Synthetic oligonucleotide
  Target: ATXN1; (-) strand; PAM type: NRG; PAM sequence: AAG
gtacctggtgggaaccgcca

SEQ ID NO: 95279 - DNA, 20 bp, Artificial Sequence
  Description of Artificial Sequence: Synthetic oligonucleotide
  Target: ATXN1; (-) strand; PAM type: NRG; PAM sequence: GGG
tataaaaaaatgtacctggt

SEQ ID NO: 95280 - DNA, 20 bp, Artificial Sequence
  Description of Artificial Sequence: Synthetic oligonucleotide
  Target: ATXN1; (-) strand; PAM type: NRG; PAM sequence: TGG
gtataaaaaaatgtacctgg

SEQ ID NO: 95281 - DNA, 20 bp, Artificial Sequence
  Description of Artificial Sequence: Synthetic oligonucleotide
  Target: ATXN1; (-) strand; PAM type: NRG; PAM sequence: TGG
taagtataaaaaaatgtacc

SEQ ID NO: 95282 - DNA, 20 bp, Artificial Sequence
  Description of Artificial Sequence: Synthetic oligonucleotide
  Target: ATXN1; (-) strand; PAM type: NRG; PAM sequence: AAG
aaataaattcatgtgaaaat

SEQ ID NO: 95283 - DNA, 20 bp, Artificial Sequence
  Description of Artificial Sequence: Synthetic oligonucleotide
  Target: ATXN1; (-) strand; PAM type: NRG; PAM sequence: CAG
aaatgtgaacatatattttt

SEQ ID NO: 95284 - DNA, 20 bp, Artificial Sequence
  Description of Artificial Sequence: Synthetic oligonucleotide
  Target: ATXN1; (-) strand; PAM type: NRG; PAM sequence: CAG
atagaaaaatgctttacttg

SEQ ID NO: 95285 - DNA, 20 bp, Artificial Sequence
  Description of Artificial Sequence: Synthetic oligonucleotide
  Target: ATXN1; (-) strand; PAM type: NRG; PAM sequence: TAG
ggattctattttgcaacata

SEQ ID NO: 95286 - DNA, 20 bp, Artificial Sequence
  Description of Artificial Sequence: Synthetic oligonucleotide
  Target: ATXN1; (-) strand; PAM type: NRG; PAM sequence: TGG
acacaatgccttggaggtcc

SEQ ID NO: 95287 - DNA, 20 bp, Artificial Sequence
  Description of Artificial Sequence: Synthetic oligonucleotide
  Target: ATXN1; (-) strand; PAM type: NRG; PAM sequence: AGG
aatattacacaatgccttgg

SEQ ID NO: 95288 - DNA, 20 bp, Artificial Sequence
  Description of Artificial Sequence: Synthetic oligonucleotide
  Target: ATXN1; (-) strand; PAM type: NRG; PAM sequence: GAG
caatattacacaatgccttg

SEQ ID NO: 95289 - DNA, 20 bp, Artificial Sequence
  Description of Artificial Sequence: Synthetic oligonucleotide
  Target: ATXN1; (-) strand; PAM type: NRG; PAM sequence: TGG
gtcaatattacacaatgcct

SEQ ID NO: 95290 - DNA, 20 bp, Artificial Sequence
  Description of Artificial Sequence: Synthetic oligonucleotide
  Target: ATXN1; (-) strand; PAM type: NRG; PAM sequence: AGG
tggtaaatagatgggaagca

SEQ ID NO: 95291 - DNA, 20 bp, Artificial Sequence
  Description of Artificial Sequence: Synthetic oligonucleotide
  Target: ATXN1; (-) strand; PAM type: NRG; PAM sequence: AAG
gtggtaaatagatgggaagc

SEQ ID NO: 95292 - DNA, 20 bp, Artificial Sequence
  Description of Artificial Sequence: Synthetic oligonucleotide
  Target: ATXN1; (-) strand; PAM type: NRG; PAM sequence: AAG
taaggtggtaaatagatggg

SEQ ID NO: 95293 - DNA, 20 bp, Artificial Sequence
  Description of Artificial Sequence: Synthetic oligonucleotide
  Target: ATXN1; (-) strand; PAM type: NRG; PAM sequence: GGG
ttataaggtggtaaatagat

SEQ ID NO: 95294 - DNA, 20 bp, Artificial Sequence
  Description of Artificial Sequence: Synthetic oligonucleotide
  Target: ATXN1; (-) strand; PAM type: NRG; PAM sequence: TGG
tttataaggtggtaaataga

SEQ ID NO: 95295 - DNA, 20 bp, Artificial Sequence
  Description of Artificial Sequence: Synthetic oligonucleotide
  Target: ATXN1; (-) strand; PAM type: NRG; PAM sequence: TAG
aacttttataaggtggtaaa

SEQ ID NO: 95296 - DNA, 20 bp, Artificial Sequence
  Description of Artificial Sequence: Synthetic oligonucleotide
  Target: ATXN1; (-) strand; PAM type: NRG; PAM sequence: TGG
gctactcaacttttataagg

SEQ ID NO: 95297 - DNA, 20 bp, Artificial Sequence
  Description of Artificial Sequence: Synthetic oligonucleotide
  Target: ATXN1; (-) strand; PAM type: NRG; PAM sequence: AGG
ctagctactcaacttttata

SEQ ID NO: 95298 - DNA, 20 bp, Artificial Sequence
  Description of Artificial Sequence: Synthetic oligonucleotide
  Target: ATXN1; (-) strand; PAM type: NRG; PAM sequence: AAG
tctagctactcaacttttat

SEQ ID NO: 95299 - DNA, 20 bp, Artificial Sequence
  Description of Artificial Sequence: Synthetic oligonucleotide
  Target: ATXN1; (-) strand; PAM type: NRG; PAM sequence: TAG
aaatgagctattatttcttc

SEQ ID NO: 95300 - DNA, 20 bp, Artificial Sequence
  Description of Artificial Sequence: Synthetic oligonucleotide
  Target: ATXN1; (-) strand; PAM type: NRG; PAM sequence: GAG
agcactgctgtagttaaaat

SEQ ID NO: 95301 - DNA, 20 bp, Artificial Sequence
  Description of Artificial Sequence: Synthetic oligonucleotide
  Target: ATXN1; (-) strand; PAM type: NRG; PAM sequence: TAG
ggtcagatgaagcactgctg

SEQ ID NO: 95302 - DNA, 20 bp, Artificial Sequence
  Description of Artificial Sequence: Synthetic oligonucleotide
  Target: ATXN1; (-) strand; PAM type: NRG; PAM sequence: AAG
cattgtggcctggtcagatg

SEQ ID NO: 95303 - DNA, 20 bp, Artificial Sequence
  Description of Artificial Sequence: Synthetic oligonucleotide
  Target: ATXN1; (-) strand; PAM type: NRG; PAM sequence: CAG
taaattcattgtggcctggt

SEQ ID NO: 95304 - DNA, 20 bp, Artificial Sequence
  Description of Artificial Sequence: Synthetic oligonucleotide
  Target: ATXN1; (-) strand; PAM type: NRG; PAM sequence: TGG
ttggtaaattcattgtggcc

SEQ ID NO: 95305 - DNA, 20 bp, Artificial Sequence
  Description of Artificial Sequence: Synthetic oligonucleotide
  Target: ATXN1; (-) strand; PAM type: NRG; PAM sequence: TGG
tgtggttggtaaattcattg

SEQ ID NO: 95306 - DNA, 20 bp, Artificial Sequence
  Description of Artificial Sequence: Synthetic oligonucleotide
  Target: ATXN1; (-) strand; PAM type: NRG; PAM sequence: TGG
gttttgtgagtttatgtggt

SEQ ID NO: 95307 - DNA, 20 bp, Artificial Sequence
  Description of Artificial Sequence: Synthetic oligonucleotide
  Target: ATXN1; (-) strand; PAM type: NRG; PAM sequence: TGG
taccgttttgtgagtttatg

SEQ ID NO: 95308 - DNA, 20 bp, Artificial Sequence
  Description of Artificial Sequence: Synthetic oligonucleotide
  Target: ATXN1; (-) strand; PAM type: NRG; PAM sequence: GAG
atgagtttttaccgttttgt

SEQ ID NO: 95309 - DNA, 20 bp, Artificial Sequence
  Description of Artificial Sequence: Synthetic oligonucleotide
  Target: ATXN1; (-) strand; PAM type: NRG; PAM sequence: GAG
tctattcccagggggtttat

SEQ ID NO: 95310 - DNA, 20 bp, Artificial Sequence
  Description of Artificial Sequence: Synthetic oligonucleotide
  Target: ATXN1; (-) strand; PAM type: NRG; PAM sequence: GGG
tactcaactctattcccagg

SEQ ID NO: 95311 - DNA, 20 bp, Artificial Sequence
  Description of Artificial Sequence: Synthetic oligonucleotide
  Target: ATXN1; (-) strand; PAM type: NRG; PAM sequence: GGG
ctactcaactctattcccag

SEQ ID NO: 95312 - DNA, 20 bp, Artificial Sequence
  Description of Artificial Sequence: Synthetic oligonucleotide
  Target: ATXN1; (-) strand; PAM type: NRG; PAM sequence: GGG
gctactcaactctattccca

SEQ ID NO: 95313 - DNA, 20 bp, Artificial Sequence
  Description of Artificial Sequence: Synthetic oligonucleotide
  Target: ATXN1; (-) strand; PAM type: NRG; PAM sequence: AGG
agctactcaactctattccc

SEQ ID NO: 95314 - DNA, 20 bp, Artificial Sequence
  Description of Artificial Sequence: Synthetic oligonucleotide
  Target: ATXN1; (-) strand; PAM type: NRG; PAM sequence: CAG
gagctactcaactctattcc

SEQ ID NO: 95315 - DNA, 20 bp, Artificial Sequence
  Description of Artificial Sequence: Synthetic oligonucleotide
  Target: ATXN1; (-) strand; PAM type: NRG; PAM sequence: GAG
ccccagggctaggattgaga

SEQ ID NO: 95316 - DNA, 20 bp, Artificial Sequence
  Description of Artificial Sequence: Synthetic oligonucleotide
  Target: ATXN1; (-) strand; PAM type: NRG; PAM sequence: GAG
tcccccagggctaggattga

SEQ ID NO: 95317 - DNA, 20 bp, Artificial Sequence
  Description of Artificial Sequence: Synthetic oligonucleotide
  Target: ATXN1; (-) strand; PAM type: NRG; PAM sequence: GAG
tttcccccagggctaggatt

SEQ ID NO: 95318 - DNA, 20 bp, Artificial Sequence
  Description of Artificial Sequence: Synthetic oligonucleotide
  Target: ATXN1; (-) strand; PAM type: NRG; PAM sequence: AGG
aaattttttcccccagggct

SEQ ID NO: 95319 - DNA, 20 bp, Artificial Sequence
  Description of Artificial Sequence: Synthetic oligonucleotide
  Target: ATXN1; (-) strand; PAM type: NRG; PAM sequence: TAG
taaattttttcccccagggc

SEQ ID NO: 95320 - DNA, 20 bp, Artificial Sequence
  Description of Artificial Sequence: Synthetic oligonucleotide
  Target: ATXN1; (-) strand; PAM type: NRG; PAM sequence: GGG
ctggtaaattttttccccca

SEQ ID NO: 95321 - DNA, 20 bp, Artificial Sequence
  Description of Artificial Sequence: Synthetic oligonucleotide
  Target: ATXN1; (-) strand; PAM type: NRG; PAM sequence: AGG
actggtaaattttttccccc

SEQ ID NO: 95322 - DNA, 20 bp, Artificial Sequence
  Description of Artificial Sequence: Synthetic oligonucleotide
  Target: ATXN1; (-) strand; PAM type: NRG; PAM sequence: CAG
aactggtaaattttttcccc

SEQ ID NO: 95323 - DNA, 20 bp, Artificial Sequence
  Description of Artificial Sequence: Synthetic oligonucleotide
  Target: ATXN1; (-) strand; PAM type: NRG; PAM sequence: TGG
tatggccaacaaagctaaac

SEQ ID NO: 95324 - DNA, 20 bp, Artificial Sequence
  Description of Artificial Sequence: Synthetic oligonucleotide
  Target: ATXN1; (-) strand; PAM type: NRG; PAM sequence: AAG
ttacaattttatggccaaca

SEQ ID NO: 95325 - DNA, 20 bp, Artificial Sequence
  Description of Artificial Sequence: Synthetic oligonucleotide
  Target: ATXN1; (-) strand; PAM type: NRG; PAM sequence: TGG
ccagtcagtttacaatttta

SEQ ID NO: 95326 - DNA, 20 bp, Artificial Sequence
  Description of Artificial Sequence: Synthetic oligonucleotide
  Target: ATXN1; (-) strand; PAM type: NRG; PAM sequence: CAG
atttagttgtgactgccagt

SEQ ID NO: 95327 - DNA, 20 bp, Artificial Sequence
  Description of Artificial Sequence: Synthetic oligonucleotide
  Target: ATXN1; (-) strand; PAM type: NRG; PAM sequence: CAG
cttgatttagttgtgactgc

SEQ ID NO: 95328 - DNA, 20 bp, Artificial Sequence
  Description of Artificial Sequence: Synthetic oligonucleotide
  Target: ATXN1; (-) strand; PAM type: NRG; PAM sequence: TAG
ttgagaattatgtcttgatt

SEQ ID NO: 95329 - DNA, 20 bp, Artificial Sequence
  Description of Artificial Sequence: Synthetic oligonucleotide
  Target: ATXN1; (-) strand; PAM type: NRG; PAM sequence: GAG
atttgaaagaaaagataatt

SEQ ID NO: 95330 - DNA, 20 bp, Artificial Sequence
  Description of Artificial Sequence: Synthetic oligonucleotide
  Target: ATXN1; (-) strand; PAM type: NRG; PAM sequence: AAG
aaccctggtatttgaaagaa

SEQ ID NO: 95331 - DNA, 20 bp, Artificial Sequence
  Description of Artificial Sequence: Synthetic oligonucleotide
  Target: ATXN1; (-) strand; PAM type: NRG; PAM sequence: AAG
ttcataaccctggtatttga

SEQ ID NO: 95332 - DNA, 20 bp, Artificial Sequence
  Description of Artificial Sequence: Synthetic oligonucleotide
  Target: ATXN1; (-) strand; PAM type: NRG; PAM sequence: TGG
ggggagtattttcataaccc

SEQ ID NO: 95333 - DNA, 20 bp, Artificial Sequence
  Description of Artificial Sequence: Synthetic oligonucleotide
  Target: ATXN1; (-) strand; PAM type: NRG; PAM sequence: GAG
ggcagggggcgggcgggggg

SEQ ID NO: 95334 - DNA, 20 bp, Artificial Sequence
  Description of Artificial Sequence: Synthetic oligonucleotide
  Target: ATXN1; (-) strand; PAM type: NRG; PAM sequence: GGG
ggggcagggggcgggcgggg

SEQ ID NO: 95335 - DNA, 20 bp, Artificial Sequence
  Description of Artificial Sequence: Synthetic oligonucleotide
  Target: ATXN1; (-) strand; PAM type: NRG; PAM sequence: GGG
tggggcagggggcgggcggg

SEQ ID NO: 95336 - DNA, 20 bp, Artificial Sequence
  Description of Artificial Sequence: Synthetic oligonucleotide
  Target: ATXN1; (-) strand; PAM type: NRG; PAM sequence: GGG
gtggggcagggggcgggcgg

SEQ ID NO: 95337 - DNA, 20 bp, Artificial Sequence
  Description of Artificial Sequence: Synthetic oligonucleotide
  Target: ATXN1; (-) strand; PAM type: NRG; PAM sequence: GGG
agtggggcagggggcgggcg

SEQ ID NO: 95338 - DNA, 20 bp, Artificial Sequence
  Description of Artificial Sequence: Synthetic oligonucleotide
  Target: ATXN1; (-) strand; PAM type: NRG; PAM sequence: GGG
aagtggggcagggggcgggc

SEQ ID NO: 95339 - DNA, 20 bp, Artificial Sequence
  Description of Artificial Sequence: Synthetic oligonucleotide
  Target: ATXN1; (-) strand; PAM type: NRG; PAM sequence: CGG
taagtggggcagggggcggg

SEQ ID NO: 95340 - DNA, 20 bp, Artificial Sequence
  Description of Artificial Sequence: Synthetic oligonucleotide
  Target: ATXN1; (-) strand; PAM type: NRG; PAM sequence: GGG
aactaagtggggcagggggc

SEQ ID NO: 95341 - DNA, 20 bp, Artificial Sequence
  Description of Artificial Sequence: Synthetic oligonucleotide
  Target: ATXN1; (-) strand; PAM type: NRG; PAM sequence: CGG
caactaagtggggcaggggg

SEQ ID NO: 95342 - DNA, 20 bp, Artificial Sequence
  Description of Artificial Sequence: Synthetic oligonucleotide
  Target: ATXN1; (-) strand; PAM type: NRG; PAM sequence: GGG
atccaactaagtggggcagg

SEQ ID NO: 95343 - DNA, 20 bp, Artificial Sequence
  Description of Artificial Sequence: Synthetic oligonucleotide
  Target: ATXN1; (-) strand; PAM type: NRG; PAM sequence: GGG
aatccaactaagtggggcag

SEQ ID NO: 95344 - DNA, 20 bp, Artificial Sequence
  Description of Artificial Sequence: Synthetic oligonucleotide
  Target: ATXN1; (-) strand; PAM type: NRG; PAM sequence: GGG
caatccaactaagtggggca

SEQ ID NO: 95345 - DNA, 20 bp, Artificial Sequence
  Description of Artificial Sequence: Synthetic oligonucleotide
  Target: ATXN1; (-) strand; PAM type: NRG; PAM sequence: AGG
gcaatccaactaagtggggc

SEQ ID NO: 95346 - DNA, 20 bp, Artificial Sequence
  Description of Artificial Sequence: Synthetic oligonucleotide
  Target: ATXN1; (-) strand; PAM type: NRG; PAM sequence: CAG
ggcaatccaactaagtgggg

SEQ ID NO: 95347 - DNA, 20 bp, Artificial Sequence
  Description of Artificial Sequence: Synthetic oligonucleotide
  Target: ATXN1; (-) strand; PAM type: NRG; PAM sequence: GGG
tcaggcaatccaactaagtg

SEQ ID NO: 95348 - DNA, 20 bp, Artificial Sequence
  Description of Artificial Sequence: Synthetic oligonucleotide
  Target: ATXN1; (-) strand; PAM type: NRG; PAM sequence: GGG
ctcaggcaatccaactaagt

SEQ ID NO: 95349 - DNA, 20 bp, Artificial Sequence
  Description of Artificial Sequence: Synthetic oligonucleotide
  Target: ATXN1; (-) strand; PAM type: NRG; PAM sequence: TGG
gctcaggcaatccaactaag

SEQ ID NO: 95350 - DNA, 20 bp, Artificial Sequence
  Description of Artificial Sequence: Synthetic oligonucleotide
  Target: ATXN1; (-) strand; PAM type: NRG; PAM sequence: AAG
gctgctcaggcaatccaact

SEQ ID NO: 95351 - DNA, 20 bp, Artificial Sequence
  Description of Artificial Sequence: Synthetic oligonucleotide
  Target: ATXN1; (-) strand; PAM type: NRG; PAM sequence: AGG
gctgaagctctgtgctgctc

SEQ ID NO: 95352 - DNA, 20 bp, Artificial Sequence
  Description of Artificial Sequence: Synthetic oligonucleotide
  Target: ATXN1; (-) strand; PAM type: NRG; PAM sequence: CAG
tgctgaagctctgtgctgct

SEQ ID NO: 95353 - DNA, 20 bp, Artificial Sequence
  Description of Artificial Sequence: Synthetic oligonucleotide
  Target: ATXN1; (-) strand; PAM type: NRG; PAM sequence: AAG
aaaagttgctttagttgctg

SEQ ID NO: 95354 - DNA, 20 bp, Artificial Sequence
  Description of Artificial Sequence: Synthetic oligonucleotide
  Target: ATXN1; (-) strand; PAM type: NRG; PAM sequence: TAG
gaaaaaaggaaaagttgctt

SEQ ID NO: 95355 - DNA, 20 bp, Artificial Sequence
  Description of Artificial Sequence: Synthetic oligonucleotide
  Target: ATXN1; (-) strand; PAM type: NRG; PAM sequence: AAG
ggcaaaaaggaaaaaaggaa

SEQ ID NO: 95356 - DNA, 20 bp, Artificial Sequence
  Description of Artificial Sequence: Synthetic oligonucleotide
  Target: ATXN1; (-) strand; PAM type: NRG; PAM sequence: AGG
attatggcaaaaaggaaaaa

SEQ ID NO: 95357 - DNA, 20 bp, Artificial Sequence
  Description of Artificial Sequence: Synthetic oligonucleotide
  Target: ATXN1; (-) strand; PAM type: NRG; PAM sequence: AAG
tattatggcaaaaaggaaaa

SEQ ID NO: 95358 - DNA, 20 bp, Artificial Sequence
  Description of Artificial Sequence: Synthetic oligonucleotide
  Target: ATXN1; (-) strand; PAM type: NRG; PAM sequence: AGG
gaaataatattatggcaaaa

SEQ ID NO: 95359 - DNA, 20 bp, Artificial Sequence
  Description of Artificial Sequence: Synthetic oligonucleotide
  Target: ATXN1; (-) strand; PAM type: NRG; PAM sequence: AAG
agaaataatattatggcaaa

SEQ ID NO: 95360 - DNA, 20 bp, Artificial Sequence
  Description of Artificial Sequence: Synthetic oligonucleotide
  Target: ATXN1; (-) strand; PAM type: NRG; PAM sequence: TGG
agcaaagagaaataatatta

SEQ ID NO: 95361 - DNA, 20 bp, Artificial Sequence
  Description of Artificial Sequence: Synthetic oligonucleotide
  Target: ATXN1; (-) strand; PAM type: NRG; PAM sequence: GAG
gataaagctggctaagcaaa

SEQ ID NO: 95362 - DNA, 20 bp, Artificial Sequence
  Description of Artificial Sequence: Synthetic oligonucleotide
  Target: ATXN1; (-) strand; PAM type: NRG; PAM sequence: AAG
ctgataaagctggctaagca

SEQ ID NO: 95363 - DNA, 20 bp, Artificial Sequence
  Description of Artificial Sequence: Synthetic oligonucleotide
  Target: ATXN1; (-) strand; PAM type: NRG; PAM sequence: AAG
caccactgataaagctggct

SEQ ID NO: 95364 - DNA, 20 bp, Artificial Sequence
  Description of Artificial Sequence: Synthetic oligonucleotide
  Target: ATXN1; (-) strand; PAM type: NRG; PAM sequence: TGG
tagggcaccactgataaagc

SEQ ID NO: 95365 - DNA, 20 bp, Artificial Sequence
  Description of Artificial Sequence: Synthetic oligonucleotide
  Target: ATXN1; (-) strand; PAM type: NRG; PAM sequence: AAG
gcattagggcaccactgata

SEQ ID NO: 95366 - DNA, 20 bp, Artificial Sequence
  Description of Artificial Sequence: Synthetic oligonucleotide
  Target: ATXN1; (-) strand; PAM type: NRG; PAM sequence: GGG
gtattctagtctttgcatta

SEQ ID NO: 95367 - DNA, 20 bp, Artificial Sequence
  Description of Artificial Sequence: Synthetic oligonucleotide
  Target: ATXN1; (-) strand; PAM type: NRG; PAM sequence: AGG
agtattctagtctttgcatt

SEQ ID NO: 95368 - DNA, 20 bp, Artificial Sequence
  Description of Artificial Sequence: Synthetic oligonucleotide
  Target: ATXN1; (-) strand; PAM type: NRG; PAM sequence: TAG
cagtattctagtctttgcat

SEQ ID NO: 95369 - DNA, 20 bp, Artificial Sequence
  Description of Artificial Sequence: Synthetic oligonucleotide
  Target: ATXN1; (-) strand; PAM type: NRG; PAM sequence: TAG
gcagttagaaagcagtattc

SEQ ID NO: 95370 - DNA, 20 bp, Artificial Sequence
  Description of Artificial Sequence: Synthetic oligonucleotide
  Target: ATXN1; (-) strand; PAM type: NRG; PAM sequence: CAG
tttagtgagcagttagaaag

SEQ ID NO: 95371 - DNA, 20 bp, Artificial Sequence
  Description of Artificial Sequence: Synthetic oligonucleotide
  Target: ATXN1; (-) strand; PAM type: NRG; PAM sequence: AAG
taatttagtgagcagttaga

SEQ ID NO: 95372 - DNA, 20 bp, Artificial Sequence
  Description of Artificial Sequence: Synthetic oligonucleotide
  Target: ATXN1; (-) strand; PAM type: NRG; PAM sequence: TAG
gatgtaatttagtgagcagt

SEQ ID NO: 95373 - DNA, 20 bp, Artificial Sequence
  Description of Artificial Sequence: Synthetic oligonucleotide
  Target: ATXN1; (-) strand; PAM type: NRG; PAM sequence: CAG
ttaggatgtaatttagtgag

SEQ ID NO: 95374 - DNA, 20 bp, Artificial Sequence
  Description of Artificial Sequence: Synthetic oligonucleotide
  Target: ATXN1; (-) strand; PAM type: NRG; PAM sequence: GAG
attttaggatgtaatttagt

SEQ ID NO: 95375 - DNA, 20 bp, Artificial Sequence
  Description of Artificial Sequence: Synthetic oligonucleotide
  Target: ATXN1; (-) strand; PAM type: NRG; PAM sequence: TAG
ctttattttaggatgtaatt

SEQ ID NO: 95376 - DNA, 20 bp, Artificial Sequence
  Description of Artificial Sequence: Synthetic oligonucleotide
  Target: ATXN1; (-) strand; PAM type: NRG; PAM sequence: AGG
ataaacatgtactttatttt

SEQ ID NO: 95377 - DNA, 20 bp, Artificial Sequence
  Description of Artificial Sequence: Synthetic oligonucleotide
  Target: ATXN1; (-) strand; PAM type: NRG; PAM sequence: TAG
aataaacatgtactttattt

SEQ ID NO: 95378 - DNA, 20 bp, Artificial Sequence
  Description of Artificial Sequence: Synthetic oligonucleotide
  Target: ATXN1; (-) strand; PAM type: NRG; PAM sequence: TGG
ctgatagtgcatggtgcttt

SEQ ID NO: 95379 - DNA, 20 bp, Artificial Sequence
  Description of Artificial Sequence: Synthetic oligonucleotide
  Target: ATXN1; (-) strand; PAM type: NRG; PAM sequence: TGG
gctagaggactgatagtgca

SEQ ID NO: 95380 - DNA, 20 bp, Artificial Sequence
  Description of Artificial Sequence: Synthetic oligonucleotide
  Target: ATXN1; (-) strand; PAM type: NRG; PAM sequence: TAG
gcctatagctagaggactga

SEQ ID NO: 95381 - DNA, 20 bp, Artificial Sequence
  Description of Artificial Sequence: Synthetic oligonucleotide
  Target: ATXN1; (-) strand; PAM type: NRG; PAM sequence: AGG
cgatagaggcctatagctag

SEQ ID NO: 95382 - DNA, 20 bp, Artificial Sequence
  Description of Artificial Sequence: Synthetic oligonucleotide
  Target: ATXN1; (-) strand; PAM type: NRG; PAM sequence: GAG
acgatagaggcctatagcta

SEQ ID NO: 95383 - DNA, 20 bp, Artificial Sequence
  Description of Artificial Sequence: Synthetic oligonucleotide
  Target: ATXN1; (-) strand; PAM type: NRG; PAM sequence: TAG
aaacgatagaggcctatagc

SEQ ID NO: 95384 - DNA, 20 bp, Artificial Sequence
  Description of Artificial Sequence: Synthetic oligonucleotide
  Target: ATXN1; (-) strand; PAM type: NRG; PAM sequence: TAG
cgagaaacgatagaggccta

SEQ ID NO: 95385 - DNA, 20 bp, Artificial Sequence
  Description of Artificial Sequence: Synthetic oligonucleotide
  Target: ATXN1; (-) strand; PAM type: NRG; PAM sequence: AGG
agctaagcgagaaacgatag

SEQ ID NO: 95386 - DNA, 20 bp, Artificial Sequence
  Description of Artificial Sequence: Synthetic oligonucleotide
  Target: ATXN1; (-) strand; PAM type: NRG; PAM sequence: GAG
tagctaagcgagaaacgata

SEQ ID NO: 95387 - DNA, 20 bp, Artificial Sequence
  Description of Artificial Sequence: Synthetic oligonucleotide
  Target: ATXN1; (-) strand; PAM type: NRG; PAM sequence: TAG
cttagctaagcgagaaacga

SEQ ID NO: 95388 - DNA, 20 bp, Artificial Sequence
  Description of Artificial Sequence: Synthetic oligonucleotide
  Target: ATXN1; (-) strand; PAM type: NRG; PAM sequence: GAG
ttttttttccttagctaagc

SEQ ID NO: 95389 - DNA, 20 bp, Artificial Sequence
  Description of Artificial Sequence: Synthetic oligonucleotide
  Target: ATXN1; (-) strand; PAM type: NRG; PAM sequence: AAG
ggatttttttttccttagct

SEQ ID NO: 95390 - DNA, 20 bp, Artificial Sequence
  Description of Artificial Sequence: Synthetic oligonucleotide
  Target: ATXN1; (-) strand; PAM type: NRG; PAM sequence: TAG
taaaaggatttttttttcct

SEQ ID NO: 95391 - DNA, 20 bp, Artificial Sequence
  Description of Artificial Sequence: Synthetic oligonucleotide
  Target: ATXN1; (-) strand; PAM type: NRG; PAM sequence: AGG
atctttggtagtaagttaaa

SEQ ID NO: 95392 - DNA, 20 bp, Artificial Sequence
  Description of Artificial Sequence: Synthetic oligonucleotide
  Target: ATXN1; (-) strand; PAM type: NRG; PAM sequence: AAG
gatctttggtagtaagttaa

SEQ ID NO: 95393 - DNA, 20 bp, Artificial Sequence
  Description of Artificial Sequence: Synthetic oligonucleotide
  Target: ATXN1; (-) strand; PAM type: NRG; PAM sequence: AAG
tttgaatgatctttggtagt

SEQ ID NO: 95394 - DNA, 20 bp, Artificial Sequence
  Description of Artificial Sequence: Synthetic oligonucleotide
  Target: ATXN1; (-) strand; PAM type: NRG; PAM sequence: TAG
gtgatttgaatgatctttgg

SEQ ID NO: 95395 - DNA, 20 bp, Artificial Sequence
  Description of Artificial Sequence: Synthetic oligonucleotide
  Target: ATXN1; (-) strand; PAM type: NRG; PAM sequence: TGG
gctgtgatttgaatgatctt

SEQ ID NO: 95396 - DNA, 20 bp, Artificial Sequence
  Description of Artificial Sequence: Synthetic oligonucleotide
  Target: ATXN1; (-) strand; PAM type: NRG; PAM sequence: TGG
cattcttaatttggatctat

SEQ ID NO: 95397 - DNA, 20 bp, Artificial Sequence
  Description of Artificial Sequence: Synthetic oligonucleotide
  Target: ATXN1; (-) strand; PAM type: NRG; PAM sequence: TGG
gaatgtattcattcttaatt

SEQ ID NO: 95398 - DNA, 20 bp, Artificial Sequence
  Description of Artificial Sequence: Synthetic oligonucleotide
  Target: ATXN1; (-) strand; PAM type: NRG; PAM sequence: CAG
aaactggtactgacagtagg

SEQ ID NO: 95399 - DNA, 20 bp, Artificial Sequence
  Description of Artificial Sequence: Synthetic oligonucleotide
  Target: ATXN1; (-) strand; PAM type: NRG; PAM sequence: AGG
caaaaactggtactgacagt

SEQ ID NO: 95400 - DNA, 20 bp, Artificial Sequence
  Description of Artificial Sequence: Synthetic oligonucleotide
  Target: ATXN1; (-) strand; PAM type: NRG; PAM sequence: TAG
acaaaaactggtactgacag

SEQ ID NO: 95401 - DNA, 20 bp, Artificial Sequence
  Description of Artificial Sequence: Synthetic oligonucleotide
  Target: ATXN1; (-) strand; PAM type: NRG; PAM sequence: CAG
ataacaaaaactggtactga

SEQ ID NO: 95402 - DNA, 20 bp, Artificial Sequence
  Description of Artificial Sequence: Synthetic oligonucleotide
  Target: ATXN1; (-) strand; PAM type: NRG; PAM sequence: TGG
acagccatcataacaaaaac

SEQ ID NO: 95403 - DNA, 20 bp, Artificial Sequence
  Description of Artificial Sequence: Synthetic oligonucleotide
  Target: ATXN1; (-) strand; PAM type: NRG; PAM sequence: CAG
tgtcacattttaaaacttga

SEQ ID NO: 95404 - DNA, 20 bp, Artificial Sequence
  Description of Artificial Sequence: Synthetic oligonucleotide
  Target: ATXN1; (-) strand; PAM type: NRG; PAM sequence: CGG
actcaggggaataacttatt

SEQ ID NO: 95405 - DNA, 20 bp, Artificial Sequence
  Description of Artificial Sequence: Synthetic oligonucleotide
  Target: ATXN1; (-) strand; PAM type: NRG; PAM sequence: GGG
tttctaaagggtttactcag

SEQ ID NO: 95406 - DNA, 20 bp, Artificial Sequence
  Description of Artificial Sequence: Synthetic oligonucleotide
  Target: ATXN1; (-) strand; PAM type: NRG; PAM sequence: GGG
atttctaaagggtttactca

SEQ ID NO: 95407 - DNA, 20 bp, Artificial Sequence
  Description of Artificial Sequence: Synthetic oligonucleotide
  Target: ATXN1; (-) strand; PAM type: NRG; PAM sequence: AGG
gatttctaaagggtttactc

SEQ ID NO: 95408 - DNA, 20 bp, Artificial Sequence
  Description of Artificial Sequence: Synthetic oligonucleotide
  Target: ATXN1; (-) strand; PAM type: NRG; PAM sequence: CAG
ggatttctaaagggtttact

SEQ ID NO: 95409 - DNA, 20 bp, Artificial Sequence
  Description of Artificial Sequence: Synthetic oligonucleotide
  Target: ATXN1; (-) strand; PAM type: NRG; PAM sequence: GGG
gcgatggctggatttctaaa

SEQ ID NO: 95410 - DNA, 20 bp, Artificial Sequence
  Description of Artificial Sequence: Synthetic oligonucleotide
  Target: ATXN1; (-) strand; PAM type: NRG; PAM sequence: AGG
agcgatggctggatttctaa

SEQ ID NO: 95411 - DNA, 20 bp, Artificial Sequence
  Description of Artificial Sequence: Synthetic oligonucleotide
  Target: ATXN1; (-) strand; PAM type: NRG; PAM sequence: AAG
tagcgatggctggatttcta

SEQ ID NO: 95412 - DNA, 20 bp, Artificial Sequence
  Description of Artificial Sequence: Synthetic oligonucleotide
  Target: ATXN1; (-) strand; PAM type: NRG; PAM sequence: TGG
ccattgcccatagcgatggc

SEQ ID NO: 95413 - DNA, 20 bp, Artificial Sequence
  Description of Artificial Sequence: Synthetic oligonucleotide
  Target: ATXN1; (-) strand; PAM type: NRG; PAM sequence: TGG
acctccattgcccatagcga

SEQ ID NO: 95414 - DNA, 20 bp, Artificial Sequence
  Description of Artificial Sequence: Synthetic oligonucleotide
  Target: ATXN1; (-) strand; PAM type: NRG; PAM sequence: TAG
tttggaacctccattgccca

SEQ ID NO: 95415 - DNA, 20 bp, Artificial Sequence
  Description of Artificial Sequence: Synthetic oligonucleotide
  Target: ATXN1; (-) strand; PAM type: NRG; PAM sequence: TGG
tgtgaagagcgttcatcatt

SEQ ID NO: 95416 - DNA, 20 bp, Artificial Sequence
  Description of Artificial Sequence: Synthetic oligonucleotide
  Target: ATXN1; (-) strand; PAM type: NRG; PAM sequence: GAG
ttaaccctttcaagtgtgaa

SEQ ID NO: 95417 - DNA, 20 bp, Artificial Sequence
  Description of Artificial Sequence: Synthetic oligonucleotide
  Target: ATXN1; (-) strand; PAM type: NRG; PAM sequence: AAG
acttaaccctttcaagtgtg

SEQ ID NO: 95418 - DNA, 20 bp, Artificial Sequence
  Description of Artificial Sequence: Synthetic oligonucleotide
  Target: ATXN1; (-) strand; PAM type: NRG; PAM sequence: AAG
gtcagtcacttaaccctttc

SEQ ID NO: 95419 - DNA, 20 bp, Artificial Sequence
  Description of Artificial Sequence: Synthetic oligonucleotide
  Target: ATXN1; (-) strand; PAM type: NRG; PAM sequence: CAG
ggtgcctttggccttgcagt

SEQ ID NO: 95420 - DNA, 20 bp, Artificial Sequence
  Description of Artificial Sequence: Synthetic oligonucleotide
  Target: ATXN1; (-) strand; PAM type: NRG; PAM sequence: CAG
gtctggtgcctttggccttg

SEQ ID NO: 95421 - DNA, 20 bp, Artificial Sequence
  Description of Artificial Sequence: Synthetic oligonucleotide
  Target: ATXN1; (-) strand; PAM type: NRG; PAM sequence: TGG
cttttgcagtctggtgcctt

SEQ ID NO: 95422 - DNA, 20 bp, Artificial Sequence
  Description of Artificial Sequence: Synthetic oligonucleotide
  Target: ATXN1; (-) strand; PAM type: NRG; PAM sequence: TGG
gcaacatttcttttgcagtc

SEQ ID NO: 95423 - DNA, 20 bp, Artificial Sequence
  Description of Artificial Sequence: Synthetic oligonucleotide
  Target: ATXN1; (-) strand; PAM type: NRG; PAM sequence: CAG
ctaaagcaacatttcttttg

SEQ ID NO: 95424 - DNA, 20 bp, Artificial Sequence
  Description of Artificial Sequence: Synthetic oligonucleotide
  Target: ATXN1; (-) strand; PAM type: NRG; PAM sequence: AAG
aaacctttcagagctcacta

SEQ ID NO: 95425 - DNA, 20 bp, Artificial Sequence
  Description of Artificial Sequence: Synthetic oligonucleotide
  Target: ATXN1; (-) strand; PAM type: NRG; PAM sequence: GAG
tacttgttagaaacctttca

SEQ ID NO: 95426 - DNA, 20 bp, Artificial Sequence
  Description of Artificial Sequence: Synthetic oligonucleotide
  Target: ATXN1; (-) strand; PAM type: NRG; PAM sequence: CAG
ggtacttgttagaaaccttt

SEQ ID NO: 95427 - DNA, 20 bp, Artificial Sequence
  Description of Artificial Sequence: Synthetic oligonucleotide
  Target: ATXN1; (-) strand; PAM type: NRG; PAM sequence: TAG
aacaagtatttggtacttgt

SEQ ID NO: 95428 - DNA, 20 bp, Artificial Sequence
  Description of Artificial Sequence: Synthetic oligonucleotide
  Target: ATXN1; (-) strand; PAM type: NRG; PAM sequence: TGG
tgaacagatcaacaagtatt

SEQ ID NO: 95429 - DNA, 20 bp, Artificial Sequence
  Description of Artificial Sequence: Synthetic oligonucleotide
  Target: ATXN1; (-) strand; PAM type: NRG; PAM sequence: AAG
tttattgtgaacagatcaac

SEQ ID NO: 95430 - DNA, 20 bp, Artificial Sequence
  Description of Artificial Sequence: Synthetic oligonucleotide
  Target: ATXN1; (-) strand; PAM type: NRG; PAM sequence: CAG
ctgctggtgtttattgtgaa

SEQ ID NO: 95431 - DNA, 20 bp, Artificial Sequence
  Description of Artificial Sequence: Synthetic oligonucleotide
  Target: ATXN1; (-) strand; PAM type: NRG; PAM sequence: TGG
aaggagcctgacaatcctgc

SEQ ID NO: 95432 - DNA, 20 bp, Artificial Sequence
  Description of Artificial Sequence: Synthetic oligonucleotide
  Target: ATXN1; (-) strand; PAM type: NRG; PAM sequence: GAG
atctccccagacagtgaaag

SEQ ID NO: 95433 - DNA, 20 bp, Artificial Sequence
  Description of Artificial Sequence: Synthetic oligonucleotide
  Target: ATXN1; (-) strand; PAM type: NRG; PAM sequence: AGG
gcatctccccagacagtgaa

SEQ ID NO: 95434 - DNA, 20 bp, Artificial Sequence
  Description of Artificial Sequence: Synthetic oligonucleotide
  Target: ATXN1; (-) strand; PAM type: NRG; PAM sequence: AAG
tgcatctccccagacagtga

SEQ ID NO: 95435 - DNA, 20 bp, Artificial Sequence
  Description of Artificial Sequence: Synthetic oligonucleotide
  Target: ATXN1; (-) strand; PAM type: NRG; PAM sequence: CAG
tgtaaatgcatctccccaga

SEQ ID NO: 95436 - DNA, 20 bp, Artificial Sequence
  Description of Artificial Sequence: Synthetic oligonucleotide
  Target: ATXN1; (-) strand; PAM type: NRG; PAM sequence: CAG
agtatgtaaatgcatctccc

SEQ ID NO: 95437 - DNA, 20 bp, Artificial Sequence
  Description of Artificial Sequence: Synthetic oligonucleotide
  Target: ATXN1; (-) strand; PAM type: NRG; PAM sequence: CAG
caagctgttcttcctaggtg

SEQ ID NO: 95438 - DNA, 20 bp, Artificial Sequence
  Description of Artificial Sequence: Synthetic oligonucleotide
  Target: ATXN1; (-) strand; PAM type: NRG; PAM sequence: AGG
accaacaagctgttcttcct

SEQ ID NO: 95439 - DNA, 20 bp, Artificial Sequence
  Description of Artificial Sequence: Synthetic oligonucleotide
  Target: ATXN1; (-) strand; PAM type: NRG; PAM sequence: TAG
gaccaacaagctgttcttcc

SEQ ID NO: 95440 - DNA, 20 bp, Artificial Sequence
  Description of Artificial Sequence: Synthetic oligonucleotide
  Target: ATXN1; (-) strand; PAM type: NRG; PAM sequence: AAG
cttttataaaggagaccaac

SEQ ID NO: 95441 - DNA, 20 bp, Artificial Sequence
  Description of Artificial Sequence: Synthetic oligonucleotide
  Target: ATXN1; (-) strand; PAM type: NRG; PAM sequence: GAG
gctactcaacttttataaag

SEQ ID NO: 95442 - DNA, 20 bp, Artificial Sequence
  Description of Artificial Sequence: Synthetic oligonucleotide
  Target: ATXN1; (-) strand; PAM type: NRG; PAM sequence: AGG
tagctactcaacttttataa

SEQ ID NO: 95443 - DNA, 20 bp, Artificial Sequence
  Description of Artificial Sequence: Synthetic oligonucleotide
  Target: ATXN1; (-) strand; PAM type: NRG; PAM sequence: AAG
ctagctactcaacttttata

SEQ ID NO: 95444 - DNA, 20 bp, Artificial Sequence
  Description of Artificial Sequence: Synthetic oligonucleotide
  Target: ATXN1; (-) strand; PAM type: NRG; PAM sequence: TAG
gagacactgaatgaggcttc

SEQ ID NO: 95445 - DNA, 20 bp, Artificial Sequence
  Description of Artificial Sequence: Synthetic oligonucleotide
  Target: ATXN1; (-) strand; PAM type: NRG; PAM sequence: AGG
tggatgggagacactgaatg

SEQ ID NO: 95446 - DNA, 20 bp, Artificial Sequence
  Description of Artificial Sequence: Synthetic oligonucleotide
  Target: ATXN1; (-) strand; PAM type: NRG; PAM sequence: GAG
ttggatgggagacactgaat

SEQ ID NO: 95447 - DNA, 20 bp, Artificial Sequence
  Description of Artificial Sequence: Synthetic oligonucleotide
  Target: ATXN1; (-) strand; PAM type: NRG; PAM sequence: GAG
tctttcagtcatttggatgg

SEQ ID NO: 95448 - DNA, 20 bp, Artificial Sequence
  Description of Artificial Sequence: Synthetic oligonucleotide
  Target: ATXN1; (-) strand; PAM type: NRG; PAM sequence: GGG
cttctttcagtcatttggat

SEQ ID NO: 95449 - DNA, 20 bp, Artificial Sequence
  Description of Artificial Sequence: Synthetic oligonucleotide
  Target: ATXN1; (-) strand; PAM type: NRG; PAM sequence: TGG
tcttctttcagtcatttgga

SEQ ID NO: 95450 - DNA, 20 bp, Artificial Sequence
  Description of Artificial Sequence: Synthetic oligonucleotide
  Target: ATXN1; (-) strand; PAM type: NRG; PAM sequence: TGG
tgcatcttctttcagtcatt

SEQ ID NO: 95451 - DNA, 20 bp, Artificial Sequence
  Description of Artificial Sequence: Synthetic oligonucleotide
  Target: ATXN1; (-) strand; PAM type: NRG; PAM sequence: CAG
atttcaattgcatcttcttt

SEQ ID NO: 95452 - DNA, 20 bp, Artificial Sequence
  Description of Artificial Sequence: Synthetic oligonucleotide
  Target: ATXN1; (-) strand; PAM type: NRG; PAM sequence: GAG
atgctgcccaagccagacga

SEQ ID NO: 95453 - DNA, 20 bp, Artificial Sequence
  Description of Artificial Sequence: Synthetic oligonucleotide
  Target: ATXN1; (-) strand; PAM type: NRG; PAM sequence: GAG
ttatgctgcccaagccagac

SEQ ID NO: 95454 - DNA, 20 bp, Artificial Sequence
  Description of Artificial Sequence: Synthetic oligonucleotide
  Target: ATXN1; (-) strand; PAM type: NRG; PAM sequence: CAG
agcatttatgctgcccaagc

SEQ ID NO: 95455 - DNA, 20 bp, Artificial Sequence
  Description of Artificial Sequence: Synthetic oligonucleotide
  Target: ATXN1; (-) strand; PAM type: NRG; PAM sequence: AAG
gcacagcatttatgctgccc

SEQ ID NO: 95456 - DNA, 20 bp, Artificial Sequence
  Description of Artificial Sequence: Synthetic oligonucleotide
  Target: ATXN1; (-) strand; PAM type: NRG; PAM sequence: CAG
tactccaagtgttttatgca

SEQ ID NO: 95457 - DNA, 20 bp, Artificial Sequence
  Description of Artificial Sequence: Synthetic oligonucleotide
  Target: ATXN1; (-) strand; PAM type: NRG; PAM sequence: AAG
tcttgtgcctgaactactcc

SEQ ID NO: 95458 - DNA, 20 bp, Artificial Sequence
  Description of Artificial Sequence: Synthetic oligonucleotide
  Target: ATXN1; (-) strand; PAM type: NRG; PAM sequence: GGG
tgttcctcgtccattcaggt

SEQ ID NO: 95459 - DNA, 20 bp, Artificial Sequence
  Description of Artificial Sequence: Synthetic oligonucleotide
  Target: ATXN1; (-) strand; PAM type: NRG; PAM sequence: TGG
gtgttcctcgtccattcagg

SEQ ID NO: 95460 - DNA, 20 bp, Artificial Sequence
  Description of Artificial Sequence: Synthetic oligonucleotide
  Target: ATXN1; (-) strand; PAM type: NRG; PAM sequence: AGG
acagtgttcctcgtccattc

SEQ ID NO: 95461 - DNA, 20 bp, Artificial Sequence
  Description of Artificial Sequence: Synthetic oligonucleotide
  Target: ATXN1; (-) strand; PAM type: NRG; PAM sequence: CAG
gacagtgttcctcgtccatt

SEQ ID NO: 95462 - DNA, 20 bp, Artificial Sequence
  Description of Artificial Sequence: Synthetic oligonucleotide
  Target: ATXN1; (-) strand; PAM type: NRG; PAM sequence: CAG
caggctgccatggcaacaga

SEQ ID NO: 95463 - DNA, 20 bp, Artificial Sequence
  Description of Artificial Sequence: Synthetic oligonucleotide
  Target: ATXN1; (-) strand; PAM type: NRG; PAM sequence: CAG
agatcaggctgccatggcaa

SEQ ID NO: 95464 - DNA, 20 bp, Artificial Sequence
  Description of Artificial Sequence: Synthetic oligonucleotide
  Target: ATXN1; (-) strand; PAM type: NRG; PAM sequence: TGG
gtaattagatcaggctgcca

SEQ ID NO: 95465 - DNA, 20 bp, Artificial Sequence
  Description of Artificial Sequence: Synthetic oligonucleotide
  Target: ATXN1; (-) strand; PAM type: NRG; PAM sequence: AGG
atcactcatgtaattagatc

SEQ ID NO: 95466 - DNA, 20 bp, Artificial Sequence
  Description of Artificial Sequence: Synthetic oligonucleotide
  Target: ATXN1; (-) strand; PAM type: NRG; PAM sequence: CAG
gatcactcatgtaattagat

SEQ ID NO: 95467 - DNA, 20 bp, Artificial Sequence
  Description of Artificial Sequence: Synthetic oligonucleotide
  Target: ATXN1; (-) strand; PAM type: NRG; PAM sequence: TAG
gtcctgatcactcatgtaat

SEQ ID NO: 95468 - DNA, 20 bp, Artificial Sequence
  Description of Artificial Sequence: Synthetic oligonucleotide
  Target: ATXN1; (-) strand; PAM type: NRG; PAM sequence: CAG
ggttttcggtgcacttactc

SEQ ID NO: 95469 - DNA, 20 bp, Artificial Sequence
  Description of Artificial Sequence: Synthetic oligonucleotide
  Target: ATXN1; (-) strand; PAM type: NRG; PAM sequence: CGG
ctgtcagtggtgtaggtttt

SEQ ID NO: 95470 - DNA, 20 bp, Artificial Sequence
  Description of Artificial Sequence: Synthetic oligonucleotide
  Target: ATXN1; (-) strand; PAM type: NRG; PAM sequence: AGG
tggctgcctgtcagtggtgt

SEQ ID NO: 95471 - DNA, 20 bp, Artificial Sequence
  Description of Artificial Sequence: Synthetic oligonucleotide
  Target: ATXN1; (-) strand; PAM type: NRG; PAM sequence: TAG
ctggctgcctgtcagtggtg

SEQ ID NO: 95472 - DNA, 20 bp, Artificial Sequence
  Description of Artificial Sequence: Synthetic oligonucleotide
  Target: ATXN1; (-) strand; PAM type: NRG; PAM sequence: TGG
acctcctggctgcctgtcag

SEQ ID NO: 95473 - DNA, 20 bp, Artificial Sequence
  Description of Artificial Sequence: Synthetic oligonucleotide
  Target: ATXN1; (-) strand; PAM type: NRG; PAM sequence: CAG
tgaacctcctggctgcctgt

SEQ ID NO: 95474 - DNA, 20 bp, Artificial Sequence
  Description of Artificial Sequence: Synthetic oligonucleotide
  Target: ATXN1; (-) strand; PAM type: NRG; PAM sequence: TGG
aagggctcccctgaacctcc

SEQ ID NO: 95475 - DNA, 20 bp, Artificial Sequence
  Description of Artificial Sequence: Synthetic oligonucleotide
  Target: ATXN1; (-) strand; PAM type: NRG; PAM sequence: GGG
tacataaagcagaggttgaa

SEQ ID NO: 95476 - DNA, 20 bp, Artificial Sequence
  Description of Artificial Sequence: Synthetic oligonucleotide
  Target: ATXN1; (-) strand; PAM type: NRG; PAM sequence: AGG
ctacataaagcagaggttga

SEQ ID NO: 95477 - DNA, 20 bp, Artificial Sequence
  Description of Artificial Sequence: Synthetic oligonucleotide
  Target: ATXN1; (-) strand; PAM type: NRG; PAM sequence: AAG
tctacataaagcagaggttg

SEQ ID NO: 95478 - DNA, 20 bp, Artificial Sequence
  Description of Artificial Sequence: Synthetic oligonucleotide
  Target: ATXN1; (-) strand; PAM type: NRG; PAM sequence: AGG
ccatcttctacataaagcag

SEQ ID NO: 95479 - DNA, 20 bp, Artificial Sequence
  Description of Artificial Sequence: Synthetic oligonucleotide
  Target: ATXN1; (-) strand; PAM type: NRG; PAM sequence: GAG
gccatcttctacataaagca

SEQ ID NO: 95480 - DNA, 20 bp, Artificial Sequence
  Description of Artificial Sequence: Synthetic oligonucleotide
  Target: ATXN1; (-) strand; PAM type: NRG; PAM sequence: CAG
atgccatcttctacataaag

SEQ ID NO: 95481 - DNA, 20 bp, Artificial Sequence
  Description of Artificial Sequence: Synthetic oligonucleotide
  Target: ATXN1; (-) strand; PAM type: NRG; PAM sequence: AAG
tgaatgccatcttctacata

SEQ ID NO: 95482 - DNA, 20 bp, Artificial Sequence
  Description of Artificial Sequence: Synthetic oligonucleotide
  Target: ATXN1; (-) strand; PAM type: NRG; PAM sequence: TGG
ttagcagctccgcaaataaa

SEQ ID NO: 95483 - DNA, 20 bp, Artificial Sequence
  Description of Artificial Sequence: Synthetic oligonucleotide
  Target: ATXN1; (-) strand; PAM type: NRG; PAM sequence: CAG
tgcatcagtcaatattttag

SEQ ID NO: 95484 - DNA, 20 bp, Artificial Sequence
  Description of Artificial Sequence: Synthetic oligonucleotide
  Target: ATXN1; (-) strand; PAM type: NRG; PAM sequence: TAG
gcatgcatcagtcaatattt

SEQ ID NO: 95485 - DNA, 20 bp, Artificial Sequence
  Description of Artificial Sequence: Synthetic oligonucleotide
  Target: ATXN1; (-) strand; PAM type: NRG; PAM sequence: CAG
ccctctcactgtgcatgcat

SEQ ID NO: 95486 - DNA, 20 bp, Artificial Sequence
  Description of Artificial Sequence: Synthetic oligonucleotide
  Target: ATXN1; (-) strand; PAM type: NRG; PAM sequence: TGG
caccataacggctagcgctg

SEQ ID NO: 95487 - DNA, 20 bp, Artificial Sequence
  Description of Artificial Sequence: Synthetic oligonucleotide
  Target: ATXN1; (-) strand; PAM type: NRG; PAM sequence: TAG
agggattgcaccataacggc

SEQ ID NO: 95488 - DNA, 20 bp, Artificial Sequence
  Description of Artificial Sequence: Synthetic oligonucleotide
  Target: ATXN1; (-) strand; PAM type: NRG; PAM sequence: CGG
ggaaagggattgcaccataa

SEQ ID NO: 95489 - DNA, 20 bp, Artificial Sequence
  Description of Artificial Sequence: Synthetic oligonucleotide
  Target: ATXN1; (-) strand; PAM type: NRG; PAM sequence: GGG
tgcacaggaactcttggaaa

SEQ ID NO: 95490 - DNA, 20 bp, Artificial Sequence
  Description of Artificial Sequence: Synthetic oligonucleotide
  Target: ATXN1; (-) strand; PAM type: NRG; PAM sequence: AGG
ctgcacaggaactcttggaa

SEQ ID NO: 95491 - DNA, 20 bp, Artificial Sequence
  Description of Artificial Sequence: Synthetic oligonucleotide
  Target: ATXN1; (-) strand; PAM type: NRG; PAM sequence: AAG
cctgcacaggaactcttgga

SEQ ID NO: 95492 - DNA, 20 bp, Artificial Sequence
  Description of Artificial Sequence: Synthetic oligonucleotide
  Target: ATXN1; (-) strand; PAM type: NRG; PAM sequence: TGG
aaatcctgcacaggaactct

SEQ ID NO: 95493 - DNA, 20 bp, Artificial Sequence
  Description of Artificial Sequence: Synthetic oligonucleotide
  Target: ATXN1; (-) strand; PAM type: NRG; PAM sequence: AGG
gagaagagaaaatcctgcac

SEQ ID NO: 95494 - DNA, 20 bp, Artificial Sequence
  Description of Artificial Sequence: Synthetic oligonucleotide
  Target: ATXN1; (-) strand; PAM type: NRG; PAM sequence: CAG
agagaagagaaaatcctgca

SEQ ID NO: 95495 - DNA, 20 bp, Artificial Sequence
  Description of Artificial Sequence: Synthetic oligonucleotide
  Target: ATXN1; (-) strand; PAM type: NRG; PAM sequence: GAG
gaggaaaccaccagagagaa

SEQ ID NO: 95496 - DNA, 20 bp, Artificial Sequence
  Description of Artificial Sequence: Synthetic oligonucleotide
  Target: ATXN1; (-) strand; PAM type: NRG; PAM sequence: AAG
ctgaggaaaccaccagagag

SEQ ID NO: 95497 - DNA, 20 bp, Artificial Sequence
  Description of Artificial Sequence: Synthetic oligonucleotide
  Target: ATXN1; (-) strand; PAM type: NRG; PAM sequence: GAG
tgtctgaggaaaccaccaga

SEQ ID NO: 95498 - DNA, 20 bp, Artificial Sequence
  Description of Artificial Sequence: Synthetic oligonucleotide
  Target: ATXN1; (-) strand; PAM type: NRG; PAM sequence: GAG
tatgtctgaggaaaccacca

SEQ ID NO: 95499 - DNA, 20 bp, Artificial Sequence
  Description of Artificial Sequence: Synthetic oligonucleotide
  Target: ATXN1; (-) strand; PAM type: NRG; PAM sequence: CAG
cttatgtctgaggaaaccac

SEQ ID NO: 95500 - DNA, 20 bp, Artificial Sequence
  Description of Artificial Sequence: Synthetic oligonucleotide
  Target: ATXN1; (-) strand; PAM type: NRG; PAM sequence: AGG
tggagtgaagcttatgtctg

SEQ ID NO: 95501 - DNA, 20 bp, Artificial Sequence
  Description of Artificial Sequence: Synthetic oligonucleotide
  Target: ATXN1; (-) strand; PAM type: NRG; PAM sequence: GAG
ttggagtgaagcttatgtct

SEQ ID NO: 95502 - DNA, 20 bp, Artificial Sequence
  Description of Artificial Sequence: Synthetic oligonucleotide
  Target: ATXN1; (-) strand; PAM type: NRG; PAM sequence: AAG
cttgagctttttttggagtg

SEQ ID NO: 95503 - DNA, 20 bp, Artificial Sequence
  Description of Artificial Sequence: Synthetic oligonucleotide
  Target: ATXN1; (-) strand; PAM type: NRG; PAM sequence: GAG
tgatacttgagctttttttg

SEQ ID NO: 95504 - DNA, 20 bp, Artificial Sequence
  Description of Artificial Sequence: Synthetic oligonucleotide
  Target: ATXN1; (-) strand; PAM type: NRG; PAM sequence: TGG
tttgatacttgagctttttt

SEQ ID NO: 95505 - DNA, 20 bp, Artificial Sequence
  Description of Artificial Sequence: Synthetic oligonucleotide
  Target: ATXN1; (-) strand; PAM type: NRG; PAM sequence: GAG
gtaaaggtagtttgatactt

SEQ ID NO: 95506 - DNA, 20 bp, Artificial Sequence
  Description of Artificial Sequence: Synthetic oligonucleotide
  Target: ATXN1; (-) strand; PAM type: NRG; PAM sequence: TAG
gtttatttgatgggtaaagg

SEQ ID NO: 95507 - DNA, 20 bp, Artificial Sequence
  Description of Artificial Sequence: Synthetic oligonucleotide
  Target: ATXN1; (-) strand; PAM type: NRG; PAM sequence: AGG
tcggtttatttgatgggtaa

SEQ ID NO: 95508 - DNA, 20 bp, Artificial Sequence
  Description of Artificial Sequence: Synthetic oligonucleotide
  Target: ATXN1; (-) strand; PAM type: NRG; PAM sequence: AAG
ttcggtttatttgatgggta

SEQ ID NO: 95509 - DNA, 20 bp, Artificial Sequence
  Description of Artificial Sequence: Synthetic oligonucleotide
  Target: ATXN1; (-) strand; PAM type: NRG; PAM sequence: GGG
cacccttcggtttatttgat

SEQ ID NO: 95510 - DNA, 20 bp, Artificial Sequence
  Description of Artificial Sequence: Synthetic oligonucleotide
  Target: ATXN1; (-) strand; PAM type: NRG; PAM sequence: TGG
ccacccttcggtttatttga

SEQ ID NO: 95511 - DNA, 20 bp, Artificial Sequence
  Description of Artificial Sequence: Synthetic oligonucleotide
  Target: ATXN1; (-) strand; PAM type: NRG; PAM sequence: CGG
ccccccttaagcccaccctt

SEQ ID NO: 95512 - DNA, 20 bp, Artificial Sequence
  Description of Artificial Sequence: Synthetic oligonucleotide
  Target: ATXN1; (-) strand; PAM type: NRG; PAM sequence: AAG
agttcctagaagcccccctt

SEQ ID NO: 95513 - DNA, 20 bp, Artificial Sequence
  Description of Artificial Sequence: Synthetic oligonucleotide
  Target: ATXN1; (-) strand; PAM type: NRG; PAM sequence: AAG
taggaggctgcagttcctag

SEQ ID NO: 95514 - DNA, 20 bp, Artificial Sequence
  Description of Artificial Sequence: Synthetic oligonucleotide
  Target: ATXN1; (-) strand; PAM type: NRG; PAM sequence: TAG
ttttaggaggctgcagttcc

SEQ ID NO: 95515 - DNA, 20 bp, Artificial Sequence
  Description of Artificial Sequence: Synthetic oligonucleotide
  Target: ATXN1; (-) strand; PAM type: NRG; PAM sequence: CAG
ttgggttttttaggaggctg

SEQ ID NO: 95516 - DNA, 20 bp, Artificial Sequence
  Description of Artificial Sequence: Synthetic oligonucleotide
  Target: ATXN1; (-) strand; PAM type: NRG; PAM sequence: AGG
ttctgtttgggttttttagg

SEQ ID NO: 95517 - DNA, 20 bp, Artificial Sequence
  Description of Artificial Sequence: Synthetic oligonucleotide
  Target: ATXN1; (-) strand; PAM type: NRG; PAM sequence: GAG
tttctgtttgggttttttag

SEQ ID NO: 95518 - DNA, 20 bp, Artificial Sequence
  Description of Artificial Sequence: Synthetic oligonucleotide
  Target: ATXN1; (-) strand; PAM type: NRG; PAM sequence: AGG
catttctgtttgggtttttt

SEQ ID NO: 95519 - DNA, 20 bp, Artificial Sequence
  Description of Artificial Sequence: Synthetic oligonucleotide
  Target: ATXN1; (-) strand; PAM type: NRG; PAM sequence: TAG
acatttctgtttgggttttt

SEQ ID NO: 95520 - DNA, 20 bp, Artificial Sequence
  Description of Artificial Sequence: Synthetic oligonucleotide
  Target: ATXN1; (-) strand; PAM type: NRG; PAM sequence: GGG
tagctgagacatttctgttt

SEQ ID NO: 95521 - DNA, 20 bp, Artificial Sequence
  Description of Artificial Sequence: Synthetic oligonucleotide
  Target: ATXN1; (-) strand; PAM type: NRG; PAM sequence: TGG
ttagctgagacatttctgtt

SEQ ID NO: 95522 - DNA, 20 bp, Artificial Sequence
  Description of Artificial Sequence: Synthetic oligonucleotide
  Target: ATXN1; (-) strand; PAM type: NRG; PAM sequence: GAG
ctttttcaacagtgttagct

SEQ ID NO: 95523 - DNA, 20 bp, Artificial Sequence
  Description of Artificial Sequence: Synthetic oligonucleotide
  Target: ATXN1; (-) strand; PAM type: NRG; PAM sequence: TAG
agttactttttcaacagtgt

SEQ ID NO: 95524 - DNA, 20 bp, Artificial Sequence
  Description of Artificial Sequence: Synthetic oligonucleotide
  Target: ATXN1; (-) strand; PAM type: NRG; PAM sequence: CAG
acagctagttactttttcaa

SEQ ID NO: 95525 - DNA, 20 bp, Artificial Sequence
  Description of Artificial Sequence: Synthetic oligonucleotide
  Target: ATXN1; (-) strand; PAM type: NRG; PAM sequence: TAG
tggttatttttaggcacagc

SEQ ID NO: 95526 - DNA, 20 bp, Artificial Sequence
  Description of Artificial Sequence: Synthetic oligonucleotide
  Target: ATXN1; (-) strand; PAM type: NRG; PAM sequence: CAG
tacttggttatttttaggca

SEQ ID NO: 95527 - DNA, 20 bp, Artificial Sequence
  Description of Artificial Sequence: Synthetic oligonucleotide
  Target: ATXN1; (-) strand; PAM type: NRG; PAM sequence: AGG
gtagttacttggttattttt

SEQ ID NO: 95528 - DNA, 20 bp, Artificial Sequence
  Description of Artificial Sequence: Synthetic oligonucleotide
  Target: ATXN1; (-) strand; PAM type: NRG; PAM sequence: TAG
ggtagttacttggttatttt

SEQ ID NO: 95529 - DNA, 20 bp, Artificial Sequence
  Description of Artificial Sequence: Synthetic oligonucleotide
  Target: ATXN1; (-) strand; PAM type: NRG; PAM sequence: TGG
cacagcagtgggtagttact

SEQ ID NO: 95530 - DNA, 20 bp, Artificial Sequence
  Description of Artificial Sequence: Synthetic oligonucleotide
  Target: ATXN1; (-) strand; PAM type: NRG; PAM sequence: TAG
atattgcacacagcagtggg

SEQ ID NO: 95531 - DNA, 20 bp, Artificial Sequence
  Description of Artificial Sequence: Synthetic oligonucleotide
  Target: ATXN1; (-) strand; PAM type: NRG; PAM sequence: GGG
tatatattgcacacagcagt

SEQ ID NO: 95532 - DNA, 20 bp, Artificial Sequence
  Description of Artificial Sequence: Synthetic oligonucleotide
  Target: ATXN1; (-) strand; PAM type: NRG; PAM sequence: TGG
ttatatattgcacacagcag

SEQ ID NO: 95533 - DNA, 20 bp, Artificial Sequence
  Description of Artificial Sequence: Synthetic oligonucleotide
  Target: ATXN1; (-) strand; PAM type: NRG; PAM sequence: CAG
ttgttatatattgcacacag

SEQ ID NO: 95534 - DNA, 20 bp, Artificial Sequence
  Description of Artificial Sequence: Synthetic oligonucleotide
  Target: ATXN1; (-) strand; PAM type: NRG; PAM sequence: CAG
tcattgttatatattgcaca

SEQ ID NO: 95535 - DNA, 20 bp, Artificial Sequence
  Description of Artificial Sequence: Synthetic oligonucleotide
  Target: ATXN1; (-) strand; PAM type: NRG; PAM sequence: AGG
acatttgtgttttataatgc

SEQ ID NO: 95536 - DNA, 20 bp, Artificial Sequence
  Description of Artificial Sequence: Synthetic oligonucleotide
  Target: ATXN1; (-) strand; PAM type: NRG; PAM sequence: CAG
gacatttgtgttttataatg

SEQ ID NO: 95537 - DNA, 20 bp, Artificial Sequence
  Description of Artificial Sequence: Synthetic oligonucleotide
  Target: ATXN1; (-) strand; PAM type: NRG; PAM sequence: TAG
gttctcctttggcaatctag

SEQ ID NO: 95538 - DNA, 20 bp, Artificial Sequence
  Description of Artificial Sequence: Synthetic oligonucleotide
  Target: ATXN1; (-) strand; PAM type: NRG; PAM sequence: TAG
taagttctcctttggcaatc

SEQ ID NO: 95539 - DNA, 20 bp, Artificial Sequence
  Description of Artificial Sequence: Synthetic oligonucleotide
  Target: ATXN1; (-) strand; PAM type: NRG; PAM sequence: TGG
tatgcaaataagttctcctt

SEQ ID NO: 95540 - DNA, 20 bp, Artificial Sequence
  Description of Artificial Sequence: Synthetic oligonucleotide
  Target: ATXN1; (-) strand; PAM type: NRG; PAM sequence: AAG
gggaatgtgtgtatgcaaat

SEQ ID NO: 95541 - DNA, 20 bp, Artificial Sequence
  Description of Artificial Sequence: Synthetic oligonucleotide
  Target: ATXN1; (-) strand; PAM type: NRG; PAM sequence: GGG
acatcctgtcgtgcatgcac

SEQ ID NO: 95542 - DNA, 20 bp, Artificial Sequence
  Description of Artificial Sequence: Synthetic oligonucleotide
  Target: ATXN1; (-) strand; PAM type: NRG; PAM sequence: CGG
cacatcctgtcgtgcatgca

SEQ ID NO: 95543 - DNA, 20 bp, Artificial Sequence
  Description of Artificial Sequence: Synthetic oligonucleotide
  Target: ATXN1; (-) strand; PAM type: NRG; PAM sequence: TGG
taaaaactaatgccttacag

SEQ ID NO: 95544 - DNA, 20 bp, Artificial Sequence
  Description of Artificial Sequence: Synthetic oligonucleotide
  Target: ATXN1; (-) strand; PAM type: NRG; PAM sequence: CAG
gaataaaaactaatgcctta

SEQ ID NO: 95545 - DNA, 20 bp, Artificial Sequence
  Description of Artificial Sequence: Synthetic oligonucleotide
  Target: ATXN1; (-) strand; PAM type: NRG; PAM sequence: CAG
agaagaccctattacaccca

SEQ ID NO: 95546 - DNA, 20 bp, Artificial Sequence
  Description of Artificial Sequence: Synthetic oligonucleotide
  Target: ATXN1; (-) strand; PAM type: NRG; PAM sequence: AAG
gatacaattagcaaaattag

SEQ ID NO: 95547 - DNA, 20 bp, Artificial Sequence
  Description of Artificial Sequence: Synthetic oligonucleotide
  Target: ATXN1; (-) strand; PAM type: NRG; PAM sequence: TAG
caggatacaattagcaaaat

SEQ ID NO: 95548 - DNA, 20 bp, Artificial Sequence
  Description of Artificial Sequence: Synthetic oligonucleotide
  Target: ATXN1; (-) strand; PAM type: NRG; PAM sequence: TAG
cgagatccacaggatacaat

SEQ ID NO: 95549 - DNA, 20 bp, Artificial Sequence
  Description of Artificial Sequence: Synthetic oligonucleotide
  Target: ATXN1; (-) strand; PAM type: NRG; PAM sequence: AGG
agcttccctgcgagatccac

SEQ ID NO: 95550 - DNA, 20 bp, Artificial Sequence
  Description of Artificial Sequence: Synthetic oligonucleotide
  Target: ATXN1; (-) strand; PAM type: NRG; PAM sequence: CAG
tagcttccctgcgagatcca

SEQ ID NO: 95551 - DNA, 20 bp, Artificial Sequence
  Description of Artificial Sequence: Synthetic oligonucleotide
  Target: ATXN1; (-) strand; PAM type: NRG; PAM sequence: GAG
gagattcttagcttccctgc

SEQ ID NO: 95552 - DNA, 20 bp, Artificial Sequence
  Description of Artificial Sequence: Synthetic oligonucleotide
  Target: ATXN1; (-) strand; PAM type: NRG; PAM sequence: TAG
tctgtccccgaagagattct

SEQ ID NO: 95553 - DNA, 20 bp, Artificial Sequence
  Description of Artificial Sequence: Synthetic oligonucleotide
  Target: ATXN1; (-) strand; PAM type: NRG; PAM sequence: GAG
aaactggttctgtccccgaa

SEQ ID NO: 95554 - DNA, 20 bp, Artificial Sequence
  Description of Artificial Sequence: Synthetic oligonucleotide
  Target: ATXN1; (-) strand; PAM type: NRG; PAM sequence: AAG
ccaaactggttctgtccccg

SEQ ID NO: 95555 - DNA, 20 bp, Artificial Sequence
  Description of Artificial Sequence: Synthetic oligonucleotide
  Target: ATXN1; (-) strand; PAM type: NRG; PAM sequence: TGG
cagtagggactcctccaaac

SEQ ID NO: 95556 - DNA, 20 bp, Artificial Sequence
  Description of Artificial Sequence: Synthetic oligonucleotide
  Target: ATXN1; (-) strand; PAM type: NRG; PAM sequence: GGG
ttaccgtatgctgtgcagta

SEQ ID NO: 95557 - DNA, 20 bp, Artificial Sequence
  Description of Artificial Sequence: Synthetic oligonucleotide
  Target: ATXN1; (-) strand; PAM type: NRG; PAM sequence: AGG
tttaccgtatgctgtgcagt

SEQ ID NO: 95558 - DNA, 20 bp, Artificial Sequence
  Description of Artificial Sequence: Synthetic oligonucleotide
  Target: ATXN1; (-) strand; PAM type: NRG; PAM sequence: TAG
gtttaccgtatgctgtgcag

SEQ ID NO: 95559 - DNA, 20 bp, Artificial Sequence
  Description of Artificial Sequence: Synthetic oligonucleotide
  Target: ATXN1; (-) strand; PAM type: NRG; PAM sequence: CAG
tttgtttaccgtatgctgtg

SEQ ID NO: 95560 - DNA, 20 bp, Artificial Sequence
  Description of Artificial Sequence: Synthetic oligonucleotide
  Target: ATXN1; (-) strand; PAM type: NRG; PAM sequence: AAG
atgtggctaacaagaaaggc

SEQ ID NO: 95561 - DNA, 20 bp, Artificial Sequence
  Description of Artificial Sequence: Synthetic oligonucleotide
  Target: ATXN1; (-) strand; PAM type: NRG; PAM sequence: AGG
cgcgatgtggctaacaagaa

SEQ ID NO: 95562 - DNA, 20 bp, Artificial Sequence
  Description of Artificial Sequence: Synthetic oligonucleotide
  Target: ATXN1; (-) strand; PAM type: NRG; PAM sequence: AAG
gcgcgatgtggctaacaaga

SEQ ID NO: 95563 - DNA, 20 bp, Artificial Sequence
  Description of Artificial Sequence: Synthetic oligonucleotide
  Target: ATXN1; (-) strand; PAM type: NRG; PAM sequence: AAG
taatgcgcgatgtggctaac

SEQ ID NO: 95564 - DNA, 20 bp, Artificial Sequence
  Description of Artificial Sequence: Synthetic oligonucleotide
  Target: ATXN1; (-) strand; PAM type: NRG; PAM sequence: TGG
tggttatataatgcgcgatg

SEQ ID NO: 95565 - DNA, 20 bp, Artificial Sequence
  Description of Artificial Sequence: Synthetic oligonucleotide
  Target: ATXN1; (-) strand; PAM type: NRG; PAM sequence: TGG
aaaaaacagtcggaagaagc

SEQ ID NO: 95566 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaacagtcggaag

SEQ ID NO: 95567 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaacagtcgg

SEQ ID NO: 95568 - DNA, 20 bp, Artificial Sequence
  Description of Artificial Sequence: Synthetic oligonucleotide
  Target: ATXN1; (-) strand; PAM type: NRG; PAM sequence: CGG
aaaaaaaaaaaaaaaacagt

SEQ ID NO: 95569 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaaaaaaaa

SEQ ID NO: 95570 - DNA, 20 bp, Artificial Sequence
  Description of Artificial Sequence: Synthetic oligonucleotide
  Target: ATXN1; (-) strand; PAM type: NRG; PAM sequence: GGG
aaattgctgaagagtagtaa

SEQ ID NO: 95571 - DNA, 20 bp, Artificial Sequence
  Description of Artificial Sequence: Synthetic oligonucleotide
  Target: ATXN1; (-) strand; PAM type: NRG; PAM sequence: AGG
gaaattgctgaagagtagta

SEQ ID NO: 95572 - DNA, 20 bp, Artificial Sequence
  Description of Artificial Sequence: Synthetic oligonucleotide
  Target: ATXN1; (-) strand; PAM type: NRG; PAM sequence: AAG
ggaaattgctgaagagtagt

SEQ ID NO: 95573 - DNA, 20 bp, Artificial Sequence
  Description of Artificial Sequence: Synthetic oligonucleotide
  Target: ATXN1; (-) strand; PAM type: NRG; PAM sequence: TAG
agagggaaattgctgaagag

SEQ ID NO: 95574 - DNA, 20 bp, Artificial Sequence
  Description of Artificial Sequence: Synthetic oligonucleotide
  Target: ATXN1; (-) strand; PAM type: NRG; PAM sequence: GAG
agaagagggaaattgctgaa

SEQ ID NO: 95575 - DNA, 20 bp, Artificial Sequence
  Description of Artificial Sequence: Synthetic oligonucleotide
  Target: ATXN1; (-) strand; PAM type: NRG; PAM sequence: AAG
tgagaagagggaaattgctg

SEQ ID NO: 95576 - DNA, 20 bp, Artificial Sequence
  Description of Artificial Sequence: Synthetic oligonucleotide
  Target: ATXN1; (-) strand; PAM type: NRG; PAM sequence: GGG
aatataaatatttgagaaga

SEQ ID NO: 95577 - DNA, 20 bp, Artificial Sequence
  Description of Artificial Sequence: Synthetic oligonucleotide
  Target: ATXN1; (-) strand; PAM type: NRG; PAM sequence: AGG
taatataaatatttgagaag

SEQ ID NO: 95578 - DNA, 20 bp, Artificial Sequence
  Description of Artificial Sequence: Synthetic oligonucleotide
  Target: ATXN1; (-) strand; PAM type: NRG; PAM sequence: GAG
gtaatataaatatttgagaa

SEQ ID NO: 95579 - DNA, 20 bp, Artificial Sequence
  Description of Artificial Sequence: Synthetic oligonucleotide
  Target: ATXN1; (-) strand; PAM type: NRG; PAM sequence: AAG
gggtaatataaatatttgag

SEQ ID NO: 95580 - DNA, 20 bp, Artificial Sequence
  Description of Artificial Sequence: Synthetic oligonucleotide
  Target: ATXN1; (-) strand; PAM type: NRG; PAM sequence: GAG
aaagggtaatataaatattt

SEQ ID NO: 95581 - DNA, 20 bp, Artificial Sequence
  Description of Artificial Sequence: Synthetic oligonucleotide
  Target: ATXN1; (-) strand; PAM type: NRG; PAM sequence: GGG
atataatcctacagataaaa

SEQ ID NO: 95582 - DNA, 20 bp, Artificial Sequence
  Description of Artificial Sequence: Synthetic oligonucleotide
  Target: ATXN1; (-) strand; PAM type: NRG; PAM sequence: AGG
tatataatcctacagataaa

SEQ ID NO: 95583 - DNA, 20 bp, Artificial Sequence
  Description of Artificial Sequence: Synthetic oligonucleotide
  Target: ATXN1; (-) strand; PAM type: NRG; PAM sequence: AAG
gtatataatcctacagataa

SEQ ID NO: 95584 - DNA, 20 bp, Artificial Sequence
  Description of Artificial Sequence: Synthetic oligonucleotide
  Target: ATXN1; (-) strand; PAM type: NRG; PAM sequence: CAG
tttcttggtatataatccta

SEQ ID NO: 95585 - DNA, 20 bp, Artificial Sequence
  Description of Artificial Sequence: Synthetic oligonucleotide
  Target: ATXN1; (-) strand; PAM type: NRG; PAM sequence: TGG
tctgttttgttttgctttct

SEQ ID NO: 95586 - DNA, 20 bp, Artificial Sequence
  Description of Artificial Sequence: Synthetic oligonucleotide
  Target: ATXN1; (-) strand; PAM type: NRG; PAM sequence: TGG
ggggattcggttcgagcccg

SEQ ID NO: 95587 - DNA, 20 bp, Artificial Sequence
  Description of Artificial Sequence: Synthetic oligonucleotide
  Target: ATXN1; (-) strand; PAM type: NRG; PAM sequence: GAG
ggacggcggggattcggttc

SEQ ID NO: 95588 - DNA, 20 bp, Artificial Sequence
  Description of Artificial Sequence: Synthetic oligonucleotide
  Target: ATXN1; (-) strand; PAM type: NRG; PAM sequence: CGG
ttctaaggacggcggggatt

SEQ ID NO: 95589 - DNA, 20 bp, Artificial Sequence
  Description of Artificial Sequence: Synthetic oligonucleotide
  Target: ATXN1; (-) strand; PAM type: NRG; PAM sequence: GGG
atccgtttctaaggacggcg

SEQ ID NO: 95590 - DNA, 20 bp, Artificial Sequence
  Description of Artificial Sequence: Synthetic oligonucleotide
  Target: ATXN1; (-) strand; PAM type: NRG; PAM sequence: GGG
aatccgtttctaaggacggc

SEQ ID NO: 95591 - DNA, 20 bp, Artificial Sequence
  Description of Artificial Sequence: Synthetic oligonucleotide
  Target: ATXN1; (-) strand; PAM type: NRG; PAM sequence: CGG
aaatccgtttctaaggacgg

SEQ ID NO: 95592 - DNA, 20 bp, Artificial Sequence
  Description of Artificial Sequence: Synthetic oligonucleotide
  Target: ATXN1; (-) strand; PAM type: NRG; PAM sequence: CGG
aaaaaatccgtttctaagga

SEQ ID NO: 95593 - DNA, 20 bp, Artificial Sequence
  Description of Artificial Sequence: Synthetic oligonucleotide
  Target: ATXN1; (-) strand; PAM type: NRG; PAM sequence: AGG
caaaaaaaaatccgtttcta

SEQ ID NO: 95594 - DNA, 20 bp, Artificial Sequence
  Description of Artificial Sequence: Synthetic oligonucleotide
  Target: ATXN1; (-) strand; PAM type: NRG; PAM sequence: AAG
acaaaaaaaaatccgtttct

SEQ ID NO: 95595 - DNA, 20 bp, Artificial Sequence
  Description of Artificial Sequence: Synthetic oligonucleotide
  Target: ATXN1; (-) strand; PAM type: NRG; PAM sequence: CAG
ggtggtgatcgagactctgc

SEQ ID NO: 95596 - DNA, 20 bp, Artificial Sequence
  Description of Artificial Sequence: Synthetic oligonucleotide
  Target: ATXN1; (-) strand; PAM type: NRG; PAM sequence: GAG
gtggaagtagggtggtgatc

SEQ ID NO: 95597 - DNA, 20 bp, Artificial Sequence
  Description of Artificial Sequence: Synthetic oligonucleotide
  Target: ATXN1; (-) strand; PAM type: NRG; PAM sequence: TGG
tagtgggggtggaagtaggg

SEQ ID NO: 95598 - DNA, 20 bp, Artificial Sequence
  Description of Artificial Sequence: Synthetic oligonucleotide
  Target: ATXN1; (-) strand; PAM type: NRG; PAM sequence: GGG
ccttagtgggggtggaagta

SEQ ID NO: 95599 - DNA, 20 bp, Artificial Sequence
  Description of Artificial Sequence: Synthetic oligonucleotide
  Target: ATXN1; (-) strand; PAM type: NRG; PAM sequence: AGG
accttagtgggggtggaagt

SEQ ID NO: 95600 - DNA, 20 bp, Artificial Sequence
  Description of Artificial Sequence: Synthetic oligonucleotide
  Target: ATXN1; (-) strand; PAM type: NRG; PAM sequence: TAG
aaccttagtgggggtggaag

SEQ ID NO: 95601 - DNA, 20 bp, Artificial Sequence
  Description of Artificial Sequence: Synthetic oligonucleotide
  Target: ATXN1; (-) strand; PAM type: NRG; PAM sequence: AAG
aagaaccttagtgggggtgg

SEQ ID NO: 95602 - DNA, 20 bp, Artificial Sequence
  Description of Artificial Sequence: Synthetic oligonucleotide
  Target: ATXN1; (-) strand; PAM type: NRG; PAM sequence: TGG
agcaagaaccttagtggggg

SEQ ID NO: 95603 - DNA, 20 bp, Artificial Sequence
  Description of Artificial Sequence: Synthetic oligonucleotide
  Target: ATXN1; (-) strand; PAM type: NRG; PAM sequence: GGG
ttgagcaagaaccttagtgg

SEQ ID NO: 95604 - DNA, 20 bp, Artificial Sequence
  Description of Artificial Sequence: Synthetic oligonucleotide
  Target: ATXN1; (-) strand; PAM type: NRG; PAM sequence: GGG
attgagcaagaaccttagtg

SEQ ID NO: 95605 - DNA, 20 bp, Artificial Sequence
  Description of Artificial Sequence: Synthetic oligonucleotide
  Target: ATXN1; (-) strand; PAM type: NRG; PAM sequence: GGG
gattgagcaagaaccttagt

SEQ ID NO: 95606 - DNA, 20 bp, Artificial Sequence
  Description of Artificial Sequence: Synthetic oligonucleotide
  Target: ATXN1; (-) strand; PAM type: NRG; PAM sequence: TGG
agattgagcaagaaccttag

SEQ ID NO: 95607 - DNA, 20 bp, Artificial Sequence
  Description of Artificial Sequence: Synthetic oligonucleotide
  Target: ATXN1; (-) strand; PAM type: NRG; PAM sequence: TAG
gggagattgagcaagaacct

SEQ ID NO: 95608 - DNA, 20 bp, Artificial Sequence
  Description of Artificial Sequence: Synthetic oligonucleotide
  Target: ATXN1; (-) strand; PAM type: NRG; PAM sequence: AAG
gttttctagggagattgagc

SEQ ID NO: 95609 - DNA, 20 bp, Artificial Sequence
  Description of Artificial Sequence: Synthetic oligonucleotide
  Target: ATXN1; (-) strand; PAM type: NRG; PAM sequence: GAG
tcaggttttctagggagatt

SEQ ID NO: 95610 - DNA, 20 bp, Artificial Sequence
  Description of Artificial Sequence: Synthetic oligonucleotide
  Target: ATXN1; (-) strand; PAM type: NRG; PAM sequence: GAG
aacaattcaggttttctagg

SEQ ID NO: 95611 - DNA, 20 bp, Artificial Sequence
  Description of Artificial Sequence: Synthetic oligonucleotide
  Target: ATXN1; (-) strand; PAM type: NRG; PAM sequence: GGG
gaaacaattcaggttttcta

SEQ ID NO: 95612 - DNA, 20 bp, Artificial Sequence
  Description of Artificial Sequence: Synthetic oligonucleotide
  Target: ATXN1; (-) strand; PAM type: NRG; PAM sequence: AGG
tgaaacaattcaggttttct

SEQ ID NO: 95613 - DNA, 20 bp, Artificial Sequence
  Description of Artificial Sequence: Synthetic oligonucleotide
  Target: ATXN1; (-) strand; PAM type: NRG; PAM sequence: TAG
atgaaacaattcaggttttc

SEQ ID NO: 95614 - DNA, 20 bp, Artificial Sequence
  Description of Artificial Sequence: Synthetic oligonucleotide
  Target: ATXN1; (-) strand; PAM type: NRG; PAM sequence: AGG
tgaaagggatgaaacaattc

SEQ ID NO: 95615 - DNA, 20 bp, Artificial Sequence
  Description of Artificial Sequence: Synthetic oligonucleotide
  Target: ATXN1; (-) strand; PAM type: NRG; PAM sequence: CAG
ctgaaagggatgaaacaatt

SEQ ID NO: 95616 - DNA, 20 bp, Artificial Sequence
  Description of Artificial Sequence: Synthetic oligonucleotide
  Target: ATXN1; (-) strand; PAM type: NRG; PAM sequence: GGG
acgtagggggctgactgaaa

SEQ ID NO: 95617 - DNA, 20 bp, Artificial Sequence
  Description of Artificial Sequence: Synthetic oligonucleotide
  Target: ATXN1; (-) strand; PAM type: NRG; PAM sequence: AGG
cacgtagggggctgactgaa

SEQ ID NO: 95618 - DNA, 20 bp, Artificial Sequence
  Description of Artificial Sequence: Synthetic oligonucleotide
  Target: ATXN1; (-) strand; PAM type: NRG; PAM sequence: AAG
ccacgtagggggctgactga

SEQ ID NO: 95619 - DNA, 20 bp, Artificial Sequence
  Description of Artificial Sequence: Synthetic oligonucleotide
  Target: ATXN1; (-) strand; PAM type: NRG; PAM sequence: GGG
tttgtttcagaccacgtagg

SEQ ID NO: 95620 - DNA, 20 bp, Artificial Sequence
  Description of Artificial Sequence: Synthetic oligonucleotide
  Target: ATXN1; (-) strand; PAM type: NRG; PAM sequence: GGG
ttttgtttcagaccacgtag

SEQ ID NO: 95621 - DNA, 20 bp, Artificial Sequence
  Description of Artificial Sequence: Synthetic oligonucleotide
  Target: ATXN1; (-) strand; PAM type: NRG; PAM sequence: GGG
attttgtttcagaccacgta

SEQ ID NO: 95622 - DNA, 20 bp, Artificial Sequence
  Description of Artificial Sequence: Synthetic oligonucleotide
  Target: ATXN1; (-) strand; PAM type: NRG; PAM sequence: AGG
cattttgtttcagaccacgt

SEQ ID NO: 95623 - DNA, 20 bp, Artificial Sequence
  Description of Artificial Sequence: Synthetic oligonucleotide
  Target: ATXN1; (-) strand; PAM type: NRG; PAM sequence: TAG
tcattttgtttcagaccacg

SEQ ID NO: 95624 - DNA, 20 bp, Artificial Sequence
  Description of Artificial Sequence: Synthetic oligonucleotide
  Target: ATXN1; (-) strand; PAM type: NRG; PAM sequence: CAG
cttgtgctttcattttgttt

SEQ ID NO: 95625 - DNA, 20 bp, Artificial Sequence
  Description of Artificial Sequence: Synthetic oligonucleotide
  Target: ATXN1; (-) strand; PAM type: NRG; PAM sequence: TGG
ggctgccttcttaaactccg

SEQ ID NO: 95626 - DNA, 20 bp, Artificial Sequence
  Description of Artificial Sequence: Synthetic oligonucleotide
  Target: ATXN1; (-) strand; PAM type: NRG; PAM sequence: AGG
ctcttcagccccccgccttc

SEQ ID NO: 95627 - DNA, 20 bp, Artificial Sequence
  Description of Artificial Sequence: Synthetic oligonucleotide
  Target: ATXN1; (-) strand; PAM type: NRG; PAM sequence: CAG
cctcttcagccccccgcctt

SEQ ID NO: 95628 - DNA, 20 bp, Artificial Sequence
  Description of Artificial Sequence: Synthetic oligonucleotide
  Target: ATXN1; (-) strand; PAM type: NRG; PAM sequence: CAG
gcagcgccccgacccctctt

SEQ ID NO: 95629 - DNA, 20 bp, Artificial Sequence
  Description of Artificial Sequence: Synthetic oligonucleotide
  Target: ATXN1; (-) strand; PAM type: NRG; PAM sequence: CAG
tggctacttggctgactctg

SEQ ID NO: 95630 - DNA, 20 bp, Artificial Sequence
  Description of Artificial Sequence: Synthetic oligonucleotide
  Target: ATXN1; (-) strand; PAM type: NRG; PAM sequence: TGG
ggggcccttccttggctact

SEQ ID NO: 95631 - DNA, 20 bp, Artificial Sequence
  Description of Artificial Sequence: Synthetic oligonucleotide
  Target: ATXN1; (-) strand; PAM type: NRG; PAM sequence: TGG
acgcggagggggcccttcct

SEQ ID NO: 95632 - DNA, 20 bp, Artificial Sequence
  Description of Artificial Sequence: Synthetic oligonucleotide
  Target: ATXN1; (-) strand; PAM type: NRG; PAM sequence: GGG
gggccgtcgcgacgcggagg

SEQ ID NO: 95633 - DNA, 20 bp, Artificial Sequence
  Description of Artificial Sequence: Synthetic oligonucleotide
  Target: ATXN1; (-) strand; PAM type: NRG; PAM sequence: GGG
agggccgtcgcgacgcggag

SEQ ID NO: 95634 - DNA, 20 bp, Artificial Sequence
  Description of Artificial Sequence: Synthetic oligonucleotide
  Target: ATXN1; (-) strand; PAM type: NRG; PAM sequence: GGG
gagggccgtcgcgacgcgga

SEQ ID NO: 95635 - DNA, 20 bp, Artificial Sequence
  Description of Artificial Sequence: Synthetic oligonucleotide
  Target: ATXN1; (-) strand; PAM type: NRG; PAM sequence: AGG
cgagggccgtcgcgacgcgg

SEQ ID NO: 95636 - DNA, 20 bp, Artificial Sequence
  Description of Artificial Sequence: Synthetic oligonucleotide
  Target: ATXN1; (-) strand; PAM type: NRG; PAM sequence: GAG
gcgagggccgtcgcgacgcg

SEQ ID NO: 95637 - DNA, 20 bp, Artificial Sequence
  Description of Artificial Sequence: Synthetic oligonucleotide
  Target: ATXN1; (-) strand; PAM type: NRG; PAM sequence: CGG
gggcgagggccgtcgcgacg

SEQ ID NO: 95638 - DNA, 20 bp, Artificial Sequence
  Description of Artificial Sequence: Synthetic oligonucleotide
  Target: ATXN1; (-) strand; PAM type: NRG; PAM sequence: GGG
gcgcgccgggcggggggcga

SEQ ID NO: 95639 - DNA, 20 bp, Artificial Sequence
  Description of Artificial Sequence: Synthetic oligonucleotide
  Target: ATXN1; (-) strand; PAM type: NRG; PAM sequence: AGG
cgcgcgccgggcggggggcg

SEQ ID NO: 95640 - DNA, 20 bp, Artificial Sequence
  Description of Artificial Sequence: Synthetic oligonucleotide
  Target: ATXN1; (-) strand; PAM type: NRG; PAM sequence: GAG
gcgcgcgccgggcggggggc

SEQ ID NO: 95641 - DNA, 20 bp, Artificial Sequence
  Description of Artificial Sequence: Synthetic oligonucleotide
  Target: ATXN1; (-) strand; PAM type: NRG; PAM sequence: GGG
gcgcgcgcgcgccgggcggg

SEQ ID NO: 95642 - DNA, 20 bp, Artificial Sequence
  Description of Artificial Sequence: Synthetic oligonucleotide
  Target: ATXN1; (-) strand; PAM type: NRG; PAM sequence: GGG
tgcgcgcgcgcgccgggcgg

SEQ ID NO: 95643 - DNA, 20 bp, Artificial Sequence
  Description of Artificial Sequence: Synthetic oligonucleotide
  Target: ATXN1; (-) strand; PAM type: NRG; PAM sequence: GGG
gtgcgcgcgcgcgccgggcg

SEQ ID NO: 95644 - DNA, 20 bp, Artificial Sequence
  Description of Artificial Sequence: Synthetic oligonucleotide
  Target: ATXN1; (-) strand; PAM type: NRG; PAM sequence: GGG
tgtgcgcgcgcgcgccgggc

SEQ ID NO: 95645 - DNA, 20 bp, Artificial Sequence
  Description of Artificial Sequence: Synthetic oligonucleotide
  Target: ATXN1; (-) strand; PAM type: NRG; PAM sequence: CGG
ttgtgcgcgcgcgcgccggg

SEQ ID NO: 95646 - DNA, 20 bp, Artificial Sequence
  Description of Artificial Sequence: Synthetic oligonucleotide
  Target: ATXN1; (-) strand; PAM type: NRG; PAM sequence: GGG
tatttgtgcgcgcgcgcgcc

SEQ ID NO: 95647 - DNA, 20 bp, Artificial Sequence
  Description of Artificial Sequence: Synthetic oligonucleotide
  Target: ATXN1; (-) strand; PAM type: NRG; PAM sequence: CGG
gtatttgtgcgcgcgcgcgc

SEQ ID NO: 95648 - DNA, 20 bp, Artificial Sequence
  Description of Artificial Sequence: Synthetic oligonucleotide
  Target: ATXN1; (-) strand; PAM type: NRG; PAM sequence: GAG
gtgagtgtgagtgagtgtgt

SEQ ID NO: 95649 - DNA, 20 bp, Artificial Sequence
  Description of Artificial Sequence: Synthetic oligonucleotide
  Target: ATXN1; (-) strand; PAM type: NRG; PAM sequence: GAG
agcgcggcgtgagtgtgagt

SEQ ID NO: 95650 - DNA, 20 bp, Artificial Sequence
  Description of Artificial Sequence: Synthetic oligonucleotide
  Target: ATXN1; (-) strand; PAM type: NRG; PAM sequence: GAG
tcggagcgcggcgtgagtgt

SEQ ID NO: 95651 - DNA, 20 bp, Artificial Sequence
  Description of Artificial Sequence: Synthetic oligonucleotide
  Target: ATXN1; (-) strand; PAM type: NRG; PAM sequence: GAG
gcggtgtcggagcgcggcgt

SEQ ID NO: 95652 - DNA, 20 bp, Artificial Sequence
  Description of Artificial Sequence: Synthetic oligonucleotide
  Target: ATXN1; (-) strand; PAM type: NRG; PAM sequence: CGG
ggtgaggcggtgtcggagcg

SEQ ID NO: 95653 - DNA, 20 bp, Artificial Sequence
  Description of Artificial Sequence: Synthetic oligonucleotide
  Target: ATXN1; (-) strand; PAM type: NRG; PAM sequence: GAG
cgagaggtgaggcggtgtcg

SEQ ID NO: 95654 - DNA, 20 bp, Artificial Sequence
  Description of Artificial Sequence: Synthetic oligonucleotide
  Target: ATXN1; (-) strand; PAM type: NRG; PAM sequence: CGG
agcgagaggtgaggcggtgt

SEQ ID NO: 95655 - DNA, 20 bp, Artificial Sequence
  Description of Artificial Sequence: Synthetic oligonucleotide
  Target: ATXN1; (-) strand; PAM type: NRG; PAM sequence: CGG
gggcggagcgagaggtgagg

SEQ ID NO: 95656 - DNA, 20 bp, Artificial Sequence
  Description of Artificial Sequence: Synthetic oligonucleotide
  Target: ATXN1; (-) strand; PAM type: NRG; PAM sequence: AGG
gacgggcggagcgagaggtg

SEQ ID NO: 95657 - DNA, 20 bp, Artificial Sequence
  Description of Artificial Sequence: Synthetic oligonucleotide
  Target: ATXN1; (-) strand; PAM type: NRG; PAM sequence: GAG
ggacgggcggagcgagaggt

SEQ ID NO: 95658 - DNA, 20 bp, Artificial Sequence
  Description of Artificial Sequence: Synthetic oligonucleotide
  Target: ATXN1; (-) strand; PAM type: NRG; PAM sequence: AGG
ggccggacgggcggagcgag

SEQ ID NO: 95659 - DNA, 20 bp, Artificial Sequence
  Description of Artificial Sequence: Synthetic oligonucleotide
  Target: ATXN1; (-) strand; PAM type: NRG; PAM sequence: GAG
gggccggacgggcggagcga

SEQ ID NO: 95660 - DNA, 20 bp, Artificial Sequence
  Description of Artificial Sequence: Synthetic oligonucleotide
  Target: ATXN1; (-) strand; PAM type: NRG; PAM sequence: GAG
gggggccggacgggcggagc

SEQ ID NO: 95661 - DNA, 20 bp, Artificial Sequence
  Description of Artificial Sequence: Synthetic oligonucleotide
  Target: ATXN1; (-) strand; PAM type: NRG; PAM sequence: GAG
ggaagggggccggacgggcg

SEQ ID NO: 95662 - DNA, 20 bp, Artificial Sequence
  Description of Artificial Sequence: Synthetic oligonucleotide
  Target: ATXN1; (-) strand; PAM type: NRG; PAM sequence: CGG
agggaagggggccggacggg

SEQ ID NO: 95663 - DNA, 20 bp, Artificial Sequence
  Description of Artificial Sequence: Synthetic oligonucleotide
  Target: ATXN1; (-) strand; PAM type: NRG; PAM sequence: GGG
ggcagggaagggggccggac

SEQ ID NO: 95664 - DNA, 20 bp, Artificial Sequence
  Description of Artificial Sequence: Synthetic oligonucleotide
  Target: ATXN1; (-) strand; PAM type: NRG; PAM sequence: CGG
gggcagggaagggggccgga

SEQ ID NO: 95665 - DNA, 20 bp, Artificial Sequence
  Description of Artificial Sequence: Synthetic oligonucleotide
  Target: ATXN1; (-) strand; PAM type: NRG; PAM sequence: CGG
cagggggcagggaagggggc

SEQ ID NO: 95666 - DNA, 20 bp, Artificial Sequence
  Description of Artificial Sequence: Synthetic oligonucleotide
  Target: ATXN1; (-) strand; PAM type: NRG; PAM sequence: GGG
cccgcagggggcagggaagg

SEQ ID NO: 95667 - DNA, 20 bp, Artificial Sequence
  Description of Artificial Sequence: Synthetic oligonucleotide
  Target: ATXN1; (-) strand; PAM type: NRG; PAM sequence: GGG
tcccgcagggggcagggaag

SEQ ID NO: 95668 - DNA, 20 bp, Artificial Sequence
  Description of Artificial Sequence: Synthetic oligonucleotide
  Target: ATXN1; (-) strand; PAM type: NRG; PAM sequence: GGG
gtcccgcagggggcagggaa

SEQ ID NO: 95669 - DNA, 20 bp, Artificial Sequence
  Description of Artificial Sequence: Synthetic oligonucleotide
  Target: ATXN1; (-) strand; PAM type: NRG; PAM sequence: AGG
ggtcccgcagggggcaggga

SEQ ID NO: 95670 - DNA, 20 bp, Artificial Sequence
  Description of Artificial Sequence: Synthetic oligonucleotide
  Target: ATXN1; (-) strand; PAM type: NRG; PAM sequence: AAG
cggtcccgcagggggcaggg

SEQ ID NO: 95671 - DNA, 20 bp, Artificial Sequence
  Description of Artificial Sequence: Synthetic oligonucleotide
  Target: ATXN1; (-) strand; PAM type: NRG; PAM sequence: GGG
ggccggtcccgcagggggca

SEQ ID NO: 95672 - DNA, 20 bp, Artificial Sequence
  Description of Artificial Sequence: Synthetic oligonucleotide
  Target: ATXN1; (-) strand; PAM type: NRG; PAM sequence: AGG
aggccggtcccgcagggggc

SEQ ID NO: 95673 - DNA, 20 bp, Artificial Sequence
  Description of Artificial Sequence: Synthetic oligonucleotide
  Target: ATXN1; (-) strand; PAM type: NRG; PAM sequence: CAG
caggccggtcccgcaggggg

SEQ ID NO: 95674 - DNA, 20 bp, Artificial Sequence
  Description of Artificial Sequence: Synthetic oligonucleotide
  Target: ATXN1; (-) strand; PAM type: NRG; PAM sequence: GGG
gcgcaggccggtcccgcagg

SEQ ID NO: 95675 - DNA, 20 bp, Artificial Sequence
  Description of Artificial Sequence: Synthetic oligonucleotide
  Target: ATXN1; (-) strand; PAM type: NRG; PAM sequence: GGG
cgcgcaggccggtcccgcag

SEQ ID NO: 95676 - DNA, 20 bp, Artificial Sequence
  Description of Artificial Sequence: Synthetic oligonucleotide
  Target: ATXN1; (-) strand; PAM type: NRG; PAM sequence: GGG
gcgcgcaggccggtcccgca

SEQ ID NO: 95677 - DNA, 20 bp, Artificial Sequence
  Description of Artificial Sequence: Synthetic oligonucleotide
  Target: ATXN1; (-) strand; PAM type: NRG; PAM sequence: AGG
tgcgcgcaggccggtcccgc

SEQ ID NO: 95678 - DNA, 20 bp, Artificial Sequence
  Description of Artificial Sequence: Synthetic oligonucleotide
  Target: ATXN1; (-) strand; PAM type: NRG; PAM sequence: CAG
ctgcgcgcaggccggtcccg

SEQ ID NO: 95679 - DNA, 20 bp, Artificial Sequence
  Description of Artificial Sequence: Synthetic oligonucleotide
  Target: ATXN1; (-) strand; PAM type: NRG; PAM sequence: CGG
ttccagtgctgcgcgcaggc

SEQ ID NO: 95680 - DNA, 20 bp, Artificial Sequence
  Description of Artificial Sequence: Synthetic oligonucleotide
  Target: ATXN1; (-) strand; PAM type: NRG; PAM sequence: AGG
gtggttccagtgctgcgcgc

SEQ ID NO: 95681 - DNA, 20 bp, Artificial Sequence
  Description of Artificial Sequence: Synthetic oligonucleotide
  Target: ATXN1; (-) strand; PAM type: NRG; PAM sequence: CAG
cgtggttccagtgctgcgcg

SEQ ID NO: 95682 - DNA, 20 bp, Artificial Sequence
  Description of Artificial Sequence: Synthetic oligonucleotide
  Target: ATXN1; (-) strand; PAM type: NRG; PAM sequence: CAG
cgcctcctcctacgtggttc

SEQ ID NO: 95683 - DNA, 20 bp, Artificial Sequence
  Description of Artificial Sequence: Synthetic oligonucleotide
  Target: ATXN1; (-) strand; PAM type: NRG; PAM sequence: TGG
cgccgccgcctcctcctacg

SEQ ID NO: 95684 - DNA, 20 bp, Artificial Sequence
  Description of Artificial Sequence: Synthetic oligonucleotide
  Target: ATXN1; (-) strand; PAM type: NRG; PAM sequence: GGG
ggagactctgccactcccgg

SEQ ID NO: 95685 - DNA, 20 bp, Artificial Sequence
  Description of Artificial Sequence: Synthetic oligonucleotide
  Target: ATXN1; (-) strand; PAM type: NRG; PAM sequence: GGG
cggagactctgccactcccg

SEQ ID NO: 95686 - DNA, 20 bp, Artificial Sequence
  Description of Artificial Sequence: Synthetic oligonucleotide
  Target: ATXN1; (-) strand; PAM type: NRG; PAM sequence: GGG
ccggagactctgccactccc

SEQ ID NO: 95687 - DNA, 20 bp, Artificial Sequence
  Description of Artificial Sequence: Synthetic oligonucleotide
  Target: ATXN1; (-) strand; PAM type: NRG; PAM sequence: CGG
gccggagactctgccactcc

SEQ ID NO: 95688 - DNA, 20 bp, Artificial Sequence
  Description of Artificial Sequence: Synthetic oligonucleotide
  Target: ATXN1; (-) strand; PAM type: NRG; PAM sequence: GAG
gttcactctgggccgggccg

SEQ ID NO: 95689 - DNA, 20 bp, Artificial Sequence
  Description of Artificial Sequence: Synthetic oligonucleotide
  Target: ATXN1; (-) strand; PAM type: NRG; PAM sequence: CGG
tcgttcactctgggccgggc

SEQ ID NO: 95690 - DNA, 20 bp, Artificial Sequence
  Description of Artificial Sequence: Synthetic oligonucleotide
  Target: ATXN1; (-) strand; PAM type: NRG; PAM sequence: GGG
ctgctcgttcactctgggcc

SEQ ID NO: 95691 - DNA, 20 bp, Artificial Sequence
  Description of Artificial Sequence: Synthetic oligonucleotide
  Target: ATXN1; (-) strand; PAM type: NRG; PAM sequence: CGG
actgctcgttcactctgggc

SEQ ID NO: 95692 - DNA, 20 bp, Artificial Sequence
  Description of Artificial Sequence: Synthetic oligonucleotide
  Target: ATXN1; (-) strand; PAM type: NRG; PAM sequence: GGG
ccccactgctcgttcactct

SEQ ID NO: 95693 - DNA, 20 bp, Artificial Sequence
  Description of Artificial Sequence: Synthetic oligonucleotide
  Target: ATXN1; (-) strand; PAM type: NRG; PAM sequence: TGG
gccccactgctcgttcactc

SEQ ID NO: 95694 - DNA, 20 bp, Artificial Sequence
  Description of Artificial Sequence: Synthetic oligonucleotide
  Target: ATXN1; (-) strand; PAM type: NRG; PAM sequence: GAG
ggggattgggatgcgccctg

SEQ ID NO: 95695 - DNA, 20 bp, Artificial Sequence
  Description of Artificial Sequence: Synthetic oligonucleotide
  Target: ATXN1; (-) strand; PAM type: NRG; PAM sequence: TGG
gcggggattgggatgcgccc

SEQ ID NO: 95696 - DNA, 20 bp, Artificial Sequence
  Description of Artificial Sequence: Synthetic oligonucleotide
  Target: ATXN1; (-) strand; PAM type: NRG; PAM sequence: GGG
gaggaggcgctgcggggatt

SEQ ID NO: 95697 - DNA, 20 bp, Artificial Sequence
  Description of Artificial Sequence: Synthetic oligonucleotide
  Target: ATXN1; (-) strand; PAM type: NRG; PAM sequence: TGG
ggaggaggcgctgcggggat

SEQ ID NO: 95698 - DNA, 20 bp, Artificial Sequence
  Description of Artificial Sequence: Synthetic oligonucleotide
  Target: ATXN1; (-) strand; PAM type: NRG; PAM sequence: GGG
gccgcggaggaggcgctgcg

SEQ ID NO: 95699 - DNA, 20 bp, Artificial Sequence
  Description of Artificial Sequence: Synthetic oligonucleotide
  Target: ATXN1; (-) strand; PAM type: NRG; PAM sequence: GGG
cgccgcggaggaggcgctgc

SEQ ID NO: 95700 - DNA, 20 bp, Artificial Sequence
  Description of Artificial Sequence: Synthetic oligonucleotide
  Target: ATXN1; (-) strand; PAM type: NRG; PAM sequence: CGG
ccgccgcggaggaggcgctg

SEQ ID NO: 95701 - DNA, 20 bp, Artificial Sequence
  Description of Artificial Sequence: Synthetic oligonucleotide
  Target: ATXN1; (-) strand; PAM type: NRG; PAM sequence: AGG
ggcggcggccgccgcggagg

SEQ ID NO: 95702 - DNA, 20 bp, Artificial Sequence
  Description of Artificial Sequence: Synthetic oligonucleotide
  Target: ATXN1; (-) strand; PAM type: NRG; PAM sequence: GAG
aggcggcggccgccgcggag

SEQ ID NO: 95703 - DNA, 20 bp, Artificial Sequence
  Description of Artificial Sequence: Synthetic oligonucleotide
  Target: ATXN1; (-) strand; PAM type: NRG; PAM sequence: AGG
ggaggcggcggccgccgcgg

SEQ ID NO: 95704 - DNA, 20 bp, Artificial Sequence
  Description of Artificial Sequence: Synthetic oligonucleotide
  Target: ATXN1; (-) strand; PAM type: NRG; PAM sequence: GAG
aggaggcggcggccgccgcg

SEQ ID NO: 95705 - DNA, 20 bp, Artificial Sequence
  Description of Artificial Sequence: Synthetic oligonucleotide
  Target: ATXN1; (-) strand; PAM type: NRG; PAM sequence: CGG
ggaggaggcggcggccgccg

SEQ ID NO: 95706 - DNA, 20 bp, Artificial Sequence
  Description of Artificial Sequence: Synthetic oligonucleotide
  Target: ATXN1; (-) strand; PAM type: NRG; PAM sequence: CGG
ggggaaggaggaggaggcgg

SEQ ID NO: 95707 - DNA, 20 bp, Artificial Sequence
  Description of Artificial Sequence: Synthetic oligonucleotide
  Target: ATXN1; (-) strand; PAM type: NRG; PAM sequence: CGG
ggaggggaaggaggaggagg

SEQ ID NO: 95708 - DNA, 20 bp, Artificial Sequence
  Description of Artificial Sequence: Synthetic oligonucleotide
  Target: ATXN1; (-) strand; PAM type: NRG; PAM sequence: AGG
ggaggaggggaaggaggagg

SEQ ID NO: 95709 - DNA, 20 bp, Artificial Sequence
  Description of Artificial Sequence: Synthetic oligonucleotide
  Target: ATXN1; (-) strand; PAM type: NRG; PAM sequence: GAG
aggaggaggggaaggaggag

SEQ ID NO: 95710 - DNA, 20 bp, Artificial Sequence
  Description of Artificial Sequence: Synthetic oligonucleotide
  Target: ATXN1; (-) strand; PAM type: NRG; PAM sequence: AGG
ccaggaggaggggaaggagg

SEQ ID NO: 95711 - DNA, 20 bp, Artificial Sequence
  Description of Artificial Sequence: Synthetic oligonucleotide
  Target: ATXN1; (-) strand; PAM type: NRG; PAM sequence: GAG
gccaggaggaggggaaggag

SEQ ID NO: 95712 - DNA, 20 bp, Artificial Sequence
  Description of Artificial Sequence: Synthetic oligonucleotide
  Target: ATXN1; (-) strand; PAM type: NRG; PAM sequence: AGG
aagccaggaggaggggaagg

SEQ ID NO: 95713 - DNA, 20 bp, Artificial Sequence
  Description of Artificial Sequence: Synthetic oligonucleotide
  Target: ATXN1; (-) strand; PAM type: NRG; PAM sequence: GAG
gaagccaggaggaggggaag

SEQ ID NO: 95714 - DNA, 20 bp, Artificial Sequence
  Description of Artificial Sequence: Synthetic oligonucleotide
  Target: ATXN1; (-) strand; PAM type: NRG; PAM sequence: AGG
atgaagccaggaggagggga

SEQ ID NO: 95715 - DNA, 20 bp, Artificial Sequence
  Description of Artificial Sequence: Synthetic oligonucleotide
  Target: ATXN1; (-) strand; PAM type: NRG; PAM sequence: AAG
aatgaagccaggaggagggg

SEQ ID NO: 95716 - DNA, 20 bp, Artificial Sequence
  Description of Artificial Sequence: Synthetic oligonucleotide
  Target: ATXN1; (-) strand; PAM type: NRG; PAM sequence: GGG
gtgaatgaagccaggaggag

SEQ ID NO: 95717 - DNA, 20 bp, Artificial Sequence
  Description of Artificial Sequence: Synthetic oligonucleotide
  Target: ATXN1; (-) strand; PAM type: NRG; PAM sequence: GGG
ggtgaatgaagccaggagga

SEQ ID NO: 95718 - DNA, 20 bp, Artificial Sequence
  Description of Artificial Sequence: Synthetic oligonucleotide
  Target: ATXN1; (-) strand; PAM type: NRG; PAM sequence: AGG
gggtgaatgaagccaggagg

SEQ ID NO: 95719 - DNA, 20 bp, Artificial Sequence
  Description of Artificial Sequence: Synthetic oligonucleotide
  Target: ATXN1; (-) strand; PAM type: NRG; PAM sequence: GAG
agggtgaatgaagccaggag

SEQ ID NO: 95720 - DNA, 20 bp, Artificial Sequence
  Description of Artificial Sequence: Synthetic oligonucleotide
  Target: ATXN1; (-) strand; PAM type: NRG; PAM sequence: AGG
ggagggtgaatgaagccagg

SEQ ID NO: 95721 - DNA, 20 bp, Artificial Sequence
  Description of Artificial Sequence: Synthetic oligonucleotide
  Target: ATXN1; (-) strand; PAM type: NRG; PAM sequence: GAG
gggagggtgaatgaagccag

SEQ ID NO: 95722 - DNA, 20 bp, Artificial Sequence
  Description of Artificial Sequence: Synthetic oligonucleotide
  Target: ATXN1; (-) strand; PAM type: NRG; PAM sequence: AGG
ctgggagggtgaatgaagcc

SEQ ID NO: 95723 - DNA, 20 bp, Artificial Sequence
  Description of Artificial Sequence: Synthetic oligonucleotide
  Target: ATXN1; (-) strand; PAM type: NRG; PAM sequence: CAG
gctgggagggtgaatgaagc

SEQ ID NO: 95724 - DNA, 20 bp, Artificial Sequence
  Description of Artificial Sequence: Synthetic oligonucleotide
  Target: ATXN1; (-) strand; PAM type: NRG; PAM sequence: AAG
ggctgctgggagggtgaatg

SEQ ID NO: 95725 - DNA, 20 bp, Artificial Sequence
  Description of Artificial Sequence: Synthetic oligonucleotide
  Target: ATXN1; (-) strand; PAM type: NRG; PAM sequence: GGG
cggctgcgcggctgctggga

SEQ ID NO: 95726 - DNA, 20 bp, Artificial Sequence
  Description of Artificial Sequence: Synthetic oligonucleotide
  Target: ATXN1; (-) strand; PAM type: NRG; PAM sequence: AGG
acggctgcgcggctgctggg

SEQ ID NO: 95727 - DNA, 20 bp, Artificial Sequence
  Description of Artificial Sequence: Synthetic oligonucleotide
  Target: ATXN1; (-) strand; PAM type: NRG; PAM sequence: GAG
aacggctgcgcggctgctgg

SEQ ID NO: 95728 - DNA, 20 bp, Artificial Sequence
  Description of Artificial Sequence: Synthetic oligonucleotide
  Target: ATXN1; (-) strand; PAM type: NRG; PAM sequence: GGG
tgaacggctgcgcggctgct

SEQ ID NO: 95729 - DNA, 20 bp, Artificial Sequence
  Description of Artificial Sequence: Synthetic oligonucleotide
  Target: ATXN1; (-) strand; PAM type: NRG; PAM sequence: TGG
gtgaacggctgcgcggctgc

SEQ ID NO: 95730 - DNA, 20 bp, Artificial Sequence
  Description of Artificial Sequence: Synthetic oligonucleotide
  Target: ATXN1; (-) strand; PAM type: NRG; PAM sequence: CGG
gccgggagtgaacggctgcg

SEQ ID NO: 95731 - DNA, 20 bp, Artificial Sequence
  Description of Artificial Sequence: Synthetic oligonucleotide
  Target: ATXN1; (-) strand; PAM type: NRG; PAM sequence: CGG
tgccctgagccgggagtgaa

SEQ ID NO: 95732 - DNA, 20 bp, Artificial Sequence
  Description of Artificial Sequence: Synthetic oligonucleotide
  Target: ATXN1; (-) strand; PAM type: NRG; PAM sequence: GAG
caggcgctgccctgagccgg

SEQ ID NO: 95733 - DNA, 20 bp, Artificial Sequence
  Description of Artificial Sequence: Synthetic oligonucleotide
  Target: ATXN1; (-) strand; PAM type: NRG; PAM sequence: GGG
ggcaggcgctgccctgagcc

SEQ ID NO: 95734 - DNA, 20 bp, Artificial Sequence
  Description of Artificial Sequence: Synthetic oligonucleotide
  Target: ATXN1; (-) strand; PAM type: NRG; PAM sequence: CGG
cggcaggcgctgccctgagc

SEQ ID NO: 95735 - DNA, 20 bp, Artificial Sequence
  Description of Artificial Sequence: Synthetic oligonucleotide
  Target: ATXN1; (-) strand; PAM type: NRG; PAM sequence: GAG
gccgcggcaggcgctgccct

SEQ ID NO: 95736 - DNA, 20 bp, Artificial Sequence
  Description of Artificial Sequence: Synthetic oligonucleotide
  Target: ATXN1; (-) strand; PAM type: NRG; PAM sequence: AGG
aggagacgaggagccgcggc

SEQ ID NO: 95737 - DNA, 20 bp, Artificial Sequence
  Description of Artificial Sequence: Synthetic oligonucleotide
  Target: ATXN1; (-) strand; PAM type: NRG; PAM sequence: CAG
caggagacgaggagccgcgg

SEQ ID NO: 95738 - DNA, 20 bp, Artificial Sequence
  Description of Artificial Sequence: Synthetic oligonucleotide
  Target: ATXN1; (-) strand; PAM type: NRG; PAM sequence: CGG
cggcaggagacgaggagccg

SEQ ID NO: 95739 - DNA, 20 bp, Artificial Sequence
  Description of Artificial Sequence: Synthetic oligonucleotide
  Target: ATXN1; (-) strand; PAM type: NRG; PAM sequence: GAG
cacccgcggcaggagacgag

SEQ ID NO: 95740 - DNA, 20 bp, Artificial Sequence
  Description of Artificial Sequence: Synthetic oligonucleotide
  Target: ATXN1; (-) strand; PAM type: NRG; PAM sequence: AGG
agcacccgcggcaggagacg

SEQ ID NO: 95741 - DNA, 20 bp, Artificial Sequence
  Description of Artificial Sequence: Synthetic oligonucleotide
  Target: ATXN1; (-) strand; PAM type: NRG; PAM sequence: GAG
cagcacccgcggcaggagac

SEQ ID NO: 95742 - DNA, 20 bp, Artificial Sequence
  Description of Artificial Sequence: Synthetic oligonucleotide
  Target: ATXN1; (-) strand; PAM type: NRG; PAM sequence: GAG
cccgccagcacccgcggcag

SEQ ID NO: 95743 - DNA, 20 bp, Artificial Sequence
  Description of Artificial Sequence: Synthetic oligonucleotide
  Target: ATXN1; (-) strand; PAM type: NRG; PAM sequence: AGG
cccccgccagcacccgcggc

SEQ ID NO: 95744 - DNA, 20 bp, Artificial Sequence
  Description of Artificial Sequence: Synthetic oligonucleotide
  Target: ATXN1; (-) strand; PAM type: NRG; PAM sequence: CAG
gcccccgccagcacccgcgg

SEQ ID NO: 95745 - DNA, 20 bp, Artificial Sequence
  Description of Artificial Sequence: Synthetic oligonucleotide
  Target: ATXN1; (-) strand; PAM type: NRG; PAM sequence: CGG
ggcgcccccgccagcacccg

SEQ ID NO: 95746 - DNA, 20 bp, Artificial Sequence
  Description of Artificial Sequence: Synthetic oligonucleotide
  Target: ATXN1; (-) strand; PAM type: NRG; PAM sequence: CAG
gtccgggccggcgcccccgc

SEQ ID NO: 95747 - DNA, 20 bp, Artificial Sequence
  Description of Artificial Sequence: Synthetic oligonucleotide
  Target: ATXN1; (-) strand; PAM type: NRG; PAM sequence: CGG
gcgagcgccccagtccgggc

SEQ ID NO: 95748 - DNA, 20 bp, Artificial Sequence
  Description of Artificial Sequence: Synthetic oligonucleotide
  Target: ATXN1; (-) strand; PAM type: NRG; PAM sequence: GGG
gcccgcgagcgccccagtcc

SEQ ID NO: 95749 - DNA, 20 bp, Artificial Sequence
  Description of Artificial Sequence: Synthetic oligonucleotide
  Target: ATXN1; (-) strand; PAM type: NRG; PAM sequence: CGG
agcccgcgagcgccccagtc

SEQ ID NO: 95750 - DNA, 20 bp, Artificial Sequence
  Description of Artificial Sequence: Synthetic oligonucleotide
  Target: ATXN1; (-) strand; PAM type: NRG; PAM sequence: CAG
ccgggagcccgcgagcgccc

SEQ ID NO: 95751 - DNA, 20 bp, Artificial Sequence
  Description of Artificial Sequence: Synthetic oligonucleotide
  Target: ATXN1; (-) strand; PAM type: NRG; PAM sequence: GAG
gcccggagccgggagcccgc

SEQ ID NO: 95752 - DNA, 20 bp, Artificial Sequence
  Description of Artificial Sequence: Synthetic oligonucleotide
  Target: ATXN1; (-) strand; PAM type: NRG; PAM sequence: GAG
cagccgccgcccggagccgg

SEQ ID NO: 95753 - DNA, 20 bp, Artificial Sequence
  Description of Artificial Sequence: Synthetic oligonucleotide
  Target: ATXN1; (-) strand; PAM type: NRG; PAM sequence: GGG
ggcagccgccgcccggagcc

SEQ ID NO: 95754 - DNA, 20 bp, Artificial Sequence
  Description of Artificial Sequence: Synthetic oligonucleotide
  Target: ATXN1; (-) strand; PAM type: NRG; PAM sequence: CGG
cggcagccgccgcccggagc

SEQ ID NO: 95755 - DNA, 20 bp, Artificial Sequence
  Description of Artificial Sequence: Synthetic oligonucleotide
  Target: ATXN1; (-) strand; PAM type: NRG; PAM sequence: GAG
gcagcggcagccgccgcccg

SEQ ID NO: 95756 - DNA, 20 bp, Artificial Sequence
  Description of Artificial Sequence: Synthetic oligonucleotide
  Target: ATXN1; (-) strand; PAM type: NRG; PAM sequence: CGG
gtgcagcggcagccgccgcc

SEQ ID NO: 95757 - DNA, 20 bp, Artificial Sequence
  Description of Artificial Sequence: Synthetic oligonucleotide
  Target: ATXN1; (-) strand; PAM type: NRG; PAM sequence: CAG
ttcctgatcatgtgcagcgg

SEQ ID NO: 95758 - DNA, 20 bp, Artificial Sequence
  Description of Artificial Sequence: Synthetic oligonucleotide
  Target: ATXN1; (-) strand; PAM type: NRG; PAM sequence: CGG
cgcttcctgatcatgtgcag

SEQ ID NO: 95759 - DNA, 20 bp, Artificial Sequence
  Description of Artificial Sequence: Synthetic oligonucleotide
  Target: ATXN1; (-) strand; PAM type: NRG; PAM sequence: CAG
ggccgcttcctgatcatgtg

SEQ ID NO: 95760 - DNA, 20 bp, Artificial Sequence
  Description of Artificial Sequence: Synthetic oligonucleotide
  Target: ATXN1; (-) strand; PAM type: NRG; PAM sequence: CGG
ccaccgccgccctgttggtg

SEQ ID NO: 95761 - DNA, 20 bp, Artificial Sequence
  Description of Artificial Sequence: Synthetic oligonucleotide
  Target: ATXN1; (-) strand; PAM type: NRG; PAM sequence: TGG
cgccgccaccgccgccctgt

SEQ ID NO: 95762 - DNA, 20 bp, Artificial Sequence
  Description of Artificial Sequence: Synthetic oligonucleotide
  Target: ATXN1; (-) strand; PAM type: NRG; PAM sequence: TGG
tggagtggcggtgacggccc

SEQ ID NO: 95763 - DNA, 20 bp, Artificial Sequence
  Description of Artificial Sequence: Synthetic oligonucleotide
  Target: ATXN1; (-) strand; PAM type: NRG; PAM sequence: CGG
cgcggctggagtggcggtga

SEQ ID NO: 95764 - DNA, 20 bp, Artificial Sequence
  Description of Artificial Sequence: Synthetic oligonucleotide
  Target: ATXN1; (-) strand; PAM type: NRG; PAM sequence: CGG
ctggagcgcggctggagtgg

SEQ ID NO: 95765 - DNA, 20 bp, Artificial Sequence
  Description of Artificial Sequence: Synthetic oligonucleotide
  Target: ATXN1; (-) strand; PAM type: NRG; PAM sequence: TGG
tgcctggagcgcggctggag

SEQ ID NO: 95766 - DNA, 20 bp, Artificial Sequence
  Description of Artificial Sequence: Synthetic oligonucleotide
  Target: ATXN1; (-) strand; PAM type: NRG; PAM sequence: GAG
gggtgcctggagcgcggctg

SEQ ID NO: 95767 - DNA, 20 bp, Artificial Sequence
  Description of Artificial Sequence: Synthetic oligonucleotide
  Target: ATXN1; (-) strand; PAM type: NRG; PAM sequence: TGG
gcgggtgcctggagcgcggc

SEQ ID NO: 95768 - DNA, 20 bp, Artificial Sequence
  Description of Artificial Sequence: Synthetic oligonucleotide
  Target: ATXN1; (-) strand; PAM type: NRG; PAM sequence: CGG
gtgtgcgggtgcctggagcg

SEQ ID NO: 95769 - DNA, 20 bp, Artificial Sequence
  Description of Artificial Sequence: Synthetic oligonucleotide
  Target: ATXN1; (-) strand; PAM type: NRG; PAM sequence: GAG
agcgggtgtgcgggtgcctg

SEQ ID NO: 95770 - DNA, 20 bp, Artificial Sequence
  Description of Artificial Sequence: Synthetic oligonucleotide
  Target: ATXN1; (-) strand; PAM type: NRG; PAM sequence: TGG
gtagcgggtgtgcgggtgcc

SEQ ID NO: 95771 - DNA, 20 bp, Artificial Sequence
  Description of Artificial Sequence: Synthetic oligonucleotide
  Target: ATXN1; (-) strand; PAM type: NRG; PAM sequence: GGG
cgcgggggtagcgggtgtgc

SEQ ID NO: 95772 - DNA, 20 bp, Artificial Sequence
  Description of Artificial Sequence: Synthetic oligonucleotide
  Target: ATXN1; (-) strand; PAM type: NRG; PAM sequence: CGG
gcgcgggggtagcgggtgtg

SEQ ID NO: 95773 - DNA, 20 bp, Artificial Sequence
  Description of Artificial Sequence: Synthetic oligonucleotide
  Target: ATXN1; (-) strand; PAM type: NRG; PAM sequence: GGG
ggggaccgcgcgggggtagc

SEQ ID NO: 95774 - DNA, 20 bp, Artificial Sequence
  Description of Artificial Sequence: Synthetic oligonucleotide
  Target: ATXN1; (-) strand; PAM type: NRG; PAM sequence: CGG
cggggaccgcgcgggggtag

SEQ ID NO: 95775 - DNA, 20 bp, Artificial Sequence
  Description of Artificial Sequence: Synthetic oligonucleotide
  Target: ATXN1; (-) strand; PAM type: NRG; PAM sequence: TAG
cctcggggaccgcgcggggg

SEQ ID NO: 95776 - DNA, 20 bp, Artificial Sequence
  Description of Artificial Sequence: Synthetic oligonucleotide
  Target: ATXN1; (-) strand; PAM type: NRG; PAM sequence: GGG
tggcctcggggaccgcgcgg

SEQ ID NO: 95777 - DNA, 20 bp, Artificial Sequence
  Description of Artificial Sequence: Synthetic oligonucleotide
  Target: ATXN1; (-) strand; PAM type: NRG; PAM sequence: GGG
gtggcctcggggaccgcgcg

SEQ ID NO: 95778 - DNA, 20 bp, Artificial Sequence
  Description of Artificial Sequence: Synthetic oligonucleotide
  Target: ATXN1; (-) strand; PAM type: NRG; PAM sequence: GGG
ggtggcctcggggaccgcgc

SEQ ID NO: 95779 - DNA, 20 bp, Artificial Sequence
  Description of Artificial Sequence: Synthetic oligonucleotide
  Target: ATXN1; (-) strand; PAM type: NRG; PAM sequence: CGG
gggtggcctcggggaccgcg

SEQ ID NO: 95780 - DNA, 20 bp, Artificial Sequence
  Description of Artificial Sequence: Synthetic oligonucleotide
  Target: ATXN1; (-) strand; PAM type: NRG; PAM sequence: GGG
ggcgcagaggggtggcctcg

SEQ ID NO: 95781 - DNA, 20 bp, Artificial Sequence
  Description of Artificial Sequence: Synthetic oligonucleotide
  Target: ATXN1; (-) strand; PAM type: NRG; PAM sequence: GGG
gggcgcagaggggtggcctc

SEQ ID NO: 95782 - DNA, 20 bp, Artificial Sequence
  Description of Artificial Sequence: Synthetic oligonucleotide
  Target: ATXN1; (-) strand; PAM type: NRG; PAM sequence: CGG
ggggcgcagaggggtggcct

SEQ ID NO: 95783 - DNA, 20 bp, Artificial Sequence
  Description of Artificial Sequence: Synthetic oligonucleotide
  Target: ATXN1; (-) strand; PAM type: NRG; PAM sequence: TGG
gggcggggggcgcagagggg

SEQ ID NO: 95784 - DNA, 20 bp, Artificial Sequence
  Description of Artificial Sequence: Synthetic oligonucleotide
  Target: ATXN1; (-) strand; PAM type: NRG; PAM sequence: GGG
gccgggcggggggcgcagag

SEQ ID NO: 95785 - DNA, 20 bp, Artificial Sequence
  Description of Artificial Sequence: Synthetic oligonucleotide
  Target: ATXN1; (-) strand; PAM type: NRG; PAM sequence: GGG
tgccgggcggggggcgcaga

SEQ ID NO: 95786 - DNA, 20 bp, Artificial Sequence
  Description of Artificial Sequence: Synthetic oligonucleotide
  Target: ATXN1; (-) strand; PAM type: NRG; PAM sequence: AGG
gtgccgggcggggggcgcag

SEQ ID NO: 95787 - DNA, 20 bp, Artificial Sequence
  Description of Artificial Sequence: Synthetic oligonucleotide
  Target: ATXN1; (-) strand; PAM type: NRG; PAM sequence: GAG
ggtgccgggcggggggcgca

SEQ ID NO: 95788 - DNA, 20 bp, Artificial Sequence
  Description of Artificial Sequence: Synthetic oligonucleotide
  Target: ATXN1; (-) strand; PAM type: NRG; PAM sequence: CAG
cgggtgccgggcggggggcg

SEQ ID NO: 95789 - DNA, 20 bp, Artificial Sequence
  Description of Artificial Sequence: Synthetic oligonucleotide
  Target: ATXN1; (-) strand; PAM type: NRG; PAM sequence: GGG
gcggccgggtgccgggcggg

SEQ ID NO: 95790 - DNA, 20 bp, Artificial Sequence
  Description of Artificial Sequence: Synthetic oligonucleotide
  Target: ATXN1; (-) strand; PAM type: NRG; PAM sequence: GGG
cgcggccgggtgccgggcgg

SEQ ID NO: 95791 - DNA, 20 bp, Artificial Sequence
  Description of Artificial Sequence: Synthetic oligonucleotide
  Target: ATXN1; (-) strand; PAM type: NRG; PAM sequence: GGG
gcgcggccgggtgccgggcg

SEQ ID NO: 95792 - DNA, 20 bp, Artificial Sequence
  Description of Artificial Sequence: Synthetic oligonucleotide
  Target: ATXN1; (-) strand; PAM type: NRG; PAM sequence: GGG
cgcgcggccgggtgccgggc

SEQ ID NO: 95793 - DNA, 20 bp, Artificial Sequence
  Description of Artificial Sequence: Synthetic oligonucleotide
  Target: ATXN1; (-) strand; PAM type: NRG; PAM sequence: CGG
gcgcgcggccgggtgccggg

SEQ ID NO: 95794 - DNA, 20 bp, Artificial Sequence
  Description of Artificial Sequence: Synthetic oligonucleotide
  Target: ATXN1; (-) strand; PAM type: NRG; PAM sequence: GGG
tttgcgcgcggccgggtgcc

SEQ ID NO: 95795 - DNA, 20 bp, Artificial Sequence
  Description of Artificial Sequence: Synthetic oligonucleotide
  Target: ATXN1; (-) strand; PAM type: NRG; PAM sequence: CGG
ctttgcgcgcggccgggtgc

SEQ ID NO: 95796 - DNA, 20 bp, Artificial Sequence
  Description of Artificial Sequence: Synthetic oligonucleotide
  Target: ATXN1; (-) strand; PAM type: NRG; PAM sequence: GGG
acgggactttgcgcgcggcc

SEQ ID NO: 95797 - DNA, 20 bp, Artificial Sequence
  Description of Artificial Sequence: Synthetic oligonucleotide
  Target: ATXN1; (-) strand; PAM type: NRG; PAM sequence: CGG
gacgggactttgcgcgcggc

SEQ ID NO: 95798 - DNA, 20 bp, Artificial Sequence
  Description of Artificial Sequence: Synthetic oligonucleotide
  Target: ATXN1; (-) strand; PAM type: NRG; PAM sequence: CGG
ccgggacgggactttgcgcg

SEQ ID NO: 95799 - DNA, 20 bp, Artificial Sequence
  Description of Artificial Sequence: Synthetic oligonucleotide
  Target: ATXN1; (-) strand; PAM type: NRG; PAM sequence: GGG
actgctcctgcagccgggac

SEQ ID NO: 95800 - DNA, 20 bp, Artificial Sequence
  Description of Artificial Sequence: Synthetic oligonucleotide
  Target: ATXN1; (-) strand; PAM type: NRG; PAM sequence: CGG
gactgctcctgcagccggga

SEQ ID NO: 95801 - DNA, 20 bp, Artificial Sequence
  Description of Artificial Sequence: Synthetic oligonucleotide
  Target: ATXN1; (-) strand; PAM type: NRG; PAM sequence: GGG
aagggactgctcctgcagcc

SEQ ID NO: 95802 - DNA, 20 bp, Artificial Sequence
  Description of Artificial Sequence: Synthetic oligonucleotide
  Target: ATXN1; (-) strand; PAM type: NRG; PAM sequence: CGG
gaagggactgctcctgcagc

SEQ ID NO: 95803 - DNA, 20 bp, Artificial Sequence
  Description of Artificial Sequence: Synthetic oligonucleotide
  Target: ATXN1; (-) strand; PAM type: NRG; PAM sequence: CAG
cggggaagggactgctcctg

SEQ ID NO: 95804 - DNA, 20 bp, Artificial Sequence
  Description of Artificial Sequence: Synthetic oligonucleotide
  Target: ATXN1; (-) strand; PAM type: NRG; PAM sequence: GGG
gtgcggctgcgggcggggaa

SEQ ID NO: 95805 - DNA, 20 bp, Artificial Sequence
  Description of Artificial Sequence: Synthetic oligonucleotide
  Target: ATXN1; (-) strand; PAM type: NRG; PAM sequence: AGG
tgtgcggctgcgggcgggga

SEQ ID NO: 95806 - DNA, 20 bp, Artificial Sequence
  Description of Artificial Sequence: Synthetic oligonucleotide
  Target: ATXN1; (-) strand; PAM type: NRG; PAM sequence: AAG
gtgtgcggctgcgggcgggg

SEQ ID NO: 95807 - DNA, 20 bp, Artificial Sequence
  Description of Artificial Sequence: Synthetic oligonucleotide
  Target: ATXN1; (-) strand; PAM type: NRG; PAM sequence: GGG
cgggtgtgcggctgcgggcg

SEQ ID NO: 95808 - DNA, 20 bp, Artificial Sequence
  Description of Artificial Sequence: Synthetic oligonucleotide
  Target: ATXN1; (-) strand; PAM type: NRG; PAM sequence: GGG
ccgggtgtgcggctgcgggc

SEQ ID NO: 95809 - DNA, 20 bp, Artificial Sequence
  Description of Artificial Sequence: Synthetic oligonucleotide
  Target: ATXN1; (-) strand; PAM type: NRG; PAM sequence: CGG
gccgggtgtgcggctgcggg

SEQ ID NO: 95810 - DNA, 20 bp, Artificial Sequence
  Description of Artificial Sequence: Synthetic oligonucleotide
  Target: ATXN1; (-) strand; PAM type: NRG; PAM sequence: GGG
ctcgccgggtgtgcggctgc

SEQ ID NO: 95811 - DNA, 20 bp, Artificial Sequence
  Description of Artificial Sequence: Synthetic oligonucleotide
  Target: ATXN1; (-) strand; PAM type: NRG; PAM sequence: CGG
cctcgccgggtgtgcggctg

SEQ ID NO: 95812 - DNA, 20 bp, Artificial Sequence
  Description of Artificial Sequence: Synthetic oligonucleotide
  Target: ATXN1; (-) strand; PAM type: NRG; PAM sequence: CGG
ggccggcctcgccgggtgtg

SEQ ID NO: 95813 - DNA, 20 bp, Artificial Sequence
  Description of Artificial Sequence: Synthetic oligonucleotide
  Target: ATXN1; (-) strand; PAM type: NRG; PAM sequence: GGG
ctcggagggccggcctcgcc

SEQ ID NO: 95814 - DNA, 20 bp, Artificial Sequence
  Description of Artificial Sequence: Synthetic oligonucleotide
  Target: ATXN1; (-) strand; PAM type: NRG; PAM sequence: CGG
cctcggagggccggcctcgc

SEQ ID NO: 95815 - DNA, 20 bp, Artificial Sequence
  Description of Artificial Sequence: Synthetic oligonucleotide
  Target: ATXN1; (-) strand; PAM type: NRG; PAM sequence: CGG
ggggtctcccctcggagggc

SEQ ID NO: 95816 - DNA, 20 bp, Artificial Sequence
  Description of Artificial Sequence: Synthetic oligonucleotide
  Target: ATXN1; (-) strand; PAM type: NRG; PAM sequence: GGG
ggcgggggtctcccctcgga

SEQ ID NO: 95817 - DNA, 20 bp, Artificial Sequence
  Description of Artificial Sequence: Synthetic oligonucleotide
  Target: ATXN1; (-) strand; PAM type: NRG; PAM sequence: AGG
gggcgggggtctcccctcgg

SEQ ID NO: 95818 - DNA, 20 bp, Artificial Sequence
  Description of Artificial Sequence: Synthetic oligonucleotide
  Target: ATXN1; (-) strand; PAM type: NRG; PAM sequence: GAG
ggggcgggggtctcccctcg

SEQ ID NO: 95819 - DNA, 20 bp, Artificial Sequence
  Description of Artificial Sequence: Synthetic oligonucleotide
  Target: ATXN1; (-) strand; PAM type: NRG; PAM sequence: CGG
ctggggcgggggtctcccct

SEQ ID NO: 95820 - DNA, 20 bp, Artificial Sequence
  Description of Artificial Sequence: Synthetic oligonucleotide
  Target: ATXN1; (-) strand; PAM type: NRG; PAM sequence: GGG
gcctcggcgccctggggcgg

SEQ ID NO: 95821 - DNA, 20 bp, Artificial Sequence
  Description of Artificial Sequence: Synthetic oligonucleotide
  Target: ATXN1; (-) strand; PAM type: NRG; PAM sequence: GGG
ggcctcggcgccctggggcg

SEQ ID NO: 95822 - DNA, 20 bp, Artificial Sequence
  Description of Artificial Sequence: Synthetic oligonucleotide
  Target: ATXN1; (-) strand; PAM type: NRG; PAM sequence: GGG
cggcctcggcgccctggggc

SEQ ID NO: 95823 - DNA, 20 bp, Artificial Sequence
  Description of Artificial Sequence: Synthetic oligonucleotide
  Target: ATXN1; (-) strand; PAM type: NRG; PAM sequence: CGG
ccggcctcggcgccctgggg

SEQ ID NO: 95824 - DNA, 20 bp, Artificial Sequence
  Description of Artificial Sequence: Synthetic oligonucleotide
  Target: ATXN1; (-) strand; PAM type: NRG; PAM sequence: GGG
cgcccggcctcggcgccctg

SEQ ID NO: 95825 - DNA, 20 bp, Artificial Sequence
  Description of Artificial Sequence: Synthetic oligonucleotide
  Target: ATXN1; (-) strand; PAM type: NRG; PAM sequence: GGG
tcgcccggcctcggcgccct

SEQ ID NO: 95826 - DNA, 20 bp, Artificial Sequence
  Description of Artificial Sequence: Synthetic oligonucleotide
  Target: ATXN1; (-) strand; PAM type: NRG; PAM sequence: TGG
gtcgcccggcctcggcgccc

SEQ ID NO: 95827 - DNA, 20 bp, Artificial Sequence
  Description of Artificial Sequence: Synthetic oligonucleotide
  Target: ATXN1; (-) strand; PAM type: NRG; PAM sequence: CGG
cgcgggtggtcgcccggcct

SEQ ID NO: 95828 - DNA, 20 bp, Artificial Sequence
  Description of Artificial Sequence: Synthetic oligonucleotide
  Target: ATXN1; (-) strand; PAM type: NRG; PAM sequence: CGG
cttctccgcgggtggtcgcc

SEQ ID NO: 95829 - DNA, 20 bp, Artificial Sequence
  Description of Artificial Sequence: Synthetic oligonucleotide
  Target: ATXN1; (-) strand; PAM type: NRG; PAM sequence: TGG
gggctggacttctccgcggg

SEQ ID NO: 95830 - DNA, 20 bp, Artificial Sequence
  Description of Artificial Sequence: Synthetic oligonucleotide
  Target: ATXN1; (-) strand; PAM type: NRG; PAM sequence: GGG
ggagggctggacttctccgc

SEQ ID NO: 95831 - DNA, 20 bp, Artificial Sequence
  Description of Artificial Sequence: Synthetic oligonucleotide
  Target: ATXN1; (-) strand; PAM type: NRG; PAM sequence: CGG
cggagggctggacttctccg

SEQ ID NO: 95832 - DNA, 20 bp, Artificial Sequence
  Description of Artificial Sequence: Synthetic oligonucleotide
  Target: ATXN1; (-) strand; PAM type: NRG; PAM sequence: TGG
gagggggtctcacggagggc

SEQ ID NO: 95833 - DNA, 20 bp, Artificial Sequence
  Description of Artificial Sequence: Synthetic oligonucleotide
  Target: ATXN1; (-) strand; PAM type: NRG; PAM sequence: GGG
gagagagggggtctcacgga

SEQ ID NO: 95834 - DNA, 20 bp, Artificial Sequence
  Description of Artificial Sequence: Synthetic oligonucleotide
  Target: ATXN1; (-) strand; PAM type: NRG; PAM sequence: AGG
agagagagggggtctcacgg

SEQ ID NO: 95835 - DNA, 20 bp, Artificial Sequence
  Description of Artificial Sequence: Synthetic oligonucleotide
  Target: ATXN1; (-) strand; PAM type: NRG; PAM sequence: GAG
gagagagagggggtctcacg

SEQ ID NO: 95836 - DNA, 20 bp, Artificial Sequence
  Description of Artificial Sequence: Synthetic oligonucleotide
  Target: ATXN1; (-) strand; PAM type: NRG; PAM sequence: CGG
gtgagagagagggggtctca

SEQ ID NO: 95837 - DNA, 20 bp, Artificial Sequence
  Description of Artificial Sequence: Synthetic oligonucleotide
  Target: ATXN1; (-) strand; PAM type: NRG; PAM sequence: GGG
agagggcggtgagagagagg

SEQ ID NO: 95838 - DNA, 20 bp, Artificial Sequence
  Description of Artificial Sequence: Synthetic oligonucleotide
  Target: ATXN1; (-) strand; PAM type: NRG; PAM sequence: GGG
gagagggcggtgagagagag

SEQ ID NO: 95839 - DNA, 20 bp, Artificial Sequence
  Description of Artificial Sequence: Synthetic oligonucleotide
  Target: ATXN1; (-) strand; PAM type: NRG; PAM sequence: GGG
ggagagggcggtgagagaga

SEQ ID NO: 95840 - DNA, 20 bp, Artificial Sequence
  Description of Artificial Sequence: Synthetic oligonucleotide
  Target: ATXN1; (-) strand; PAM type: NRG; PAM sequence: AGG
cggagagggcggtgagagag

SEQ ID NO: 95841 - DNA, 20 bp, Artificial Sequence
  Description of Artificial Sequence: Synthetic oligonucleotide
  Target: ATXN1; (-) strand; PAM type: NRG; PAM sequence: GAG
ccggagagggcggtgagaga

SEQ ID NO: 95842 - DNA, 20 bp, Artificial Sequence
  Description of Artificial Sequence: Synthetic oligonucleotide
  Target: ATXN1; (-) strand; PAM type: NRG; PAM sequence: GAG
ccccggagagggcggtgaga

SEQ ID NO: 95843 - DNA, 20 bp, Artificial Sequence
  Description of Artificial Sequence: Synthetic oligonucleotide
  Target: ATXN1; (-) strand; PAM type: NRG; PAM sequence: GAG
ctccccggagagggcggtga

SEQ ID NO: 95844 - DNA, 20 bp, Artificial Sequence
  Description of Artificial Sequence: Synthetic oligonucleotide
  Target: ATXN1; (-) strand; PAM type: NRG; PAM sequence: GAG
tcctccccggagagggcggt

SEQ ID NO: 95845 - DNA, 20 bp, Artificial Sequence
  Description of Artificial Sequence: Synthetic oligonucleotide
  Target: ATXN1; (-) strand; PAM type: NRG; PAM sequence: CGG
ttcctcctccccggagaggg

SEQ ID NO: 95846 - DNA, 20 bp, Artificial Sequence
  Description of Artificial Sequence: Synthetic oligonucleotide
  Target: ATXN1; (-) strand; PAM type: NRG; PAM sequence: GGG
ccattcctcctccccggaga

SEQ ID NO: 95847 - DNA, 20 bp, Artificial Sequence
  Description of Artificial Sequence: Synthetic oligonucleotide
  Target: ATXN1; (-) strand; PAM type: NRG; PAM sequence: AGG
cccattcctcctccccggag

SEQ ID NO: 95848 - DNA, 20 bp, Artificial Sequence
  Description of Artificial Sequence: Synthetic oligonucleotide
  Target: ATXN1; (-) strand; PAM type: NRG; PAM sequence: GAG
tcccattcctcctccccgga

SEQ ID NO: 95849 - DNA, 20 bp, Artificial Sequence
  Description of Artificial Sequence: Synthetic oligonucleotide
  Target: ATXN1; (-) strand; PAM type: NRG; PAM sequence: GAG
cttcccattcctcctccccg

SEQ ID NO: 95850 - DNA, 20 bp, Artificial Sequence
  Description of Artificial Sequence: Synthetic oligonucleotide
  Target: ATXN1; (-) strand; PAM type: NRG; PAM sequence: CGG
ctcttcccattcctcctccc

SEQ ID NO: 95851 - DNA, 20 bp, Artificial Sequence
  Description of Artificial Sequence: Synthetic oligonucleotide
  Target: ATXN1; (-) strand; PAM type: NRG; PAM sequence: CGG
ttggggggtggtccctttcc

SEQ ID NO: 95852 - DNA, 20 bp, Artificial Sequence
  Description of Artificial Sequence: Synthetic oligonucleotide
  Target: ATXN1; (-) strand; PAM type: NRG; PAM sequence: TGG
cggcggctggggttgggggg

SEQ ID NO: 95853 - DNA, 20 bp, Artificial Sequence
  Description of Artificial Sequence: Synthetic oligonucleotide
  Target: ATXN1; (-) strand; PAM type: NRG; PAM sequence: GGG
aggcggcggctggggttggg

SEQ ID NO: 95854 - DNA, 20 bp, Artificial Sequence
  Description of Artificial Sequence: Synthetic oligonucleotide
  Target: ATXN1; (-) strand; PAM type: NRG; PAM sequence: GGG
gaggcggcggctggggttgg

SEQ ID NO: 95855 - DNA, 20 bp, Artificial Sequence
  Description of Artificial Sequence: Synthetic oligonucleotide
  Target: ATXN1; (-) strand; PAM type: NRG; PAM sequence: GGG
ggaggcggcggctggggttg

SEQ ID NO: 95856 - DNA, 20 bp, Artificial Sequence
  Description of Artificial Sequence: Synthetic oligonucleotide
  Target: ATXN1; (-) strand; PAM type: NRG; PAM sequence: GGG
gggaggcggcggctggggtt

SEQ ID NO: 95857 - DNA, 20 bp, Artificial Sequence
  Description of Artificial Sequence: Synthetic oligonucleotide
  Target: ATXN1; (-) strand; PAM type: NRG; PAM sequence: TGG
ggggaggcggcggctggggt

SEQ ID NO: 95858 - DNA, 20 bp, Artificial Sequence
  Description of Artificial Sequence: Synthetic oligonucleotide
  Target: ATXN1; (-) strand; PAM type: NRG; PAM sequence: GGG
caggggggaggcggcggctg

SEQ ID NO: 95859 - DNA, 20 bp, Artificial Sequence
  Description of Artificial Sequence: Synthetic oligonucleotide
  Target: ATXN1; (-) strand; PAM type: NRG; PAM sequence: GGG
gcaggggggaggcggcggct

SEQ ID NO: 95860 - DNA, 20 bp, Artificial Sequence
  Description of Artificial Sequence: Synthetic oligonucleotide
  Target: ATXN1; (-) strand; PAM type: NRG; PAM sequence: TGG
cgcaggggggaggcggcggc

SEQ ID NO: 95861 - DNA, 20 bp, Artificial Sequence
  Description of Artificial Sequence: Synthetic oligonucleotide
  Target: ATXN1; (-) strand; PAM type: NRG; PAM sequence: CGG
gtggcgcaggggggaggcgg

SEQ ID NO: 95862 - DNA, 20 bp, Artificial Sequence
  Description of Artificial Sequence: Synthetic oligonucleotide
  Target: ATXN1; (-) strand; PAM type: NRG; PAM sequence: CGG
cgggtggcgcaggggggagg

SEQ ID NO: 95863 - DNA, 20 bp, Artificial Sequence
  Description of Artificial Sequence: Synthetic oligonucleotide
  Target: ATXN1; (-) strand; PAM type: NRG; PAM sequence: AGG
ctccgggtggcgcagggggg

SEQ ID NO: 95864 - DNA, 20 bp, Artificial Sequence
  Description of Artificial Sequence: Synthetic oligonucleotide
  Target: ATXN1; (-) strand; PAM type: NRG; PAM sequence: GAG
cctccgggtggcgcaggggg

SEQ ID NO: 95865 - DNA, 20 bp, Artificial Sequence
  Description of Artificial Sequence: Synthetic oligonucleotide
  Target: ATXN1; (-) strand; PAM type: NRG; PAM sequence: GGG
tccctccgggtggcgcaggg

SEQ ID NO: 95866 - DNA, 20 bp, Artificial Sequence
  Description of Artificial Sequence: Synthetic oligonucleotide
  Target: ATXN1; (-) strand; PAM type: NRG; PAM sequence: GGG
ctccctccgggtggcgcagg

SEQ ID NO: 95867 - DNA, 20 bp, Artificial Sequence
  Description of Artificial Sequence: Synthetic oligonucleotide
  Target: ATXN1; (-) strand; PAM type: NRG; PAM sequence: GGG
cctccctccgggtggcgcag

SEQ ID NO: 95868 - DNA, 20 bp, Artificial Sequence
  Description of Artificial Sequence: Synthetic oligonucleotide
  Target: ATXN1; (-) strand; PAM type: NRG; PAM sequence: GGG
tcctccctccgggtggcgca

SEQ ID NO: 95869 - DNA, 20 bp, Artificial Sequence
  Description of Artificial Sequence: Synthetic oligonucleotide
  Target: ATXN1; (-) strand; PAM type: NRG; PAM sequence: AGG
ctcctccctccgggtggcgc

SEQ ID NO: 95870 - DNA, 20 bp, Artificial Sequence
  Description of Artificial Sequence: Synthetic oligonucleotide
  Target: ATXN1; (-) strand; PAM type: NRG; PAM sequence: CAG
cctcctccctccgggtggcg

SEQ ID NO: 95871 - DNA, 20 bp, Artificial Sequence
  Description of Artificial Sequence: Synthetic oligonucleotide
  Target: ATXN1; (-) strand; PAM type: NRG; PAM sequence: TGG
catgtcctcctccctccggg

SEQ ID NO: 95872 - DNA, 20 bp, Artificial Sequence
  Description of Artificial Sequence: Synthetic oligonucleotide
  Target: ATXN1; (-) strand; PAM type: NRG; PAM sequence: GGG
agccatgtcctcctccctcc

SEQ ID NO: 95873 - DNA, 20 bp, Artificial Sequence
  Description of Artificial Sequence: Synthetic oligonucleotide
  Target: ATXN1; (-) strand; PAM type: NRG; PAM sequence: CGG
gagccatgtcctcctccctc

SEQ ID NO: 95874 - DNA, 20 bp, Artificial Sequence
  Description of Artificial Sequence: Synthetic oligonucleotide
  Target: ATXN1; (-) strand; PAM type: NRG; PAM sequence: GAG
ggtccggtcgcaagtgcgga

SEQ ID NO: 95875 - DNA, 20 bp, Artificial Sequence
  Description of Artificial Sequence: Synthetic oligonucleotide
  Target: ATXN1; (-) strand; PAM type: NRG; PAM sequence: GAG
ctggtccggtcgcaagtgcg

SEQ ID NO: 95876 - DNA, 20 bp, Artificial Sequence
  Description of Artificial Sequence: Synthetic oligonucleotide
  Target: ATXN1; (-) strand; PAM type: NRG; PAM sequence: CGG
tgctggtccggtcgcaagtg

SEQ ID NO: 95877 - DNA, 20 bp, Artificial Sequence
  Description of Artificial Sequence: Synthetic oligonucleotide
  Target: ATXN1; (-) strand; PAM type: NRG; PAM sequence: AAG
ccggctgctggtccggtcgc

SEQ ID NO: 95878 - DNA, 20 bp, Artificial Sequence
  Description of Artificial Sequence: Synthetic oligonucleotide
  Target: ATXN1; (-) strand; PAM type: NRG; PAM sequence: CGG
cgctcccccggctgctggtc

SEQ ID NO: 95879 - DNA, 20 bp, Artificial Sequence
  Description of Artificial Sequence: Synthetic oligonucleotide
  Target: ATXN1; (-) strand; PAM type: NRG; PAM sequence: TGG
cgccccgctcccccggctgc

SEQ ID NO: 95880 - DNA, 20 bp, Artificial Sequence
  Description of Artificial Sequence: Synthetic oligonucleotide
  Target: ATXN1; (-) strand; PAM type: NRG; PAM sequence: CGG
gcggcggcgccccgctcccc

SEQ ID NO: 95881 - DNA, 20 bp, Artificial Sequence
  Description of Artificial Sequence: Synthetic oligonucleotide
  Target: ATXN1; (-) strand; PAM type: NRG; PAM sequence: CGG
gcgggcggggagagcggcgg

SEQ ID NO: 95882 - DNA, 20 bp, Artificial Sequence
  Description of Artificial Sequence: Synthetic oligonucleotide
  Target: ATXN1; (-) strand; PAM type: NRG; PAM sequence: CGG
ggcgcgggcggggagagcgg

SEQ ID NO: 95883 - DNA, 20 bp, Artificial Sequence
  Description of Artificial Sequence: Synthetic oligonucleotide
  Target: ATXN1; (-) strand; PAM type: NRG; PAM sequence: CGG
gggggcgcgggcggggagag

SEQ ID NO: 95884 - DNA, 20 bp, Artificial Sequence
  Description of Artificial Sequence: Synthetic oligonucleotide
  Target: ATXN1; (-) strand; PAM type: NRG; PAM sequence: GAG
gcggggggcgcgggcgggga

SEQ ID NO: 95885 - DNA, 20 bp, Artificial Sequence
  Description of Artificial Sequence: Synthetic oligonucleotide
  Target: ATXN1; (-) strand; PAM type: NRG; PAM sequence: GAG
gggcggggggcgcgggcggg

SEQ ID NO: 95886 - DNA, 20 bp, Artificial Sequence
  Description of Artificial Sequence: Synthetic oligonucleotide
  Target: ATXN1; (-) strand; PAM type: NRG; PAM sequence: GGG
ccgggcggggggcgcgggcg

SEQ ID NO: 95887 - DNA, 20 bp, Artificial Sequence
  Description of Artificial Sequence: Synthetic oligonucleotide
  Target: ATXN1; (-) strand; PAM type: NRG; PAM sequence: GGG
cccgggcggggggcgcgggc

SEQ ID NO: 95888 - DNA, 20 bp, Artificial Sequence
  Description of Artificial Sequence: Synthetic oligonucleotide
  Target: ATXN1; (-) strand; PAM type: NRG; PAM sequence: CGG
gcccgggcggggggcgcggg

SEQ ID NO: 95889 - DNA, 20 bp, Artificial Sequence
  Description of Artificial Sequence: Synthetic oligonucleotide
  Target: ATXN1; (-) strand; PAM type: NRG; PAM sequence: GGG
cgcgcccgggcggggggcgc

SEQ ID NO: 95890 - DNA, 20 bp, Artificial Sequence
  Description of Artificial Sequence: Synthetic oligonucleotide
  Target: ATXN1; (-) strand; PAM type: NRG; PAM sequence: CGG
gcgcgcccgggcggggggcg

SEQ ID NO: 95891 - DNA, 20 bp, Artificial Sequence
  Description of Artificial Sequence: Synthetic oligonucleotide
  Target: ATXN1; (-) strand; PAM type: NRG; PAM sequence: GGG
agggggcgcgcccgggcggg

SEQ ID NO: 95892 - DNA, 20 bp, Artificial Sequence
  Description of Artificial Sequence: Synthetic oligonucleotide
  Target: ATXN1; (-) strand; PAM type: NRG; PAM sequence: GGG
tagggggcgcgcccgggcgg

SEQ ID NO: 95893 - DNA, 20 bp, Artificial Sequence
  Description of Artificial Sequence: Synthetic oligonucleotide
  Target: ATXN1; (-) strand; PAM type: NRG; PAM sequence: GGG
ctagggggcgcgcccgggcg

SEQ ID NO: 95894 - DNA, 20 bp, Artificial Sequence
  Description of Artificial Sequence: Synthetic oligonucleotide
  Target: ATXN1; (-) strand; PAM type: NRG; PAM sequence: GGG
gctagggggcgcgcccgggc

SEQ ID NO: 95895 - DNA, 20 bp, Artificial Sequence
  Description of Artificial Sequence: Synthetic oligonucleotide
  Target: ATXN1; (-) strand; PAM type: NRG; PAM sequence: CGG
ggctagggggcgcgcccggg

SEQ ID NO: 95896 - DNA, 20 bp, Artificial Sequence
  Description of Artificial Sequence: Synthetic oligonucleotide
  Target: ATXN1; (-) strand; PAM type: NRG; PAM sequence: GGG
ccgggctagggggcgcgccc

SEQ ID NO: 95897 - DNA, 20 bp, Artificial Sequence
  Description of Artificial Sequence: Synthetic oligonucleotide
  Target: ATXN1; (-) strand; PAM type: NRG; PAM sequence: CGG
gccgggctagggggcgcgcc

SEQ ID NO: 95898 - DNA, 20 bp, Artificial Sequence
  Description of Artificial Sequence: Synthetic oligonucleotide
  Target: ATXN1; (-) strand; PAM type: NRG; PAM sequence: GGG
tgggcgcccgccgggctagg

SEQ ID NO: 95899 - DNA, 20 bp, Artificial Sequence
  Description of Artificial Sequence: Synthetic oligonucleotide
  Target: ATXN1; (-) strand; PAM type: NRG; PAM sequence: GGG
gtgggcgcccgccgggctag

SEQ ID NO: 95900 - DNA, 20 bp, Artificial Sequence
  Description of Artificial Sequence: Synthetic oligonucleotide
  Target: ATXN1; (-) strand; PAM type: NRG; PAM sequence: GGG
ggtgggcgcccgccgggcta

SEQ ID NO: 95901 - DNA, 20 bp, Artificial Sequence
  Description of Artificial Sequence: Synthetic oligonucleotide
  Target: ATXN1; (-) strand; PAM type: NRG; PAM sequence: AGG
gggtgggcgcccgccgggct

SEQ ID NO: 95902 - DNA, 20 bp, Artificial Sequence
  Description of Artificial Sequence: Synthetic oligonucleotide
  Target: ATXN1; (-) strand; PAM type: NRG; PAM sequence: TAG
tgggtgggcgcccgccgggc

SEQ ID NO: 95903 - DNA, 20 bp, Artificial Sequence
  Description of Artificial Sequence: Synthetic oligonucleotide
  Target: ATXN1; (-) strand; PAM type: NRG; PAM sequence: GGG
gggctgggtgggcgcccgcc

SEQ ID NO: 95904 - DNA, 20 bp, Artificial Sequence
  Description of Artificial Sequence: Synthetic oligonucleotide
  Target: ATXN1; (-) strand; PAM type: NRG; PAM sequence: CGG
ggggctgggtgggcgcccgc

SEQ ID NO: 95905 - DNA, 20 bp, Artificial Sequence
  Description of Artificial Sequence: Synthetic oligonucleotide
  Target: ATXN1; (-) strand; PAM type: NRG; PAM sequence: GGG
ggggctgtcaggggctgggt

SEQ ID NO: 95906 - DNA, 20 bp, Artificial Sequence
  Description of Artificial Sequence: Synthetic oligonucleotide
  Target: ATXN1; (-) strand; PAM type: NRG; PAM sequence: TGG
gggggctgtcaggggctggg

SEQ ID NO: 95907 - DNA, 20 bp, Artificial Sequence
  Description of Artificial Sequence: Synthetic oligonucleotide
  Target: ATXN1; (-) strand; PAM type: NRG; PAM sequence: GGG
cgggggggctgtcaggggct

SEQ ID NO: 95908 - DNA, 20 bp, Artificial Sequence
  Description of Artificial Sequence: Synthetic oligonucleotide
  Target: ATXN1; (-) strand; PAM type: NRG; PAM sequence: TGG
gcgggggggctgtcaggggc

SEQ ID NO: 95909 - DNA, 20 bp, Artificial Sequence
  Description of Artificial Sequence: Synthetic oligonucleotide
  Target: ATXN1; (-) strand; PAM type: NRG; PAM sequence: GGG
gccggcgggggggctgtcag

SEQ ID NO: 95910 - DNA, 20 bp, Artificial Sequence
  Description of Artificial Sequence: Synthetic oligonucleotide
  Target: ATXN1; (-) strand; PAM type: NRG; PAM sequence: GGG
ggccggcgggggggctgtca

SEQ ID NO: 95911 - DNA, 20 bp, Artificial Sequence
  Description of Artificial Sequence: Synthetic oligonucleotide
  Target: ATXN1; (-) strand; PAM type: NRG; PAM sequence: AGG
cggccggcgggggggctgtc

SEQ ID NO: 95912 - DNA, 20 bp, Artificial Sequence
  Description of Artificial Sequence: Synthetic oligonucleotide
  Target: ATXN1; (-) strand; PAM type: NRG; PAM sequence: CAG
gcggccggcgggggggctgt

SEQ ID NO: 95913 - DNA, 20 bp, Artificial Sequence
  Description of Artificial Sequence: Synthetic oligonucleotide
  Target: ATXN1; (-) strand; PAM type: NRG; PAM sequence: GGG
cgcaggggcggccggcgggg

SEQ ID NO: 95914 - DNA, 20 bp, Artificial Sequence
  Description of Artificial Sequence: Synthetic oligonucleotide
  Target: ATXN1; (-) strand; PAM type: NRG; PAM sequence: GGG
gcgcaggggcggccggcggg

SEQ ID NO: 95915 - DNA, 20 bp, Artificial Sequence
  Description of Artificial Sequence: Synthetic oligonucleotide
  Target: ATXN1; (-) strand; PAM type: NRG; PAM sequence: GGG
ggcgcaggggcggccggcgg

SEQ ID NO: 95916 - DNA, 20 bp, Artificial Sequence
  Description of Artificial Sequence: Synthetic oligonucleotide
  Target: ATXN1; (-) strand; PAM type: NRG; PAM sequence: GGG
gggcgcaggggcggccggcg

SEQ ID NO: 95917 - DNA, 20 bp, Artificial Sequence
  Description of Artificial Sequence: Synthetic oligonucleotide
  Target: ATXN1; (-) strand; PAM type: NRG; PAM sequence: GGG
tgggcgcaggggcggccggc

SEQ ID NO: 95918 - DNA, 20 bp, Artificial Sequence
  Description of Artificial Sequence: Synthetic oligonucleotide
  Target: ATXN1; (-) strand; PAM type: NRG; PAM sequence: CGG
ctgggcgcaggggcggccgg

SEQ ID NO: 95919 - DNA, 20 bp, Artificial Sequence
  Description of Artificial Sequence: Synthetic oligonucleotide
  Target: ATXN1; (-) strand; PAM type: NRG; PAM sequence: CGG
actctgggcgcaggggcggc

SEQ ID NO: 95920 - DNA, 20 bp, Artificial Sequence
  Description of Artificial Sequence: Synthetic oligonucleotide
  Target: ATXN1; (-) strand; PAM type: NRG; PAM sequence: CGG
ccccactctgggcgcagggg

SEQ ID NO: 95921 - DNA, 20 bp, Artificial Sequence
  Description of Artificial Sequence: Synthetic oligonucleotide
  Target: ATXN1; (-) strand; PAM type: NRG; PAM sequence: GGG
cacccccactctgggcgcag

SEQ ID NO: 95922 - DNA, 20 bp, Artificial Sequence
  Description of Artificial Sequence: Synthetic oligonucleotide
  Target: ATXN1; (-) strand; PAM type: NRG; PAM sequence: GGG
acacccccactctgggcgca

SEQ ID NO: 95923 - DNA, 20 bp, Artificial Sequence
  Description of Artificial Sequence: Synthetic oligonucleotide
  Target: ATXN1; (-) strand; PAM type: NRG; PAM sequence: AGG
gacacccccactctgggcgc

SEQ ID NO: 95924 - DNA, 20 bp, Artificial Sequence
  Description of Artificial Sequence: Synthetic oligonucleotide
  Target: ATXN1; (-) strand; PAM type: NRG; PAM sequence: CAG
cgacacccccactctgggcg

SEQ ID NO: 95925 - DNA, 20 bp, Artificial Sequence
  Description of Artificial Sequence: Synthetic oligonucleotide
  Target: ATXN1; (-) strand; PAM type: NRG; PAM sequence: GGG
cgggccgacacccccactct

SEQ ID NO: 95926 - DNA, 20 bp, Artificial Sequence
  Description of Artificial Sequence: Synthetic oligonucleotide
  Target: ATXN1; (-) strand; PAM type: NRG; PAM sequence: TGG
ccgggccgacacccccactc

SEQ ID NO: 95927 - DNA, 20 bp, Artificial Sequence
  Description of Artificial Sequence: Synthetic oligonucleotide
  Target: ATXN1; (-) strand; PAM type: NRG; PAM sequence: GGG
gtccccggctccaggctccc

SEQ ID NO: 95928 - DNA, 20 bp, Artificial Sequence
  Description of Artificial Sequence: Synthetic oligonucleotide
  Target: ATXN1; (-) strand; PAM type: NRG; PAM sequence: CGG
cgtccccggctccaggctcc

SEQ ID NO: 95929 - DNA, 20 bp, Artificial Sequence
  Description of Artificial Sequence: Synthetic oligonucleotide
  Target: ATXN1; (-) strand; PAM type: NRG; PAM sequence: AGG
atacaaccgtccccggctcc

SEQ ID NO: 95930 - DNA, 20 bp, Artificial Sequence
  Description of Artificial Sequence: Synthetic oligonucleotide
  Target: ATXN1; (-) strand; PAM type: NRG; PAM sequence: CAG
catacaaccgtccccggctc

SEQ ID NO: 95931 - DNA, 20 bp, Artificial Sequence
  Description of Artificial Sequence: Synthetic oligonucleotide
  Target: ATXN1; (-) strand; PAM type: NRG; PAM sequence: CGG
tgtgtacatacaaccgtccc

SEQ ID NO: 95932 - DNA, 20 bp, Artificial Sequence
  Description of Artificial Sequence: Synthetic oligonucleotide
  Target: ATXN1; (-) strand; PAM type: NRG; PAM sequence: AGG
aacagctggaagaggagcga

SEQ ID NO: 95933 - DNA, 20 bp, Artificial Sequence
  Description of Artificial Sequence: Synthetic oligonucleotide
  Target: ATXN1; (-) strand; PAM type: NRG; PAM sequence: AAG
aaacagctggaagaggagcg

SEQ ID NO: 95934 - DNA, 20 bp, Artificial Sequence
  Description of Artificial Sequence: Synthetic oligonucleotide
  Target: ATXN1; (-) strand; PAM type: NRG; PAM sequence: GAG
acggaaaacagctggaagag

SEQ ID NO: 95935 - DNA, 20 bp, Artificial Sequence
  Description of Artificial Sequence: Synthetic oligonucleotide
  Target: ATXN1; (-) strand; PAM type: NRG; PAM sequence: AGG
gcacggaaaacagctggaag

SEQ ID NO: 95936 - DNA, 20 bp, Artificial Sequence
  Description of Artificial Sequence: Synthetic oligonucleotide
  Target: ATXN1; (-) strand; PAM type: NRG; PAM sequence: GAG
tgcacggaaaacagctggaa

SEQ ID NO: 95937 - DNA, 20 bp, Artificial Sequence
  Description of Artificial Sequence: Synthetic oligonucleotide
  Target: ATXN1; (-) strand; PAM type: NRG; PAM sequence: AAG
gctgcacggaaaacagctgg

SEQ ID NO: 95938 - DNA, 20 bp, Artificial Sequence
  Description of Artificial Sequence: Synthetic oligonucleotide
  Target: ATXN1; (-) strand; PAM type: NRG; PAM sequence: TGG
tcggctgcacggaaaacagc

SEQ ID NO: 95939 - DNA, 20 bp, Artificial Sequence
  Description of Artificial Sequence: Synthetic oligonucleotide
  Target: ATXN1; (-) strand; PAM type: NRG; PAM sequence: CAG
ccaatcggctgcacggaaaa

SEQ ID NO: 95940 - DNA, 20 bp, Artificial Sequence
  Description of Artificial Sequence: Synthetic oligonucleotide
  Target: ATXN1; (-) strand; PAM type: NRG; PAM sequence: CGG
caaaaccccaatcggctgca

SEQ ID NO: 95941 - DNA, 20 bp, Artificial Sequence
  Description of Artificial Sequence: Synthetic oligonucleotide
  Target: ATXN1; (-) strand; PAM type: NRG; PAM sequence: CGG
aacaaacccaaaaccccaat

SEQ ID NO: 95942 - DNA, 20 bp, Artificial Sequence
  Description of Artificial Sequence: Synthetic oligonucleotide
  Target: ATXN1; (-) strand; PAM type: NRG; PAM sequence: CAG
agaggggcaaaagcaacaac

SEQ ID NO: 95943 - DNA, 20 bp, Artificial Sequence
  Description of Artificial Sequence: Synthetic oligonucleotide
  Target: ATXN1; (-) strand; PAM type: NRG; PAM sequence: AAG
cgatctcccgagaggggcaa

SEQ ID NO: 95944 - DNA, 20 bp, Artificial Sequence
  Description of Artificial Sequence: Synthetic oligonucleotide
  Target: ATXN1; (-) strand; PAM type: NRG; PAM sequence: GGG
ctcccccgatctcccgagag

SEQ ID NO: 95945 - DNA, 20 bp, Artificial Sequence
  Description of Artificial Sequence: Synthetic oligonucleotide
  Target: ATXN1; (-) strand; PAM type: NRG; PAM sequence: GGG
cctcccccgatctcccgaga

SEQ ID NO: 95946 - DNA, 20 bp, Artificial Sequence
  Description of Artificial Sequence: Synthetic oligonucleotide
  Target: ATXN1; (-) strand; PAM type: NRG; PAM sequence: AGG
tcctcccccgatctcccgag

SEQ ID NO: 95947 - DNA, 20 bp, Artificial Sequence
  Description of Artificial Sequence: Synthetic oligonucleotide
  Target: ATXN1; (-) strand; PAM type: NRG; PAM sequence: GAG
ctcctcccccgatctcccga

SEQ ID NO: 95948 - DNA, 20 bp, Artificial Sequence
  Description of Artificial Sequence: Synthetic oligonucleotide
  Target: ATXN1; (-) strand; PAM type: NRG; PAM sequence: GAG
ccctcctcccccgatctccc

SEQ ID NO: 95949 - DNA, 20 bp, Artificial Sequence
  Description of Artificial Sequence: Synthetic oligonucleotide
  Target: ATXN1; (-) strand; PAM type: NRG; PAM sequence: TAG
cattcccttctccccttatt

SEQ ID NO: 95950 - DNA, 20 bp, Artificial Sequence
  Description of Artificial Sequence: Synthetic oligonucleotide
  Target: ATXN1; (-) strand; PAM type: NRG; PAM sequence: AAG
atccatttacactttacagt

SEQ ID NO: 95951 - DNA, 20 bp, Artificial Sequence
  Description of Artificial Sequence: Synthetic oligonucleotide
  Target: ATXN1; (-) strand; PAM type: NRG; PAM sequence: CAG
ccagatccatttacacttta

SEQ ID NO: 95952 - DNA, 20 bp, Artificial Sequence
  Description of Artificial Sequence: Synthetic oligonucleotide
  Target: ATXN1; (-) strand; PAM type: NRG; PAM sequence: CAG
cccccttccccacgcaaccc

SEQ ID NO: 95953 - DNA, 20 bp, Artificial Sequence
  Description of Artificial Sequence: Synthetic oligonucleotide
  Target: ATXN1; (-) strand; PAM type: NRG; PAM sequence: AAG
gccagagcaacagcagccgc

SEQ ID NO: 95954 - DNA, 20 bp, Artificial Sequence
  Description of Artificial Sequence: Synthetic oligonucleotide
  Target: ATXN1; (-) strand; PAM type: NRG; PAM sequence: CAG
agcagcagccagagcaacag

SEQ ID NO: 95955 - DNA, 20 bp, Artificial Sequence
  Description of Artificial Sequence: Synthetic oligonucleotide
  Target: ATXN1; (-) strand; PAM type: NRG; PAM sequence: CAG
tggagcagcagccagagcaa

SEQ ID NO: 95956 - DNA, 20 bp, Artificial Sequence
  Description of Artificial Sequence: Synthetic oligonucleotide
  Target: ATXN1; (-) strand; PAM type: NRG; PAM sequence: GAG
gccccgtggagcagcagcca

SEQ ID NO: 95957 - DNA, 20 bp, Artificial Sequence
  Description of Artificial Sequence: Synthetic oligonucleotide
  Target: ATXN1; (-) strand; PAM type: NRG; PAM sequence: CAG
aagccccgtggagcagcagc

SEQ ID NO: 95958 - DNA, 20 bp, Artificial Sequence
  Description of Artificial Sequence: Synthetic oligonucleotide
  Target: ATXN1; (-) strand; PAM type: NRG; PAM sequence: CAG
aaacaagccccgtggagcag

SEQ ID NO: 95959 - DNA, 20 bp, Artificial Sequence
  Description of Artificial Sequence: Synthetic oligonucleotide
  Target: ATXN1; (-) strand; PAM type: NRG; PAM sequence: CAG
ccaaaacaagccccgtggag

SEQ ID NO: 95960 - DNA, 20 bp, Artificial Sequence
  Description of Artificial Sequence: Synthetic oligonucleotide
  Target: ATXN1; (-) strand; PAM type: NRG; PAM sequence: GAG
gatccaaaacaagccccgtg

SEQ ID NO: 95961 - DNA, 20 bp, Artificial Sequence
  Description of Artificial Sequence: Synthetic oligonucleotide
  Target: ATXN1; (-) strand; PAM type: NRG; PAM sequence: TGG
gggatccaaaacaagccccg

SEQ ID NO: 95962 - DNA, 20 bp, Artificial Sequence
  Description of Artificial Sequence: Synthetic oligonucleotide
  Target: ATXN1; (-) strand; PAM type: NRG; PAM sequence: AAG
actgcagggggatccaaaac

SEQ ID NO: 95963 - DNA, 20 bp, Artificial Sequence
  Description of Artificial Sequence: Synthetic oligonucleotide
  Target: ATXN1; (-) strand; PAM type: NRG; PAM sequence: GGG
aggacctgtttcactgcagg

SEQ ID NO: 95964 - DNA, 20 bp, Artificial Sequence
  Description of Artificial Sequence: Synthetic oligonucleotide
  Target: ATXN1; (-) strand; PAM type: NRG; PAM sequence: GGG
caggacctgtttcactgcag

SEQ ID NO: 95965 - DNA, 20 bp, Artificial Sequence
  Description of Artificial Sequence: Synthetic oligonucleotide
  Target: ATXN1; (-) strand; PAM type: NRG; PAM sequence: GGG
acaggacctgtttcactgca

SEQ ID NO: 95966 - DNA, 20 bp, Artificial Sequence
  Description of Artificial Sequence: Synthetic oligonucleotide
  Target: ATXN1; (-) strand; PAM type: NRG; PAM sequence: AGG
tacaggacctgtttcactgc

SEQ ID NO: 95967 - DNA, 20 bp, Artificial Sequence
  Description of Artificial Sequence: Synthetic oligonucleotide
  Target: ATXN1; (-) strand; PAM type: NRG; PAM sequence: CAG
gtacaggacctgtttcactg

SEQ ID NO: 95968 - DNA, 20 bp, Artificial Sequence
  Description of Artificial Sequence: Synthetic oligonucleotide
  Target: ATXN1; (-) strand; PAM type: NRG; PAM sequence: AGG
ctacagtggcggagccgtac

SEQ ID NO: 95969 - DNA, 20 bp, Artificial Sequence
  Description of Artificial Sequence: Synthetic oligonucleotide
  Target: ATXN1; (-) strand; PAM type: NRG; PAM sequence: CAG
actacagtggcggagccgta

SEQ ID NO: 95970 - DNA, 20 bp, Artificial Sequence
  Description of Artificial Sequence: Synthetic oligonucleotide
  Target: ATXN1; (-) strand; PAM type: NRG; PAM sequence: GAG
tcatttctactacagtggcg

SEQ ID NO: 95971 - DNA, 20 bp, Artificial Sequence
  Description of Artificial Sequence: Synthetic oligonucleotide
  Target: ATXN1; (-) strand; PAM type: NRG; PAM sequence: CGG
catcatttctactacagtgg

SEQ ID NO: 95972 - DNA, 20 bp, Artificial Sequence
  Description of Artificial Sequence: Synthetic oligonucleotide
  Target: ATXN1; (-) strand; PAM type: NRG; PAM sequence: TGG
agacatcatttctactacag

SEQ ID NO: 95973 - DNA, 20 bp, Artificial Sequence
  Description of Artificial Sequence: Synthetic oligonucleotide
  Target: ATXN1; (-) strand; PAM type: NRG; PAM sequence: CAG
cgcagacatcatttctacta

SEQ ID NO: 95974 - DNA, 20 bp, Artificial Sequence
  Description of Artificial Sequence: Synthetic oligonucleotide
  Target: ATXN1; (-) strand; PAM type: NRG; PAM sequence: CAG
ggagagagcagagtataccg

SEQ ID NO: 95975 - DNA, 20 bp, Artificial Sequence
  Description of Artificial Sequence: Synthetic oligonucleotide
  Target: ATXN1; (-) strand; PAM type: NRG; PAM sequence: GAG
aggaggaggaggagagagca

SEQ ID NO: 95976 - DNA, 20 bp, Artificial Sequence
  Description of Artificial Sequence: Synthetic oligonucleotide
  Target: ATXN1; (-) strand; PAM type: NRG; PAM sequence: CAG
ggaggaggaggaggagagag

SEQ ID NO: 95977 - DNA, 20 bp, Artificial Sequence
  Description of Artificial Sequence: Synthetic oligonucleotide
  Target: ATXN1; (-) strand; PAM type: NRG; PAM sequence: GAG
ggaggaggaggaggaggaga

SEQ ID NO: 95978 - DNA, 20 bp, Artificial Sequence
  Description of Artificial Sequence: Synthetic oligonucleotide
  Target: ATXN1; (-) strand; PAM type: NRG; PAM sequence: GAG
gaggaggaggaggaggagga

SEQ ID NO: 95979 - DNA, 20 bp, Artificial Sequence
  Description of Artificial Sequence: Synthetic oligonucleotide
  Target: ATXN1; (-) strand; PAM type: NRG; PAM sequence: GAG
aggaggaggaggaggaggag

SEQ ID NO: 95980 - DNA, 20 bp, Artificial Sequence
  Description of Artificial Sequence: Synthetic oligonucleotide
  Target: ATXN1; (-) strand; PAM type: NRG; PAM sequence: AGG
ggaggaggaggaggaggagg

SEQ ID NO: 95981 - DNA, 20 bp, Artificial Sequence
  Description of Artificial Sequence: Synthetic oligonucleotide
  Target: ATXN1; (-) strand; PAM type: NRG; PAM sequence: GAG
aggaggaggaggaggaggag

SEQ ID NO: 95982 - DNA, 20 bp, Artificial Sequence
  Description of Artificial Sequence: Synthetic oligonucleotide
  Target: ATXN1; (-) strand; PAM type: NRG; PAM sequence: AGG
ggaggaggaggaggaggagg

SEQ ID NO: 95983 - DNA, 20 bp, Artificial Sequence
  Description of Artificial Sequence: Synthetic oligonucleotide
  Target: ATXN1; (-) strand; PAM type: NRG; PAM sequence: GAG
gggaggaggaggaggaggag

SEQ ID NO: 95984 - DNA, 20 bp, Artificial Sequence
  Description of Artificial Sequence: Synthetic oligonucleotide
  Target: ATXN1; (-) strand; PAM type: NRG; PAM sequence: AGG
gggggaggaggaggaggagg

SEQ ID NO: 95985 - DNA, 20 bp, Artificial Sequence
  Description of Artificial Sequence: Synthetic oligonucleotide
  Target: ATXN1; (-) strand; PAM type: NRG; PAM sequence: GAG
agggggaggaggaggaggag

SEQ ID NO: 95986 - DNA, 20 bp, Artificial Sequence
  Description of Artificial Sequence: Synthetic oligonucleotide
  Target: ATXN1; (-) strand; PAM type: NRG; PAM sequence: AGG
ggagggggaggaggaggagg

SEQ ID NO: 95987 - DNA, 20 bp, Artificial Sequence
  Description of Artificial Sequence: Synthetic oligonucleotide
  Target: ATXN1; (-) strand; PAM type: NRG; PAM sequence: GAG
aggagggggaggaggaggag

SEQ ID NO: 95988 - DNA, 20 bp, Artificial Sequence
  Description of Artificial Sequence: Synthetic oligonucleotide
  Target: ATXN1; (-) strand; PAM type: NRG; PAM sequence: AGG
ggaggagggggaggaggagg

SEQ ID NO: 95989 - DNA, 20 bp, Artificial Sequence
  Description of Artificial Sequence: Synthetic oligonucleotide
  Target: ATXN1; (-) strand; PAM type: NRG; PAM sequence: GAG
gggaggagggggaggaggag

SEQ ID NO: 95990 - DNA, 20 bp, Artificial Sequence
  Description of Artificial Sequence: Synthetic oligonucleotide
  Target: ATXN1; (-) strand; PAM type: NRG; PAM sequence: AGG
gcgggaggagggggaggagg

SEQ ID NO: 95991 - DNA, 20 bp, Artificial Sequence
  Description of Artificial Sequence: Synthetic oligonucleotide
  Target: ATXN1; (-) strand; PAM type: NRG; PAM sequence: GAG
agcgggaggagggggaggag

SEQ ID NO: 95992 - DNA, 20 bp, Artificial Sequence
  Description of Artificial Sequence: Synthetic oligonucleotide
  Target: ATXN1; (-) strand; PAM type: NRG; PAM sequence: AGG
ggagcgggaggagggggagg

SEQ ID NO: 95993 - DNA, 20 bp, Artificial Sequence
  Description of Artificial Sequence: Synthetic oligonucleotide
  Target: ATXN1; (-) strand; PAM type: NRG; PAM sequence: GAG
gggagcgggaggagggggag

SEQ ID NO: 95994 - DNA, 20 bp, Artificial Sequence
  Description of Artificial Sequence: Synthetic oligonucleotide
  Target: ATXN1; (-) strand; PAM type: NRG; PAM sequence: AGG
aggggagcgggaggaggggg

SEQ ID NO: 95995 - DNA, 20 bp, Artificial Sequence
  Description of Artificial Sequence: Synthetic oligonucleotide
  Target: ATXN1; (-) strand; PAM type: NRG; PAM sequence: GAG
gaggggagcgggaggagggg

SEQ ID NO: 95996 - DNA, 20 bp, Artificial Sequence
  Description of Artificial Sequence: Synthetic oligonucleotide
  Target: ATXN1; (-) strand; PAM type: NRG; PAM sequence: GGG
gggaggggagcgggaggagg

SEQ ID NO: 95997 - DNA, 20 bp, Artificial Sequence
  Description of Artificial Sequence: Synthetic oligonucleotide
  Target: ATXN1; (-) strand; PAM type: NRG; PAM sequence: GGG
ggggaggggagcgggaggag

SEQ ID NO: 95998 - DNA, 20 bp, Artificial Sequence
  Description of Artificial Sequence: Synthetic oligonucleotide
  Target: ATXN1; (-) strand; PAM type: NRG; PAM sequence: GGG
aggggaggggagcgggagga

SEQ ID NO: 95999 - DNA, 20 bp, Artificial Sequence
  Description of Artificial Sequence: Synthetic oligonucleotide
  Target: ATXN1; (-) strand; PAM type: NRG; PAM sequence: AGG
gaggggaggggagcgggagg

SEQ ID NO: 96000 - DNA, 20 bp, Artificial Sequence
  Description of Artificial Sequence: Synthetic oligonucleotide
  Target: ATXN1; (-) strand; PAM type: NRG; PAM sequence: GAG
ggaggggaggggagcgggag

SEQ ID NO: 96001 - DNA, 20 bp, Artificial Sequence
  Description of Artificial Sequence: Synthetic oligonucleotide
  Target: ATXN1; (-) strand; PAM type: NRG; PAM sequence: AGG
agggaggggaggggagcggg

SEQ ID NO: 96002 - DNA, 20 bp, Artificial Sequence
  Description of Artificial Sequence: Synthetic oligonucleotide
  Target: ATXN1; (-) strand; PAM type: NRG; PAM sequence: GAG
gagggaggggaggggagcgg

SEQ ID NO: 96003 - DNA, 20 bp, Artificial Sequence
  Description of Artificial Sequence: Synthetic oligonucleotide
  Target: ATXN1; (-) strand; PAM type: NRG; PAM sequence: GGG
aggagggaggggaggggagc

SEQ ID NO: 96004 - DNA, 20 bp, Artificial Sequence
  Description of Artificial Sequence: Synthetic oligonucleotide
  Target: ATXN1; (-) strand; PAM type: NRG; PAM sequence: CGG
gaggagggaggggaggggag

SEQ ID NO: 96005 - DNA, 20 bp, Artificial Sequence
  Description of Artificial Sequence: Synthetic oligonucleotide
  Target: ATXN1; (-) strand; PAM type: NRG; PAM sequence: GAG
agggaggagggaggggaggg

SEQ ID NO: 96006 - DNA, 20 bp, Artificial Sequence
  Description of Artificial Sequence: Synthetic oligonucleotide
  Target: ATXN1; (-) strand; PAM type: NRG; PAM sequence: GGG
ggagggaggagggaggggag

SEQ ID NO: 96007 - DNA, 20 bp, Artificial Sequence
  Description of Artificial Sequence: Synthetic oligonucleotide
  Target: ATXN1; (-) strand; PAM type: NRG; PAM sequence: GGG
cggagggaggagggagggga

SEQ ID NO: 96008 - DNA, 20 bp, Artificial Sequence
  Description of Artificial Sequence: Synthetic oligonucleotide
  Target: ATXN1; (-) strand; PAM type: NRG; PAM sequence: AGG
gcggagggaggagggagggg

SEQ ID NO: 96009 - DNA, 20 bp, Artificial Sequence
  Description of Artificial Sequence: Synthetic oligonucleotide
  Target: ATXN1; (-) strand; PAM type: NRG; PAM sequence: GAG
ggcggagggaggagggaggg

SEQ ID NO: 96010 - DNA, 20 bp, Artificial Sequence
  Description of Artificial Sequence: Synthetic oligonucleotide
  Target: ATXN1; (-) strand; PAM type: NRG; PAM sequence: GGG
cgggcggagggaggagggag

SEQ ID NO: 96011 - DNA, 20 bp, Artificial Sequence
  Description of Artificial Sequence: Synthetic oligonucleotide
  Target: ATXN1; (-) strand; PAM type: NRG; PAM sequence: GGG
gcgggcggagggaggaggga

SEQ ID NO: 96012 - DNA, 20 bp, Artificial Sequence
  Description of Artificial Sequence: Synthetic oligonucleotide
  Target: ATXN1; (-) strand; PAM type: NRG; PAM sequence: AGG
ggcgggcggagggaggaggg

SEQ ID NO: 96013 - DNA, 20 bp, Artificial Sequence
  Description of Artificial Sequence: Synthetic oligonucleotide
  Target: ATXN1; (-) strand; PAM type: NRG; PAM sequence: GAG
gggcgggcggagggaggagg

SEQ ID NO: 96014 - DNA, 20 bp, Artificial Sequence
  Description of Artificial Sequence: Synthetic oligonucleotide
  Target: ATXN1; (-) strand; PAM type: NRG; PAM sequence: GGG
gcgggcgggcggagggagga

SEQ ID NO: 96015 - DNA, 20 bp, Artificial Sequence
  Description of Artificial Sequence: Synthetic oligonucleotide
  Target: ATXN1; (-) strand; PAM type: NRG; PAM sequence: AGG
ggcgggcgggcggagggagg

SEQ ID NO: 96016 - DNA, 20 bp, Artificial Sequence
  Description of Artificial Sequence: Synthetic oligonucleotide
  Target: ATXN1; (-) strand; PAM type: NRG; PAM sequence: GAG
gggcgggcgggcggagggag

SEQ ID NO: 96017 - DNA, 20 bp, Artificial Sequence
  Description of Artificial Sequence: Synthetic oligonucleotide
  Target: ATXN1; (-) strand; PAM type: NRG; PAM sequence: AGG
gagggcgggcgggcggaggg

SEQ ID NO: 96018 - DNA, 20 bp, Artificial Sequence
  Description of Artificial Sequence: Synthetic oligonucleotide
  Target: ATXN1; (-) strand; PAM type: NRG; PAM sequence: GAG
ggagggcgggcgggcggagg

SEQ ID NO: 96019 - DNA, 20 bp, Artificial Sequence
  Description of Artificial Sequence: Synthetic oligonucleotide
  Target: ATXN1; (-) strand; PAM type: NRG; PAM sequence: GGG
agggagggcgggcgggcgga

SEQ ID NO: 96020 - DNA, 20 bp, Artificial Sequence
  Description of Artificial Sequence: Synthetic oligonucleotide
  Target: ATXN1; (-) strand; PAM type: NRG; PAM sequence: AGG
gagggagggcgggcgggcgg

SEQ ID NO: 96021 - DNA, 20 bp, Artificial Sequence
  Description of Artificial Sequence: Synthetic oligonucleotide
  Target: ATXN1; (-) strand; PAM type: NRG; PAM sequence: GAG
ggagggagggcgggcgggcg

SEQ ID NO: 96022 - DNA, 20 bp, Artificial Sequence
  Description of Artificial Sequence: Synthetic oligonucleotide
  Target: ATXN1; (-) strand; PAM type: NRG; PAM sequence: CGG
agggagggagggcgggcggg

SEQ ID NO: 96023 - DNA, 20 bp, Artificial Sequence
  Description of Artificial Sequence: Synthetic oligonucleotide
  Target: ATXN1; (-) strand; PAM type: NRG; PAM sequence: GGG
gggagggagggagggcgggc

SEQ ID NO: 96024 - DNA, 20 bp, Artificial Sequence
  Description of Artificial Sequence: Synthetic oligonucleotide
  Target: ATXN1; (-) strand; PAM type: NRG; PAM sequence: CGG
agggagggagggagggcggg

SEQ ID NO: 96025 - DNA, 20 bp, Artificial Sequence
  Description of Artificial Sequence: Synthetic oligonucleotide
  Target: ATXN1; (-) strand; PAM type: NRG; PAM sequence: GGG
gcgagggagggagggagggc

SEQ ID NO: 96026 - DNA, 20 bp, Artificial Sequence
  Description of Artificial Sequence: Synthetic oligonucleotide
  Target: ATXN1; (-) strand; PAM type: NRG; PAM sequence: CGG
cgcgagggagggagggaggg

SEQ ID NO: 96027 - DNA, 20 bp, Artificial Sequence
  Description of Artificial Sequence: Synthetic oligonucleotide
  Target: ATXN1; (-) strand; PAM type: NRG; PAM sequence: GGG
gagcgcgagggagggaggga

SEQ ID NO: 96028 - DNA, 20 bp, Artificial Sequence
  Description of Artificial Sequence: Synthetic oligonucleotide
  Target: ATXN1; (-) strand; PAM type: NRG; PAM sequence: AGG
agagcgcgagggagggaggg

SEQ ID NO: 96029 - DNA, 20 bp, Artificial Sequence
  Description of Artificial Sequence: Synthetic oligonucleotide
  Target: ATXN1; (-) strand; PAM type: NRG; PAM sequence: GAG
gagagcgcgagggagggagg

SEQ ID NO: 96030 - DNA, 20 bp, Artificial Sequence
  Description of Artificial Sequence: Synthetic oligonucleotide
  Target: ATXN1; (-) strand; PAM type: NRG; PAM sequence: GGG
gagagagcgcgagggaggga

SEQ ID NO: 96031 - DNA, 20 bp, Artificial Sequence
  Description of Artificial Sequence: Synthetic oligonucleotide
  Target: ATXN1; (-) strand; PAM type: NRG; PAM sequence: AGG
cgagagagcgcgagggaggg

SEQ ID NO: 96032 - DNA, 20 bp, Artificial Sequence
  Description of Artificial Sequence: Synthetic oligonucleotide
  Target: ATXN1; (-) strand; PAM type: NRG; PAM sequence: GAG
gcgagagagcgcgagggagg

SEQ ID NO: 96033 - DNA, 20 bp, Artificial Sequence
  Description of Artificial Sequence: Synthetic oligonucleotide
  Target: ATXN1; (-) strand; PAM type: NRG; PAM sequence: GGG
gcgcgagagagcgcgaggga

SEQ ID NO: 96034 - DNA, 20 bp, Artificial Sequence
  Description of Artificial Sequence: Synthetic oligonucleotide
  Target: ATXN1; (-) strand; PAM type: NRG; PAM sequence: AGG
agcgcgagagagcgcgaggg

SEQ ID NO: 96035 - DNA, 20 bp, Artificial Sequence
  Description of Artificial Sequence: Synthetic oligonucleotide
  Target: ATXN1; (-) strand; PAM type: NRG; PAM sequence: GAG
gagcgcgagagagcgcgagg

SEQ ID NO: 96036 - DNA, 20 bp, Artificial Sequence
  Description of Artificial Sequence: Synthetic oligonucleotide
  Target: ATXN1; (-) strand; PAM type: NRG; PAM sequence: GGG
gcgagcgcgagagagcgcga

SEQ ID NO: 96037 - DNA, 20 bp, Artificial Sequence
  Description of Artificial Sequence: Synthetic oligonucleotide
  Target: ATXN1; (-) strand; PAM type: NRG; PAM sequence: AGG
agcgagcgcgagagagcgcg

SEQ ID NO: 96038 - DNA, 20 bp, Artificial Sequence
  Description of Artificial Sequence: Synthetic oligonucleotide
  Target: ATXN1; (-) strand; PAM type: NRG; PAM sequence: GAG
gagcgagcgcgagagagcgc

SEQ ID NO: 96039 - DNA, 20 bp, Artificial Sequence
  Description of Artificial Sequence: Synthetic oligonucleotide
  Target: ATXN1; (-) strand; PAM type: NRG; PAM sequence: GAG
gcgagcgagcgagcgcgaga

SEQ ID NO: 96040 - DNA, 20 bp, Artificial Sequence
  Description of Artificial Sequence: Synthetic oligonucleotide
  Target: ATXN1; (-) strand; PAM type: NRG; PAM sequence: GAG
gagcgagcgagcgagcgcga

SEQ ID NO: 96041 - DNA, 20 bp, Artificial Sequence
  Description of Artificial Sequence: Synthetic oligonucleotide
  Target: ATXN1; (-) strand; PAM type: NRG; PAM sequence: GAG
gcgagcgagcgagcgagcgc

SEQ ID NO: 96042 - DNA, 20 bp, Artificial Sequence
  Description of Artificial Sequence: Synthetic oligonucleotide
  Target: ATXN1; (-) strand; PAM type: NRG; PAM sequence: GAG
actggagcgagcgagcgagc

SEQ ID NO: 96043 - DNA, 20 bp, Artificial Sequence
  Description of Artificial Sequence: Synthetic oligonucleotide
  Target: ATXN1; (-) strand; PAM type: NRG; PAM sequence: GAG
acatactggagcgagcgagc

SEQ ID NO: 96044 - DNA, 20 bp, Artificial Sequence
  Description of Artificial Sequence: Synthetic oligonucleotide
  Target: ATXN1; (-) strand; PAM type: NRG; PAM sequence: GAG
atttacatactggagcgagc

SEQ ID NO: 96045 - DNA, 20 bp, Artificial Sequence
  Description of Artificial Sequence: Synthetic oligonucleotide
  Target: ATXN1; (-) strand; PAM type: NRG; PAM sequence: GAG
acacatttacatactggagc

SEQ ID NO: 96046 - DNA, 20 bp, Artificial Sequence
  Description of Artificial Sequence: Synthetic oligonucleotide
  Target: ATXN1; (-) strand; PAM type: NRG; PAM sequence: GAG
tattacacatttacatactg

SEQ ID NO: 96047 - DNA, 20 bp, Artificial Sequence
  Description of Artificial Sequence: Synthetic oligonucleotide
  Target: ATXN1; (-) strand; PAM type: NRG; PAM sequence: TGG
tctattacacatttacatac

SEQ ID NO: 96048 - DNA, 20 bp, Artificial Sequence
  Description of Artificial Sequence: Synthetic oligonucleotide
  Target: ATXN1; (-) strand; PAM type: NRG; PAM sequence: TGG
gcagccaactgctccatatt

SEQ ID NO: 96049 - DNA, 20 bp, Artificial Sequence
  Description of Artificial Sequence: Synthetic oligonucleotide
  Target: ATXN1; (-) strand; PAM type: NRG; PAM sequence: CAG
tccttgagctgcggcggcgg

SEQ ID NO: 96050 - DNA, 20 bp, Artificial Sequence
  Description of Artificial Sequence: Synthetic oligonucleotide
  Target: ATXN1; (-) strand; PAM type: NRG; PAM sequence: CGG
ggatccttgagctgcggcgg

SEQ ID NO: 96051 - DNA, 20 bp, Artificial Sequence
  Description of Artificial Sequence: Synthetic oligonucleotide
  Target: ATXN1; (-) strand; PAM type: NRG; PAM sequence: CGG
gtcggatccttgagctgcgg

SEQ ID NO: 96052 - DNA, 20 bp, Artificial Sequence
  Description of Artificial Sequence: Synthetic oligonucleotide
  Target: ATXN1; (-) strand; PAM type: NRG; PAM sequence: CGG
gaagtcggatccttgagctg

SEQ ID NO: 96053 - DNA, 20 bp, Artificial Sequence
  Description of Artificial Sequence: Synthetic oligonucleotide
  Target: ATXN1; (-) strand; PAM type: NRG; PAM sequence: GAG
ccccatgaagtcggatcctt

SEQ ID NO: 96054 - DNA, 20 bp, Artificial Sequence
  Description of Artificial Sequence: Synthetic oligonucleotide
  Target: ATXN1; (-) strand; PAM type: NRG; PAM sequence: CGG
gccccccacccccatgaagt

SEQ ID NO: 96055 - DNA, 20 bp, Artificial Sequence
  Description of Artificial Sequence: Synthetic oligonucleotide
  Target: ATXN1; (-) strand; PAM type: NRG; PAM sequence: AAG
gggtgccccccacccccatg

SEQ ID NO: 96056 - DNA, 20 bp, Artificial Sequence
  Description of Artificial Sequence: Synthetic oligonucleotide
  Target: ATXN1; (-) strand; PAM type: NRG; PAM sequence: GGG
tcgccgggccgcccgccaga

SEQ ID NO: 96057 - DNA, 20 bp, Artificial Sequence
  Description of Artificial Sequence: Synthetic oligonucleotide
  Target: ATXN1; (-) strand; PAM type: NRG; PAM sequence: AGG
ctcgccgggccgcccgccag

SEQ ID NO: 96058 - DNA, 20 bp, Artificial Sequence
  Description of Artificial Sequence: Synthetic oligonucleotide
  Target: ATXN1; (-) strand; PAM type: NRG; PAM sequence: GAG
gctcgccgggccgcccgcca

SEQ ID NO: 96059 - DNA, 20 bp, Artificial Sequence
  Description of Artificial Sequence: Synthetic oligonucleotide
  Target: ATXN1; (-) strand; PAM type: NRG; PAM sequence: CAG
cggctcgccgggccgcccgc

SEQ ID NO: 96060 - DNA, 20 bp, Artificial Sequence
  Description of Artificial Sequence: Synthetic oligonucleotide
  Target: ATXN1; (-) strand; PAM type: NRG; PAM sequence: GGG
cgtgctctgtgcggctcgcc

SEQ ID NO: 96061 - DNA, 20 bp, Artificial Sequence
  Description of Artificial Sequence: Synthetic oligonucleotide
  Target: ATXN1; (-) strand; PAM type: NRG; PAM sequence: CGG
ccgtgctctgtgcggctcgc

SEQ ID NO: 96062 - DNA, 20 bp, Artificial Sequence
  Description of Artificial Sequence: Synthetic oligonucleotide
  Target: ATXN1; (-) strand; PAM type: NRG; PAM sequence: CGG
tgcgctcgccgtgctctgtg

SEQ ID NO: 96063 - DNA, 20 bp, Artificial Sequence
  Description of Artificial Sequence: Synthetic oligonucleotide
  Target: ATXN1; (-) strand; PAM type: NRG; PAM sequence: CGG
ggcgcgggccggccgccgcg

SEQ ID NO: 96064 - DNA, 20 bp, Artificial Sequence
  Description of Artificial Sequence: Synthetic oligonucleotide
  Target: ATXN1; (-) strand; PAM type: NRG; PAM sequence: CGG
gaagggttaagggcgcgggc

SEQ ID NO: 96065 - DNA, 20 bp, Artificial Sequence
  Description of Artificial Sequence: Synthetic oligonucleotide
  Target: ATXN1; (-) strand; PAM type: NRG; PAM sequence: GGG
cagcgaagggttaagggcgc

SEQ ID NO: 96066 - DNA, 20 bp, Artificial Sequence
  Description of Artificial Sequence: Synthetic oligonucleotide
  Target: ATXN1; (-) strand; PAM type: NRG; PAM sequence: CGG
gcagcgaagggttaagggcg

SEQ ID NO: 96067 - DNA, 20 bp, Artificial Sequence
  Description of Artificial Sequence: Synthetic oligonucleotide
  Target: ATXN1; (-) strand; PAM type: NRG; PAM sequence: GGG
ggcgcgcagcgaagggttaa

SEQ ID NO: 96068 - DNA, 20 bp, Artificial Sequence
  Description of Artificial Sequence: Synthetic oligonucleotide
  Target: ATXN1; (-) strand; PAM type: NRG; PAM sequence: AGG
cggcgcgcagcgaagggtta

SEQ ID NO: 96069 - DNA, 20 bp, Artificial Sequence
  Description of Artificial Sequence: Synthetic oligonucleotide
  Target: ATXN1; (-) strand; PAM type: NRG; PAM sequence: AAG
gcggcgcgcagcgaagggtt

SEQ ID NO: 96070 - DNA, 20 bp, Artificial Sequence
  Description of Artificial Sequence: Synthetic oligonucleotide
  Target: ATXN1; (-) strand; PAM type: NRG; PAM sequence: GGG
cccgggcggcgcgcagcgaa

SEQ ID NO: 96071 - DNA, 20 bp, Artificial Sequence
  Description of Artificial Sequence: Synthetic oligonucleotide
  Target: ATXN1; (-) strand; PAM type: NRG; PAM sequence: AGG
ccccgggcggcgcgcagcga

SEQ ID NO: 96072 - DNA, 20 bp, Artificial Sequence
  Description of Artificial Sequence: Synthetic oligonucleotide
  Target: ATXN1; (-) strand; PAM type: NRG; PAM sequence: AAG
tccccgggcggcgcgcagcg

SEQ ID NO: 96073 - DNA, 20 bp, Artificial Sequence
  Description of Artificial Sequence: Synthetic oligonucleotide
  Target: ATXN1; (-) strand; PAM type: NRG; PAM sequence: CAG
ccgcctccccgggcggcgcg

SEQ ID NO: 96074 - DNA, 20 bp, Artificial Sequence
  Description of Artificial Sequence: Synthetic oligonucleotide
  Target: ATXN1; (-) strand; PAM type: NRG; PAM sequence: CGG
aaggtgcccgcctccccggg

SEQ ID NO: 96075 - DNA, 20 bp, Artificial Sequence
  Description of Artificial Sequence: Synthetic oligonucleotide
  Target: ATXN1; (-) strand; PAM type: NRG; PAM sequence: GGG
ggaaaggtgcccgcctcccc

SEQ ID NO: 96076 - DNA, 20 bp, Artificial Sequence
  Description of Artificial Sequence: Synthetic oligonucleotide
  Target: ATXN1; (-) strand; PAM type: NRG; PAM sequence: CGG
gggaaaggtgcccgcctccc

SEQ ID NO: 96077 - DNA, 20 bp, Artificial Sequence
  Description of Artificial Sequence: Synthetic oligonucleotide
  Target: ATXN1; (-) strand; PAM type: NRG; PAM sequence: AGG
cccgagccactctttgggaa

SEQ ID NO: 96078 - DNA, 20 bp, Artificial Sequence
  Description of Artificial Sequence: Synthetic oligonucleotide
  Target: ATXN1; (-) strand; PAM type: NRG; PAM sequence: AAG
tcccgagccactctttggga

SEQ ID NO: 96079 - DNA, 20 bp, Artificial Sequence
  Description of Artificial Sequence: Synthetic oligonucleotide
  Target: ATXN1; (-) strand; PAM type: NRG; PAM sequence: GGG
cccatcccgagccactcttt

SEQ ID NO: 96080 - DNA, 20 bp, Artificial Sequence
  Description of Artificial Sequence: Synthetic oligonucleotide
  Target: ATXN1; (-) strand; PAM type: NRG; PAM sequence: TGG
ccccatcccgagccactctt

SEQ ID NO: 96081 - DNA, 20 bp, Artificial Sequence
  Description of Artificial Sequence: Synthetic oligonucleotide
  Target: ATXN1; (-) strand; PAM type: NRG; PAM sequence: GAG
cctcccccgcaccccatccc

SEQ ID NO: 96082 - DNA, 20 bp, Artificial Sequence
  Description of Artificial Sequence: Synthetic oligonucleotide
  Target: ATXN1; (-) strand; PAM type: NRG; PAM sequence: CGG
ctggaaggaaccttgccctc

SEQ ID NO: 96083 - DNA, 20 bp, Artificial Sequence
  Description of Artificial Sequence: Synthetic oligonucleotide
  Target: ATXN1; (-) strand; PAM type: NRG; PAM sequence: AGG
gcccccttcccaaacctgga

SEQ ID NO: 96084 - DNA, 20 bp, Artificial Sequence
  Description of Artificial Sequence: Synthetic oligonucleotide
  Target: ATXN1; (-) strand; PAM type: NRG; PAM sequence: AAG
cgcccccttcccaaacctgg

SEQ ID NO: 96085 - DNA, 20 bp, Artificial Sequence
  Description of Artificial Sequence: Synthetic oligonucleotide
  Target: ATXN1; (-) strand; PAM type: NRG; PAM sequence: TGG
ccccgcccccttcccaaacc

SEQ ID NO: 96086 - DNA, 20 bp, Artificial Sequence
  Description of Artificial Sequence: Synthetic oligonucleotide
  Target: ATXN1; (-) strand; PAM type: NRG; PAM sequence: CAG
gctcaaattacctcatcgcc

SEQ ID NO: 96087 - DNA, 20 bp, Artificial Sequence
  Description of Artificial Sequence: Synthetic oligonucleotide
  Target: ATXN1; (-) strand; PAM type: NRG; PAM sequence: AGG
gggacccagggaggcgcgcg

SEQ ID NO: 96088 - DNA, 20 bp, Artificial Sequence
  Description of Artificial Sequence: Synthetic oligonucleotide
  Target: ATXN1; (-) strand; PAM type: NRG; PAM sequence: GAG
agggacccagggaggcgcgc

SEQ ID NO: 96089 - DNA, 20 bp, Artificial Sequence
  Description of Artificial Sequence: Synthetic oligonucleotide
  Target: ATXN1; (-) strand; PAM type: NRG; PAM sequence: AGG
ctaggtgcagggacccaggg

SEQ ID NO: 96090 - DNA, 20 bp, Artificial Sequence
  Description of Artificial Sequence: Synthetic oligonucleotide
  Target: ATXN1; (-) strand; PAM type: NRG; PAM sequence: GAG
actaggtgcagggacccagg

SEQ ID NO: 96091 - DNA, 20 bp, Artificial Sequence
  Description of Artificial Sequence: Synthetic oligonucleotide
  Target: ATXN1; (-) strand; PAM type: NRG; PAM sequence: GGG
caactaggtgcagggaccca

SEQ ID NO: 96092 - DNA, 20 bp, Artificial Sequence
  Description of Artificial Sequence: Synthetic oligonucleotide
  Target: ATXN1; (-) strand; PAM type: NRG; PAM sequence: AGG
ccaactaggtgcagggaccc

SEQ ID NO: 96093 - DNA, 20 bp, Artificial Sequence
  Description of Artificial Sequence: Synthetic oligonucleotide
  Target: ATXN1; (-) strand; PAM type: NRG; PAM sequence: CAG
tccaactaggtgcagggacc

SEQ ID NO: 96094 - DNA, 20 bp, Artificial Sequence
  Description of Artificial Sequence: Synthetic oligonucleotide
  Target: ATXN1; (-) strand; PAM type: NRG; PAM sequence: GGG
gtcccctccaactaggtgca

SEQ ID NO: 96095 - DNA, 20 bp, Artificial Sequence
  Description of Artificial Sequence: Synthetic oligonucleotide
  Target: ATXN1; (-) strand; PAM type: NRG; PAM sequence: AGG
agtcccctccaactaggtgc

SEQ ID NO: 96096 - DNA, 20 bp, Artificial Sequence
  Description of Artificial Sequence: Synthetic oligonucleotide
  Target: ATXN1; (-) strand; PAM type: NRG; PAM sequence: CAG
cagtcccctccaactaggtg

SEQ ID NO: 96097 - DNA, 20 bp, Artificial Sequence
  Description of Artificial Sequence: Synthetic oligonucleotide
  Target: ATXN1; (-) strand; PAM type: NRG; PAM sequence: AGG
tcgttcagtcccctccaact

SEQ ID NO: 96098 - DNA, 20 bp, Artificial Sequence
  Description of Artificial Sequence: Synthetic oligonucleotide
  Target: ATXN1; (-) strand; PAM type: NRG; PAM sequence: TAG
gtcgttcagtcccctccaac

SEQ ID NO: 96099 - DNA, 20 bp, Artificial Sequence
  Description of Artificial Sequence: Synthetic oligonucleotide
  Target: ATXN1; (-) strand; PAM type: NRG; PAM sequence: CAG
agtagcgccccgttgtcgtt

SEQ ID NO: 96100 - DNA, 20 bp, Artificial Sequence
  Description of Artificial Sequence: Synthetic oligonucleotide
  Target: ATXN1; (-) strand; PAM type: NRG; PAM sequence: TAG
agtcccccaggttgcctgag

SEQ ID NO: 96101 - DNA, 20 bp, Artificial Sequence
  Description of Artificial Sequence: Synthetic oligonucleotide
  Target: ATXN1; (-) strand; PAM type: NRG; PAM sequence: GAG
gggagtcccccaggttgcct

SEQ ID NO: 96102 - DNA, 20 bp, Artificial Sequence
  Description of Artificial Sequence: Synthetic oligonucleotide
  Target: ATXN1; (-) strand; PAM type: NRG; PAM sequence: AGG
agcccttgggggagtccccc

SEQ ID NO: 96103 - DNA, 20 bp, Artificial Sequence
  Description of Artificial Sequence: Synthetic oligonucleotide
  Target: ATXN1; (-) strand; PAM type: NRG; PAM sequence: CAG
cagcccttgggggagtcccc

SEQ ID NO: 96104 - DNA, 20 bp, Artificial Sequence
  Description of Artificial Sequence: Synthetic oligonucleotide
  Target: ATXN1; (-) strand; PAM type: NRG; PAM sequence: GAG
aagcctgacagcccttgggg

SEQ ID NO: 96105 - DNA, 20 bp, Artificial Sequence
  Description of Artificial Sequence: Synthetic oligonucleotide
  Target: ATXN1; (-) strand; PAM type: NRG; PAM sequence: GGG
tgaagcctgacagcccttgg

SEQ ID NO: 96106 - DNA, 20 bp, Artificial Sequence
  Description of Artificial Sequence: Synthetic oligonucleotide
  Target: ATXN1; (-) strand; PAM type: NRG; PAM sequence: GGG
ctgaagcctgacagcccttg

SEQ ID NO: 96107 - DNA, 20 bp, Artificial Sequence
  Description of Artificial Sequence: Synthetic oligonucleotide
  Target: ATXN1; (-) strand; PAM type: NRG; PAM sequence: GGG
gctgaagcctgacagccctt

SEQ ID NO: 96108 - DNA, 20 bp, Artificial Sequence
  Description of Artificial Sequence: Synthetic oligonucleotide
  Target: ATXN1; (-) strand; PAM type: NRG; PAM sequence: TGG
agctgaagcctgacagccct

SEQ ID NO: 96109 - DNA, 20 bp, Artificial Sequence
  Description of Artificial Sequence: Synthetic oligonucleotide
  Target: ATXN1; (-) strand; PAM type: NRG; PAM sequence: CAG
ggctcccagctgaagcctga

SEQ ID NO: 96110 - DNA, 20 bp, Artificial Sequence
  Description of Artificial Sequence: Synthetic oligonucleotide
  Target: ATXN1; (-) strand; PAM type: NRG; PAM sequence: AAG
gttgcatcggctcccagctg

SEQ ID NO: 96111 - DNA, 20 bp, Artificial Sequence
  Description of Artificial Sequence: Synthetic oligonucleotide
  Target: ATXN1; (-) strand; PAM type: NRG; PAM sequence: CAG
tggggtgttgcatcggctcc

SEQ ID NO: 96112 - DNA, 20 bp, Artificial Sequence
  Description of Artificial Sequence: Synthetic oligonucleotide
  Target: ATXN1; (-) strand; PAM type: NRG; PAM sequence: CGG
tccccgctggggtgttgcat

SEQ ID NO: 96113 - DNA, 20 bp, Artificial Sequence
  Description of Artificial Sequence: Synthetic oligonucleotide
  Target: ATXN1; (-) strand; PAM type: NRG; PAM sequence: GGG
ccgacctcccctccccgctg

SEQ ID NO: 96114 - DNA, 20 bp, Artificial Sequence
  Description of Artificial Sequence: Synthetic oligonucleotide
  Target: ATXN1; (-) strand; PAM type: NRG; PAM sequence: GGG
gccgacctcccctccccgct

SEQ ID NO: 96115 - DNA, 20 bp, Artificial Sequence
  Description of Artificial Sequence: Synthetic oligonucleotide
  Target: ATXN1; (-) strand; PAM type: NRG; PAM sequence: TGG
ggccgacctcccctccccgc

SEQ ID NO: 96116 - DNA, 20 bp, Artificial Sequence
  Description of Artificial Sequence: Synthetic oligonucleotide
  Target: ATXN1; (-) strand; PAM type: NRG; PAM sequence: GGG
ggacacgtcgggattagaat

SEQ ID NO: 96117 - DNA, 20 bp, Artificial Sequence
  Description of Artificial Sequence: Synthetic oligonucleotide
  Target: ATXN1; (-) strand; PAM type: NRG; PAM sequence: TGG
aggacacgtcgggattagaa

SEQ ID NO: 96118 - DNA, 20 bp, Artificial Sequence
  Description of Artificial Sequence: Synthetic oligonucleotide
  Target: ATXN1; (-) strand; PAM type: NRG; PAM sequence: TAG
gaccaaggacacgtcgggat

SEQ ID NO: 96119 - DNA, 20 bp, Artificial Sequence
  Description of Artificial Sequence: Synthetic oligonucleotide
  Target: ATXN1; (-) strand; PAM type: NRG; PAM sequence: GGG
cctgggaccaaggacacgtc

SEQ ID NO: 96120 - DNA, 20 bp, Artificial Sequence
  Description of Artificial Sequence: Synthetic oligonucleotide
  Target: ATXN1; (-) strand; PAM type: NRG; PAM sequence: CGG
gcctgggaccaaggacacgt

SEQ ID NO: 96121 - DNA, 20 bp, Artificial Sequence
  Description of Artificial Sequence: Synthetic oligonucleotide
  Target: ATXN1; (-) strand; PAM type: NRG; PAM sequence: AGG
gctccgagcgcctgggacca

SEQ ID NO: 96122 - DNA, 20 bp, Artificial Sequence
  Description of Artificial Sequence: Synthetic oligonucleotide
  Target: ATXN1; (-) strand; PAM type: NRG; PAM sequence: AAG
tgctccgagcgcctgggacc

SEQ ID NO: 96123 - DNA, 20 bp, Artificial Sequence
  Description of Artificial Sequence: Synthetic oligonucleotide
  Target: ATXN1; (-) strand; PAM type: NRG; PAM sequence: GGG
agatgctgctccgagcgcct

SEQ ID NO: 96124 - DNA, 20 bp, Artificial Sequence
  Description of Artificial Sequence: Synthetic oligonucleotide
  Target: ATXN1; (-) strand; PAM type: NRG; PAM sequence: TGG
cagatgctgctccgagcgcc

SEQ ID NO: 96125 - DNA, 20 bp, Artificial Sequence
  Description of Artificial Sequence: Synthetic oligonucleotide
  Target: ATXN1; (-) strand; PAM type: NRG; PAM sequence: GAG
gccctctcagatgctgctcc

SEQ ID NO: 96126 - DNA, 20 bp, Artificial Sequence
  Description of Artificial Sequence: Synthetic oligonucleotide
  Target: ATXN1; (-) strand; PAM type: NRG; PAM sequence: CAG
atgatcagagtgagccctct

SEQ ID NO: 96127 - DNA, 20 bp, Artificial Sequence
  Description of Artificial Sequence: Synthetic oligonucleotide
  Target: ATXN1; (-) strand; PAM type: NRG; PAM sequence: GAG
gtgcagctgatgatcagagt

SEQ ID NO: 96128 - DNA, 20 bp, Artificial Sequence
  Description of Artificial Sequence: Synthetic oligonucleotide
  Target: ATXN1; (-) strand; PAM type: NRG; PAM sequence: GAG
taacgtgcagctgatgatca

SEQ ID NO: 96129 - DNA, 20 bp, Artificial Sequence
  Description of Artificial Sequence: Synthetic oligonucleotide
  Target: ATXN1; (-) strand; PAM type: NRG; PAM sequence: CAG
cttaacgtgcagctgatgat

SEQ ID NO: 96130 - DNA, 20 bp, Artificial Sequence
  Description of Artificial Sequence: Synthetic oligonucleotide
  Target: ATXN1; (-) strand; PAM type: NRG; PAM sequence: CAG
ccggtttgtggcttaacgtg

SEQ ID NO: 96131 - DNA, 20 bp, Artificial Sequence
  Description of Artificial Sequence: Synthetic oligonucleotide
  Target: ATXN1; (-) strand; PAM type: NRG; PAM sequence: TGG
gccgaagcgacgccggtttg

SEQ ID NO: 96132 - DNA, 20 bp, Artificial Sequence
  Description of Artificial Sequence: Synthetic oligonucleotide
  Target: ATXN1; (-) strand; PAM type: NRG; PAM sequence: CGG
ccggaacgccgaagcgacgc

SEQ ID NO: 96133 - DNA, 20 bp, Artificial Sequence
  Description of Artificial Sequence: Synthetic oligonucleotide
  Target: ATXN1; (-) strand; PAM type: NRG; PAM sequence: AAG
gcctgggttccggaacgccg

SEQ ID NO: 96134 - DNA, 20 bp, Artificial Sequence
  Description of Artificial Sequence: Synthetic oligonucleotide
  Target: ATXN1; (-) strand; PAM type: NRG; PAM sequence: CGG
cggcccccaggcctgggttc

SEQ ID NO: 96135 - DNA, 20 bp, Artificial Sequence
  Description of Artificial Sequence: Synthetic oligonucleotide
  Target: ATXN1; (-) strand; PAM type: NRG; PAM sequence: GGG
tccccgcggcccccaggcct

SEQ ID NO: 96136 - DNA, 20 bp, Artificial Sequence
  Description of Artificial Sequence: Synthetic oligonucleotide
  Target: ATXN1; (-) strand; PAM type: NRG; PAM sequence: TGG
atccccgcggcccccaggcc

SEQ ID NO: 96137 - DNA, 20 bp, Artificial Sequence
  Description of Artificial Sequence: Synthetic oligonucleotide
  Target: ATXN1; (-) strand; PAM type: NRG; PAM sequence: AGG
aggcaatccccgcggccccc

SEQ ID NO: 96138 - DNA, 20 bp, Artificial Sequence
  Description of Artificial Sequence: Synthetic oligonucleotide
  Target: ATXN1; (-) strand; PAM type: NRG; PAM sequence: CAG
gaggcaatccccgcggcccc

SEQ ID NO: 96139 - DNA, 20 bp, Artificial Sequence
  Description of Artificial Sequence: Synthetic oligonucleotide
  Target: ATXN1; (-) strand; PAM type: NRG; PAM sequence: CGG
gcacgcagaggcaatccccg

SEQ ID NO: 96140 - DNA, 20 bp, Artificial Sequence
  Description of Artificial Sequence: Synthetic oligonucleotide
  Target: ATXN1; (-) strand; PAM type: NRG; PAM sequence: AGG
ctttccggagttgcacgcag

SEQ ID NO: 96141 - DNA, 20 bp, Artificial Sequence
  Description of Artificial Sequence: Synthetic oligonucleotide
  Target: ATXN1; (-) strand; PAM type: NRG; PAM sequence: GAG
actttccggagttgcacgca

SEQ ID NO: 96142 - DNA, 20 bp, Artificial Sequence
  Description of Artificial Sequence: Synthetic oligonucleotide
  Target: ATXN1; (-) strand; PAM type: NRG; PAM sequence: CAG
aaactttccggagttgcacg

SEQ ID NO: 96143 - DNA, 20 bp, Artificial Sequence
  Description of Artificial Sequence: Synthetic oligonucleotide
  Target: ATXN1; (-) strand; PAM type: NRG; PAM sequence: GAG
ggaccccttgaaactttccg

SEQ ID NO: 96144 - DNA, 20 bp, Artificial Sequence
  Description of Artificial Sequence: Synthetic oligonucleotide
  Target: ATXN1; (-) strand; PAM type: NRG; PAM sequence: CGG
ggggaccccttgaaactttc

SEQ ID NO: 96145 - DNA, 20 bp, Artificial Sequence
  Description of Artificial Sequence: Synthetic oligonucleotide
  Target: ATXN1; (-) strand; PAM type: NRG; PAM sequence: GGG
gagggtacctgtgcagtcgg

SEQ ID NO: 96146 - DNA, 20 bp, Artificial Sequence
  Description of Artificial Sequence: Synthetic oligonucleotide
  Target: ATXN1; (-) strand; PAM type: NRG; PAM sequence: GGG
tgagggtacctgtgcagtcg

SEQ ID NO: 96147 - DNA, 20 bp, Artificial Sequence
  Description of Artificial Sequence: Synthetic oligonucleotide
  Target: ATXN1; (-) strand; PAM type: NRG; PAM sequence: GGG
gtgagggtacctgtgcagtc

SEQ ID NO: 96148 - DNA, 20 bp, Artificial Sequence
  Description of Artificial Sequence: Synthetic oligonucleotide
  Target: ATXN1; (-) strand; PAM type: NRG; PAM sequence: CGG
ggtgagggtacctgtgcagt

SEQ ID NO: 96149 - DNA, 20 bp, Artificial Sequence
  Description of Artificial Sequence: Synthetic oligonucleotide
  Target: ATXN1; (-) strand; PAM type: NRG; PAM sequence: CAG
gaaaggtgagggtacctgtg

SEQ ID NO: 96150 - DNA, 20 bp, Artificial Sequence
  Description of Artificial Sequence: Synthetic oligonucleotide
  Target: ATXN1; (-) strand; PAM type: NRG; PAM sequence: GGG
ttcgccggcaggaaaggtga

SEQ ID NO: 96151 - DNA, 20 bp, Artificial Sequence
  Description of Artificial Sequence: Synthetic oligonucleotide
  Target: ATXN1; (-) strand; PAM type: NRG; PAM sequence: AGG
gttcgccggcaggaaaggtg

SEQ ID NO: 96152 - DNA, 20 bp, Artificial Sequence
  Description of Artificial Sequence: Synthetic oligonucleotide
  Target: ATXN1; (-) strand; PAM type: NRG; PAM sequence: GAG
cgttcgccggcaggaaaggt

SEQ ID NO: 96153 - DNA, 20 bp, Artificial Sequence
  Description of Artificial Sequence: Synthetic oligonucleotide
  Target: ATXN1; (-) strand; PAM type: NRG; PAM sequence: AGG
ccagcgttcgccggcaggaa

SEQ ID NO: 96154 - DNA, 20 bp, Artificial Sequence
  Description of Artificial Sequence: Synthetic oligonucleotide
  Target: ATXN1; (-) strand; PAM type: NRG; PAM sequence: AAG
gccagcgttcgccggcagga

SEQ ID NO: 96155 - DNA, 20 bp, Artificial Sequence
  Description of Artificial Sequence: Synthetic oligonucleotide
  Target: ATXN1; (-) strand; PAM type: NRG; PAM sequence: AGG
ggtcgccagcgttcgccggc

SEQ ID NO: 96156 - DNA, 20 bp, Artificial Sequence
  Description of Artificial Sequence: Synthetic oligonucleotide
  Target: ATXN1; (-) strand; PAM type: NRG; PAM sequence: CAG
cggtcgccagcgttcgccgg

SEQ ID NO: 96157 - DNA, 20 bp, Artificial Sequence
  Description of Artificial Sequence: Synthetic oligonucleotide
  Target: ATXN1; (-) strand; PAM type: NRG; PAM sequence: CGG
gggcggtcgccagcgttcgc

SEQ ID NO: 96158 - DNA, 20 bp, Artificial Sequence
  Description of Artificial Sequence: Synthetic oligonucleotide
  Target: ATXN1; (-) strand; PAM type: NRG; PAM sequence: CAG
gggcagggtcgggcggtcgc

SEQ ID NO: 96159 - DNA, 20 bp, Artificial Sequence
  Description of Artificial Sequence: Synthetic oligonucleotide
  Target: ATXN1; (-) strand; PAM type: NRG; PAM sequence: CGG
agaaagagggcagggtcggg

SEQ ID NO: 96160 - DNA, 20 bp, Artificial Sequence
  Description of Artificial Sequence: Synthetic oligonucleotide
  Target: ATXN1; (-) strand; PAM type: NRG; PAM sequence: GGG
gagagaaagagggcagggtc

SEQ ID NO: 96161 - DNA, 20 bp, Artificial Sequence
  Description of Artificial Sequence: Synthetic oligonucleotide
  Target: ATXN1; (-) strand; PAM type: NRG; PAM sequence: CGG
agagagaaagagggcagggt

SEQ ID NO: 96162 - DNA, 20 bp, Artificial Sequence
  Description of Artificial Sequence: Synthetic oligonucleotide
  Target: ATXN1; (-) strand; PAM type: NRG; PAM sequence: GGG
gcgaagagagaaagagggca

SEQ ID NO: 96163 - DNA, 20 bp, Artificial Sequence
  Description of Artificial Sequence: Synthetic oligonucleotide
  Target: ATXN1; (-) strand; PAM type: NRG; PAM sequence: AGG
tgcgaagagagaaagagggc

SEQ ID NO: 96164 - DNA, 20 bp, Artificial Sequence
  Description of Artificial Sequence: Synthetic oligonucleotide
  Target: ATXN1; (-) strand; PAM type: NRG; PAM sequence: CAG
gtgcgaagagagaaagaggg

SEQ ID NO: 96165 - DNA, 20 bp, Artificial Sequence
  Description of Artificial Sequence: Synthetic oligonucleotide
  Target: ATXN1; (-) strand; PAM type: NRG; PAM sequence: GGG
tgcgtgcgaagagagaaaga

SEQ ID NO: 96166 - DNA, 20 bp, Artificial Sequence
  Description of Artificial Sequence: Synthetic oligonucleotide
  Target: ATXN1; (-) strand; PAM type: NRG; PAM sequence: AGG
ctgcgtgcgaagagagaaag

SEQ ID NO: 96167 - DNA, 20 bp, Artificial Sequence
  Description of Artificial Sequence: Synthetic oligonucleotide
  Target: ATXN1; (-) strand; PAM type: NRG; PAM sequence: GAG
cctgcgtgcgaagagagaaa

SEQ ID NO: 96168 - DNA, 20 bp, Artificial Sequence
  Description of Artificial Sequence: Synthetic oligonucleotide
  Target: ATXN1; (-) strand; PAM type: NRG; PAM sequence: AAG
gacctgcgtgcgaagagaga

SEQ ID NO: 96169 - DNA, 20 bp, Artificial Sequence
  Description of Artificial Sequence: Synthetic oligonucleotide
  Target: ATXN1; (-) strand; PAM type: NRG; PAM sequence: GAG
tccggacctgcgtgcgaaga

SEQ ID NO: 96170 - DNA, 20 bp, Artificial Sequence
  Description of Artificial Sequence: Synthetic oligonucleotide
  Target: ATXN1; (-) strand; PAM type: NRG; PAM sequence: GAG
tttccggacctgcgtgcgaa

SEQ ID NO: 96171 - DNA, 20 bp, Artificial Sequence
  Description of Artificial Sequence: Synthetic oligonucleotide
  Target: ATXN1; (-) strand; PAM type: NRG; PAM sequence: AAG
gatttccggacctgcgtgcg

SEQ ID NO: 96172 - DNA, 20 bp, Artificial Sequence
  Description of Artificial Sequence: Synthetic oligonucleotide
  Target: ATXN1; (-) strand; PAM type: NRG; PAM sequence: CGG
tccatatcaaagccgatttc

SEQ ID NO: 96173 - DNA, 20 bp, Artificial Sequence
  Description of Artificial Sequence: Synthetic oligonucleotide
  Target: ATXN1; (-) strand; PAM type: NRG; PAM sequence: AAG
agcggagtagttccatatca

SEQ ID NO: 96174 - DNA, 20 bp, Artificial Sequence
  Description of Artificial Sequence: Synthetic oligonucleotide
  Target: ATXN1; (-) strand; PAM type: NRG; PAM sequence: TAG
ctttccaggctagagcggag

SEQ ID NO: 96175 - DNA, 20 bp, Artificial Sequence
  Description of Artificial Sequence: Synthetic oligonucleotide
  Target: ATXN1; (-) strand; PAM type: NRG; PAM sequence: GAG
ctcctttccaggctagagcg

SEQ ID NO: 96176 - DNA, 20 bp, Artificial Sequence
  Description of Artificial Sequence: Synthetic oligonucleotide
  Target: ATXN1; (-) strand; PAM type: NRG; PAM sequence: CGG
gtctcctttccaggctagag

SEQ ID NO: 96177 - DNA, 20 bp, Artificial Sequence
  Description of Artificial Sequence: Synthetic oligonucleotide
  Target: ATXN1; (-) strand; PAM type: NRG; PAM sequence: GAG
cgggtctcctttccaggcta

SEQ ID NO: 96178 - DNA, 20 bp, Artificial Sequence
  Description of Artificial Sequence: Synthetic oligonucleotide
  Target: ATXN1; (-) strand; PAM type: NRG; PAM sequence: TAG
cgcgggtctcctttccaggc

SEQ ID NO: 96179 - DNA, 20 bp, Artificial Sequence
  Description of Artificial Sequence: Synthetic oligonucleotide
  Target: ATXN1; (-) strand; PAM type: NRG; PAM sequence: AGG
agtgcgcgggtctcctttcc

SEQ ID NO: 96180 - DNA, 20 bp, Artificial Sequence
  Description of Artificial Sequence: Synthetic oligonucleotide
  Target: ATXN1; (-) strand; PAM type: NRG; PAM sequence: CAG
gagtgcgcgggtctcctttc

SEQ ID NO: 96181 - DNA, 20 bp, Artificial Sequence
  Description of Artificial Sequence: Synthetic oligonucleotide
  Target: ATXN1; (-) strand; PAM type: NRG; PAM sequence: GGG
tagctgcgagaggagtgcgc

SEQ ID NO: 96182 - DNA, 20 bp, Artificial Sequence
  Description of Artificial Sequence: Synthetic oligonucleotide
  Target: ATXN1; (-) strand; PAM type: NRG; PAM sequence: CGG
ttagctgcgagaggagtgcg

SEQ ID NO: 96183 - DNA, 20 bp, Artificial Sequence
  Description of Artificial Sequence: Synthetic oligonucleotide
  Target: ATXN1; (-) strand; PAM type: NRG; PAM sequence: GAG
tccgaaattagctgcgagag

SEQ ID NO: 96184 - DNA, 20 bp, Artificial Sequence
  Description of Artificial Sequence: Synthetic oligonucleotide
  Target: ATXN1; (-) strand; PAM type: NRG; PAM sequence: AGG
gatccgaaattagctgcgag

SEQ ID NO: 96185 - DNA, 20 bp, Artificial Sequence
  Description of Artificial Sequence: Synthetic oligonucleotide
  Target: ATXN1; (-) strand; PAM type: NRG; PAM sequence: GAG
tgatccgaaattagctgcga

SEQ ID NO: 96186 - DNA, 20 bp, Artificial Sequence
  Description of Artificial Sequence: Synthetic oligonucleotide
  Target: ATXN1; (-) strand; PAM type: NRG; PAM sequence: GAG
aatgatccgaaattagctgc

SEQ ID NO: 96187 - DNA, 20 bp, Artificial Sequence
  Description of Artificial Sequence: Synthetic oligonucleotide
  Target: ATXN1; (-) strand; PAM type: NRG; PAM sequence: TAG
ttaaattaatgatccgaaat

SEQ ID NO: 96188 - DNA, 20 bp, Artificial Sequence
  Description of Artificial Sequence: Synthetic oligonucleotide
  Target: ATXN1; (-) strand; PAM type: NRG; PAM sequence: TGG
gctttctctgtctcctacac

SEQ ID NO: 96189 - DNA, 20 bp, Artificial Sequence
  Description of Artificial Sequence: Synthetic oligonucleotide
  Target: ATXN1; (-) strand; PAM type: NRG; PAM sequence: CGG
agaactgccatttgatgctc

SEQ ID NO: 96190 - DNA, 20 bp, Artificial Sequence
  Description of Artificial Sequence: Synthetic oligonucleotide
  Target: ATXN1; (-) strand; PAM type: NRG; PAM sequence: GAG
taagttcctcgtcgattctc

SEQ ID NO: 96191 - DNA, 20 bp, Artificial Sequence
  Description of Artificial Sequence: Synthetic oligonucleotide
  Target: ATXN1; (-) strand; PAM type: NRG; PAM sequence: AAG
gaaaccctgagtccagattt

SEQ ID NO: 96192 - DNA, 20 bp, Artificial Sequence
  Description of Artificial Sequence: Synthetic oligonucleotide
  Target: ATXN1; (-) strand; PAM type: NRG; PAM sequence: CAG
ccgcactgaaaccctgagtc

SEQ ID NO: 96193 - DNA, 20 bp, Artificial Sequence
  Description of Artificial Sequence: Synthetic oligonucleotide
  Target: ATXN1; (-) strand; PAM type: NRG; PAM sequence: GAG
ggagaccgcactgaaaccct

SEQ ID NO: 96194 - DNA, 20 bp, Artificial Sequence
  Description of Artificial Sequence: Synthetic oligonucleotide
  Target: ATXN1; (-) strand; PAM type: NRG; PAM sequence: GAG
gggcggggtggtgggagtcg

SEQ ID NO: 96195 - DNA, 20 bp, Artificial Sequence
  Description of Artificial Sequence: Synthetic oligonucleotide
  Target: ATXN1; (-) strand; PAM type: NRG; PAM sequence: CGG
aggggcggggtggtgggagt

SEQ ID NO: 96196 - DNA, 20 bp, Artificial Sequence
  Description of Artificial Sequence: Synthetic oligonucleotide
  Target: ATXN1; (-) strand; PAM type: NRG; PAM sequence: GAG
gcggaggggcggggtggtgg

SEQ ID NO: 96197 - DNA, 20 bp, Artificial Sequence
  Description of Artificial Sequence: Synthetic oligonucleotide
  Target: ATXN1; (-) strand; PAM type: NRG; PAM sequence: GGG
aggcggaggggcggggtggt

SEQ ID NO: 96198 - DNA, 20 bp, Artificial Sequence
  Description of Artificial Sequence: Synthetic oligonucleotide
  Target: ATXN1; (-) strand; PAM type: NRG; PAM sequence: TGG
caggcggaggggcggggtgg

SEQ ID NO: 96199 - DNA, 20 bp, Artificial Sequence
  Description of Artificial Sequence: Synthetic oligonucleotide
  Target: ATXN1; (-) strand; PAM type: NRG; PAM sequence: TGG
agacaggcggaggggcgggg

SEQ ID NO: 96200 - DNA, 20 bp, Artificial Sequence
  Description of Artificial Sequence: Synthetic oligonucleotide
  Target: ATXN1; (-) strand; PAM type: NRG; PAM sequence: GGG
gcgagacaggcggaggggcg

SEQ ID NO: 96201 - DNA, 20 bp, Artificial Sequence
  Description of Artificial Sequence: Synthetic oligonucleotide
  Target: ATXN1; (-) strand; PAM type: NRG; PAM sequence: GGG
ggcgagacaggcggaggggc

SEQ ID NO: 96202 - DNA, 20 bp, Artificial Sequence
  Description of Artificial Sequence: Synthetic oligonucleotide
  Target: ATXN1; (-) strand; PAM type: NRG; PAM sequence: CGG
cggcgagacaggcggagggg

SEQ ID NO: 96203 - DNA, 20 bp, Artificial Sequence
  Description of Artificial Sequence: Synthetic oligonucleotide
  Target: ATXN1; (-) strand; PAM type: NRG; PAM sequence: GGG
tggcggcgagacaggcggag

SEQ ID NO: 96204 - DNA, 20 bp, Artificial Sequence
  Description of Artificial Sequence: Synthetic oligonucleotide
  Target: ATXN1; (-) strand; PAM type: NRG; PAM sequence: GGG
ctggcggcgagacaggcgga

SEQ ID NO: 96205 - DNA, 20 bp, Artificial Sequence
  Description of Artificial Sequence: Synthetic oligonucleotide
  Target: ATXN1; (-) strand; PAM type: NRG; PAM sequence: AGG
cctggcggcgagacaggcgg

SEQ ID NO: 96206 - DNA, 20 bp, Artificial Sequence
  Description of Artificial Sequence: Synthetic oligonucleotide
  Target: ATXN1; (-) strand; PAM type: NRG; PAM sequence: GAG
acctggcggcgagacaggcg

SEQ ID NO: 96207 - DNA, 20 bp, Artificial Sequence
  Description of Artificial Sequence: Synthetic oligonucleotide
  Target: ATXN1; (-) strand; PAM type: NRG; PAM sequence: CGG
acacctggcggcgagacagg

SEQ ID NO: 96208 - DNA, 20 bp, Artificial Sequence
  Description of Artificial Sequence: Synthetic oligonucleotide
  Target: ATXN1; (-) strand; PAM type: NRG; PAM sequence: AGG
gtcacacctggcggcgagac

SEQ ID NO: 96209 - DNA, 20 bp, Artificial Sequence
  Description of Artificial Sequence: Synthetic oligonucleotide
  Target: ATXN1; (-) strand; PAM type: NRG; PAM sequence: CAG
ggtcacacctggcggcgaga

SEQ ID NO: 96210 - DNA, 20 bp, Artificial Sequence
  Description of Artificial Sequence: Synthetic oligonucleotide
  Target: ATXN1; (-) strand; PAM type: NRG; PAM sequence: GAG
tggaggtcacacctggcggc

SEQ ID NO: 96211 - DNA, 20 bp, Artificial Sequence
  Description of Artificial Sequence: Synthetic oligonucleotide
  Target: ATXN1; (-) strand; PAM type: NRG; PAM sequence: CGG
cgcgtggaggtcacacctgg

SEQ ID NO: 96212 - DNA, 20 bp, Artificial Sequence
  Description of Artificial Sequence: Synthetic oligonucleotide
  Target: ATXN1; (-) strand; PAM type: NRG; PAM sequence: TGG
cttcgcgtggaggtcacacc

SEQ ID NO: 96213 - DNA, 20 bp, Artificial Sequence
  Description of Artificial Sequence: Synthetic oligonucleotide
  Target: ATXN1; (-) strand; PAM type: NRG; PAM sequence: AGG
aagaagattccttcgcgtgg

SEQ ID NO: 96214 - DNA, 20 bp, Artificial Sequence
  Description of Artificial Sequence: Synthetic oligonucleotide
  Target: ATXN1; (-) strand; PAM type: NRG; PAM sequence: GAG
gaagaagattccttcgcgtg

SEQ ID NO: 96215 - DNA, 20 bp, Artificial Sequence
  Description of Artificial Sequence: Synthetic oligonucleotide
  Target: ATXN1; (-) strand; PAM type: NRG; PAM sequence: TGG
ccgaagaagattccttcgcg

SEQ ID NO: 96216 - DNA, 20 bp, Artificial Sequence
  Description of Artificial Sequence: Synthetic oligonucleotide
  Target: ATXN1; (-) strand; PAM type: NRG; PAM sequence: AAG
caaggtgcacccatccgaag

SEQ ID NO: 96217 - DNA, 20 bp, Artificial Sequence
  Description of Artificial Sequence: Synthetic oligonucleotide
  Target: ATXN1; (-) strand; PAM type: NRG; PAM sequence: AAG
tggcaaggtgcacccatccg

SEQ ID NO: 96218 - DNA, 20 bp, Artificial Sequence
  Description of Artificial Sequence: Synthetic oligonucleotide
  Target: ATXN1; (-) strand; PAM type: NRG; PAM sequence: AGG
aggtgccacacctgttggca

SEQ ID NO: 96219 - DNA, 20 bp, Artificial Sequence
  Description of Artificial Sequence: Synthetic oligonucleotide
  Target: ATXN1; (-) strand; PAM type: NRG; PAM sequence: AAG
caggtgccacacctgttggc

SEQ ID NO: 96220 - DNA, 20 bp, Artificial Sequence
  Description of Artificial Sequence: Synthetic oligonucleotide
  Target: ATXN1; (-) strand; PAM type: NRG; PAM sequence: TGG
cctccaggtgccacacctgt

SEQ ID NO: 96221 - DNA, 20 bp, Artificial Sequence
  Description of Artificial Sequence: Synthetic oligonucleotide
  Target: ATXN1; (-) strand; PAM type: NRG; PAM sequence: AGG
gaggcgcctcctagtcctcc

SEQ ID NO: 96222 - DNA, 20 bp, Artificial Sequence
  Description of Artificial Sequence: Synthetic oligonucleotide
  Target: ATXN1; (-) strand; PAM type: NRG; PAM sequence: CAG
ggaggcgcctcctagtcctc

SEQ ID NO: 96223 - DNA, 20 bp, Artificial Sequence
  Description of Artificial Sequence: Synthetic oligonucleotide
  Target: ATXN1; (-) strand; PAM type: NRG; PAM sequence: TAG
cttagtctggaggcgcctcc

SEQ ID NO: 96224 - DNA, 20 bp, Artificial Sequence
  Description of Artificial Sequence: Synthetic oligonucleotide
  Target: ATXN1; (-) strand; PAM type: NRG; PAM sequence: AGG
actgagcgcccttagtctgg

SEQ ID NO: 96225 - DNA, 20 bp, Artificial Sequence
  Description of Artificial Sequence: Synthetic oligonucleotide
  Target: ATXN1; (-) strand; PAM type: NRG; PAM sequence: GAG
cactgagcgcccttagtctg

SEQ ID NO: 96226 - DNA, 20 bp, Artificial Sequence
  Description of Artificial Sequence: Synthetic oligonucleotide
  Target: ATXN1; (-) strand; PAM type: NRG; PAM sequence: TGG
cgcactgagcgcccttagtc

SEQ ID NO: 96227 - DNA, 20 bp, Artificial Sequence
  Description of Artificial Sequence: Synthetic oligonucleotide
  Target: ATXN1; (-) strand; PAM type: NRG; PAM sequence: TAG
aacgccgcactgagcgccct

SEQ ID NO: 96228 - DNA, 20 bp, Artificial Sequence
  Description of Artificial Sequence: Synthetic oligonucleotide
  Target: ATXN1; (-) strand; PAM type: NRG; PAM sequence: GAG
tgcaacaagaacgccgcact

SEQ ID NO: 96229 - DNA, 20 bp, Artificial Sequence
  Description of Artificial Sequence: Synthetic oligonucleotide
  Target: ATXN1; (-) strand; PAM type: NRG; PAM sequence: AAG
cttccagaatcatctgcaac

SEQ ID NO: 96230 - DNA, 20 bp, Artificial Sequence
  Description of Artificial Sequence: Synthetic oligonucleotide
  Target: ATXN1; (-) strand; PAM type: NRG; PAM sequence: CAG
cccgacacctaccggccttc

SEQ ID NO: 96231 - DNA, 20 bp, Artificial Sequence
  Description of Artificial Sequence: Synthetic oligonucleotide
  Target: ATXN1; (-) strand; PAM type: NRG; PAM sequence: CGG
aaatgtcgcccgacacctac

SEQ ID NO: 96232 - DNA, 20 bp, Artificial Sequence
  Description of Artificial Sequence: Synthetic oligonucleotide
  Target: ATXN1; (-) strand; PAM type: NRG; PAM sequence: AGG
tagttctaagcacctgaaga

SEQ ID NO: 96233 - DNA, 20 bp, Artificial Sequence
  Description of Artificial Sequence: Synthetic oligonucleotide
  Target: ATXN1; (-) strand; PAM type: NRG; PAM sequence: AAG
ttagttctaagcacctgaag

SEQ ID NO: 96234 - DNA, 20 bp, Artificial Sequence
  Description of Artificial Sequence: Synthetic oligonucleotide
  Target: ATXN1; (-) strand; PAM type: NRG; PAM sequence: AAG
cacttagttctaagcacctg

SEQ ID NO: 96235 - DNA, 20 bp, Artificial Sequence
  Description of Artificial Sequence: Synthetic oligonucleotide
  Target: ATXN1; (-) strand; PAM type: NRG; PAM sequence: AAG
gtttccagacacttagttct

SEQ ID NO: 96236 - DNA, 20 bp, Artificial Sequence
  Description of Artificial Sequence: Synthetic oligonucleotide
  Target: ATXN1; (-) strand; PAM type: NRG; PAM sequence: TAG
ggatcatgtttccagacact

SEQ ID NO: 96237 - DNA, 20 bp, Artificial Sequence
  Description of Artificial Sequence: Synthetic oligonucleotide
  Target: ATXN1; (-) strand; PAM type: NRG; PAM sequence: CAG
acgcgaaaggatcatgtttc

SEQ ID NO: 96238 - DNA, 20 bp, Artificial Sequence
  Description of Artificial Sequence: Synthetic oligonucleotide
  Target: ATXN1; (-) strand; PAM type: NRG; PAM sequence: AGG
cagaaagaaacttacgcgaa

SEQ ID NO: 96239 - DNA, 20 bp, Artificial Sequence
  Description of Artificial Sequence: Synthetic oligonucleotide
  Target: ATXN1; (-) strand; PAM type: NRG; PAM sequence: AAG
tcagaaagaaacttacgcga

SEQ ID NO: 96240 - DNA, 20 bp, Artificial Sequence
  Description of Artificial Sequence: Synthetic oligonucleotide
  Target: ATXN1; (-) strand; PAM type: NRG; PAM sequence: AAG
caagattggtggctttcaga

SEQ ID NO: 96241 - DNA, 20 bp, Artificial Sequence
  Description of Artificial Sequence: Synthetic oligonucleotide
  Target: ATXN1; (-) strand; PAM type: NRG; PAM sequence: CAG
cagtcaagattggtggcttt

SEQ ID NO: 96242 - DNA, 20 bp, Artificial Sequence
  Description of Artificial Sequence: Synthetic oligonucleotide
  Target: ATXN1; (-) strand; PAM type: NRG; PAM sequence: TGG
cagcttacagtcaagattgg

SEQ ID NO: 96243 - DNA, 20 bp, Artificial Sequence
  Description of Artificial Sequence: Synthetic oligonucleotide
  Target: ATXN1; (-) strand; PAM type: NRG; PAM sequence: TGG
atacagcttacagtcaagat

SEQ ID NO: 96244 - DNA, 20 bp, Artificial Sequence
  Description of Artificial Sequence: Synthetic oligonucleotide
  Target: ATXN1; (-) strand; PAM type: NRG; PAM sequence: AAG
ctcaaatacagcttacagtc

SEQ ID NO: 96245 - DNA, 20 bp, Artificial Sequence
  Description of Artificial Sequence: Synthetic oligonucleotide
  Target: ATXN1; (-) strand; PAM type: NRG; PAM sequence: CAG
gatctctcaaatacagctta

SEQ ID NO: 96246 - DNA, 20 bp, Artificial Sequence
  Description of Artificial Sequence: Synthetic oligonucleotide
  Target: ATXN1; (-) strand; PAM type: NRG; PAM sequence: CAG
gccaaaagatctctcaaata

SEQ ID NO: 96247 - DNA, 20 bp, Artificial Sequence
  Description of Artificial Sequence: Synthetic oligonucleotide
  Target: ATXN1; (-) strand; PAM type: NRG; PAM sequence: AAG
tcataagtaaactcagccaa

SEQ ID NO: 96248 - DNA, 20 bp, Artificial Sequence
  Description of Artificial Sequence: Synthetic oligonucleotide
  Target: ATXN1; (-) strand; PAM type: NRG; PAM sequence: CAG
cgttaggtcataagtaaact

SEQ ID NO: 96249 - DNA, 20 bp, Artificial Sequence
  Description of Artificial Sequence: Synthetic oligonucleotide
  Target: ATXN1; (-) strand; PAM type: NRG; PAM sequence: AAG
gtgactaaccgttaggtcat

SEQ ID NO: 96250 - DNA, 20 bp, Artificial Sequence
  Description of Artificial Sequence: Synthetic oligonucleotide
  Target: ATXN1; (-) strand; PAM type: NRG; PAM sequence: AGG
tcagttggtgactaaccgtt

SEQ ID NO: 96251 - DNA, 20 bp, Artificial Sequence
  Description of Artificial Sequence: Synthetic oligonucleotide
  Target: ATXN1; (-) strand; PAM type: NRG; PAM sequence: TAG
ctcagttggtgactaaccgt

SEQ ID NO: 96252 - DNA, 20 bp, Artificial Sequence
  Description of Artificial Sequence: Synthetic oligonucleotide
  Target: ATXN1; (-) strand; PAM type: NRG; PAM sequence: TGG
atcctgtgccctgcctcagt

SEQ ID NO: 96253 - DNA, 20 bp, Artificial Sequence
  Description of Artificial Sequence: Synthetic oligonucleotide
  Target: ATXN1; (-) strand; PAM type: NRG; PAM sequence: CAG
ggtcatcctgtgccctgcct

SEQ ID NO: 96254 - DNA, 20 bp, Artificial Sequence
  Description of Artificial Sequence: Synthetic oligonucleotide
  Target: ATXN1; (-) strand; PAM type: NRG; PAM sequence: TGG
aaaaactgacactttttttt

SEQ ID NO: 96255 - DNA, 20 bp, Artificial Sequence
  Description of Artificial Sequence: Synthetic oligonucleotide
  Target: ATXN1; (-) strand; PAM type: NRG; PAM sequence: GAG
acgtaggctcttgcaggcca

SEQ ID NO: 96256 - DNA, 20 bp, Artificial Sequence
  Description of Artificial Sequence: Synthetic oligonucleotide
  Target: ATXN1; (-) strand; PAM type: NRG; PAM sequence: CAG
gcacgtaggctcttgcaggc

SEQ ID NO: 96257 - DNA, 20 bp, Artificial Sequence
  Description of Artificial Sequence: Synthetic oligonucleotide
  Target: ATXN1; (-) strand; PAM type: NRG; PAM sequence: AGG
tgaagcacgtaggctcttgc

SEQ ID NO: 96258 - DNA, 20 bp, Artificial Sequence
  Description of Artificial Sequence: Synthetic oligonucleotide
  Target: ATXN1; (-) strand; PAM type: NRG; PAM sequence: CAG
atgaagcacgtaggctcttg

SEQ ID NO: 96259 - DNA, 20 bp, Artificial Sequence
  Description of Artificial Sequence: Synthetic oligonucleotide
  Target: ATXN1; (-) strand; PAM type: NRG; PAM sequence: AGG
tttttatttatgaagcacgt

SEQ ID NO: 96260 - DNA, 20 bp, Artificial Sequence
  Description of Artificial Sequence: Synthetic oligonucleotide
  Target: ATXN1; (-) strand; PAM type: NRG; PAM sequence: TAG
atttttatttatgaagcacg

SEQ ID NO: 96261 - DNA, 20 bp, Artificial Sequence
  Description of Artificial Sequence: Synthetic oligonucleotide
  Target: ATXN1; (-) strand; PAM type: NRG; PAM sequence: AAG
tatgtttatttttatttatg

SEQ ID NO: 96262 - DNA, 20 bp, Artificial Sequence
  Description of Artificial Sequence: Synthetic oligonucleotide
  Target: ATXN1; (-) strand; PAM type: NRG; PAM sequence: GGG
gtgagaaaaaaatatttccg

SEQ ID NO: 96263 - DNA, 20 bp, Artificial Sequence
  Description of Artificial Sequence: Synthetic oligonucleotide
  Target: ATXN1; (-) strand; PAM type: NRG; PAM sequence: GGG
tgtgagaaaaaaatatttcc

SEQ ID NO: 96264 - DNA, 20 bp, Artificial Sequence
  Description of Artificial Sequence: Synthetic oligonucleotide
  Target: ATXN1; (-) strand; PAM type: NRG; PAM sequence: CGG
atgtgagaaaaaaatatttc

SEQ ID NO: 96265 - DNA, 20 bp, Artificial Sequence
  Description of Artificial Sequence: Synthetic oligonucleotide
  Target: ATXN1; (-) strand; PAM type: NRG; PAM sequence: GAG
gcatggtatttcaaaaatgt

SEQ ID NO: 96266 - DNA, 20 bp, Artificial Sequence
  Description of Artificial Sequence: Synthetic oligonucleotide
  Target: ATXN1; (-) strand; PAM type: NRG; PAM sequence: TGG
aatagccacatatatgtgca

SEQ ID NO: 96267 - DNA, 20 bp, Artificial Sequence
  Description of Artificial Sequence: Synthetic oligonucleotide
  Target: ATXN1; (-) strand; PAM type: NRG; PAM sequence: TAG
cactagtagttatacttaaa

SEQ ID NO: 96268 - DNA, 20 bp, Artificial Sequence
  Description of Artificial Sequence: Synthetic oligonucleotide
  Target: ATXN1; (-) strand; PAM type: NRG; PAM sequence: TAG
tgagtaagagtgaacactag

SEQ ID NO: 96269 - DNA, 20 bp, Artificial Sequence
  Description of Artificial Sequence: Synthetic oligonucleotide
  Target: ATXN1; (-) strand; PAM type: NRG; PAM sequence: TAG
aaatgagtaagagtgaacac

SEQ ID NO: 96270 - DNA, 20 bp, Artificial Sequence
  Description of Artificial Sequence: Synthetic oligonucleotide
  Target: ATXN1; (-) strand; PAM type: NRG; PAM sequence: GAG
aaagttgtagaaatgagtaa

SEQ ID NO: 96271 - DNA, 20 bp, Artificial Sequence
  Description of Artificial Sequence: Synthetic oligonucleotide
  Target: ATXN1; (-) strand; PAM type: NRG; PAM sequence: AAG
aaaaagttgtagaaatgagt

SEQ ID NO: 96272 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaagttgtagaaat

SEQ ID NO: 96273 - DNA, 20 bp, Artificial Sequence
  Description of Artificial Sequence: Synthetic oligonucleotide
  Target: ATXN1; (-) strand; PAM type: NRG; PAM sequence: TAG
aaatggaaaaaaaaaagttg

SEQ ID NO: 96274 - DNA, 20 bp, Artificial Sequence
  Description of Artificial Sequence: Synthetic oligonucleotide
  Target: ATXN1; (-) strand; PAM type: NRG; PAM sequence: AAG
atttttaaatggaaaaaaaa

SEQ ID NO: 96275 - DNA, 20 bp, Artificial Sequence
  Description of Artificial Sequence: Synthetic oligonucleotide
  Target: ATXN1; (-) strand; PAM type: NRG; PAM sequence: TGG
aacaataatcgatttttaaa

SEQ ID NO: 96276 - DNA, 20 bp, Artificial Sequence
  Description of Artificial Sequence: Synthetic oligonucleotide
  Target: ATXN1; (-) strand; PAM type: NRG; PAM sequence: AGG
tgtcactttagaccaacccg

SEQ ID NO: 96277 - DNA, 20 bp, Artificial Sequence
  Description of Artificial Sequence: Synthetic oligonucleotide
  Target: ATXN1; (-) strand; PAM type: NRG; PAM sequence: GAG
atgtcactttagaccaaccc

SEQ ID NO: 96278 - DNA, 20 bp, Artificial Sequence
  Description of Artificial Sequence: Synthetic oligonucleotide
  Target: ATXN1; (-) strand; PAM type: NRG; PAM sequence: TAG
tgagaccaacaatgtcactt

SEQ ID NO: 96279 - DNA, 20 bp, Artificial Sequence
  Description of Artificial Sequence: Synthetic oligonucleotide
  Target: ATXN1; (-) strand; PAM type: NRG; PAM sequence: GAG
tgtccactagaggctgtaat

SEQ ID NO: 96280 - DNA, 20 bp, Artificial Sequence
  Description of Artificial Sequence: Synthetic oligonucleotide
  Target: ATXN1; (-) strand; PAM type: NRG; PAM sequence: AGG
tgatgttaactgtccactag

SEQ ID NO: 96281 - DNA, 20 bp, Artificial Sequence
  Description of Artificial Sequence: Synthetic oligonucleotide
  Target: ATXN1; (-) strand; PAM type: NRG; PAM sequence: GAG
ctgatgttaactgtccacta

SEQ ID NO: 96282 - DNA, 20 bp, Artificial Sequence
  Description of Artificial Sequence: Synthetic oligonucleotide
  Target: ATXN1; (-) strand; PAM type: NRG; PAM sequence: TAG
aactgatgttaactgtccac

SEQ ID NO: 96283 - DNA, 20 bp, Artificial Sequence
  Description of Artificial Sequence: Synthetic oligonucleotide
  Target: ATXN1; (-) strand; PAM type: NRG; PAM sequence: AGG
aaaccagtcagagccttttc

SEQ ID NO: 96284 - DNA, 20 bp, Artificial Sequence
  Description of Artificial Sequence: Synthetic oligonucleotide
  Target: ATXN1; (-) strand; PAM type: NRG; PAM sequence: CAG
aaaaccagtcagagcctttt

SEQ ID NO: 96285 - DNA, 20 bp, Artificial Sequence
  Description of Artificial Sequence: Synthetic oligonucleotide
  Target: ATXN1; (-) strand; PAM type: NRG; PAM sequence: GAG
aacgaaaacaaaaccagtca

SEQ ID NO: 96286 - DNA, 20 bp, Artificial Sequence
  Description of Artificial Sequence: Synthetic oligonucleotide
  Target: ATXN1; (-) strand; PAM type: NRG; PAM sequence: CAG
tcaacgaaaacaaaaccagt

SEQ ID NO: 96287 - DNA, 20 bp, Artificial Sequence
  Description of Artificial Sequence: Synthetic oligonucleotide
  Target: ATXN1; (-) strand; PAM type: NRG; PAM sequence: CAG
cttgtcaacgaaaacaaaac

SEQ ID NO: 96288 - DNA, 20 bp, Artificial Sequence
  Description of Artificial Sequence: Synthetic oligonucleotide
  Target: ATXN1; (-) strand; PAM type: NRG; PAM sequence: AAG
tactaaccttcaccttgaca

SEQ ID NO: 96289 - DNA, 20 bp, Artificial Sequence
  Description of Artificial Sequence: Synthetic oligonucleotide
  Target: ATXN1; (-) strand; PAM type: NRG; PAM sequence: CGG
gggtgaggggacattttacc

SEQ ID NO: 96290 - DNA, 20 bp, Artificial Sequence
  Description of Artificial Sequence: Synthetic oligonucleotide
  Target: ATXN1; (-) strand; PAM type: NRG; PAM sequence: GGG
ggggtgaggataggggtgag

SEQ ID NO: 96291 - DNA, 20 bp, Artificial Sequence
  Description of Artificial Sequence: Synthetic oligonucleotide
  Target: ATXN1; (-) strand; PAM type: NRG; PAM sequence: GGG
gggggtgaggataggggtga

SEQ ID NO: 96292 - DNA, 20 bp, Artificial Sequence
  Description of Artificial Sequence: Synthetic oligonucleotide
  Target: ATXN1; (-) strand; PAM type: NRG; PAM sequence: AGG
cgggggtgaggataggggtg

SEQ ID NO: 96293 - DNA, 20 bp, Artificial Sequence
  Description of Artificial Sequence: Synthetic oligonucleotide
  Target: ATXN1; (-) strand; PAM type: NRG; PAM sequence: GAG
gcgggggtgaggataggggt

SEQ ID NO: 96294 - DNA, 20 bp, Artificial Sequence
  Description of Artificial Sequence: Synthetic oligonucleotide
  Target: ATXN1; (-) strand; PAM type: NRG; PAM sequence: GGG
gggggcgggggtgaggatag

SEQ ID NO: 96295 - DNA, 20 bp, Artificial Sequence
  Description of Artificial Sequence: Synthetic oligonucleotide
  Target: ATXN1; (-) strand; PAM type: NRG; PAM sequence: GGG
tgggggcgggggtgaggata

SEQ ID NO: 96296 - DNA, 20 bp, Artificial Sequence
  Description of Artificial Sequence: Synthetic oligonucleotide
  Target: ATXN1; (-) strand; PAM type: NRG; PAM sequence: AGG
ttgggggcgggggtgaggat

SEQ ID NO: 96297 - DNA, 20 bp, Artificial Sequence
  Description of Artificial Sequence: Synthetic oligonucleotide
  Target: ATXN1; (-) strand; PAM type: NRG; PAM sequence: TAG
gttgggggcgggggtgagga

SEQ ID NO: 96298 - DNA, 20 bp, Artificial Sequence
  Description of Artificial Sequence: Synthetic oligonucleotide
  Target: ATXN1; (-) strand; PAM type: NRG; PAM sequence: AGG
gggtgttgggggcgggggtg

SEQ ID NO: 96299 - DNA, 20 bp, Artificial Sequence
  Description of Artificial Sequence: Synthetic oligonucleotide
  Target: ATXN1; (-) strand; PAM type: NRG; PAM sequence: GAG
agggtgttgggggcgggggt

SEQ ID NO: 96300 - DNA, 20 bp, Artificial Sequence
  Description of Artificial Sequence: Synthetic oligonucleotide
  Target: ATXN1; (-) strand; PAM type: NRG; PAM sequence: GGG
aagcagggtgttgggggcgg

SEQ ID NO: 96301 - DNA, 20 bp, Artificial Sequence
  Description of Artificial Sequence: Synthetic oligonucleotide
  Target: ATXN1; (-) strand; PAM type: NRG; PAM sequence: GGG
caagcagggtgttgggggcg

SEQ ID NO: 96302 - DNA, 20 bp, Artificial Sequence
  Description of Artificial Sequence: Synthetic oligonucleotide
  Target: ATXN1; (-) strand; PAM type: NRG; PAM sequence: GGG
ccaagcagggtgttgggggc

SEQ ID NO: 96303 - DNA, 20 bp, Artificial Sequence
  Description of Artificial Sequence: Synthetic oligonucleotide
  Target: ATXN1; (-) strand; PAM type: NRG; PAM sequence: CGG
gccaagcagggtgttggggg

SEQ ID NO: 96304 - DNA, 20 bp, Artificial Sequence
  Description of Artificial Sequence: Synthetic oligonucleotide
  Target: ATXN1; (-) strand; PAM type: NRG; PAM sequence: GGG
tttgccaagcagggtgttgg

SEQ ID NO: 96305 - DNA, 20 bp, Artificial Sequence
  Description of Artificial Sequence: Synthetic oligonucleotide
  Target: ATXN1; (-) strand; PAM type: NRG; PAM sequence: GGG
ctttgccaagcagggtgttg

SEQ ID NO: 96306 - DNA, 20 bp, Artificial Sequence
  Description of Artificial Sequence: Synthetic oligonucleotide
  Target: ATXN1; (-) strand; PAM type: NRG; PAM sequence: GGG
tctttgccaagcagggtgtt

SEQ ID NO: 96307 - DNA, 20 bp, Artificial Sequence
  Description of Artificial Sequence: Synthetic oligonucleotide
  Target: ATXN1; (-) strand; PAM type: NRG; PAM sequence: TGG
gtctttgccaagcagggtgt

SEQ ID NO: 96308 - DNA, 20 bp, Artificial Sequence
  Description of Artificial Sequence: Synthetic oligonucleotide
  Target: ATXN1; (-) strand; PAM type: NRG; PAM sequence: GGG
gaagtcgtctttgccaagca

SEQ ID NO: 96309 - DNA, 20 bp, Artificial Sequence
  Description of Artificial Sequence: Synthetic oligonucleotide
  Target: ATXN1; (-) strand; PAM type: NRG; PAM sequence: AGG
tgaagtcgtctttgccaagc

SEQ ID NO: 96310 - DNA, 20 bp, Artificial Sequence
  Description of Artificial Sequence: Synthetic oligonucleotide
  Target: ATXN1; (-) strand; PAM type: NRG; PAM sequence: CAG
ctgaagtcgtctttgccaag

SEQ ID NO: 96311 - DNA, 20 bp, Artificial Sequence
  Description of Artificial Sequence: Synthetic oligonucleotide
  Target: ATXN1; (-) strand; PAM type: NRG; PAM sequence: AAG
tttctgaagtcgtctttgcc

SEQ ID NO: 96312 - DNA, 20 bp, Artificial Sequence
  Description of Artificial Sequence: Synthetic oligonucleotide
  Target: ATXN1; (-) strand; PAM type: NRG; PAM sequence: AAG
caagcttctgctcctttctg

SEQ ID NO: 96313 - DNA, 20 bp, Artificial Sequence
  Description of Artificial Sequence: Synthetic oligonucleotide
  Target: ATXN1; (-) strand; PAM type: NRG; PAM sequence: AAG
cttttctatataaagccaac

SEQ ID NO: 96314 - DNA, 20 bp, Artificial Sequence
  Description of Artificial Sequence: Synthetic oligonucleotide
  Target: ATXN1; (-) strand; PAM type: NRG; PAM sequence: AAG
gcatacgtcttttctatata

SEQ ID NO: 96315 - DNA, 20 bp, Artificial Sequence
  Description of Artificial Sequence: Synthetic oligonucleotide
  Target: ATXN1; (-) strand; PAM type: NRG; PAM sequence: AAG
ataataatacctgcagcaca

SEQ ID NO: 96316 - DNA, 20 bp, Artificial Sequence
  Description of Artificial Sequence: Synthetic oligonucleotide
  Target: ATXN1; (-) strand; PAM type: NRG; PAM sequence: CAG
tccagtaataataatacctg

SEQ ID NO: 96317 - DNA, 20 bp, Artificial Sequence
  Description of Artificial Sequence: Synthetic oligonucleotide
  Target: ATXN1; (-) strand; PAM type: NRG; PAM sequence: CAG
ctttctgtttattcacagtc

SEQ ID NO: 96318 - DNA, 20 bp, Artificial Sequence
  Description of Artificial Sequence: Synthetic oligonucleotide
  Target: ATXN1; (-) strand; PAM type: NRG; PAM sequence: CAG
agaagctttctgtttattca

SEQ ID NO: 96319 - DNA, 20 bp, Artificial Sequence
  Description of Artificial Sequence: Synthetic oligonucleotide
  Target: ATXN1; (-) strand; PAM type: NRG; PAM sequence: AAG
gaaactgaaatgaatagcag

SEQ ID NO: 96320 - DNA, 20 bp, Artificial Sequence
  Description of Artificial Sequence: Synthetic oligonucleotide
  Target: ATXN1; (-) strand; PAM type: NRG; PAM sequence: CAG
tctgaaactgaaatgaatag

SEQ ID NO: 96321 - DNA, 20 bp, Artificial Sequence
  Description of Artificial Sequence: Synthetic oligonucleotide
  Target: ATXN1; (-) strand; PAM type: NRG; PAM sequence: TAG
ctgtctgaaactgaaatgaa

SEQ ID NO: 96322 - DNA, 20 bp, Artificial Sequence
  Description of Artificial Sequence: Synthetic oligonucleotide
  Target: ATXN1; (-) strand; PAM type: NRG; PAM sequence: AAG
gatgaatttagtttttatga

SEQ ID NO: 96323 - DNA, 20 bp, Artificial Sequence
  Description of Artificial Sequence: Synthetic oligonucleotide
  Target: ATXN1; (-) strand; PAM type: NRG; PAM sequence: TAG
aaaaatatttgagatgaatt

SEQ ID NO: 96324 - DNA, 20 bp, Artificial Sequence
  Description of Artificial Sequence: Synthetic oligonucleotide
  Target: ATXN1; (-) strand; PAM type: NRG; PAM sequence: GAG
tttctgttataaaaatattt

SEQ ID NO: 96325 - DNA, 20 bp, Artificial Sequence
  Description of Artificial Sequence: Synthetic oligonucleotide
  Target: ATXN1; (-) strand; PAM type: NRG; PAM sequence: TGG
tcgcagttaagccaaaaaca

SEQ ID NO: 96326 - DNA, 20 bp, Artificial Sequence
  Description of Artificial Sequence: Synthetic oligonucleotide
  Target: ATXN1; (-) strand; PAM type: NRG; PAM sequence: AAG
ggaataaaaacatcgcagtt

SEQ ID NO: 96327 - DNA, 20 bp, Artificial Sequence
  Description of Artificial Sequence: Synthetic oligonucleotide
  Target: ATXN1; (-) strand; PAM type: NRG; PAM sequence: CAG
gagttggaataaaaacatcg

SEQ ID NO: 96328 - DNA, 20 bp, Artificial Sequence
  Description of Artificial Sequence: Synthetic oligonucleotide
  Target: ATXN1; (-) strand; PAM type: NRG; PAM sequence: TGG
acagtttgcagattatgagt

SEQ ID NO: 96329 - DNA, 20 bp, Artificial Sequence
  Description of Artificial Sequence: Synthetic oligonucleotide
  Target: ATXN1; (-) strand; PAM type: NRG; PAM sequence: GAG
ttggacagtttgcagattat

SEQ ID NO: 96330 - DNA, 20 bp, Artificial Sequence
  Description of Artificial Sequence: Synthetic oligonucleotide
  Target: ATXN1; (-) strand; PAM type: NRG; PAM sequence: CAG
gaggtggattggacagtttg

SEQ ID NO: 96331 - DNA, 20 bp, Artificial Sequence
  Description of Artificial Sequence: Synthetic oligonucleotide
  Target: ATXN1; (-) strand; PAM type: NRG; PAM sequence: CAG
tagagtggaggtggattgga

SEQ ID NO: 96332 - DNA, 20 bp, Artificial Sequence
  Description of Artificial Sequence: Synthetic oligonucleotide
  Target: ATXN1; (-) strand; PAM type: NRG; PAM sequence: TGG
aaaatagagtggaggtggat

SEQ ID NO: 96333 - DNA, 20 bp, Artificial Sequence
  Description of Artificial Sequence: Synthetic oligonucleotide
  Target: ATXN1; (-) strand; PAM type: NRG; PAM sequence: TGG
gtctaaaaatagagtggagg

SEQ ID NO: 96334 - DNA, 20 bp, Artificial Sequence
  Description of Artificial Sequence: Synthetic oligonucleotide
  Target: ATXN1; (-) strand; PAM type: NRG; PAM sequence: AGG
gatgtctaaaaatagagtgg

SEQ ID NO: 96335 - DNA, 20 bp, Artificial Sequence
  Description of Artificial Sequence: Synthetic oligonucleotide
  Target: ATXN1; (-) strand; PAM type: NRG; PAM sequence: GAG
agatgtctaaaaatagagtg

SEQ ID NO: 96336 - DNA, 20 bp, Artificial Sequence
  Description of Artificial Sequence: Synthetic oligonucleotide
  Target: ATXN1; (-) strand; PAM type: NRG; PAM sequence: TGG
taagatgtctaaaaatagag

SEQ ID NO: 96337 - DNA, 20 bp, Artificial Sequence
  Description of Artificial Sequence: Synthetic oligonucleotide
  Target: ATXN1; (-) strand; PAM type: NRG; PAM sequence: GAG
atgtaagatgtctaaaaata

SEQ ID NO: 96338 - DNA, 20 bp, Artificial Sequence
  Description of Artificial Sequence: Synthetic oligonucleotide
  Target: ATXN1; (-) strand; PAM type: NRG; PAM sequence: TAG
aaatgtaagatgtctaaaaa

SEQ ID NO: 96339 - DNA, 20 bp, Artificial Sequence
  Description of Artificial Sequence: Synthetic oligonucleotide
  Target: ATXN1; (-) strand; PAM type: NRG; PAM sequence: AAG
actgaaaattatctaaatgt

SEQ ID NO: 96340 - DNA, 20 bp, Artificial Sequence
  Description of Artificial Sequence: Synthetic oligonucleotide
  Target: ATXN1; (-) strand; PAM type: NRG; PAM sequence: TAG
ccaacgtaaaattacaatat

SEQ ID NO: 96341 - DNA, 20 bp, Artificial Sequence
  Description of Artificial Sequence: Synthetic oligonucleotide
  Target: ATXN1; (-) strand; PAM type: NRG; PAM sequence: AGG
gaattatgtgttttaattta

SEQ ID NO: 96342 - DNA, 20 bp, Artificial Sequence
  Description of Artificial Sequence: Synthetic oligonucleotide
  Target: ATXN1; (-) strand; PAM type: NRG; PAM sequence: AAG
tgaattatgtgttttaattt

SEQ ID NO: 96343 - DNA, 20 bp, Artificial Sequence
  Description of Artificial Sequence: Synthetic oligonucleotide
  Target: ATXN1; (-) strand; PAM type: NRG; PAM sequence: GAG
tacatatttagcttccttga

SEQ ID NO: 96344 - DNA, 20 bp, Artificial Sequence
  Description of Artificial Sequence: Synthetic oligonucleotide
  Target: ATXN1; (-) strand; PAM type: NRG; PAM sequence: GAG
tatacatatttagcttcctt

SEQ ID NO: 96345 - DNA, 20 bp, Artificial Sequence
  Description of Artificial Sequence: Synthetic oligonucleotide
  Target: ATXN1; (-) strand; PAM type: NRG; PAM sequence: TAG
atttgggtaatatacatatt

SEQ ID NO: 96346 - DNA, 20 bp, Artificial Sequence
  Description of Artificial Sequence: Synthetic oligonucleotide
  Target: ATXN1; (-) strand; PAM type: NRG; PAM sequence: GGG
attaattgtttttaccattt

SEQ ID NO: 96347 - DNA, 20 bp, Artificial Sequence
  Description of Artificial Sequence: Synthetic oligonucleotide
  Target: ATXN1; (-) strand; PAM type: NRG; PAM sequence: TGG
tattaattgtttttaccatt

SEQ ID NO: 96348 - DNA, 20 bp, Artificial Sequence
  Description of Artificial Sequence: Synthetic oligonucleotide
  Target: ATXN1; (-) strand; PAM type: NRG; PAM sequence: AAG
tttaaacttaatggctaaga

SEQ ID NO: 96349 - DNA, 20 bp, Artificial Sequence
  Description of Artificial Sequence: Synthetic oligonucleotide
  Target: ATXN1; (-) strand; PAM type: NRG; PAM sequence: AAG
tggctttaaacttaatggct

SEQ ID NO: 96350 - DNA, 20 bp, Artificial Sequence
  Description of Artificial Sequence: Synthetic oligonucleotide
  Target: ATXN1; (-) strand; PAM type: NRG; PAM sequence: TGG
gtttatggctttaaacttaa

SEQ ID NO: 96351 - DNA, 20 bp, Artificial Sequence
  Description of Artificial Sequence: Synthetic oligonucleotide
  Target: ATXN1; (-) strand; PAM type: NRG; PAM sequence: TGG
cagattttggtggcagttta

SEQ ID NO: 96352 - DNA, 20 bp, Artificial Sequence
  Description of Artificial Sequence: Synthetic oligonucleotide
  Target: ATXN1; (-) strand; PAM type: NRG; PAM sequence: CAG
atagttacagattttggtgg

SEQ ID NO: 96353 - DNA, 20 bp, Artificial Sequence
  Description of Artificial Sequence: Synthetic oligonucleotide
  Target: ATXN1; (-) strand; PAM type: NRG; PAM sequence: TGG
gaaatagttacagattttgg

SEQ ID NO: 96354 - DNA, 20 bp, Artificial Sequence
  Description of Artificial Sequence: Synthetic oligonucleotide
  Target: ATXN1; (-) strand; PAM type: NRG; PAM sequence: TGG
gaagaaatagttacagattt

SEQ ID NO: 96355 - DNA, 20 bp, Artificial Sequence
  Description of Artificial Sequence: Synthetic oligonucleotide
  Target: ATXN1; (-) strand; PAM type: NRG; PAM sequence: CAG
cttgcaggaagaaatagtta

SEQ ID NO: 96356 - DNA, 20 bp, Artificial Sequence
  Description of Artificial Sequence: Synthetic oligonucleotide
  Target: ATXN1; (-) strand; PAM type: NRG; PAM sequence: TAG
ttggatcttgcaggaagaaa

SEQ ID NO: 96357 - DNA, 20 bp, Artificial Sequence
  Description of Artificial Sequence: Synthetic oligonucleotide
  Target: ATXN1; (-) strand; PAM type: NRG; PAM sequence: AAG
tttatgttggatcttgcagg

SEQ ID NO: 96358 - DNA, 20 bp, Artificial Sequence
  Description of Artificial Sequence: Synthetic oligonucleotide
  Target: ATXN1; (-) strand; PAM type: NRG; PAM sequence: AGG
gtgtttatgttggatcttgc

SEQ ID NO: 96359 - DNA, 20 bp, Artificial Sequence
  Description of Artificial Sequence: Synthetic oligonucleotide
  Target: ATXN1; (-) strand; PAM type: NRG; PAM sequence: CAG
ggtgtttatgttggatcttg

SEQ ID NO: 96360 - DNA, 20 bp, Artificial Sequence
  Description of Artificial Sequence: Synthetic oligonucleotide
  Target: ATXN1; (-) strand; PAM type: NRG; PAM sequence: TGG
catgagtatggtgtttatgt

SEQ ID NO: 96361 - DNA, 20 bp, Artificial Sequence
  Description of Artificial Sequence: Synthetic oligonucleotide
  Target: ATXN1; (-) strand; PAM type: NRG; PAM sequence: TGG
atgagacagtttcatgagta

SEQ ID NO: 96362 - DNA, 20 bp, Artificial Sequence
  Description of Artificial Sequence: Synthetic oligonucleotide
  Target: ATXN1; (-) strand; PAM type: NRG; PAM sequence: GAG
aggtaatgagacagtttcat

SEQ ID NO: 96363 - DNA, 20 bp, Artificial Sequence
  Description of Artificial Sequence: Synthetic oligonucleotide
  Target: ATXN1; (-) strand; PAM type: NRG; PAM sequence: CAG
cagtactaaaggtaatgaga

SEQ ID NO: 96364 - DNA, 20 bp, Artificial Sequence
  Description of Artificial Sequence: Synthetic oligonucleotide
  Target: ATXN1; (-) strand; PAM type: NRG; PAM sequence: GAG
atttcagtactaaaggtaat

SEQ ID NO: 96365 - DNA, 20 bp, Artificial Sequence
  Description of Artificial Sequence: Synthetic oligonucleotide
  Target: ATXN1; (-) strand; PAM type: NRG; PAM sequence: AGG
acaaaatatttcagtactaa

SEQ ID NO: 96366 - DNA, 20 bp, Artificial Sequence
  Description of Artificial Sequence: Synthetic oligonucleotide
  Target: ATXN1; (-) strand; PAM type: NRG; PAM sequence: AAG
aacaaaatatttcagtacta

SEQ ID NO: 96367 - DNA, 20 bp, Artificial Sequence
  Description of Artificial Sequence: Synthetic oligonucleotide
  Target: ATXN1; (-) strand; PAM type: NRG; PAM sequence: CAG
catctgaaaacaaaatattt

SEQ ID NO: 96368 - DNA, 20 bp, Artificial Sequence
  Description of Artificial Sequence: Synthetic oligonucleotide
  Target: ATXN1; (-) strand; PAM type: NRG; PAM sequence: CAG
aagtcttgtttctaaagaat

SEQ ID NO: 96369 - DNA, 20 bp, Artificial Sequence
  Description of Artificial Sequence: Synthetic oligonucleotide
  Target: ATXN1; (-) strand; PAM type: NRG; PAM sequence: AAG
acgagaaagtcttgtttcta

SEQ ID NO: 96370 - DNA, 20 bp, Artificial Sequence
  Description of Artificial Sequence: Synthetic oligonucleotide
  Target: ATXN1; (-) strand; PAM type: NRG; PAM sequence: AAG
gagtttttatttgcacgaga

SEQ ID NO: 96371 - DNA, 20 bp, Artificial Sequence
  Description of Artificial Sequence: Synthetic oligonucleotide
  Target: ATXN1; (-) strand; PAM type: NRG; PAM sequence: GAG
cattgagtttttatttgcac

SEQ ID NO: 96372 - DNA, 20 bp, Artificial Sequence
  Description of Artificial Sequence: Synthetic oligonucleotide
  Target: ATXN1; (-) strand; PAM type: NRG; PAM sequence: GAG
aagctctgccctttttcatt

SEQ ID NO: 96373 - DNA, 20 bp, Artificial Sequence
  Description of Artificial Sequence: Synthetic oligonucleotide
  Target: ATXN1; (-) strand; PAM type: NRG; PAM sequence: AAG
tttgtctactagcttcttgg

SEQ ID NO: 96374 - DNA, 20 bp, Artificial Sequence
  Description of Artificial Sequence: Synthetic oligonucleotide
  Target: ATXN1; (-) strand; PAM type: NRG; PAM sequence: TGG
atatttgtctactagcttct

SEQ ID NO: 96375 - DNA, 20 bp, Artificial Sequence
  Description of Artificial Sequence: Synthetic oligonucleotide
  Target: ATXN1; (-) strand; PAM type: NRG; PAM sequence: TAG
agtactatatatttgtctac

SEQ ID NO: 96376 - DNA, 20 bp, Artificial Sequence
  Description of Artificial Sequence: Synthetic oligonucleotide
  Target: ATXN1; (-) strand; PAM type: NRG; PAM sequence: TAG
cagccttatgagtaggacta

SEQ ID NO: 96377 - DNA, 20 bp, Artificial Sequence
  Description of Artificial Sequence: Synthetic oligonucleotide
  Target: ATXN1; (-) strand; PAM type: NRG; PAM sequence: AGG
ataacaccagccttatgagt

SEQ ID NO: 96378 - DNA, 20 bp, Artificial Sequence
  Description of Artificial Sequence: Synthetic oligonucleotide
  Target: ATXN1; (-) strand; PAM type: NRG; PAM sequence: TAG
cataacaccagccttatgag

SEQ ID NO: 96379 - DNA, 20 bp, Artificial Sequence
  Description of Artificial Sequence: Synthetic oligonucleotide
  Target: ATXN1; (-) strand; PAM type: NRG; PAM sequence: GAG
aaacataacaccagccttat

SEQ ID NO: 96380 - DNA, 20 bp, Artificial Sequence
  Description of Artificial Sequence: Synthetic oligonucleotide
  Target: ATXN1; (-) strand; PAM type: NRG; PAM sequence: CAG
tgcttttacaaacataacac

SEQ ID NO: 96381 - DNA, 20 bp, Artificial Sequence
  Description of Artificial Sequence: Synthetic oligonucleotide
  Target: ATXN1; (-) strand; PAM type: NRG; PAM sequence: AGG
tcgatttcctgtaatttcaa

SEQ ID NO: 96382 - DNA, 20 bp, Artificial Sequence
  Description of Artificial Sequence: Synthetic oligonucleotide
  Target: ATXN1; (-) strand; PAM type: NRG; PAM sequence: AAG
atcgatttcctgtaatttca

SEQ ID NO: 96383 - DNA, 20 bp, Artificial Sequence
  Description of Artificial Sequence: Synthetic oligonucleotide
  Target: ATXN1; (-) strand; PAM type: NRG; PAM sequence: AGG
ggatacgagtcaagctcatc

SEQ ID NO: 96384 - DNA, 20 bp, Artificial Sequence
  Description of Artificial Sequence: Synthetic oligonucleotide
  Target: ATXN1; (-) strand; PAM type: NRG; PAM sequence: CAG
aggatacgagtcaagctcat

SEQ ID NO: 96385 - DNA, 20 bp, Artificial Sequence
  Description of Artificial Sequence: Synthetic oligonucleotide
  Target: ATXN1; (-) strand; PAM type: NRG; PAM sequence: AAG
tatgacacaggatacgagtc

SEQ ID NO: 96386 - DNA, 20 bp, Artificial Sequence
  Description of Artificial Sequence: Synthetic oligonucleotide
  Target: ATXN1; (-) strand; PAM type: NRG; PAM sequence: GAG
caatctatgacacaggatac

SEQ ID NO: 96387 - DNA, 20 bp, Artificial Sequence
  Description of Artificial Sequence: Synthetic oligonucleotide
  Target: ATXN1; (-) strand; PAM type: NRG; PAM sequence: AGG
atttaagcaatctatgacac

SEQ ID NO: 96388 - DNA, 20 bp, Artificial Sequence
  Description of Artificial Sequence: Synthetic oligonucleotide
  Target: ATXN1; (-) strand; PAM type: NRG; PAM sequence: CAG
tatttaagcaatctatgaca

SEQ ID NO: 96389 - DNA, 20 bp, Artificial Sequence
  Description of Artificial Sequence: Synthetic oligonucleotide
  Target: ATXN1; (-) strand; PAM type: NRG; PAM sequence: AAG
aattatttttcatggtattt

SEQ ID NO: 96390 - DNA, 20 bp, Artificial Sequence
  Description of Artificial Sequence: Synthetic oligonucleotide
  Target: ATXN1; (-) strand; PAM type: NRG; PAM sequence: TGG
gtgattacaattatttttca

SEQ ID NO: 96391 - DNA, 20 bp, Artificial Sequence
  Description of Artificial Sequence: Synthetic oligonucleotide
  Target: ATXN1; (-) strand; PAM type: NRG; PAM sequence: TAG
ataccaccaaaacagtaaaa

SEQ ID NO: 96392 - DNA, 20 bp, Artificial Sequence
  Description of Artificial Sequence: Synthetic oligonucleotide
  Target: ATXN1; (-) strand; PAM type: NRG; PAM sequence: CAG
aagagtagataccaccaaaa

SEQ ID NO: 96393 - DNA, 20 bp, Artificial Sequence
  Description of Artificial Sequence: Synthetic oligonucleotide
  Target: ATXN1; (-) strand; PAM type: NRG; PAM sequence: TAG
ccatttaacaccttcaagag

SEQ ID NO: 96394 - DNA, 20 bp, Artificial Sequence
  Description of Artificial Sequence: Synthetic oligonucleotide
  Target: ATXN1; (-) strand; PAM type: NRG; PAM sequence: GAG
ggcccatttaacaccttcaa

SEQ ID NO: 96395 - DNA, 20 bp, Artificial Sequence
  Description of Artificial Sequence: Synthetic oligonucleotide
  Target: ATXN1; (-) strand; PAM type: NRG; PAM sequence: AAG
ctggcccatttaacaccttc

SEQ ID NO: 96396 - DNA, 20 bp, Artificial Sequence
  Description of Artificial Sequence: Synthetic oligonucleotide
  Target: ATXN1; (-) strand; PAM type: NRG; PAM sequence: TGG
attatataatatatacttgc

SEQ ID NO: 96397 - DNA, 20 bp, Artificial Sequence
  Description of Artificial Sequence: Synthetic oligonucleotide
  Target: ATXN1; (-) strand; PAM type: NRG; PAM sequence: GGG
gaaaactacactttaagtaa

SEQ ID NO: 96398 - DNA, 20 bp, Artificial Sequence
  Description of Artificial Sequence: Synthetic oligonucleotide
  Target: ATXN1; (-) strand; PAM type: NRG; PAM sequence: AGG
tgaaaactacactttaagta

SEQ ID NO: 96399 - DNA, 20 bp, Artificial Sequence
  Description of Artificial Sequence: Synthetic oligonucleotide
  Target: ATXN1; (-) strand; PAM type: NRG; PAM sequence: AAG
ttgaaaactacactttaagt

SEQ ID NO: 96400 - DNA, 20 bp, Artificial Sequence
  Description of Artificial Sequence: Synthetic oligonucleotide
  Target: ATXN1; (-) strand; PAM type: NRG; PAM sequence: AAG
gactttgaaaactacacttt

SEQ ID NO: 96401 - DNA, 20 bp, Artificial Sequence
  Description of Artificial Sequence: Synthetic oligonucleotide
  Target: ATXN1; (-) strand; PAM type: NRG; PAM sequence: TGG
aaagctcccaagtgctgctg

SEQ ID NO: 96402 - DNA, 20 bp, Artificial Sequence
  Description of Artificial Sequence: Synthetic oligonucleotide
  Target: ATXN1; (-) strand; PAM type: NRG; PAM sequence: AAG
tgaatgtctaaaaagctccc

SEQ ID NO: 96403 - DNA, 20 bp, Artificial Sequence
  Description of Artificial Sequence: Synthetic oligonucleotide
  Target: ATXN1; (-) strand; PAM type: NRG; PAM sequence: AAG
cttgactctgaatgtctaaa

SEQ ID NO: 96404 - DNA, 20 bp, Artificial Sequence
  Description of Artificial Sequence: Synthetic oligonucleotide
  Target: ATXN1; (-) strand; PAM type: NRG; PAM sequence: TAG
ctgatttggtatgtctgggg

SEQ ID NO: 96405 - DNA, 20 bp, Artificial Sequence
  Description of Artificial Sequence: Synthetic oligonucleotide
  Target: ATXN1; (-) strand; PAM type: NRG; PAM sequence: GGG
attctgatttggtatgtctg

SEQ ID NO: 96406 - DNA, 20 bp, Artificial Sequence
  Description of Artificial Sequence: Synthetic oligonucleotide
  Target: ATXN1; (-) strand; PAM type: NRG; PAM sequence: GGG
gattctgatttggtatgtct

SEQ ID NO: 96407 - DNA, 20 bp, Artificial Sequence
  Description of Artificial Sequence: Synthetic oligonucleotide
  Target: ATXN1; (-) strand; PAM type: NRG; PAM sequence: TGG
agattctgatttggtatgtc

SEQ ID NO: 96408 - DNA, 20 bp, Artificial Sequence
  Description of Artificial Sequence: Synthetic oligonucleotide
  Target: ATXN1; (-) strand; PAM type: NRG; PAM sequence: TGG
ttcaaaggcagattctgatt

SEQ ID NO: 96409 - DNA, 20 bp, Artificial Sequence
  Description of Artificial Sequence: Synthetic oligonucleotide
  Target: ATXN1; (-) strand; PAM type: NRG; PAM sequence: CAG
ccaggggcctggttcaaagg

SEQ ID NO: 96410 - DNA, 20 bp, Artificial Sequence
  Description of Artificial Sequence: Synthetic oligonucleotide
  Target: ATXN1; (-) strand; PAM type: NRG; PAM sequence: AGG
cacccaggggcctggttcaa

SEQ ID NO: 96411 - DNA, 20 bp, Artificial Sequence
  Description of Artificial Sequence: Synthetic oligonucleotide
  Target: ATXN1; (-) strand; PAM type: NRG; PAM sequence: AAG
tcacccaggggcctggttca

SEQ ID NO: 96412 - DNA, 20 bp, Artificial Sequence
  Description of Artificial Sequence: Synthetic oligonucleotide
  Target: ATXN1; (-) strand; PAM type: NRG; PAM sequence: TGG
ttagaaatcacccaggggcc

SEQ ID NO: 96413 - DNA, 20 bp, Artificial Sequence
  Description of Artificial Sequence: Synthetic oligonucleotide
  Target: ATXN1; (-) strand; PAM type: NRG; PAM sequence: GGG
tgtgtttagaaatcacccag

SEQ ID NO: 96414 - DNA, 20 bp, Artificial Sequence
  Description of Artificial Sequence: Synthetic oligonucleotide
  Target: ATXN1; (-) strand; PAM type: NRG; PAM sequence: GGG
atgtgtttagaaatcaccca

SEQ ID NO: 96415 - DNA, 20 bp, Artificial Sequence
  Description of Artificial Sequence: Synthetic oligonucleotide
  Target: ATXN1; (-) strand; PAM type: NRG; PAM sequence: AGG
aatgtgtttagaaatcaccc

SEQ ID NO: 96416 - DNA, 20 bp, Artificial Sequence
  Description of Artificial Sequence: Synthetic oligonucleotide
  Target: ATXN1; (-) strand; PAM type: NRG; PAM sequence: CAG
taatgtgtttagaaatcacc

SEQ ID NO: 96417 - DNA, 20 bp, Artificial Sequence
  Description of Artificial Sequence: Synthetic oligonucleotide
  Target: ATXN1; (-) strand; PAM type: NRG; PAM sequence: TAG
tcttcacatgataatgtgtt

SEQ ID NO: 96418 - DNA, 20 bp, Artificial Sequence
  Description of Artificial Sequence: Synthetic oligonucleotide
  Target: ATXN1; (-) strand; PAM type: NRG; PAM sequence: CAG
ttgatccctgtggtatagac

SEQ ID NO: 96419 - DNA, 20 bp, Artificial Sequence
  Description of Artificial Sequence: Synthetic oligonucleotide
  Target: ATXN1; (-) strand; PAM type: NRG; PAM sequence: TAG
ttaggttgatccctgtggta

SEQ ID NO: 96420 - DNA, 20 bp, Artificial Sequence
  Description of Artificial Sequence: Synthetic oligonucleotide
  Target: ATXN1; (-) strand; PAM type: NRG; PAM sequence: TGG
tttatttaggttgatccctg

SEQ ID NO: 96421 - DNA, 20 bp, Artificial Sequence
  Description of Artificial Sequence: Synthetic oligonucleotide
  Target: ATXN1; (-) strand; PAM type: NRG; PAM sequence: AGG
acttgtgcccaaatttattt

SEQ ID NO: 96422 - DNA, 20 bp, Artificial Sequence
  Description of Artificial Sequence: Synthetic oligonucleotide
  Target: ATXN1; (-) strand; PAM type: NRG; PAM sequence: TAG
cacttgtgcccaaatttatt

SEQ ID NO: 96423 - DNA, 20 bp, Artificial Sequence
  Description of Artificial Sequence: Synthetic oligonucleotide
  Target: ATXN1; (-) strand; PAM type: NRG; PAM sequence: AGG
agcaaaaaagaaataaatag

SEQ ID NO: 96424 - DNA, 20 bp, Artificial Sequence
  Description of Artificial Sequence: Synthetic oligonucleotide
  Target: ATXN1; (-) strand; PAM type: NRG; PAM sequence: GAG
gagcaaaaaagaaataaata

SEQ ID NO: 96425 - DNA, 20 bp, Artificial Sequence
  Description of Artificial Sequence: Synthetic oligonucleotide
  Target: ATXN1; (-) strand; PAM type: NRG; PAM sequence: TAG
aggagcaaaaaagaaataaa

SEQ ID NO: 96426 - DNA, 20 bp, Artificial Sequence
  Description of Artificial Sequence: Synthetic oligonucleotide
  Target: ATXN1; (-) strand; PAM type: NRG; PAM sequence: AAG
cttactaaaaaggagcaaaa

SEQ ID NO: 96427 - DNA, 20 bp, Artificial Sequence
  Description of Artificial Sequence: Synthetic oligonucleotide
  Target: ATXN1; (-) strand; PAM type: NRG; PAM sequence: GAG
gggctgtacttactaaaaag

SEQ ID NO: 96428 - DNA, 20 bp, Artificial Sequence
  Description of Artificial Sequence: Synthetic oligonucleotide
  Target: ATXN1; (-) strand; PAM type: NRG; PAM sequence: AGG
aagggctgtacttactaaaa

SEQ ID NO: 96429 - DNA, 20 bp, Artificial Sequence
  Description of Artificial Sequence: Synthetic oligonucleotide
  Target: ATXN1; (-) strand; PAM type: NRG; PAM sequence: AAG
taagggctgtacttactaaa

SEQ ID NO: 96430 - DNA, 20 bp, Artificial Sequence
  Description of Artificial Sequence: Synthetic oligonucleotide
  Target: ATXN1; (-) strand; PAM type: NRG; PAM sequence: GGG
tgaaaagcacaaattaataa

SEQ ID NO: 96431 - DNA, 20 bp, Artificial Sequence
  Description of Artificial Sequence: Synthetic oligonucleotide
  Target: ATXN1; (-) strand; PAM type: NRG; PAM sequence: AGG
ttgaaaagcacaaattaata

SEQ ID NO: 96432 - DNA, 20 bp, Artificial Sequence
  Description of Artificial Sequence: Synthetic oligonucleotide
  Target: ATXN1; (-) strand; PAM type: NRG; PAM sequence: AAG
attgaaaagcacaaattaat

SEQ ID NO: 96433 - DNA, 20 bp, Artificial Sequence
  Description of Artificial Sequence: Synthetic oligonucleotide
  Target: ATXN1; (-) strand; PAM type: NRG; PAM sequence: AAG
cataataatttttcattgaa

SEQ ID NO: 96434 - DNA, 20 bp, Artificial Sequence
  Description of Artificial Sequence: Synthetic oligonucleotide
  Target: ATXN1; (-) strand; PAM type: NRG; PAM sequence: AAG
agtgcagtagtatttatcca

SEQ ID NO: 96435 - DNA, 20 bp, Artificial Sequence
  Description of Artificial Sequence: Synthetic oligonucleotide
  Target: ATXN1; (-) strand; PAM type: NRG; PAM sequence: TAG
tgtgtgcacttacagtgcag

SEQ ID NO: 96436 - DNA, 20 bp, Artificial Sequence
  Description of Artificial Sequence: Synthetic oligonucleotide
  Target: ATXN1; (-) strand; PAM type: NRG; PAM sequence: CAG
agatgtgtgcacttacagtg

SEQ ID NO: 96437 - DNA, 20 bp, Artificial Sequence
  Description of Artificial Sequence: Synthetic oligonucleotide
  Target: ATXN1; (-) strand; PAM type: NRG; PAM sequence: CAG
gatgcagatgtgtgcactta

SEQ ID NO: 96438 - DNA, 20 bp, Artificial Sequence
  Description of Artificial Sequence: Synthetic oligonucleotide
  Target: ATXN1; (-) strand; PAM type: NRG; PAM sequence: CAG
cttttttggcaataatgatg

SEQ ID NO: 96439 - DNA, 20 bp, Artificial Sequence
  Description of Artificial Sequence: Synthetic oligonucleotide
  Target: ATXN1; (-) strand; PAM type: NRG; PAM sequence: TGG
ctcagcagagcattcttttt

SEQ ID NO: 96440 - DNA, 20 bp, Artificial Sequence
  Description of Artificial Sequence: Synthetic oligonucleotide
  Target: ATXN1; (-) strand; PAM type: NRG; PAM sequence: GAG
ccccagtacattcctcagca

SEQ ID NO: 96441 - DNA, 20 bp, Artificial Sequence
  Description of Artificial Sequence: Synthetic oligonucleotide
  Target: ATXN1; (-) strand; PAM type: NRG; PAM sequence: CAG
gaccccagtacattcctcag

SEQ ID NO: 96442 - DNA, 20 bp, Artificial Sequence
  Description of Artificial Sequence: Synthetic oligonucleotide
  Target: ATXN1; (-) strand; PAM type: NRG; PAM sequence: CAG
caagaccccagtacattcct

SEQ ID NO: 96443 - DNA, 20 bp, Artificial Sequence
  Description of Artificial Sequence: Synthetic oligonucleotide
  Target: ATXN1; (-) strand; PAM type: NRG; PAM sequence: CAG
aatgttcatgttcaagaccc

SEQ ID NO: 96444 - DNA, 20 bp, Artificial Sequence
  Description of Artificial Sequence: Synthetic oligonucleotide
  Target: ATXN1; (-) strand; PAM type: NRG; PAM sequence: AAG
tgaagaaaatgttcatgttc

SEQ ID NO: 96445 - DNA, 20 bp, Artificial Sequence
  Description of Artificial Sequence: Synthetic oligonucleotide
  Target: ATXN1; (-) strand; PAM type: NRG; PAM sequence: AAG
gtgctccctctgctgccatg

SEQ ID NO: 96446 - DNA, 20 bp, Artificial Sequence
  Description of Artificial Sequence: Synthetic oligonucleotide
  Target: ATXN1; (-) strand; PAM type: NRG; PAM sequence: AAG
acctgtgcactggttttatt

SEQ ID NO: 96447 - DNA, 20 bp, Artificial Sequence
  Description of Artificial Sequence: Synthetic oligonucleotide
  Target: ATXN1; (-) strand; PAM type: NRG; PAM sequence: TGG
atttggagagacctgtgcac

SEQ ID NO: 96448 - DNA, 20 bp, Artificial Sequence
  Description of Artificial Sequence: Synthetic oligonucleotide
  Target: ATXN1; (-) strand; PAM type: NRG; PAM sequence: GAG
aaaatctgtcatgatttgga

SEQ ID NO: 96449 - DNA, 20 bp, Artificial Sequence
  Description of Artificial Sequence: Synthetic oligonucleotide
  Target: ATXN1; (-) strand; PAM type: NRG; PAM sequence: GAG
gtaaaatctgtcatgatttg

SEQ ID NO: 96450 - DNA, 20 bp, Artificial Sequence
  Description of Artificial Sequence: Synthetic oligonucleotide
  Target: ATXN1; (-) strand; PAM type: NRG; PAM sequence: TGG
atgtaaaatctgtcatgatt

SEQ ID NO: 96451 - DNA, 20 bp, Artificial Sequence
  Description of Artificial Sequence: Synthetic oligonucleotide
  Target: ATXN1; (-) strand; PAM type: NRG; PAM sequence: AGG
ttcattttgaactacataac

SEQ ID NO: 96452 - DNA, 20 bp, Artificial Sequence
  Description of Artificial Sequence: Synthetic oligonucleotide
  Target: ATXN1; (-) strand; PAM type: NRG; PAM sequence: CAG
cttcattttgaactacataa

SEQ ID NO: 96453 - DNA, 20 bp, Artificial Sequence
  Description of Artificial Sequence: Synthetic oligonucleotide
  Target: ATXN1; (-) strand; PAM type: NRG; PAM sequence: CAG
taagcctatctgtgtttgct

SEQ ID NO: 96454 - DNA, 20 bp, Artificial Sequence
  Description of Artificial Sequence: Synthetic oligonucleotide
  Target: ATXN1; (-) strand; PAM type: NRG; PAM sequence: AAG
catagttgttatgacctggt

SEQ ID NO: 96455 - DNA, 20 bp, Artificial Sequence
  Description of Artificial Sequence: Synthetic oligonucleotide
  Target: ATXN1; (-) strand; PAM type: NRG; PAM sequence: TGG
gttacatagttgttatgacc

SEQ ID NO: 96456 - DNA, 20 bp, Artificial Sequence
  Description of Artificial Sequence: Synthetic oligonucleotide
  Target: ATXN1; (-) strand; PAM type: NRG; PAM sequence: TAG
tttcaatctgttcagttaca

SEQ ID NO: 96457 - DNA, 20 bp, Artificial Sequence
  Description of Artificial Sequence: Synthetic oligonucleotide
  Target: ATXN1; (-) strand; PAM type: NRG; PAM sequence: CAG
tattcaactttcaatctgtt

SEQ ID NO: 96458 - DNA, 20 bp, Artificial Sequence
  Description of Artificial Sequence: Synthetic oligonucleotide
  Target: ATXN1; (-) strand; PAM type: NRG; PAM sequence: AAG
tcaagcctaaaactctaaag

SEQ ID NO: 96459 - DNA, 20 bp, Artificial Sequence
  Description of Artificial Sequence: Synthetic oligonucleotide
  Target: ATXN1; (-) strand; PAM type: NRG; PAM sequence: AAG
aattcaagcctaaaactcta

SEQ ID NO: 96460 - DNA, 20 bp, Artificial Sequence
  Description of Artificial Sequence: Synthetic oligonucleotide
  Target: ATXN1; (-) strand; PAM type: NRG; PAM sequence: AAG
ccactttcttttaagaattc

SEQ ID NO: 96461 - DNA, 20 bp, Artificial Sequence
  Description of Artificial Sequence: Synthetic oligonucleotide
  Target: ATXN1; (-) strand; PAM type: NRG; PAM sequence: AAG
tttgaggtccactttctttt

SEQ ID NO: 96462 - DNA, 20 bp, Artificial Sequence
  Description of Artificial Sequence: Synthetic oligonucleotide
  Target: ATXN1; (-) strand; PAM type: NRG; PAM sequence: AGG
aggcatctttttcacttttg

SEQ ID NO: 96463 - DNA, 20 bp, Artificial Sequence
  Description of Artificial Sequence: Synthetic oligonucleotide
  Target: ATXN1; (-) strand; PAM type: NRG; PAM sequence: GAG
aaggcatctttttcactttt

SEQ ID NO: 96464 - DNA, 20 bp, Artificial Sequence
  Description of Artificial Sequence: Synthetic oligonucleotide
  Target: ATXN1; (-) strand; PAM type: NRG; PAM sequence: AGG
tttgtttttgagcaaagcta

SEQ ID NO: 96465 - DNA, 20 bp, Artificial Sequence
  Description of Artificial Sequence: Synthetic oligonucleotide
  Target: ATXN1; (-) strand; PAM type: NRG; PAM sequence: AAG
ctttgtttttgagcaaagct

SEQ ID NO: 96466 - DNA, 20 bp, Artificial Sequence
  Description of Artificial Sequence: Synthetic oligonucleotide
  Target: ATXN1; (-) strand; PAM type: NRG; PAM sequence: AAG
gttatctttgtttttgagca

SEQ ID NO: 96467 - DNA, 20 bp, Artificial Sequence
  Description of Artificial Sequence: Synthetic oligonucleotide
  Target: ATXN1; (-) strand; PAM type: NRG; PAM sequence: GAG
gttgtgttatctttgttttt

SEQ ID NO: 96468 - DNA, 20 bp, Artificial Sequence
  Description of Artificial Sequence: Synthetic oligonucleotide
  Target: ATXN1; (-) strand; PAM type: NRG; PAM sequence: GGG
agtaaagctaaggcatctta

SEQ ID NO: 96469 - DNA, 20 bp, Artificial Sequence
  Description of Artificial Sequence: Synthetic oligonucleotide
  Target: ATXN1; (-) strand; PAM type: NRG; PAM sequence: AGG
gagtaaagctaaggcatctt

SEQ ID NO: 96470 - DNA, 20 bp, Artificial Sequence
  Description of Artificial Sequence: Synthetic oligonucleotide
  Target: ATXN1; (-) strand; PAM type: NRG; PAM sequence: TAG
tgagtaaagctaaggcatct

SEQ ID NO: 96471 - DNA, 20 bp, Artificial Sequence
  Description of Artificial Sequence: Synthetic oligonucleotide
  Target: ATXN1; (-) strand; PAM type: NRG; PAM sequence: AGG
tttgtttttgagtaaagcta

SEQ ID NO: 96472 - DNA, 20 bp, Artificial Sequence
  Description of Artificial Sequence: Synthetic oligonucleotide
  Target: ATXN1; (-) strand; PAM type: NRG; PAM sequence: AAG
ctttgtttttgagtaaagct

SEQ ID NO: 96473 - DNA, 20 bp, Artificial Sequence
  Description of Artificial Sequence: Synthetic oligonucleotide
  Target: ATXN1; (-) strand; PAM type: NRG; PAM sequence: AAG
gttatctttgtttttgagta

SEQ ID NO: 96474 - DNA, 20 bp, Artificial Sequence
  Description of Artificial Sequence: Synthetic oligonucleotide
  Target: ATXN1; (-) strand; PAM type: NRG; PAM sequence: GAG
tctgtgttatctttgttttt

SEQ ID NO: 96475 - DNA, 20 bp, Artificial Sequence
  Description of Artificial Sequence: Synthetic oligonucleotide
  Target: ATXN1; (-) strand; PAM type: NRG; PAM sequence: GGG
ataaacaggagctactatta

SEQ ID NO: 96476 - DNA, 20 bp, Artificial Sequence
  Description of Artificial Sequence: Synthetic oligonucleotide
  Target: ATXN1; (-) strand; PAM type: NRG; PAM sequence: AGG
gataaacaggagctactatt

SEQ ID NO: 96477 - DNA, 20 bp, Artificial Sequence
  Description of Artificial Sequence: Synthetic oligonucleotide
  Target: ATXN1; (-) strand; PAM type: NRG; PAM sequence: TAG
agataaacaggagctactat

SEQ ID NO: 96478 - DNA, 20 bp, Artificial Sequence
  Description of Artificial Sequence: Synthetic oligonucleotide
  Target: ATXN1; (-) strand; PAM type: NRG; PAM sequence: GAG
ctctgtttttagataaacag

SEQ ID NO: 96479 - DNA, 20 bp, Artificial Sequence
  Description of Artificial Sequence: Synthetic oligonucleotide
  Target: ATXN1; (-) strand; PAM type: NRG; PAM sequence: AGG
gactctgtttttagataaac

SEQ ID NO: 96480 - DNA, 20 bp, Artificial Sequence
  Description of Artificial Sequence: Synthetic oligonucleotide
  Target: ATXN1; (-) strand; PAM type: NRG; PAM sequence: CAG
tgactctgtttttagataaa

SEQ ID NO: 96481 - DNA, 20 bp, Artificial Sequence
  Description of Artificial Sequence: Synthetic oligonucleotide
  Target: ATXN1; (-) strand; PAM type: NRG; PAM sequence: TAG
cagtgaactgactctgtttt

SEQ ID NO: 96482 - DNA, 20 bp, Artificial Sequence
  Description of Artificial Sequence: Synthetic oligonucleotide
  Target: ATXN1; (-) strand; PAM type: NRG; PAM sequence: CAG
aagttacctgatgtagggtc

SEQ ID NO: 96483 - DNA, 20 bp, Artificial Sequence
  Description of Artificial Sequence: Synthetic oligonucleotide
  Target: ATXN1; (-) strand; PAM type: NRG; PAM sequence: GGG
aaattaagttacctgatgta

SEQ ID NO: 96484 - DNA, 20 bp, Artificial Sequence
  Description of Artificial Sequence: Synthetic oligonucleotide
  Target: ATXN1; (-) strand; PAM type: NRG; PAM sequence: AGG
gaaattaagttacctgatgt

SEQ ID NO: 96485 - DNA, 20 bp, Artificial Sequence
  Description of Artificial Sequence: Synthetic oligonucleotide
  Target: ATXN1; (-) strand; PAM type: NRG; PAM sequence: TAG
tgaaattaagttacctgatg

SEQ ID NO: 96486 - DNA, 20 bp, Artificial Sequence
  Description of Artificial Sequence: Synthetic oligonucleotide
  Target: ATXN1; (-) strand; PAM type: NRG; PAM sequence: AAG
gtatgacaccaaatgaaatt

SEQ ID NO: 96487 - DNA, 20 bp, Artificial Sequence
  Description of Artificial Sequence: Synthetic oligonucleotide
  Target: ATXN1; (-) strand; PAM type: NRG; PAM sequence: TGG
taaacacagcaaaaggcgca

SEQ ID NO: 96488 - DNA, 20 bp, Artificial Sequence
  Description of Artificial Sequence: Synthetic oligonucleotide
  Target: ATXN1; (-) strand; PAM type: NRG; PAM sequence: AGG
ctgagtgtaaacacagcaaa

SEQ ID NO: 96489 - DNA, 20 bp, Artificial Sequence
  Description of Artificial Sequence: Synthetic oligonucleotide
  Target: ATXN1; (-) strand; PAM type: NRG; PAM sequence: AAG
tctgagtgtaaacacagcaa

SEQ ID NO: 96490 - DNA, 20 bp, Artificial Sequence
  Description of Artificial Sequence: Synthetic oligonucleotide
  Target: ATXN1; (-) strand; PAM type: NRG; PAM sequence: CAG
aattattctgagtgtaaaca

SEQ ID NO: 96491 - DNA, 20 bp, Artificial Sequence
  Description of Artificial Sequence: Synthetic oligonucleotide
  Target: ATXN1; (-) strand; PAM type: NRG; PAM sequence: GAG
gaaacccctaaaattattct

SEQ ID NO: 96492 - DNA, 20 bp, Artificial Sequence
  Description of Artificial Sequence: Synthetic oligonucleotide
  Target: ATXN1; (-) strand; PAM type: NRG; PAM sequence: GAG
tcaccactgcaagcattaag

SEQ ID NO: 96493 - DNA, 20 bp, Artificial Sequence
  Description of Artificial Sequence: Synthetic oligonucleotide
  Target: ATXN1; (-) strand; PAM type: NRG; PAM sequence: AGG
cctcaccactgcaagcatta

SEQ ID NO: 96494 - DNA, 20 bp, Artificial Sequence
  Description of Artificial Sequence: Synthetic oligonucleotide
  Target: ATXN1; (-) strand; PAM type: NRG; PAM sequence: AAG
tcctcaccactgcaagcatt

SEQ ID NO: 96495 - DNA, 20 bp, Artificial Sequence
  Description of Artificial Sequence: Synthetic oligonucleotide
  Target: ATXN1; (-) strand; PAM type: NRG; PAM sequence: AAG
acctaaatcctcaccactgc

SEQ ID NO: 96496 - DNA, 20 bp, Artificial Sequence
  Description of Artificial Sequence: Synthetic oligonucleotide
  Target: ATXN1; (-) strand; PAM type: NRG; PAM sequence: AGG
aaaagtatgaaatactacgt

SEQ ID NO: 96497 - DNA, 20 bp, Artificial Sequence
  Description of Artificial Sequence: Synthetic oligonucleotide
  Target: ATXN1; (-) strand; PAM type: NRG; PAM sequence: TAG
gaaaagtatgaaatactacg

SEQ ID NO: 96498 - DNA, 20 bp, Artificial Sequence
  Description of Artificial Sequence: Synthetic oligonucleotide
  Target: ATXN1; (-) strand; PAM type: NRG; PAM sequence: AAG
caatatggaagagtagtgaa

SEQ ID NO: 96499 - DNA, 20 bp, Artificial Sequence
  Description of Artificial Sequence: Synthetic oligonucleotide
  Target: ATXN1; (-) strand; PAM type: NRG; PAM sequence: TAG
gaggatgcaatatggaagag

SEQ ID NO: 96500 - DNA, 20 bp, Artificial Sequence
  Description of Artificial Sequence: Synthetic oligonucleotide
  Target: ATXN1; (-) strand; PAM type: NRG; PAM sequence: GAG
tttgaggatgcaatatggaa

SEQ ID NO: 96501 - DNA, 20 bp, Artificial Sequence
  Description of Artificial Sequence: Synthetic oligonucleotide
  Target: ATXN1; (-) strand; PAM type: NRG; PAM sequence: AAG
tttttgaggatgcaatatgg

SEQ ID NO: 96502 - DNA, 20 bp, Artificial Sequence
  Description of Artificial Sequence: Synthetic oligonucleotide
  Target: ATXN1; (-) strand; PAM type: NRG; PAM sequence: TGG
gagtttttgaggatgcaata

SEQ ID NO: 96503 - DNA, 20 bp, Artificial Sequence
  Description of Artificial Sequence: Synthetic oligonucleotide
  Target: ATXN1; (-) strand; PAM type: NRG; PAM sequence: AGG
ctgcttcaagggagtttttg

SEQ ID NO: 96504 - DNA, 20 bp, Artificial Sequence
  Description of Artificial Sequence: Synthetic oligonucleotide
  Target: ATXN1; (-) strand; PAM type: NRG; PAM sequence: GAG
tctgcttcaagggagttttt

SEQ ID NO: 96505 - DNA, 20 bp, Artificial Sequence
  Description of Artificial Sequence: Synthetic oligonucleotide
  Target: ATXN1; (-) strand; PAM type: NRG; PAM sequence: GAG
gtatgttatctgcttcaagg

SEQ ID NO: 96506 - DNA, 20 bp, Artificial Sequence
  Description of Artificial Sequence: Synthetic oligonucleotide
  Target: ATXN1; (-) strand; PAM type: NRG; PAM sequence: GGG
aagtatgttatctgcttcaa

SEQ ID NO: 96507 - DNA, 20 bp, Artificial Sequence
  Description of Artificial Sequence: Synthetic oligonucleotide
  Target: ATXN1; (-) strand; PAM type: NRG; PAM sequence: AGG
caagtatgttatctgcttca

SEQ ID NO: 96508 - DNA, 20 bp, Artificial Sequence
  Description of Artificial Sequence: Synthetic oligonucleotide
  Target: ATXN1; (-) strand; PAM type: NRG; PAM sequence: AAG
ccaagtatgttatctgcttc

SEQ ID NO: 96509 - DNA, 20 bp, Artificial Sequence
  Description of Artificial Sequence: Synthetic oligonucleotide
  Target: ATXN1; (-) strand; PAM type: NRG; PAM sequence: AAG
ttggatacttggcttttacc

SEQ ID NO: 96510 - DNA, 20 bp, Artificial Sequence
  Description of Artificial Sequence: Synthetic oligonucleotide
  Target: ATXN1; (-) strand; PAM type: NRG; PAM sequence: TGG
tccataactttttggatact

SEQ ID NO: 96511 - DNA, 20 bp, Artificial Sequence
  Description of Artificial Sequence: Synthetic oligonucleotide
  Target: ATXN1; (-) strand; PAM type: NRG; PAM sequence: TGG
gatgtggttccataactttt

SEQ ID NO: 96512 - DNA, 20 bp, Artificial Sequence
  Description of Artificial Sequence: Synthetic oligonucleotide
  Target: ATXN1; (-) strand; PAM type: NRG; PAM sequence: TGG
aatgttatgaaagcacgatg

SEQ ID NO: 96513 - DNA, 20 bp, Artificial Sequence
  Description of Artificial Sequence: Synthetic oligonucleotide
  Target: ATXN1; (-) strand; PAM type: NRG; PAM sequence: AAG
taaatgactcaatgttatga

SEQ ID NO: 96514 - DNA, 20 bp, Artificial Sequence
  Description of Artificial Sequence: Synthetic oligonucleotide
  Target: ATXN1; (-) strand; PAM type: NRG; PAM sequence: AAG
cctcatttatgaatacctca

SEQ ID NO: 96515 - DNA, 20 bp, Artificial Sequence
  Description of Artificial Sequence: Synthetic oligonucleotide
  Target: ATXN1; (-) strand; PAM type: NRG; PAM sequence: TAG
taaaaaatgctctggatctt

SEQ ID NO: 96516 - DNA, 20 bp, Artificial Sequence
  Description of Artificial Sequence: Synthetic oligonucleotide
  Target: ATXN1; (-) strand; PAM type: NRG; PAM sequence: TGG
taaaactgtaaaaaatgctc

SEQ ID NO: 96517 - DNA, 20 bp, Artificial Sequence
  Description of Artificial Sequence: Synthetic oligonucleotide
  Target: ATXN1; (-) strand; PAM type: NRG; PAM sequence: AAG
aatatataaacatattatct

SEQ ID NO: 96518 - DNA, 20 bp, Artificial Sequence
  Description of Artificial Sequence: Synthetic oligonucleotide
  Target: ATXN1; (-) strand; PAM type: NRG; PAM sequence: AAG
agttattgtagatgcagagt

SEQ ID NO: 96519 - DNA, 20 bp, Artificial Sequence
  Description of Artificial Sequence: Synthetic oligonucleotide
  Target: ATXN1; (-) strand; PAM type: NRG; PAM sequence: GAG
tcttagttattgtagatgca

SEQ ID NO: 96520 - DNA, 20 bp, Artificial Sequence
  Description of Artificial Sequence: Synthetic oligonucleotide
  Target: ATXN1; (-) strand; PAM type: NRG; PAM sequence: CAG
agtcttagttattgtagatg

SEQ ID NO: 96521 - DNA, 20 bp, Artificial Sequence
  Description of Artificial Sequence: Synthetic oligonucleotide
  Target: ATXN1; (-) strand; PAM type: NRG; PAM sequence: TAG
ttctcaagtcttagttattg

SEQ ID NO: 96522 - DNA, 20 bp, Artificial Sequence
  Description of Artificial Sequence: Synthetic oligonucleotide
  Target: ATXN1; (-) strand; PAM type: NRG; PAM sequence: TAG
aattttatattctcaagtct

SEQ ID NO: 96523 - DNA, 20 bp, Artificial Sequence
  Description of Artificial Sequence: Synthetic oligonucleotide
  Target: ATXN1; (-) strand; PAM type: NRG; PAM sequence: AAG
ttactcaattttatattctc

SEQ ID NO: 96524 - DNA, 20 bp, Artificial Sequence
  Description of Artificial Sequence: Synthetic oligonucleotide
  Target: ATXN1; (-) strand; PAM type: NRG; PAM sequence: AAG
ctctgatctccttgcacact

SEQ ID NO: 96525 - DNA, 20 bp, Artificial Sequence
  Description of Artificial Sequence: Synthetic oligonucleotide
  Target: ATXN1; (-) strand; PAM type: NRG; PAM sequence: AAG
attaacagttttccaaaggt

SEQ ID NO: 96526 - DNA, 20 bp, Artificial Sequence
  Description of Artificial Sequence: Synthetic oligonucleotide
  Target: ATXN1; (-) strand; PAM type: NRG; PAM sequence: AGG
aaaaattaacagttttccaa

SEQ ID NO: 96527 - DNA, 20 bp, Artificial Sequence
  Description of Artificial Sequence: Synthetic oligonucleotide
  Target: ATXN1; (-) strand; PAM type: NRG; PAM sequence: AAG
taaaaattaacagttttcca

SEQ ID NO: 96528 - DNA, 20 bp, Artificial Sequence
  Description of Artificial Sequence: Synthetic oligonucleotide
  Target: ATXN1; (-) strand; PAM type: NRG; PAM sequence: CAG
ttcaacgtggtaaaaattaa

SEQ ID NO: 96529 - DNA, 20 bp, Artificial Sequence
  Description of Artificial Sequence: Synthetic oligonucleotide
  Target: ATXN1; (-) strand; PAM type: NRG; PAM sequence: TGG
tgaatctttgtgtttcaacg

SEQ ID NO: 96530 - DNA, 20 bp, Artificial Sequence
  Description of Artificial Sequence: Synthetic oligonucleotide
  Target: ATXN1; (-) strand; PAM type: NRG; PAM sequence: TGG
gctatgattctggcaggtgc

SEQ ID NO: 96531 - DNA, 20 bp, Artificial Sequence
  Description of Artificial Sequence: Synthetic oligonucleotide
  Target: ATXN1; (-) strand; PAM type: NRG; PAM sequence: AGG
ctgattgctatgattctggc

SEQ ID NO: 96532 - DNA, 20 bp, Artificial Sequence
  Description of Artificial Sequence: Synthetic oligonucleotide
  Target: ATXN1; (-) strand; PAM type: NRG; PAM sequence: CAG
tctgattgctatgattctgg

SEQ ID NO: 96533 - DNA, 20 bp, Artificial Sequence
  Description of Artificial Sequence: Synthetic oligonucleotide
  Target: ATXN1; (-) strand; PAM type: NRG; PAM sequence: TGG
aagtctgattgctatgattc

SEQ ID NO: 96534 - DNA, 20 bp, Artificial Sequence
  Description of Artificial Sequence: Synthetic oligonucleotide
  Target: ATXN1; (-) strand; PAM type: NRG; PAM sequence: AAG
tgtttgattctcatatttgg

SEQ ID NO: 96535 - DNA, 20 bp, Artificial Sequence
  Description of Artificial Sequence: Synthetic oligonucleotide
  Target: ATXN1; (-) strand; PAM type: NRG; PAM sequence: TGG
taatgtttgattctcatatt

SEQ ID NO: 96536 - DNA, 20 bp, Artificial Sequence
  Description of Artificial Sequence: Synthetic oligonucleotide
  Target: ATXN1; (-) strand; PAM type: NRG; PAM sequence: GAG
ataagtcaacttttgctcaa

SEQ ID NO: 96537 - DNA, 20 bp, Artificial Sequence
  Description of Artificial Sequence: Synthetic oligonucleotide
  Target: ATXN1; (-) strand; PAM type: NRG; PAM sequence: AAG
ttataagtcaacttttgctc

SEQ ID NO: 96538 - DNA, 20 bp, Artificial Sequence
  Description of Artificial Sequence: Synthetic oligonucleotide
  Target: ATXN1; (-) strand; PAM type: NRG; PAM sequence: AAG
aaatattaatattagcttat

SEQ ID NO: 96539 - DNA, 20 bp, Artificial Sequence
  Description of Artificial Sequence: Synthetic oligonucleotide
  Target: ATXN1; (-) strand; PAM type: NRG; PAM sequence: TAG
caaatttgaaatattaatat

SEQ ID NO: 96540 - DNA, 20 bp, Artificial Sequence
  Description of Artificial Sequence: Synthetic oligonucleotide
  Target: ATXN1; (-) strand; PAM type: NRG; PAM sequence: AAG
catgtgattttgtgataggg

SEQ ID NO: 96541 - DNA, 20 bp, Artificial Sequence
  Description of Artificial Sequence: Synthetic oligonucleotide
  Target: ATXN1; (-) strand; PAM type: NRG; PAM sequence: GGG
actcatgtgattttgtgata

SEQ ID NO: 96542 - DNA, 20 bp, Artificial Sequence
  Description of Artificial Sequence: Synthetic oligonucleotide
  Target: ATXN1; (-) strand; PAM type: NRG; PAM sequence: AGG
tactcatgtgattttgtgat

SEQ ID NO: 96543 - DNA, 20 bp, Artificial Sequence
  Description of Artificial Sequence: Synthetic oligonucleotide
  Target: ATXN1; (-) strand; PAM type: NRG; PAM sequence: TAG
ttactcatgtgattttgtga

SEQ ID NO: 96544 - DNA, 20 bp, Artificial Sequence
  Description of Artificial Sequence: Synthetic oligonucleotide
  Target: ATXN1; (-) strand; PAM type: NRG; PAM sequence: AAG
ttcttttcagcattttagaa

SEQ ID NO: 96545 - DNA, 20 bp, Artificial Sequence
  Description of Artificial Sequence: Synthetic oligonucleotide
  Target: ATXN1; (-) strand; PAM type: NRG; PAM sequence: TAG
aaaaattcttttcagcattt

SEQ ID NO: 96546 - DNA, 20 bp, Artificial Sequence
  Description of Artificial Sequence: Synthetic oligonucleotide
  Target: ATXN1; (-) strand; PAM type: NRG; PAM sequence: CAG
tgtgggagaaaaattctttt

SEQ ID NO: 96547 - DNA, 20 bp, Artificial Sequence
  Description of Artificial Sequence: Synthetic oligonucleotide
  Target: ATXN1; (-) strand; PAM type: NRG; PAM sequence: GAG
gcaaaccctctttagtgtgg

SEQ ID NO: 96548 - DNA, 20 bp, Artificial Sequence
  Description of Artificial Sequence: Synthetic oligonucleotide
  Target: ATXN1; (-) strand; PAM type: NRG; PAM sequence: GGG
tggcaaaccctctttagtgt

SEQ ID NO: 96549 - DNA, 20 bp, Artificial Sequence
  Description of Artificial Sequence: Synthetic oligonucleotide
  Target: ATXN1; (-) strand; PAM type: NRG; PAM sequence: TGG
ttggcaaaccctctttagtg

SEQ ID NO: 96550 - DNA, 20 bp, Artificial Sequence
  Description of Artificial Sequence: Synthetic oligonucleotide
  Target: ATXN1; (-) strand; PAM type: NRG; PAM sequence: TAG
gaaacttggcaaaccctctt

SEQ ID NO: 96551 - DNA, 20 bp, Artificial Sequence
  Description of Artificial Sequence: Synthetic oligonucleotide
  Target: ATXN1; (-) strand; PAM type: NRG; PAM sequence: TGG
aattgctccaggcagaaact

SEQ ID NO: 96552 - DNA, 20 bp, Artificial Sequence
  Description of Artificial Sequence: Synthetic oligonucleotide
  Target: ATXN1; (-) strand; PAM type: NRG; PAM sequence: CAG
ccataacaaattgctccagg

SEQ ID NO: 96553 - DNA, 20 bp, Artificial Sequence
  Description of Artificial Sequence: Synthetic oligonucleotide
  Target: ATXN1; (-) strand; PAM type: NRG; PAM sequence: AGG
cagccataacaaattgctcc

SEQ ID NO: 96554 - DNA, 20 bp, Artificial Sequence
  Description of Artificial Sequence: Synthetic oligonucleotide
  Target: ATXN1; (-) strand; PAM type: NRG; PAM sequence: CAG
acagccataacaaattgctc

SEQ ID NO: 96555 - DNA, 20 bp, Artificial Sequence
  Description of Artificial Sequence: Synthetic oligonucleotide
  Target: ATXN1; (-) strand; PAM type: NRG; PAM sequence: CAG
actttctgggatttattaca

SEQ ID NO: 96556 - DNA, 20 bp, Artificial Sequence
  Description of Artificial Sequence: Synthetic oligonucleotide
  Target: ATXN1; (-) strand; PAM type: NRG; PAM sequence: GGG
attaaaaattcaaactttct

SEQ ID NO: 96557 - DNA, 20 bp, Artificial Sequence
  Description of Artificial Sequence: Synthetic oligonucleotide
  Target: ATXN1; (-) strand; PAM type: NRG; PAM sequence: TGG
cattaaaaattcaaactttc

SEQ ID NO: 96558 - DNA, 20 bp, Artificial Sequence
  Description of Artificial Sequence: Synthetic oligonucleotide
  Target: ATXN1; (-) strand; PAM type: NRG; PAM sequence: CAG
ttacaccctctttattctgt

SEQ ID NO: 96559 - DNA, 20 bp, Artificial Sequence
  Description of Artificial Sequence: Synthetic oligonucleotide
  Target: ATXN1; (-) strand; PAM type: NRG; PAM sequence: AGG
gatttttaaatgacatatgt

SEQ ID NO: 96560 - DNA, 20 bp, Artificial Sequence
  Description of Artificial Sequence: Synthetic oligonucleotide
  Target: ATXN1; (-) strand; PAM type: NRG; PAM sequence: TAG
agatttttaaatgacatatg

SEQ ID NO: 96561 - DNA, 20 bp, Artificial Sequence
  Description of Artificial Sequence: Synthetic oligonucleotide
  Target: ATXN1; (-) strand; PAM type: NRG; PAM sequence: CAG
caagcacactatggtttgct

SEQ ID NO: 96562 - DNA, 20 bp, Artificial Sequence
  Description of Artificial Sequence: Synthetic oligonucleotide
  Target: ATXN1; (-) strand; PAM type: NRG; PAM sequence: TGG
tttgttttgcaagcacacta

SEQ ID NO: 96563 - DNA, 20 bp, Artificial Sequence
  Description of Artificial Sequence: Synthetic oligonucleotide
  Target: ATXN1; (-) strand; PAM type: NRG; PAM sequence: AAG
ggaaagtatatttgttttgc

SEQ ID NO: 96564 - DNA, 20 bp, Artificial Sequence
  Description of Artificial Sequence: Synthetic oligonucleotide
  Target: ATXN1; (-) strand; PAM type: NRG; PAM sequence: AAG
ttgtgagtgcaatctaagga

SEQ ID NO: 96565 - DNA, 20 bp, Artificial Sequence
  Description of Artificial Sequence: Synthetic oligonucleotide
  Target: ATXN1; (-) strand; PAM type: NRG; PAM sequence: AGG
ttatttgtgagtgcaatcta

SEQ ID NO: 96566 - DNA, 20 bp, Artificial Sequence
  Description of Artificial Sequence: Synthetic oligonucleotide
  Target: ATXN1; (-) strand; PAM type: NRG; PAM sequence: AAG
cttatttgtgagtgcaatct

SEQ ID NO: 96567 - DNA, 20 bp, Artificial Sequence
  Description of Artificial Sequence: Synthetic oligonucleotide
  Target: ATXN1; (-) strand; PAM type: NRG; PAM sequence: GAG
gtctccccagccttatttgt

SEQ ID NO: 96568 - DNA, 20 bp, Artificial Sequence
  Description of Artificial Sequence: Synthetic oligonucleotide
  Target: ATXN1; (-) strand; PAM type: NRG; PAM sequence: CAG
ttttacttttgtggtctccc

SEQ ID NO: 96569 - DNA, 20 bp, Artificial Sequence
  Description of Artificial Sequence: Synthetic oligonucleotide
  Target: ATXN1; (-) strand; PAM type: NRG; PAM sequence: TGG
ttgagtttgttttacttttg

SEQ ID NO: 96570 - DNA, 20 bp, Artificial Sequence
  Description of Artificial Sequence: Synthetic oligonucleotide
  Target: ATXN1; (-) strand; PAM type: NRG; PAM sequence: GAG
tgtgagtgtttttcactttt

SEQ ID NO: 96571 - DNA, 20 bp, Artificial Sequence
  Description of Artificial Sequence: Synthetic oligonucleotide
  Target: ATXN1; (-) strand; PAM type: NRG; PAM sequence: GAG
gacctcagagtctattgtgt

SEQ ID NO: 96572 - DNA, 20 bp, Artificial Sequence
  Description of Artificial Sequence: Synthetic oligonucleotide
  Target: ATXN1; (-) strand; PAM type: NRG; PAM sequence: GAG
ggtgtggtgagctgacctca

SEQ ID NO: 96573 - DNA, 20 bp, Artificial Sequence
  Description of Artificial Sequence: Synthetic oligonucleotide
  Target: ATXN1; (-) strand; PAM type: NRG; PAM sequence: CAG
tgggtgtggtgagctgacct

SEQ ID NO: 96574 - DNA, 20 bp, Artificial Sequence
  Description of Artificial Sequence: Synthetic oligonucleotide
  Target: ATXN1; (-) strand; PAM type: NRG; PAM sequence: GAG
gactttagtctgggtgtggt

SEQ ID NO: 96575 - DNA, 20 bp, Artificial Sequence
  Description of Artificial Sequence: Synthetic oligonucleotide
  Target: ATXN1; (-) strand; PAM type: NRG; PAM sequence: TGG
cagtgactttagtctgggtg

SEQ ID NO: 96576 - DNA, 20 bp, Artificial Sequence
  Description of Artificial Sequence: Synthetic oligonucleotide
  Target: ATXN1; (-) strand; PAM type: NRG; PAM sequence: GGG
gagcccagtgactttagtct

SEQ ID NO: 96577 - DNA, 20 bp, Artificial Sequence
  Description of Artificial Sequence: Synthetic oligonucleotide
  Target: ATXN1; (-) strand; PAM type: NRG; PAM sequence: TGG
agagcccagtgactttagtc

SEQ ID NO: 96578 - DNA, 20 bp, Artificial Sequence
  Description of Artificial Sequence: Synthetic oligonucleotide
  Target: ATXN1; (-) strand; PAM type: NRG; PAM sequence: TAG
cgcacagagcccagtgactt

SEQ ID NO: 96579 - DNA, 20 bp, Artificial Sequence
  Description of Artificial Sequence: Synthetic oligonucleotide
  Target: ATXN1; (-) strand; PAM type: NRG; PAM sequence: CAG
ttggtgacacgcacagagcc

SEQ ID NO: 96580 - DNA, 20 bp, Artificial Sequence
  Description of Artificial Sequence: Synthetic oligonucleotide
  Target: ATXN1; (-) strand; PAM type: NRG; PAM sequence: GAG
gagtcttggtgacacgcaca

SEQ ID NO: 96581 - DNA, 20 bp, Artificial Sequence
  Description of Artificial Sequence: Synthetic oligonucleotide
  Target: ATXN1; (-) strand; PAM type: NRG; PAM sequence: CAG
aagagtcttggtgacacgca

SEQ ID NO: 96582 - DNA, 20 bp, Artificial Sequence
  Description of Artificial Sequence: Synthetic oligonucleotide
  Target: ATXN1; (-) strand; PAM type: NRG; PAM sequence: TGG
agtatgtcttttaagagtct

SEQ ID NO: 96583 - DNA, 20 bp, Artificial Sequence
  Description of Artificial Sequence: Synthetic oligonucleotide
  Target: ATXN1; (-) strand; PAM type: NRG; PAM sequence: GAG
ttcagaagtatgtcttttaa

SEQ ID NO: 96584 - DNA, 20 bp, Artificial Sequence
  Description of Artificial Sequence: Synthetic oligonucleotide
  Target: ATXN1; (-) strand; PAM type: NRG; PAM sequence: AAG
gattcagaagtatgtctttt

SEQ ID NO: 96585 - DNA, 20 bp, Artificial Sequence
  Description of Artificial Sequence: Synthetic oligonucleotide
  Target: ATXN1; (-) strand; PAM type: NRG; PAM sequence: AAG
ggtcaagaaagatgattcag

SEQ ID NO: 96586 - DNA, 20 bp, Artificial Sequence
  Description of Artificial Sequence: Synthetic oligonucleotide
  Target: ATXN1; (-) strand; PAM type: NRG; PAM sequence: CAG
gagggtcaagaaagatgatt

SEQ ID NO: 96587 - DNA, 20 bp, Artificial Sequence
  Description of Artificial Sequence: Synthetic oligonucleotide
  Target: ATXN1; (-) strand; PAM type: NRG; PAM sequence: AAG
agtttggtggagggtcaaga

SEQ ID NO: 96588 - DNA, 20 bp, Artificial Sequence
  Description of Artificial Sequence: Synthetic oligonucleotide
  Target: ATXN1; (-) strand; PAM type: NRG; PAM sequence: AAG
ctacagtttggtggagggtc

SEQ ID NO: 96589 - DNA, 20 bp, Artificial Sequence
  Description of Artificial Sequence: Synthetic oligonucleotide
  Target: ATXN1; (-) strand; PAM type: NRG; PAM sequence: GGG
tcttgctacagtttggtgga

SEQ ID NO: 96590 - DNA, 20 bp, Artificial Sequence
  Description of Artificial Sequence: Synthetic oligonucleotide
  Target: ATXN1; (-) strand; PAM type: NRG; PAM sequence: AGG
gtcttgctacagtttggtgg

SEQ ID NO: 96591 - DNA, 20 bp, Artificial Sequence
  Description of Artificial Sequence: Synthetic oligonucleotide
  Target: ATXN1; (-) strand; PAM type: NRG; PAM sequence: GAG
tgtcttgctacagtttggtg

SEQ ID NO: 96592 - DNA, 20 bp, Artificial Sequence
  Description of Artificial Sequence: Synthetic oligonucleotide
  Target: ATXN1; (-) strand; PAM type: NRG; PAM sequence: TGG
cctgtcttgctacagtttgg

SEQ ID NO: 96593 - DNA, 20 bp, Artificial Sequence
  Description of Artificial Sequence: Synthetic oligonucleotide
  Target: ATXN1; (-) strand; PAM type: NRG; PAM sequence: TGG
aagcctgtcttgctacagtt

SEQ ID NO: 96594 - DNA, 20 bp, Artificial Sequence
  Description of Artificial Sequence: Synthetic oligonucleotide
  Target: ATXN1; (-) strand; PAM type: NRG; PAM sequence: CAG
ccaggaagcctgtcttgcta

SEQ ID NO: 96595 - DNA, 20 bp, Artificial Sequence
  Description of Artificial Sequence: Synthetic oligonucleotide
  Target: ATXN1; (-) strand; PAM type: NRG; PAM sequence: AAG
atgtcattttcattcccagg

SEQ ID NO: 96596 - DNA, 20 bp, Artificial Sequence
  Description of Artificial Sequence: Synthetic oligonucleotide
  Target: ATXN1; (-) strand; PAM type: NRG; PAM sequence: AGG
ctaatgtcattttcattccc

SEQ ID NO: 96597 - DNA, 20 bp, Artificial Sequence
  Description of Artificial Sequence: Synthetic oligonucleotide
  Target: ATXN1; (-) strand; PAM type: NRG; PAM sequence: CAG
gctaatgtcattttcattcc

SEQ ID NO: 96598 - DNA, 20 bp, Artificial Sequence
  Description of Artificial Sequence: Synthetic oligonucleotide
  Target: ATXN1; (+) strand; PAM type: NRG; PAM sequence: TAG
gttgcttagtgttcatgcca

SEQ ID NO: 96599 - DNA, 20 bp, Artificial Sequence
  Description of Artificial Sequence: Synthetic oligonucleotide
  Target: ATXN1; (+) strand; PAM type: NRG; PAM sequence: AGG
ttgcttagtgttcatgccat

SEQ ID NO: 96600 - DNA, 20 bp, Artificial Sequence
  Description of Artificial Sequence: Synthetic oligonucleotide
  Target: ATXN1; (+) strand; PAM type: NRG; PAM sequence: CAG
ttagtgttcatgccataggc

SEQ ID NO: 96601 - DNA, 20 bp, Artificial Sequence
  Description of Artificial Sequence: Synthetic oligonucleotide
  Target: ATXN1; (+) strand; PAM type: NRG; PAM sequence: GAG
tcatgccataggccagactt

SEQ ID NO: 96602 - DNA, 20 bp, Artificial Sequence
  Description of Artificial Sequence: Synthetic oligonucleotide
  Target: ATXN1; (+) strand; PAM type: NRG; PAM sequence: AAG
aatgtgaacgttgctatcca

SEQ ID NO: 96603 - DNA, 20 bp, Artificial Sequence
  Description of Artificial Sequence: Synthetic oligonucleotide
  Target: ATXN1; (+) strand; PAM type: NRG; PAM sequence: TGG
gaacgttgctatccaaagcc

SEQ ID NO: 96604 - DNA, 20 bp, Artificial Sequence
  Description of Artificial Sequence: Synthetic oligonucleotide
  Target: ATXN1; (+) strand; PAM type: NRG; PAM sequence: AAG
cgttgctatccaaagcctgg

SEQ ID NO: 96605 - DNA, 20 bp, Artificial Sequence
  Description of Artificial Sequence: Synthetic oligonucleotide
  Target: ATXN1; (+) strand; PAM type: NRG; PAM sequence: TGG
atccaaagcctggaagcctc

SEQ ID NO: 96606 - DNA, 20 bp, Artificial Sequence
  Description of Artificial Sequence: Synthetic oligonucleotide
  Target: ATXN1; (+) strand; PAM type: NRG; PAM sequence: AAG
gcctggaagcctctggtgct

SEQ ID NO: 96607 - DNA, 20 bp, Artificial Sequence
  Description of Artificial Sequence: Synthetic oligonucleotide
  Target: ATXN1; (+) strand; PAM type: NRG; PAM sequence: CAG
ggaagcctctggtgctaaga

SEQ ID NO: 96608 - DNA, 20 bp, Artificial Sequence
  Description of Artificial Sequence: Synthetic oligonucleotide
  Target: ATXN1; (+) strand; PAM type: NRG; PAM sequence: AGG
gaagcctctggtgctaagac

SEQ ID NO: 96609 - DNA, 20 bp, Artificial Sequence
  Description of Artificial Sequence: Synthetic oligonucleotide
  Target: ATXN1; (+) strand; PAM type: NRG; PAM sequence: TGG
tctggtgctaagacaggtct

SEQ ID NO: 96610 - DNA, 20 bp, Artificial Sequence
  Description of Artificial Sequence: Synthetic oligonucleotide
  Target: ATXN1; (+) strand; PAM type: NRG; PAM sequence: TGG
tcctctgattccaccttgct

SEQ ID NO: 96611 - DNA, 20 bp, Artificial Sequence
  Description of Artificial Sequence: Synthetic oligonucleotide
  Target: ATXN1; (+) strand; PAM type: NRG; PAM sequence: CAG
tgcttggacccacacatgtg

SEQ ID NO: 96612 - DNA, 20 bp, Artificial Sequence
  Description of Artificial Sequence: Synthetic oligonucleotide
  Target: ATXN1; (+) strand; PAM type: NRG; PAM sequence: AGG
gcttggacccacacatgtgc

SEQ ID NO: 96613 - DNA, 20 bp, Artificial Sequence
  Description of Artificial Sequence: Synthetic oligonucleotide
  Target: ATXN1; (+) strand; PAM type: NRG; PAM sequence: GGG
cttggacccacacatgtgca

SEQ ID NO: 96614 - DNA, 20 bp, Artificial Sequence
  Description of Artificial Sequence: Synthetic oligonucleotide
  Target: ATXN1; (+) strand; PAM type: NRG; PAM sequence: TAG
cccacacatgtgcagggtga

SEQ ID NO: 96615 - DNA, 20 bp, Artificial Sequence
  Description of Artificial Sequence: Synthetic oligonucleotide
  Target: ATXN1; (+) strand; PAM type: NRG; PAM sequence: AGG
ccacacatgtgcagggtgat

SEQ ID NO: 96616 - DNA, 20 bp, Artificial Sequence
  Description of Artificial Sequence: Synthetic oligonucleotide
  Target: ATXN1; (+) strand; PAM type: NRG; PAM sequence: TAG
catgtgcagggtgataggtg

SEQ ID NO: 96617 - DNA, 20 bp, Artificial Sequence
  Description of Artificial Sequence: Synthetic oligonucleotide
  Target: ATXN1; (+) strand; PAM type: NRG; PAM sequence: AAG
tgataggtgtagtgacctgt

SEQ ID NO: 96618 - DNA, 20 bp, Artificial Sequence
  Description of Artificial Sequence: Synthetic oligonucleotide
  Target: ATXN1; (+) strand; PAM type: NRG; PAM sequence: GAG
ataggtgtagtgacctgtaa

SEQ ID NO: 96619 - DNA, 20 bp, Artificial Sequence
  Description of Artificial Sequence: Synthetic oligonucleotide
  Target: ATXN1; (+) strand; PAM type: NRG; PAM sequence: CAG
tgtagtgacctgtaagagaa

SEQ ID NO: 96620 - DNA, 20 bp, Artificial Sequence
  Description of Artificial Sequence: Synthetic oligonucleotide
  Target: ATXN1; (+) strand; PAM type: NRG; PAM sequence: AGG
gtagtgacctgtaagagaac

SEQ ID NO: 96621 - DNA, 20 bp, Artificial Sequence
  Description of Artificial Sequence: Synthetic oligonucleotide
  Target: ATXN1; (+) strand; PAM type: NRG; PAM sequence: GGG
tagtgacctgtaagagaaca

SEQ ID NO: 96622 - DNA, 20 bp, Artificial Sequence
  Description of Artificial Sequence: Synthetic oligonucleotide
  Target: ATXN1; (+) strand; PAM type: NRG; PAM sequence: GAG
gtgacctgtaagagaacagg

SEQ ID NO: 96623 - DNA, 20 bp, Artificial Sequence
  Description of Artificial Sequence: Synthetic oligonucleotide
  Target: ATXN1; (+) strand; PAM type: NRG; PAM sequence: TGG
aagagaacagggagtcgaac

SEQ ID NO: 96624 - DNA, 20 bp, Artificial Sequence
  Description of Artificial Sequence: Synthetic oligonucleotide
  Target: ATXN1; (+) strand; PAM type: NRG; PAM sequence: GGG
agagaacagggagtcgaact

SEQ ID NO: 96625 - DNA, 20 bp, Artificial Sequence
  Description of Artificial Sequence: Synthetic oligonucleotide
  Target: ATXN1; (+) strand; PAM type: NRG; PAM sequence: GGG
gagaacagggagtcgaactg

SEQ ID NO: 96626 - DNA, 20 bp, Artificial Sequence
  Description of Artificial Sequence: Synthetic oligonucleotide
  Target: ATXN1; (+) strand; PAM type: NRG; PAM sequence: GGG
agaacagggagtcgaactgg

SEQ ID NO: 96627 - DNA, 20 bp, Artificial Sequence
  Description of Artificial Sequence: Synthetic oligonucleotide
  Target: ATXN1; (+) strand; PAM type: NRG; PAM sequence: TGG
acagggagtcgaactggggg

SEQ ID NO: 96628 - DNA, 20 bp, Artificial Sequence
  Description of Artificial Sequence: Synthetic oligonucleotide
  Target: ATXN1; (+) strand; PAM type: NRG; PAM sequence: CAG
ggagtcgaactgggggtggc

SEQ ID NO: 96629 - DNA, 20 bp, Artificial Sequence
  Description of Artificial Sequence: Synthetic oligonucleotide
  Target: ATXN1; (+) strand; PAM type: NRG; PAM sequence: CAG
ctgggggtggccagtgtacc

SEQ ID NO: 96630 - DNA, 20 bp, Artificial Sequence
  Description of Artificial Sequence: Synthetic oligonucleotide
  Target: ATXN1; (+) strand; PAM type: NRG; PAM sequence: AAG
ggtggccagtgtacccagca

SEQ ID NO: 96631 - DNA, 20 bp, Artificial Sequence
  Description of Artificial Sequence: Synthetic oligonucleotide
  Target: ATXN1; (+) strand; PAM type: NRG; PAM sequence: CAG
ggccagtgtacccagcaaag

SEQ ID NO: 96632 - DNA, 20 bp, Artificial Sequence
  Description of Artificial Sequence: Synthetic oligonucleotide
  Target: ATXN1; (+) strand; PAM type: NRG; PAM sequence: AAG
agtgtacccagcaaagcaga

SEQ ID NO: 96633 - DNA, 20 bp, Artificial Sequence
  Description of Artificial Sequence: Synthetic oligonucleotide
  Target: ATXN1; (+) strand; PAM type: NRG; PAM sequence: CAG
tacccagcaaagcagaaaga

SEQ ID NO: 96634 - DNA, 20 bp, Artificial Sequence
  Description of Artificial Sequence: Synthetic oligonucleotide
  Target: ATXN1; (+) strand; PAM type: NRG; PAM sequence: AGG
acccagcaaagcagaaagac

SEQ ID NO: 96635 - DNA, 20 bp, Artificial Sequence
  Description of Artificial Sequence: Synthetic oligonucleotide
  Target: ATXN1; (+) strand; PAM type: NRG; PAM sequence: CAG
cagcaaagcagaaagacagg

SEQ ID NO: 96636 - DNA, 20 bp, Artificial Sequence
  Description of Artificial Sequence: Synthetic oligonucleotide
  Target: ATXN1; (+) strand; PAM type: NRG; PAM sequence: AGG
agcaaagcagaaagacaggc

SEQ ID NO: 96637 - DNA, 20 bp, Artificial Sequence
  Description of Artificial Sequence: Synthetic oligonucleotide
  Target: ATXN1; (+) strand; PAM type: NRG; PAM sequence: CAG
agacaggcaggctatcaaaa

SEQ ID NO: 96638 - DNA, 20 bp, Artificial Sequence
  Description of Artificial Sequence: Synthetic oligonucleotide
  Target: ATXN1; (+) strand; PAM type: NRG; PAM sequence: GAG
acaggcaggctatcaaaaca

SEQ ID NO: 96639 - DNA, 20 bp, Artificial Sequence
  Description of Artificial Sequence: Synthetic oligonucleotide
  Target: ATXN1; (+) strand; PAM type: NRG; PAM sequence: TGG
cttcaatgaaatcaccttgc

SEQ ID NO: 96640 - DNA, 20 bp, Artificial Sequence
  Description of Artificial Sequence: Synthetic oligonucleotide
  Target: ATXN1; (+) strand; PAM type: NRG; PAM sequence: AAG
cttgctggtgatttccacgt

SEQ ID NO: 96641 - DNA, 20 bp, Artificial Sequence
  Description of Artificial Sequence: Synthetic oligonucleotide
  Target: ATXN1; (+) strand; PAM type: NRG; PAM sequence: TGG
ctggtgatttccacgtaagc

SEQ ID NO: 96642 - DNA, 20 bp, Artificial Sequence
  Description of Artificial Sequence: Synthetic oligonucleotide
  Target: ATXN1; (+) strand; PAM type: NRG; PAM sequence: TAG
gtgatttccacgtaagctgg

SEQ ID NO: 96643 - DNA, 20 bp, Artificial Sequence
  Description of Artificial Sequence: Synthetic oligonucleotide
  Target: ATXN1; (+) strand; PAM type: NRG; PAM sequence: AGG
tgatttccacgtaagctggt

SEQ ID NO: 96644 - DNA, 20 bp, Artificial Sequence
  Description of Artificial Sequence: Synthetic oligonucleotide
  Target: ATXN1; (+) strand; PAM type: NRG; PAM sequence: TGG
attttatgtcctcctcgtcc

SEQ ID NO: 96645 - DNA, 20 bp, Artificial Sequence
  Description of Artificial Sequence: Synthetic oligonucleotide
  Target: ATXN1; (+) strand; PAM type: NRG; PAM sequence: AAG
cgtcctggtcgtcccccttg

SEQ ID NO: 96646 - DNA, 20 bp, Artificial Sequence
  Description of Artificial Sequence: Synthetic oligonucleotide
  Target: ATXN1; (+) strand; PAM type: NRG; PAM sequence: TAG
agacacttgatttctgatct

SEQ ID NO: 96647 - DNA, 20 bp, Artificial Sequence
  Description of Artificial Sequence: Synthetic oligonucleotide
  Target: ATXN1; (+) strand; PAM type: NRG; PAM sequence: CAG
cttgatttctgatcttagac

SEQ ID NO: 96648 - DNA, 20 bp, Artificial Sequence
  Description of Artificial Sequence: Synthetic oligonucleotide
  Target: ATXN1; (+) strand; PAM type: NRG; PAM sequence: CAG
atttctgatcttagaccaga

SEQ ID NO: 96649 - DNA, 20 bp, Artificial Sequence
  Description of Artificial Sequence: Synthetic oligonucleotide
  Target: ATXN1; (+) strand; PAM type: NRG; PAM sequence: AGG
tttctgatcttagaccagac

SEQ ID NO: 96650 - DNA, 20 bp, Artificial Sequence
  Description of Artificial Sequence: Synthetic oligonucleotide
  Target: ATXN1; (+) strand; PAM type: NRG; PAM sequence: CGG
ctgatcttagaccagacagg

SEQ ID NO: 96651 - DNA, 20 bp, Artificial Sequence
  Description of Artificial Sequence: Synthetic oligonucleotide
  Target: ATXN1; (+) strand; PAM type: NRG; PAM sequence: GGG
tgatcttagaccagacaggc

SEQ ID NO: 96652 - DNA, 20 bp, Artificial Sequence
  Description of Artificial Sequence: Synthetic oligonucleotide
  Target: ATXN1; (+) strand; PAM type: NRG; PAM sequence: GAG
atcttagaccagacaggcgg

SEQ ID NO: 96653 - DNA, 20 bp, Artificial Sequence
  Description of Artificial Sequence: Synthetic oligonucleotide
  Target: ATXN1; (+) strand; PAM type: NRG; PAM sequence: AGG
tcttagaccagacaggcggg

SEQ ID NO: 96654 - DNA, 20 bp, Artificial Sequence
  Description of Artificial Sequence: Synthetic oligonucleotide
  Target: ATXN1; (+) strand; PAM type: NRG; PAM sequence: AAG
gaccagacaggcgggaggtg

SEQ ID NO: 96655 - DNA, 20 bp, Artificial Sequence
  Description of Artificial Sequence: Synthetic oligonucleotide
  Target: ATXN1; (+) strand; PAM type: NRG; PAM sequence: TGG
acaggcgggaggtgaagctc

SEQ ID NO: 96656 - DNA, 20 bp, Artificial Sequence
  Description of Artificial Sequence: Synthetic oligonucleotide
  Target: ATXN1; (+) strand; PAM type: NRG; PAM sequence: TAG
gacttttcctgttgttgacg

SEQ ID NO: 96657 - DNA, 20 bp, Artificial Sequence
  Description of Artificial Sequence: Synthetic oligonucleotide
  Target: ATXN1; (+) strand; PAM type: NRG; PAM sequence: AGG
acttttcctgttgttgacgt

SEQ ID NO: 96658 - DNA, 20 bp, Artificial Sequence
  Description of Artificial Sequence: Synthetic oligonucleotide
  Target: ATXN1; (+) strand; PAM type: NRG; PAM sequence: GAG
ttttcctgttgttgacgtag

SEQ ID NO: 96659 - DNA, 20 bp, Artificial Sequence
  Description of Artificial Sequence: Synthetic oligonucleotide
  Target: ATXN1; (+) strand; PAM type: NRG; PAM sequence: AGG
tttcctgttgttgacgtagg

SEQ ID NO: 96660 - DNA, 20 bp, Artificial Sequence
  Description of Artificial Sequence: Synthetic oligonucleotide
  Target: ATXN1; (+) strand; PAM type: NRG; PAM sequence: CAG
ctgttgttgacgtaggagga

SEQ ID NO: 96661 - DNA, 20 bp, Artificial Sequence
  Description of Artificial Sequence: Synthetic oligonucleotide
  Target: ATXN1; (+) strand; PAM type: NRG; PAM sequence: AGG
tgttgttgacgtaggaggac

SEQ ID NO: 96662 - DNA, 20 bp, Artificial Sequence
  Description of Artificial Sequence: Synthetic oligonucleotide
  Target: ATXN1; (+) strand; PAM type: NRG; PAM sequence: GAG
ttgttgacgtaggaggacag

SEQ ID NO: 96663 - DNA, 20 bp, Artificial Sequence
  Description of Artificial Sequence: Synthetic oligonucleotide
  Target: ATXN1; (+) strand; PAM type: NRG; PAM sequence: AGG
tgttgacgtaggaggacagg

SEQ ID NO: 96664 - DNA, 20 bp, Artificial Sequence
  Description of Artificial Sequence: Synthetic oligonucleotide
  Target: ATXN1; (+) strand; PAM type: NRG; PAM sequence: CAG
ggaggacaggaggctgtttc

SEQ ID NO: 96665 - DNA, 20 bp, Artificial Sequence
  Description of Artificial Sequence: Synthetic oligonucleotide
  Target: ATXN1; (+) strand; PAM type: NRG; PAM sequence: AGG
gaggacaggaggctgtttcc

SEQ ID NO: 96666 - DNA, 20 bp, Artificial Sequence
  Description of Artificial Sequence: Synthetic oligonucleotide
  Target: ATXN1; (+) strand; PAM type: NRG; PAM sequence: GGG
aggacaggaggctgtttcca

SEQ ID NO: 96667 - DNA, 20 bp, Artificial Sequence
  Description of Artificial Sequence: Synthetic oligonucleotide
  Target: ATXN1; (+) strand; PAM type: NRG; PAM sequence: GGG
ggacaggaggctgtttccag

SEQ ID NO: 96668 - DNA, 20 bp, Artificial Sequence
  Description of Artificial Sequence: Synthetic oligonucleotide
  Target: ATXN1; (+) strand; PAM type: NRG; PAM sequence: GGG
gacaggaggctgtttccagg

SEQ ID NO: 96669 - DNA, 20 bp, Artificial Sequence
  Description of Artificial Sequence: Synthetic oligonucleotide
  Target: ATXN1; (+) strand; PAM type: NRG; PAM sequence: GGG
acaggaggctgtttccaggg

SEQ ID NO: 96670 - DNA, 20 bp, Artificial Sequence
  Description of Artificial Sequence: Synthetic oligonucleotide
  Target: ATXN1; (+) strand; PAM type: NRG; PAM sequence: CGG
ggctgtttccaggggggaat

SEQ ID NO: 96671 - DNA, 20 bp, Artificial Sequence
  Description of Artificial Sequence: Synthetic oligonucleotide
  Target: ATXN1; (+) strand; PAM type: NRG; PAM sequence: CAG
gtttccaggggggaatcggc

SEQ ID NO: 96672 - DNA, 20 bp, Artificial Sequence
  Description of Artificial Sequence: Synthetic oligonucleotide
  Target: ATXN1; (+) strand; PAM type: NRG; PAM sequence: AGG
tttccaggggggaatcggcc

SEQ ID NO: 96673 - DNA, 20 bp, Artificial Sequence
  Description of Artificial Sequence: Synthetic oligonucleotide
  Target: ATXN1; (+) strand; PAM type: NRG; PAM sequence: GGG
ttccaggggggaatcggcca

SEQ ID NO: 96674 - DNA, 20 bp, Artificial Sequence
  Description of Artificial Sequence: Synthetic oligonucleotide
  Target: ATXN1; (+) strand; PAM type: NRG; PAM sequence: TGG
ggaatcggccagggccattc

SEQ ID NO: 96675 - DNA, 20 bp, Artificial Sequence
  Description of Artificial Sequence: Synthetic oligonucleotide
  Target: ATXN1; (+) strand; PAM type: NRG; PAM sequence: GGG
gaatcggccagggccattct

SEQ ID NO: 96676 - DNA, 20 bp, Artificial Sequence
  Description of Artificial Sequence: Synthetic oligonucleotide
  Target: ATXN1; (+) strand; PAM type: NRG; PAM sequence: GGG
aatcggccagggccattctg

SEQ ID NO: 96677 - DNA, 20 bp, Artificial Sequence
  Description of Artificial Sequence: Synthetic oligonucleotide
  Target: ATXN1; (+) strand; PAM type: NRG; PAM sequence: GGG
atcggccagggccattctgg

SEQ ID NO: 96678 - DNA, 20 bp, Artificial Sequence
  Description of Artificial Sequence: Synthetic oligonucleotide
  Target: ATXN1; (+) strand; PAM type: NRG; PAM sequence: TGG
gggccattctgggggcattt

SEQ ID NO: 96679 - DNA, 20 bp, Artificial Sequence
  Description of Artificial Sequence: Synthetic oligonucleotide
  Target: ATXN1; (+) strand; PAM type: NRG; PAM sequence: GGG
ggccattctgggggcatttt

SEQ ID NO: 96680 - DNA, 20 bp, Artificial Sequence
  Description of Artificial Sequence: Synthetic oligonucleotide
  Target: ATXN1; (+) strand; PAM type: NRG; PAM sequence: TGG
ctgggggcattttgggctcc

SEQ ID NO: 96681 - DNA, 20 bp, Artificial Sequence
  Description of Artificial Sequence: Synthetic oligonucleotide
  Target: ATXN1; (+) strand; PAM type: NRG; PAM sequence: TGG
cattttgggctcctggttgt

SEQ ID NO: 96682 - DNA, 20 bp, Artificial Sequence
  Description of Artificial Sequence: Synthetic oligonucleotide
  Target: ATXN1; (+) strand; PAM type: NRG; PAM sequence: GGG
attttgggctcctggttgtt

SEQ ID NO: 96683 - DNA, 20 bp, Artificial Sequence
  Description of Artificial Sequence: Synthetic oligonucleotide
  Target: ATXN1; (+) strand; PAM type: NRG; PAM sequence: AAG
ttgggctcctggttgttggg

SEQ ID NO: 96684 - DNA, 20 bp, Artificial Sequence
  Description of Artificial Sequence: Synthetic oligonucleotide
  Target: ATXN1; (+) strand; PAM type: NRG; PAM sequence: TGG
gctcctggttgttgggaagt

SEQ ID NO: 96685 - DNA, 20 bp, Artificial Sequence
  Description of Artificial Sequence: Synthetic oligonucleotide
  Target: ATXN1; (+) strand; PAM type: NRG; PAM sequence: GAG
gggaagttggtgtgcatgtt

SEQ ID NO: 96686 - DNA, 20 bp, Artificial Sequence
  Description of Artificial Sequence: Synthetic oligonucleotide
  Target: ATXN1; (+) strand; PAM type: NRG; PAM sequence: AGG
ggaagttggtgtgcatgttg

SEQ ID NO: 96687 - DNA, 20 bp, Artificial Sequence
  Description of Artificial Sequence: Synthetic oligonucleotide
  Target: ATXN1; (+) strand; PAM type: NRG; PAM sequence: TAG
agttggtgtgcatgttgagg

SEQ ID NO: 96688 - DNA, 20 bp, Artificial Sequence
  Description of Artificial Sequence: Synthetic oligonucleotide
  Target: ATXN1; (+) strand; PAM type: NRG; PAM sequence: TAG
gtgtgcatgttgaggtagaa

SEQ ID NO: 96689 - DNA, 20 bp, Artificial Sequence
  Description of Artificial Sequence: Synthetic oligonucleotide
  Target: ATXN1; (+) strand; PAM type: NRG; PAM sequence: AAG
gcatgttgaggtagaataga

SEQ ID NO: 96690 - DNA, 20 bp, Artificial Sequence
  Description of Artificial Sequence: Synthetic oligonucleotide
  Target: ATXN1; (+) strand; PAM type: NRG; PAM sequence: AGG
catgttgaggtagaatagaa

SEQ ID NO: 96691 - DNA, 20 bp, Artificial Sequence
  Description of Artificial Sequence: Synthetic oligonucleotide
  Target: ATXN1; (+) strand; PAM type: NRG; PAM sequence: AAG
tgaggtagaatagaaaggta

SEQ ID NO: 96692 - DNA, 20 bp, Artificial Sequence
  Description of Artificial Sequence: Synthetic oligonucleotide
  Target: ATXN1; (+) strand; PAM type: NRG; PAM sequence: AGG
gaggtagaatagaaaggtaa

SEQ ID NO: 96693 - DNA, 20 bp, Artificial Sequence
  Description of Artificial Sequence: Synthetic oligonucleotide
  Target: ATXN1; (+) strand; PAM type: NRG; PAM sequence: TGG
gtagaatagaaaggtaaagg

SEQ ID NO: 96694 - DNA, 20 bp, Artificial Sequence
  Description of Artificial Sequence: Synthetic oligonucleotide
  Target: ATXN1; (+) strand; PAM type: NRG; PAM sequence: TAG
aaggtaaaggtggtttctgt

SEQ ID NO: 96695 - DNA, 20 bp, Artificial Sequence
  Description of Artificial Sequence: Synthetic oligonucleotide
  Target: ATXN1; (+) strand; PAM type: NRG; PAM sequence: CAG
gtaaaggtggtttctgttag

SEQ ID NO: 96696 - DNA, 20 bp, Artificial Sequence
  Description of Artificial Sequence: Synthetic oligonucleotide
  Target: ATXN1; (+) strand; PAM type: NRG; PAM sequence: CAG
aaggtggtttctgttagcag

SEQ ID NO: 96697 - DNA, 20 bp, Artificial Sequence
  Description of Artificial Sequence: Synthetic oligonucleotide
  Target: ATXN1; (+) strand; PAM type: NRG; PAM sequence: GAG
ggtggtttctgttagcagca

SEQ ID NO: 96698 - DNA, 20 bp, Artificial Sequence
  Description of Artificial Sequence: Synthetic oligonucleotide
  Target: ATXN1; (+) strand; PAM type: NRG; PAM sequence: AGG
gtggtttctgttagcagcag

SEQ ID NO: 96699 - DNA, 20 bp, Artificial Sequence
  Description of Artificial Sequence: Synthetic oligonucleotide
  Target: ATXN1; (+) strand; PAM type: NRG; PAM sequence: GGG
tggtttctgttagcagcaga

SEQ ID NO: 96700 - DNA, 20 bp, Artificial Sequence
  Description of Artificial Sequence: Synthetic oligonucleotide
  Target: ATXN1; (+) strand; PAM type: NRG; PAM sequence: GGG
ggtttctgttagcagcagag

SEQ ID NO: 96701 - DNA, 20 bp, Artificial Sequence
  Description of Artificial Sequence: Synthetic oligonucleotide
  Target: ATXN1; (+) strand; PAM type: NRG; PAM sequence: GAG
tttctgttagcagcagaggg

SEQ ID NO: 96702 - DNA, 20 bp, Artificial Sequence
  Description of Artificial Sequence: Synthetic oligonucleotide
  Target: ATXN1; (+) strand; PAM type: NRG; PAM sequence: TGG
agcagaggggagcacgttgc

SEQ ID NO: 96703 - DNA, 20 bp, Artificial Sequence
  Description of Artificial Sequence: Synthetic oligonucleotide
  Target: ATXN1; (+) strand; PAM type: NRG; PAM sequence: GAG
cagaggggagcacgttgctg

SEQ ID NO: 96704 - DNA, 20 bp, Artificial Sequence
  Description of Artificial Sequence: Synthetic oligonucleotide
  Target: ATXN1; (+) strand; PAM type: NRG; PAM sequence: GAG
gaggggagcacgttgctgga

SEQ ID NO: 96705 - DNA, 20 bp, Artificial Sequence
  Description of Artificial Sequence: Synthetic oligonucleotide
  Target: ATXN1; (+) strand; PAM type: NRG; PAM sequence: TGG
gagcacgttgctggagagaa

SEQ ID NO: 96706 - DNA, 20 bp, Artificial Sequence
  Description of Artificial Sequence: Synthetic oligonucleotide
  Target: ATXN1; (+) strand; PAM type: NRG; PAM sequence: AAG
ttgctggagagaatggcacc

SEQ ID NO: 96707 - DNA, 20 bp, Artificial Sequence
  Description of Artificial Sequence: Synthetic oligonucleotide
  Target: ATXN1; (+) strand; PAM type: NRG; PAM sequence: CAG
ctggagagaatggcaccaag

SEQ ID NO: 96708 - DNA, 20 bp, Artificial Sequence
  Description of Artificial Sequence: Synthetic oligonucleotide
  Target: ATXN1; (+) strand; PAM type: NRG; PAM sequence: AGG
tggagagaatggcaccaagc

SEQ ID NO: 96709 - DNA, 20 bp, Artificial Sequence
  Description of Artificial Sequence: Synthetic oligonucleotide
  Target: ATXN1; (+) strand; PAM type: NRG; PAM sequence: GGG
ggagagaatggcaccaagca

SEQ ID NO: 96710 - DNA, 20 bp, Artificial Sequence
  Description of Artificial Sequence: Synthetic oligonucleotide
  Target: ATXN1; (+) strand; PAM type: NRG; PAM sequence: TGG
tggcaccaagcagggtgtta

SEQ ID NO: 96711 - DNA, 20 bp, Artificial Sequence
  Description of Artificial Sequence: Synthetic oligonucleotide
  Target: ATXN1; (+) strand; PAM type: NRG; PAM sequence: GGG
ggcaccaagcagggtgttat

SEQ ID NO: 96712 - DNA, 20 bp, Artificial Sequence
  Description of Artificial Sequence: Synthetic oligonucleotide
  Target: ATXN1; (+) strand; PAM type: NRG; PAM sequence: AAG
tatgggtccctgactccttc

SEQ ID NO: 96713 - DNA, 20 bp, Artificial Sequence
  Description of Artificial Sequence: Synthetic oligonucleotide
  Target: ATXN1; (+) strand; PAM type: NRG; PAM sequence: CAG
ctccttcaagcgctgctcac

SEQ ID NO: 96714 - DNA, 20 bp, Artificial Sequence
  Description of Artificial Sequence: Synthetic oligonucleotide
  Target: ATXN1; (+) strand; PAM type: NRG; PAM sequence: AGG
tccttcaagcgctgctcacc

SEQ ID NO: 96715 - DNA, 20 bp, Artificial Sequence
  Description of Artificial Sequence: Synthetic oligonucleotide
  Target: ATXN1; (+) strand; PAM type: NRG; PAM sequence: CAG
actttcctctccgcaacatg

SEQ ID NO: 96716 - DNA, 20 bp, Artificial Sequence
  Description of Artificial Sequence: Synthetic oligonucleotide
  Target: ATXN1; (+) strand; PAM type: NRG; PAM sequence: AGG
ctttcctctccgcaacatgc

SEQ ID NO: 96717 - DNA, 20 bp, Artificial Sequence
  Description of Artificial Sequence: Synthetic oligonucleotide
  Target: ATXN1; (+) strand; PAM type: NRG; PAM sequence: GGG
tttcctctccgcaacatgca

SEQ ID NO: 96718 - DNA, 20 bp, Artificial Sequence
  Description of Artificial Sequence: Synthetic oligonucleotide
  Target: ATXN1; (+) strand; PAM type: NRG; PAM sequence: CAG
cctctccgcaacatgcaggg

SEQ ID NO: 96719 - DNA, 20 bp, Artificial Sequence
  Description of Artificial Sequence: Synthetic oligonucleotide
  Target: ATXN1; (+) strand; PAM type: NRG; PAM sequence: CAG
tccgcaacatgcagggcagc

SEQ ID NO: 96720 - DNA, 20 bp, Artificial Sequence
  Description of Artificial Sequence: Synthetic oligonucleotide
  Target: ATXN1; (+) strand; PAM type: NRG; PAM sequence: GAG
catgcagggcagccagcaat

SEQ ID NO: 96721 - DNA, 20 bp, Artificial Sequence
  Description of Artificial Sequence: Synthetic oligonucleotide
  Target: ATXN1; (+) strand; PAM type: NRG; PAM sequence: TGG
agcaatgagcccgtgccctt

SEQ ID NO: 96722 - DNA, 20 bp, Artificial Sequence
  Description of Artificial Sequence: Synthetic oligonucleotide
  Target: ATXN1; (+) strand; PAM type: NRG; PAM sequence: GGG
gcaatgagcccgtgcccttt

SEQ ID NO: 96723 - DNA, 20 bp, Artificial Sequence
  Description of Artificial Sequence: Synthetic oligonucleotide
  Target: ATXN1; (+) strand; PAM type: NRG; PAM sequence: CGG
atgagcccgtgccctttggg

SEQ ID NO: 96724 - DNA, 20 bp, Artificial Sequence
  Description of Artificial Sequence: Synthetic oligonucleotide
  Target: ATXN1; (+) strand; PAM type: NRG; PAM sequence: GGG
tgagcccgtgccctttgggc

SEQ ID NO: 96725 - DNA, 20 bp, Artificial Sequence
  Description of Artificial Sequence: Synthetic oligonucleotide
  Target: ATXN1; (+) strand; PAM type: NRG; PAM sequence: GAG
agcccgtgccctttgggcgg

SEQ ID NO: 96726 - DNA, 20 bp, Artificial Sequence
  Description of Artificial Sequence: Synthetic oligonucleotide
  Target: ATXN1; (+) strand; PAM type: NRG; PAM sequence: AGG
gcccgtgccctttgggcggg

SEQ ID NO: 96727 - DNA, 20 bp, Artificial Sequence
  Description of Artificial Sequence: Synthetic oligonucleotide
  Target: ATXN1; (+) strand; PAM type: NRG; PAM sequence: GAG
cgggaggaatgtgttcatct

SEQ ID NO: 96728 - DNA, 20 bp, Artificial Sequence
  Description of Artificial Sequence: Synthetic oligonucleotide
  Target: ATXN1; (+) strand; PAM type: NRG; PAM sequence: TGG
aatgtgttcatctgagatgc

SEQ ID NO: 96729 - DNA, 20 bp, Artificial Sequence
  Description of Artificial Sequence: Synthetic oligonucleotide
  Target: ATXN1; (+) strand; PAM type: NRG; PAM sequence: TGG
tgagatgctggtgatcatct

SEQ ID NO: 96730 - DNA, 20 bp, Artificial Sequence
  Description of Artificial Sequence: Synthetic oligonucleotide
  Target: ATXN1; (+) strand; PAM type: NRG; PAM sequence: TGG
ctggtgatcatcttggcact

SEQ ID NO: 96731 - DNA, 20 bp, Artificial Sequence
  Description of Artificial Sequence: Synthetic oligonucleotide
  Target: ATXN1; (+) strand; PAM type: NRG; PAM sequence: TAG
gtgatcatcttggcacttgg

SEQ ID NO: 96732 - DNA, 20 bp, Artificial Sequence
  Description of Artificial Sequence: Synthetic oligonucleotide
  Target: ATXN1; (+) strand; PAM type: NRG; PAM sequence: TGG
cttggcacttggtagaaatg

SEQ ID NO: 96733 - DNA, 20 bp, Artificial Sequence
  Description of Artificial Sequence: Synthetic oligonucleotide
  Target: ATXN1; (+) strand; PAM type: NRG; PAM sequence: GGG
ttggcacttggtagaaatgt

SEQ ID NO: 96734 - DNA, 20 bp, Artificial Sequence
  Description of Artificial Sequence: Synthetic oligonucleotide
  Target: ATXN1; (+) strand; PAM type: NRG; PAM sequence: GGG
tggcacttggtagaaatgtg

SEQ ID NO: 96735 - DNA, 20 bp, Artificial Sequence
  Description of Artificial Sequence: Synthetic oligonucleotide
  Target: ATXN1; (+) strand; PAM type: NRG; PAM sequence: TGG
acttggtagaaatgtgggga

SEQ ID NO: 96736 - DNA, 20 bp, Artificial Sequence
  Description of Artificial Sequence: Synthetic oligonucleotide
  Target: ATXN1; (+) strand; PAM type: NRG; PAM sequence: GGG
cttggtagaaatgtggggat

SEQ ID NO: 96737 - DNA, 20 bp, Artificial Sequence
  Description of Artificial Sequence: Synthetic oligonucleotide
  Target: ATXN1; (+) strand; PAM type: NRG; PAM sequence: GGG
ttggtagaaatgtggggatg

SEQ ID NO: 96738 - DNA, 20 bp, Artificial Sequence
  Description of Artificial Sequence: Synthetic oligonucleotide
  Target: ATXN1; (+) strand; PAM type: NRG; PAM sequence: CAG
tagaaatgtggggatggggt

SEQ ID NO: 96739 - DNA, 20 bp, Artificial Sequence
  Description of Artificial Sequence: Synthetic oligonucleotide
  Target: ATXN1; (+) strand; PAM type: NRG; PAM sequence: GAG
gaaatgtggggatggggtca

SEQ ID NO: 96740 - DNA, 20 bp, Artificial Sequence
  Description of Artificial Sequence: Synthetic oligonucleotide
  Target: ATXN1; (+) strand; PAM type: NRG; PAM sequence: AGG
aaatgtggggatggggtcag

SEQ ID NO: 96741 - DNA, 20 bp, Artificial Sequence
  Description of Artificial Sequence: Synthetic oligonucleotide
  Target: ATXN1; (+) strand; PAM type: NRG; PAM sequence: GGG
aatgtggggatggggtcaga

SEQ ID NO: 96742 - DNA, 20 bp, Artificial Sequence
  Description of Artificial Sequence: Synthetic oligonucleotide
  Target: ATXN1; (+) strand; PAM type: NRG; PAM sequence: TGG
gtggggatggggtcagaggg

SEQ ID NO: 96743 - DNA, 20 bp, Artificial Sequence
  Description of Artificial Sequence: Synthetic oligonucleotide
  Target: ATXN1; (+) strand; PAM type: NRG; PAM sequence: GGG
tggggatggggtcagagggt

SEQ ID NO: 96744 - DNA, 20 bp, Artificial Sequence
  Description of Artificial Sequence: Synthetic oligonucleotide
  Target: ATXN1; (+) strand; PAM type: NRG; PAM sequence: GGG
ggggatggggtcagagggtg

SEQ ID NO: 96745 - DNA, 20 bp, Artificial Sequence
  Description of Artificial Sequence: Synthetic oligonucleotide
  Target: ATXN1; (+) strand; PAM type: NRG; PAM sequence: TGG
tggggtcagagggtggggtc

SEQ ID NO: 96746 - DNA, 20 bp, Artificial Sequence
  Description of Artificial Sequence: Synthetic oligonucleotide
  Target: ATXN1; (+) strand; PAM type: NRG; PAM sequence: GAG
agggtggggtctggttttct

SEQ ID NO: 96747 - DNA, 20 bp, Artificial Sequence
  Description of Artificial Sequence: Synthetic oligonucleotide
  Target: ATXN1; (+) strand; PAM type: NRG; PAM sequence: TGG
gtctggttttctgagtgcct

SEQ ID NO: 96748 - DNA, 20 bp, Artificial Sequence
  Description of Artificial Sequence: Synthetic oligonucleotide
  Target: ATXN1; (+) strand; PAM type: NRG; PAM sequence: GGG
tctggttttctgagtgcctt

SEQ ID NO: 96749 - DNA, 20 bp, Artificial Sequence
  Description of Artificial Sequence: Synthetic oligonucleotide
  Target: ATXN1; (+) strand; PAM type: NRG; PAM sequence: GGG
ctggttttctgagtgccttg

SEQ ID NO: 96750 - DNA, 20 bp, Artificial Sequence
  Description of Artificial Sequence: Synthetic oligonucleotide
  Target: ATXN1; (+) strand; PAM type: NRG; PAM sequence: GGG
tggttttctgagtgccttgg

SEQ ID NO: 96751 - DNA, 20 bp, Artificial Sequence
  Description of Artificial Sequence: Synthetic oligonucleotide
  Target: ATXN1; (+) strand; PAM type: NRG; PAM sequence: CAG
tctgagtgccttgggggcta

SEQ ID NO: 96752 - DNA, 20 bp, Artificial Sequence
  Description of Artificial Sequence: Synthetic oligonucleotide
  Target: ATXN1; (+) strand; PAM type: NRG; PAM sequence: AAG
agtgccttgggggctacaga

SEQ ID NO: 96753 - DNA, 20 bp, Artificial Sequence
  Description of Artificial Sequence: Synthetic oligonucleotide
  Target: ATXN1; (+) strand; PAM type: NRG; PAM sequence: TGG
ttgggggctacagaaagtgc

SEQ ID NO: 96754 - DNA, 20 bp, Artificial Sequence
  Description of Artificial Sequence: Synthetic oligonucleotide
  Target: ATXN1; (+) strand; PAM type: NRG; PAM sequence: GAG
gggggctacagaaagtgctg

SEQ ID NO: 96755 - DNA, 20 bp, Artificial Sequence
  Description of Artificial Sequence: Synthetic oligonucleotide
  Target: ATXN1; (+) strand; PAM type: NRG; PAM sequence: TGG
gctacagaaagtgctggagc

SEQ ID NO: 96756 - DNA, 20 bp, Artificial Sequence
  Description of Artificial Sequence: Synthetic oligonucleotide
  Target: ATXN1; (+) strand; PAM type: NRG; PAM sequence: GGG
ctacagaaagtgctggagct

SEQ ID NO: 96757 - DNA, 20 bp, Artificial Sequence
  Description of Artificial Sequence: Synthetic oligonucleotide
  Target: ATXN1; (+) strand; PAM type: NRG; PAM sequence: GAG
acagaaagtgctggagctgg

SEQ ID NO: 96758 - DNA, 20 bp, Artificial Sequence
  Description of Artificial Sequence: Synthetic oligonucleotide
  Target: ATXN1; (+) strand; PAM type: NRG; PAM sequence: TGG
gagctgggagtaattctaat

SEQ ID NO: 96759 - DNA, 20 bp, Artificial Sequence
  Description of Artificial Sequence: Synthetic oligonucleotide
  Target: ATXN1; (+) strand; PAM type: NRG; PAM sequence: GGG
agctgggagtaattctaatt

SEQ ID NO: 96760 - DNA, 20 bp, Artificial Sequence
  Description of Artificial Sequence: Synthetic oligonucleotide
  Target: ATXN1; (+) strand; PAM type: NRG; PAM sequence: AAG
gtaattctaattgggctctt

SEQ ID NO: 96761 - DNA, 20 bp, Artificial Sequence
  Description of Artificial Sequence: Synthetic oligonucleotide
  Target: ATXN1; (+) strand; PAM type: NRG; PAM sequence: AGG
taattctaattgggctctta

SEQ ID NO: 96762 - DNA, 20 bp, Artificial Sequence
  Description of Artificial Sequence: Synthetic oligonucleotide
  Target: ATXN1; (+) strand; PAM type: NRG; PAM sequence: TGG
ttctaattgggctcttaagg

SEQ ID NO: 96763 - DNA, 20 bp, Artificial Sequence
  Description of Artificial Sequence: Synthetic oligonucleotide
  Target: ATXN1; (+) strand; PAM type: NRG; PAM sequence: GGG
tctaattgggctcttaaggt

SEQ ID NO: 96764 - DNA, 20 bp, Artificial Sequence
  Description of Artificial Sequence: Synthetic oligonucleotide
  Target: ATXN1; (+) strand; PAM type: NRG; PAM sequence: GGG
ctaattgggctcttaaggtg

SEQ ID NO: 96765 - DNA, 20 bp, Artificial Sequence
  Description of Artificial Sequence: Synthetic oligonucleotide
  Target: ATXN1; (+) strand; PAM type: NRG; PAM sequence: CGG
attgggctcttaaggtgggg

SEQ ID NO: 96766 - DNA, 20 bp, Artificial Sequence
  Description of Artificial Sequence: Synthetic oligonucleotide
  Target: ATXN1; (+) strand; PAM type: NRG; PAM sequence: GGG
ttgggctcttaaggtggggc

SEQ ID NO: 96767 - DNA, 20 bp, Artificial Sequence
  Description of Artificial Sequence: Synthetic oligonucleotide
  Target: ATXN1; (+) strand; PAM type: NRG; PAM sequence: TAG
cttaaggtggggcgggaaac

SEQ ID NO: 96768 - DNA, 20 bp, Artificial Sequence
  Description of Artificial Sequence: Synthetic oligonucleotide
  Target: ATXN1; (+) strand; PAM type: NRG; PAM sequence: AAG
ggggcgggaaactagataaa

SEQ ID NO: 96769 - DNA, 20 bp, Artificial Sequence
  Description of Artificial Sequence: Synthetic oligonucleotide
  Target: ATXN1; (+) strand; PAM type: NRG; PAM sequence: CAG
agaaaacttctatcgtcttc

SEQ ID NO: 96770 - DNA, 20 bp, Artificial Sequence
  Description of Artificial Sequence: Synthetic oligonucleotide
  Target: ATXN1; (+) strand; PAM type: NRG; PAM sequence: GAG
aaaacttctatcgtcttcca

SEQ ID NO: 96771 - DNA, 20 bp, Artificial Sequence
  Description of Artificial Sequence: Synthetic oligonucleotide
  Target: ATXN1; (+) strand; PAM type: NRG; PAM sequence: GAG
tatcgtcttccagagcctct

SEQ ID NO: 96772 - DNA, 20 bp, Artificial Sequence
  Description of Artificial Sequence: Synthetic oligonucleotide
  Target: ATXN1; (+) strand; PAM type: NRG; PAM sequence: AGG
atcgtcttccagagcctctg

SEQ ID NO: 96773 - DNA, 20 bp, Artificial Sequence
  Description of Artificial Sequence: Synthetic oligonucleotide
  Target: ATXN1; (+) strand; PAM type: NRG; PAM sequence: GGG
tcgtcttccagagcctctga

SEQ ID NO: 96774 - DNA, 20 bp, Artificial Sequence
  Description of Artificial Sequence: Synthetic oligonucleotide
  Target: ATXN1; (+) strand; PAM type: NRG; PAM sequence: AAG
cttccagagcctctgagggt

SEQ ID NO: 96775 - DNA, 20 bp, Artificial Sequence
  Description of Artificial Sequence: Synthetic oligonucleotide
  Target: ATXN1; (+) strand; PAM type: NRG; PAM sequence: TGG
agcctctgagggtaagactg

SEQ ID NO: 96776 - DNA, 20 bp, Artificial Sequence
  Description of Artificial Sequence: Synthetic oligonucleotide
  Target: ATXN1; (+) strand; PAM type: NRG; PAM sequence: AAG
ctctgagggtaagactgtgg

SEQ ID NO: 96777 - DNA, 20 bp, Artificial Sequence
  Description of Artificial Sequence: Synthetic oligonucleotide
  Target: ATXN1; (+) strand; PAM type: NRG; PAM sequence: AAG
gactgtggaagttccttaca

SEQ ID NO: 96778 - DNA, 20 bp, Artificial Sequence
  Description of Artificial Sequence: Synthetic oligonucleotide
  Target: ATXN1; (+) strand; PAM type: NRG; PAM sequence: AGG
actgtggaagttccttacaa

SEQ ID NO: 96779 - DNA, 20 bp, Artificial Sequence
  Description of Artificial Sequence: Synthetic oligonucleotide
  Target: ATXN1; (+) strand; PAM type: NRG; PAM sequence: GAG
tgtggaagttccttacaaag

SEQ ID NO: 96780 - DNA, 20 bp, Artificial Sequence
  Description of Artificial Sequence: Synthetic oligonucleotide
  Target: ATXN1; (+) strand; PAM type: NRG; PAM sequence: TGG
agttccttacaaaggagatg

SEQ ID NO: 96781 - DNA, 20 bp, Artificial Sequence
  Description of Artificial Sequence: Synthetic oligonucleotide
  Target: ATXN1; (+) strand; PAM type: NRG; PAM sequence: TGG
agatgtggaaaacactatcc

SEQ ID NO: 96782 - DNA, 20 bp, Artificial Sequence
  Description of Artificial Sequence: Synthetic oligonucleotide
  Target: ATXN1; (+) strand; PAM type: NRG; PAM sequence: CGG
aacactatcctggatattct

SEQ ID NO: 96783 - DNA, 20 bp, Artificial Sequence
  Description of Artificial Sequence: Synthetic oligonucleotide
  Target: ATXN1; (+) strand; PAM type: NRG; PAM sequence: GGG
acactatcctggatattctc

SEQ ID NO: 96784 - DNA, 20 bp, Artificial Sequence
  Description of Artificial Sequence: Synthetic oligonucleotide
  Target: ATXN1; (+) strand; PAM type: NRG; PAM sequence: GGG
cactatcctggatattctcg

SEQ ID NO: 96785 - DNA, 20 bp, Artificial Sequence
  Description of Artificial Sequence: Synthetic oligonucleotide
  Target: ATXN1; (+) strand; PAM type: NRG; PAM sequence: GGG
actatcctggatattctcgg

SEQ ID NO: 96786 - DNA, 20 bp, Artificial Sequence
  Description of Artificial Sequence: Synthetic oligonucleotide
  Target: ATXN1; (+) strand; PAM type: NRG; PAM sequence: GAG
ctggatattctcgggggact

SEQ ID NO: 96787 - DNA, 20 bp, Artificial Sequence
  Description of Artificial Sequence: Synthetic oligonucleotide
  Target: ATXN1; (+) strand; PAM type: NRG; PAM sequence: AGG
tggatattctcgggggactg

SEQ ID NO: 96788 - DNA, 20 bp, Artificial Sequence
  Description of Artificial Sequence: Synthetic oligonucleotide
  Target: ATXN1; (+) strand; PAM type: NRG; PAM sequence: TGG
gaggtccacgtgcacctacg

SEQ ID NO: 96789 - DNA, 20 bp, Artificial Sequence
  Description of Artificial Sequence: Synthetic oligonucleotide
  Target: ATXN1; (+) strand; PAM type: NRG; PAM sequence: GGG
aggtccacgtgcacctacgt

SEQ ID NO: 96790 - DNA, 20 bp, Artificial Sequence
  Description of Artificial Sequence: Synthetic oligonucleotide
  Target: ATXN1; (+) strand; PAM type: NRG; PAM sequence: GGG
ggtccacgtgcacctacgtg

SEQ ID NO: 96791 - DNA, 20 bp, Artificial Sequence
  Description of Artificial Sequence: Synthetic oligonucleotide
  Target: ATXN1; (+) strand; PAM type: NRG; PAM sequence: GGG
gtccacgtgcacctacgtgg

SEQ ID NO: 96792 - DNA, 20 bp, Artificial Sequence
  Description of Artificial Sequence: Synthetic oligonucleotide
  Target: ATXN1; (+) strand; PAM type: NRG; PAM sequence: AAG
acgtgggggccgccaaactc

SEQ ID NO: 96793 - DNA, 20 bp, Artificial Sequence
  Description of Artificial Sequence: Synthetic oligonucleotide
  Target: ATXN1; (+) strand; PAM type: NRG; PAM sequence: AGG
cgtgggggccgccaaactca

SEQ ID NO: 96794 - DNA, 20 bp, Artificial Sequence
  Description of Artificial Sequence: Synthetic oligonucleotide
  Target: ATXN1; (+) strand; PAM type: NRG; PAM sequence: GAG
tgggggccgccaaactcaag

SEQ ID NO: 96795 - DNA, 20 bp, Artificial Sequence
  Description of Artificial Sequence: Synthetic oligonucleotide
  Target: ATXN1; (+) strand; PAM type: NRG; PAM sequence: CAG
gccgccaaactcaaggagct

SEQ ID NO: 96796 - DNA, 20 bp, Artificial Sequence
  Description of Artificial Sequence: Synthetic oligonucleotide
  Target: ATXN1; (+) strand; PAM type: NRG; PAM sequence: CAG
gccaaactcaaggagctcag

SEQ ID NO: 96797 - DNA, 20 bp, Artificial Sequence
  Description of Artificial Sequence: Synthetic oligonucleotide
  Target: ATXN1; (+) strand; PAM type: NRG; PAM sequence: AGG
ccaaactcaaggagctcagc

SEQ ID NO: 96798 - DNA, 20 bp, Artificial Sequence
  Description of Artificial Sequence: Synthetic oligonucleotide
  Target: ATXN1; (+) strand; PAM type: NRG; PAM sequence: GAG
aaactcaaggagctcagcag

SEQ ID NO: 96799 - DNA, 20 bp, Artificial Sequence
  Description of Artificial Sequence: Synthetic oligonucleotide
  Target: ATXN1; (+) strand; PAM type: NRG; PAM sequence: AGG
aactcaaggagctcagcagg

SEQ ID NO: 96800 - DNA, 20 bp, Artificial Sequence
  Description of Artificial Sequence: Synthetic oligonucleotide
  Target: ATXN1; (+) strand; PAM type: NRG; PAM sequence: GGG
actcaaggagctcagcagga

SEQ ID NO: 96801 - DNA, 20 bp, Artificial Sequence
  Description of Artificial Sequence: Synthetic oligonucleotide
  Target: ATXN1; (+) strand; PAM type: NRG; PAM sequence: CGG
gcaggagggcaacattcatc

SEQ ID NO: 96802 - DNA, 20 bp, Artificial Sequence
  Description of Artificial Sequence: Synthetic oligonucleotide
  Target: ATXN1; (+) strand; PAM type: NRG; PAM sequence: GGG
caggagggcaacattcatcc

SEQ ID NO: 96803 - DNA, 20 bp, Artificial Sequence
  Description of Artificial Sequence: Synthetic oligonucleotide
  Target: ATXN1; (+) strand; PAM type: NRG; PAM sequence: CAG
caacattcatccgggtgacc

SEQ ID NO: 96804 - DNA, 20 bp, Artificial Sequence
  Description of Artificial Sequence: Synthetic oligonucleotide
  Target: ATXN1; (+) strand; PAM type: NRG; PAM sequence: CAG
cattcatccgggtgacccag

SEQ ID NO: 96805 - DNA, 20 bp, Artificial Sequence
  Description of Artificial Sequence: Synthetic oligonucleotide
  Target: ATXN1; (+) strand; PAM type: NRG; PAM sequence: CAG
cagcagcacaacaccgtgtt

SEQ ID NO: 96806 - DNA, 20 bp, Artificial Sequence
  Description of Artificial Sequence: Synthetic oligonucleotide
  Target: ATXN1; (+) strand; PAM type: NRG; PAM sequence: TGG
acaccgtgttcagctaaccc

SEQ ID NO: 96807 - DNA, 20 bp, Artificial Sequence
  Description of Artificial Sequence: Synthetic oligonucleotide
  Target: ATXN1; (+) strand; PAM type: NRG; PAM sequence: GGG
caccgtgttcagctaaccct

SEQ ID NO: 96808 - DNA, 20 bp, Artificial Sequence
  Description of Artificial Sequence: Synthetic oligonucleotide
  Target: ATXN1; (+) strand; PAM type: NRG; PAM sequence: GGG
accgtgttcagctaaccctg

SEQ ID NO: 96809 - DNA, 20 bp, Artificial Sequence
  Description of Artificial Sequence: Synthetic oligonucleotide
  Target: ATXN1; (+) strand; PAM type: NRG; PAM sequence: AAG
ttcagctaaccctggggaca

SEQ ID NO: 96810 - DNA, 20 bp, Artificial Sequence
  Description of Artificial Sequence: Synthetic oligonucleotide
  Target: ATXN1; (+) strand; PAM type: NRG; PAM sequence: CAG
agctaaccctggggacaaag

SEQ ID NO: 96811 - DNA, 20 bp, Artificial Sequence
  Description of Artificial Sequence: Synthetic oligonucleotide
  Target: ATXN1; (+) strand; PAM type: NRG; PAM sequence: TGG
cctggggacaaagcagcgtc

SEQ ID NO: 96812 - DNA, 20 bp, Artificial Sequence
  Description of Artificial Sequence: Synthetic oligonucleotide
  Target: ATXN1; (+) strand; PAM type: NRG; PAM sequence: GAG
gacaaagcagcgtctggctc

SEQ ID NO: 96813 - DNA, 20 bp, Artificial Sequence
  Description of Artificial Sequence: Synthetic oligonucleotide
  Target: ATXN1; (+) strand; PAM type: NRG; PAM sequence: TGG
aaagcagcgtctggctcgag

SEQ ID NO: 96814 - DNA, 20 bp, Artificial Sequence
  Description of Artificial Sequence: Synthetic oligonucleotide
  Target: ATXN1; (+) strand; PAM type: NRG; PAM sequence: AAG
gcagcgtctggctcgagtgg

SEQ ID NO: 96815 - DNA, 20 bp, Artificial Sequence
  Description of Artificial Sequence: Synthetic oligonucleotide
  Target: ATXN1; (+) strand; PAM type: NRG; PAM sequence: AAG
tgcttttcccatctcccccc

SEQ ID NO: 96816 - DNA, 20 bp, Artificial Sequence
  Description of Artificial Sequence: Synthetic oligonucleotide
  Target: ATXN1; (+) strand; PAM type: NRG; PAM sequence: CAG
tccccccaagtctgttccgt

SEQ ID NO: 96817 - DNA, 20 bp, Artificial Sequence
  Description of Artificial Sequence: Synthetic oligonucleotide
  Target: ATXN1; (+) strand; PAM type: NRG; PAM sequence: GAG
cccccaagtctgttccgtca

SEQ ID NO: 96818 - DNA, 20 bp, Artificial Sequence
  Description of Artificial Sequence: Synthetic oligonucleotide
  Target: ATXN1; (+) strand; PAM type: NRG; PAM sequence: TGG
gtctgttccgtcagagcttc

SEQ ID NO: 96819 - DNA, 20 bp, Artificial Sequence
  Description of Artificial Sequence: Synthetic oligonucleotide
  Target: ATXN1; (+) strand; PAM type: NRG; PAM sequence: TGG
agcttctggctgctcctgaa

SEQ ID NO: 96820 - DNA, 20 bp, Artificial Sequence
  Description of Artificial Sequence: Synthetic oligonucleotide
  Target: ATXN1; (+) strand; PAM type: NRG; PAM sequence: TGG
ttctggctgctcctgaatgg

SEQ ID NO: 96821 - DNA, 20 bp, Artificial Sequence
  Description of Artificial Sequence: Synthetic oligonucleotide
  Target: ATXN1; (+) strand; PAM type: NRG; PAM sequence: TGG
ctcttctgtctcctgctgcc

SEQ ID NO: 96822 - DNA, 20 bp, Artificial Sequence
  Description of Artificial Sequence: Synthetic oligonucleotide
  Target: ATXN1; (+) strand; PAM type: NRG; PAM sequence: GAG
cttctgtctcctgctgcctg

SEQ ID NO: 96823 - DNA, 20 bp, Artificial Sequence
  Description of Artificial Sequence: Synthetic oligonucleotide
  Target: ATXN1; (+) strand; PAM type: NRG; PAM sequence: AGG
ttctgtctcctgctgcctgg

SEQ ID NO: 96824 - DNA, 20 bp, Artificial Sequence
  Description of Artificial Sequence: Synthetic oligonucleotide
  Target: ATXN1; (+) strand; PAM type: NRG; PAM sequence: CGG
ctcctgctgcctggaggctt

SEQ ID NO: 96825 - DNA, 20 bp, Artificial Sequence
  Description of Artificial Sequence: Synthetic oligonucleotide
  Target: ATXN1; (+) strand; PAM type: NRG; PAM sequence: GGG
tcctgctgcctggaggcttc

SEQ ID NO: 96826 - DNA, 20 bp, Artificial Sequence
  Description of Artificial Sequence: Synthetic oligonucleotide
  Target: ATXN1; (+) strand; PAM type: NRG; PAM sequence: GGG
cctgctgcctggaggcttcg

SEQ ID NO: 96827 - DNA, 20 bp, Artificial Sequence
  Description of Artificial Sequence: Synthetic oligonucleotide
  Target: ATXN1; (+) strand; PAM type: NRG; PAM sequence: CGG
ggctctcccgcctgccttct

SEQ ID NO: 96828 - DNA, 20 bp, Artificial Sequence
  Description of Artificial Sequence: Synthetic oligonucleotide
  Target: ATXN1; (+) strand; PAM type: NRG; PAM sequence: GGG
gctctcccgcctgccttctc

SEQ ID NO: 96829 - DNA, 20 bp, Artificial Sequence
  Description of Artificial Sequence: Synthetic oligonucleotide
  Target: ATXN1; (+) strand; PAM type: NRG; PAM sequence: GGG
ctctcccgcctgccttctcg

SEQ ID NO: 96830 - DNA, 20 bp, Artificial Sequence
  Description of Artificial Sequence: Synthetic oligonucleotide
  Target: ATXN1; (+) strand; PAM type: NRG; PAM sequence: CAG
ccgcctgccttctcggggcc

SEQ ID NO: 96831 - DNA, 20 bp, Artificial Sequence
  Description of Artificial Sequence: Synthetic oligonucleotide
  Target: ATXN1; (+) strand; PAM type: NRG; PAM sequence: AAG
ccttctcggggcccagacgc

SEQ ID NO: 96832 - DNA, 20 bp, Artificial Sequence
  Description of Artificial Sequence: Synthetic oligonucleotide
  Target: ATXN1; (+) strand; PAM type: NRG; PAM sequence: AGG
cttctcggggcccagacgca

SEQ ID NO: 96833 - DNA, 20 bp, Artificial Sequence
  Description of Artificial Sequence: Synthetic oligonucleotide
  Target: ATXN1; (+) strand; PAM type: NRG; PAM sequence: TGG
cccagacgcaaggcaccgat

SEQ ID NO: 96834 - DNA, 20 bp, Artificial Sequence
  Description of Artificial Sequence: Synthetic oligonucleotide
  Target: ATXN1; (+) strand; PAM type: NRG; PAM sequence: GGG
ccagacgcaaggcaccgatt

SEQ ID NO: 96835 - DNA, 20 bp, Artificial Sequence
  Description of Artificial Sequence: Synthetic oligonucleotide
  Target: ATXN1; (+) strand; PAM type: NRG; PAM sequence: CAG
ggcaccgattgggccaacat

SEQ ID NO: 96836 - DNA, 20 bp, Artificial Sequence
  Description of Artificial Sequence: Synthetic oligonucleotide
  Target: ATXN1; (+) strand; PAM type: NRG; PAM sequence: GAG
caccgattgggccaacatca

SEQ ID NO: 96837 - DNA, 20 bp, Artificial Sequence
  Description of Artificial Sequence: Synthetic oligonucleotide
  Target: ATXN1; (+) strand; PAM type: NRG; PAM sequence: CAG
aacatcagagccctgctgcc

SEQ ID NO: 96838 - DNA, 20 bp, Artificial Sequence
  Description of Artificial Sequence: Synthetic oligonucleotide
  Target: ATXN1; (+) strand; PAM type: NRG; PAM sequence: AAG
tgtttttctttcttttttaa

SEQ ID NO: 96839 - DNA, 20 bp, Artificial Sequence
  Description of Artificial Sequence: Synthetic oligonucleotide
  Target: ATXN1; (+) strand; PAM type: NRG; PAM sequence: AAG
ttttctttcttttttaaaag

SEQ ID NO: 96840 - DNA, 20 bp, Artificial Sequence
  Description of Artificial Sequence: Synthetic oligonucleotide
  Target: ATXN1; (+) strand; PAM type: NRG; PAM sequence: TGG
ctttcttttttaaaagaaga

SEQ ID NO: 96841 - DNA, 20 bp, Artificial Sequence
  Description of Artificial Sequence: Synthetic oligonucleotide
  Target: ATXN1; (+) strand; PAM type: NRG; PAM sequence: AAG
taatataatgctattatctt

SEQ ID NO: 96842 - DNA, 20 bp, Artificial Sequence
  Description of Artificial Sequence: Synthetic oligonucleotide
  Target: ATXN1; (+) strand; PAM type: NRG; PAM sequence: TGG
gctattatcttaagacttaa

SEQ ID NO: 96843 - DNA, 20 bp, Artificial Sequence
  Description of Artificial Sequence: Synthetic oligonucleotide
  Target: ATXN1; (+) strand; PAM type: NRG; PAM sequence: GAG
tattatcttaagacttaatg

SEQ ID NO: 96844 - DNA, 20 bp, Artificial Sequence
  Description of Artificial Sequence: Synthetic oligonucleotide
  Target: ATXN1; (+) strand; PAM type: NRG; PAM sequence: TGG
ttaagacttaatggagttgc

SEQ ID NO: 96845 - DNA, 20 bp, Artificial Sequence
  Description of Artificial Sequence: Synthetic oligonucleotide
  Target: ATXN1; (+) strand; PAM type: NRG; PAM sequence: GAG
aagacttaatggagttgctg

SEQ ID NO: 96846 - DNA, 20 bp, Artificial Sequence
  Description of Artificial Sequence: Synthetic oligonucleotide
  Target: ATXN1; (+) strand; PAM type: NRG; PAM sequence: CAG
gttgctggagtttgtatttc

SEQ ID NO: 96847 - DNA, 20 bp, Artificial Sequence
  Description of Artificial Sequence: Synthetic oligonucleotide
  Target: ATXN1; (+) strand; PAM type: NRG; PAM sequence: AGG
ttgctggagtttgtatttcc

SEQ ID NO: 96848 - DNA, 20 bp, Artificial Sequence
  Description of Artificial Sequence: Synthetic oligonucleotide
  Target: ATXN1; (+) strand; PAM type: NRG; PAM sequence: GAG
gctggagtttgtatttccag

SEQ ID NO: 96849 - DNA, 20 bp, Artificial Sequence
  Description of Artificial Sequence: Synthetic oligonucleotide
  Target: ATXN1; (+) strand; PAM type: NRG; PAM sequence: AAG
agtttgtatttccaggagtc

SEQ ID NO: 96850 - DNA, 20 bp, Artificial Sequence
  Description of Artificial Sequence: Synthetic oligonucleotide
  Target: ATXN1; (+) strand; PAM type: NRG; PAM sequence: TGG
tttccaggagtcaagttgaa

SEQ ID NO: 96851 - DNA, 20 bp, Artificial Sequence
  Description of Artificial Sequence: Synthetic oligonucleotide
  Target: ATXN1; (+) strand; PAM type: NRG; PAM sequence: TGG
aggagtcaagttgaatggtt

SEQ ID NO: 96852 - DNA, 20 bp, Artificial Sequence
  Description of Artificial Sequence: Synthetic oligonucleotide
  Target: ATXN1; (+) strand; PAM type: NRG; PAM sequence: GGG
ggagtcaagttgaatggttt

SEQ ID NO: 96853 - DNA, 20 bp, Artificial Sequence
  Description of Artificial Sequence: Synthetic oligonucleotide
  Target: ATXN1; (+) strand; PAM type: NRG; PAM sequence: TAG
gatttgttttgctaccttcc

SEQ ID NO: 96854 - DNA, 20 bp, Artificial Sequence
  Description of Artificial Sequence: Synthetic oligonucleotide
  Target: ATXN1; (+) strand; PAM type: NRG; PAM sequence: CAG
tgttttgctaccttcctaga

SEQ ID NO: 96855 - DNA, 20 bp, Artificial Sequence
  Description of Artificial Sequence: Synthetic oligonucleotide
  Target: ATXN1; (+) strand; PAM type: NRG; PAM sequence: AGG
gttttgctaccttcctagac

SEQ ID NO: 96856 - DNA, 20 bp, Artificial Sequence
  Description of Artificial Sequence: Synthetic oligonucleotide
  Target: ATXN1; (+) strand; PAM type: NRG; PAM sequence: TGG
taccttcctagacaggctga

SEQ ID NO: 96857 - DNA, 20 bp, Artificial Sequence
  Description of Artificial Sequence: Synthetic oligonucleotide
  Target: ATXN1; (+) strand; PAM type: NRG; PAM sequence: AAG
ttcctagacaggctgatggc

SEQ ID NO: 96858 - DNA, 20 bp, Artificial Sequence
  Description of Artificial Sequence: Synthetic oligonucleotide
  Target: ATXN1; (+) strand; PAM type: NRG; PAM sequence: CGG
ggctgatggcaagcctctcc

SEQ ID NO: 96859 - DNA, 20 bp, Artificial Sequence
  Description of Artificial Sequence: Synthetic oligonucleotide
  Target: ATXN1; (+) strand; PAM type: NRG; PAM sequence: TAG
ggcaagcctctcccggcgat

SEQ ID NO: 96860 - DNA, 20 bp, Artificial Sequence
  Description of Artificial Sequence: Synthetic oligonucleotide
  Target: ATXN1; (+) strand; PAM type: NRG; PAM sequence: CAG
aagcctctcccggcgattag

SEQ ID NO: 96861 - DNA, 20 bp, Artificial Sequence
  Description of Artificial Sequence: Synthetic oligonucleotide
  Target: ATXN1; (+) strand; PAM type: NRG; PAM sequence: AAG
tctcccggcgattagcagac

SEQ ID NO: 96862 - DNA, 20 bp, Artificial Sequence
  Description of Artificial Sequence: Synthetic oligonucleotide
  Target: ATXN1; (+) strand; PAM type: NRG; PAM sequence: TAG
gattagcagacaagtcacct

SEQ ID NO: 96863 - DNA, 20 bp, Artificial Sequence
  Description of Artificial Sequence: Synthetic oligonucleotide
  Target: ATXN1; (+) strand; PAM type: NRG; PAM sequence: AGG
attagcagacaagtcacctt

SEQ ID NO: 96864 - DNA, 20 bp, Artificial Sequence
  Description of Artificial Sequence: Synthetic oligonucleotide
  Target: ATXN1; (+) strand; PAM type: NRG; PAM sequence: GAG
tagcagacaagtcaccttag

SEQ ID NO: 96865 - DNA, 20 bp, Artificial Sequence
  Description of Artificial Sequence: Synthetic oligonucleotide
  Target: ATXN1; (+) strand; PAM type: NRG; PAM sequence: AGG
agcagacaagtcaccttagg

SEQ ID NO: 96866 - DNA, 20 bp, Artificial Sequence
  Description of Artificial Sequence: Synthetic oligonucleotide
  Target: ATXN1; (+) strand; PAM type: NRG; PAM sequence: GGG
gcagacaagtcaccttagga

SEQ ID NO: 96867 - DNA, 20 bp, Artificial Sequence
  Description of Artificial Sequence: Synthetic oligonucleotide
  Target: ATXN1; (+) strand; PAM type: NRG; PAM sequence: GGG
cagacaagtcaccttaggag

SEQ ID NO: 96868 - DNA, 20 bp, Artificial Sequence
  Description of Artificial Sequence: Synthetic oligonucleotide
  Target: ATXN1; (+) strand; PAM type: NRG; PAM sequence: AAG
caagtcaccttaggaggggc

SEQ ID NO: 96869 - DNA, 20 bp, Artificial Sequence
  Description of Artificial Sequence: Synthetic oligonucleotide
  Target: ATXN1; (+) strand; PAM type: NRG; PAM sequence: AGG
aagtcaccttaggaggggca

SEQ ID NO: 96870 - DNA, 20 bp, Artificial Sequence
  Description of Artificial Sequence: Synthetic oligonucleotide
  Target: ATXN1; (+) strand; PAM type: NRG; PAM sequence: GAG
gtcaccttaggaggggcaag

SEQ ID NO: 96871 - DNA, 20 bp, Artificial Sequence
  Description of Artificial Sequence: Synthetic oligonucleotide
  Target: ATXN1; (+) strand; PAM type: NRG; PAM sequence: GAG
caccttaggaggggcaagga

SEQ ID NO: 96872 - DNA, 20 bp, Artificial Sequence
  Description of Artificial Sequence: Synthetic oligonucleotide
  Target: ATXN1; (+) strand; PAM type: NRG; PAM sequence: AGG
accttaggaggggcaaggag

SEQ ID NO: 96873 - DNA, 20 bp, Artificial Sequence
  Description of Artificial Sequence: Synthetic oligonucleotide
  Target: ATXN1; (+) strand; PAM type: NRG; PAM sequence: GAG
cttaggaggggcaaggagag

SEQ ID NO: 96874 - DNA, 20 bp, Artificial Sequence
  Description of Artificial Sequence: Synthetic oligonucleotide
  Target: ATXN1; (+) strand; PAM type: NRG; PAM sequence: AGG
ttaggaggggcaaggagagg

SEQ ID NO: 96875 - DNA, 20 bp, Artificial Sequence
  Description of Artificial Sequence: Synthetic oligonucleotide
  Target: ATXN1; (+) strand; PAM type: NRG; PAM sequence: CAG
gaggggcaaggagaggagga

SEQ ID NO: 96876 - DNA, 20 bp, Artificial Sequence
  Description of Artificial Sequence: Synthetic oligonucleotide
  Target: ATXN1; (+) strand; PAM type: NRG; PAM sequence: CGG
gcaaggagaggaggacagtg

SEQ ID NO: 96877 - DNA, 20 bp, Artificial Sequence
  Description of Artificial Sequence: Synthetic oligonucleotide
  Target: ATXN1; (+) strand; PAM type: NRG; PAM sequence: GGG
caaggagaggaggacagtgc

SEQ ID NO: 96878 - DNA, 20 bp, Artificial Sequence
  Description of Artificial Sequence: Synthetic oligonucleotide
  Target: ATXN1; (+) strand; PAM type: NRG; PAM sequence: GGG
aaggagaggaggacagtgcg

SEQ ID NO: 96879 - DNA, 20 bp, Artificial Sequence
  Description of Artificial Sequence: Synthetic oligonucleotide
  Target: ATXN1; (+) strand; PAM type: NRG; PAM sequence: GGG
aggagaggaggacagtgcgg

SEQ ID NO: 96880 - DNA, 20 bp, Artificial Sequence
  Description of Artificial Sequence: Synthetic oligonucleotide
  Target: ATXN1; (+) strand; PAM type: NRG; PAM sequence: AAG
aggaggacagtgcgggggcc

SEQ ID NO: 96881 - DNA, 20 bp, Artificial Sequence
  Description of Artificial Sequence: Synthetic oligonucleotide
  Target: ATXN1; (+) strand; PAM type: NRG; PAM sequence: AGG
ggaggacagtgcgggggcca

SEQ ID NO: 96882 - DNA, 20 bp, Artificial Sequence
  Description of Artificial Sequence: Synthetic oligonucleotide
  Target: ATXN1; (+) strand; PAM type: NRG; PAM sequence: GGG
gaggacagtgcgggggccaa

SEQ ID NO: 96883 - DNA, 20 bp, Artificial Sequence
  Description of Artificial Sequence: Synthetic oligonucleotide
  Target: ATXN1; (+) strand; PAM type: NRG; PAM sequence: TGG
gacagtgcgggggccaaggg

SEQ ID NO: 96884 - DNA, 20 bp, Artificial Sequence
  Description of Artificial Sequence: Synthetic oligonucleotide
  Target: ATXN1; (+) strand; PAM type: NRG; PAM sequence: CAG
gtgcgggggccaagggtgga

SEQ ID NO: 96885 - DNA, 20 bp, Artificial Sequence
  Description of Artificial Sequence: Synthetic oligonucleotide
  Target: ATXN1; (+) strand; PAM type: NRG; PAM sequence: AGG
tgcgggggccaagggtggac

SEQ ID NO: 96886 - DNA, 20 bp, Artificial Sequence
  Description of Artificial Sequence: Synthetic oligonucleotide
  Target: ATXN1; (+) strand; PAM type: NRG; PAM sequence: CGG
ggggccaagggtggacaggc

SEQ ID NO: 96887 - DNA, 20 bp, Artificial Sequence
  Description of Artificial Sequence: Synthetic oligonucleotide
  Target: ATXN1; (+) strand; PAM type: NRG; PAM sequence: GAG
ggccaagggtggacaggccg

SEQ ID NO: 96888 - DNA, 20 bp, Artificial Sequence
  Description of Artificial Sequence: Synthetic oligonucleotide
  Target: ATXN1; (+) strand; PAM type: NRG; PAM sequence: AAG
gggtggacaggccggagtca

SEQ ID NO: 96889 - DNA, 20 bp, Artificial Sequence
  Description of Artificial Sequence: Synthetic oligonucleotide
  Target: ATXN1; (+) strand; PAM type: NRG; PAM sequence: TGG
caggccggagtcaaagtaac

SEQ ID NO: 96890 - DNA, 20 bp, Artificial Sequence
  Description of Artificial Sequence: Synthetic oligonucleotide
  Target: ATXN1; (+) strand; PAM type: NRG; PAM sequence: TAG
taactggcatccctcacctc

SEQ ID NO: 96891 - DNA, 20 bp, Artificial Sequence
  Description of Artificial Sequence: Synthetic oligonucleotide
  Target: ATXN1; (+) strand; PAM type: NRG; PAM sequence: TGG
catccctcacctctagcttt

SEQ ID NO: 96892 - DNA, 20 bp, Artificial Sequence
  Description of Artificial Sequence: Synthetic oligonucleotide
  Target: ATXN1; (+) strand; PAM type: NRG; PAM sequence: AAG
ctagcttttggttgctgcaa

SEQ ID NO: 96893 - DNA, 20 bp, Artificial Sequence
  Description of Artificial Sequence: Synthetic oligonucleotide
  Target: ATXN1; (+) strand; PAM type: NRG; PAM sequence: AAG
tggttgctgcaaaagaacaa

SEQ ID NO: 96894 - DNA, 20 bp, Artificial Sequence
  Description of Artificial Sequence: Synthetic oligonucleotide
  Target: ATXN1; (+) strand; PAM type: NRG; PAM sequence: TGG
aaagaacaaaagcaattaac

SEQ ID NO: 96895 - DNA, 20 bp, Artificial Sequence
  Description of Artificial Sequence: Synthetic oligonucleotide
  Target: ATXN1; (+) strand; PAM type: NRG; PAM sequence: CAG
aacaaaagcaattaactgga

SEQ ID NO: 96896 - DNA, 20 bp, Artificial Sequence
  Description of Artificial Sequence: Synthetic oligonucleotide
  Target: ATXN1; (+) strand; PAM type: NRG; PAM sequence: CAG
atgaacatgaattgttttcc

SEQ ID NO: 96897 - DNA, 20 bp, Artificial Sequence
  Description of Artificial Sequence: Synthetic oligonucleotide
  Target: ATXN1; (+) strand; PAM type: NRG; PAM sequence: AAG
tttcccagctgatactcaca

SEQ ID NO: 96898 - DNA, 20 bp, Artificial Sequence
  Description of Artificial Sequence: Synthetic oligonucleotide
  Target: ATXN1; (+) strand; PAM type: NRG; PAM sequence: GAG
cagctgatactcacaaagtt

SEQ ID NO: 96899 - DNA, 20 bp, Artificial Sequence
  Description of Artificial Sequence: Synthetic oligonucleotide
  Target: ATXN1; (+) strand; PAM type: NRG; PAM sequence: GAG
tgagccaatgtgttttcccc

SEQ ID NO: 96900 - DNA, 20 bp, Artificial Sequence
  Description of Artificial Sequence: Synthetic oligonucleotide
  Target: ATXN1; (+) strand; PAM type: NRG; PAM sequence: CAG
gtttcattacatgtgctttt

SEQ ID NO: 96901 - DNA, 20 bp, Artificial Sequence
  Description of Artificial Sequence: Synthetic oligonucleotide
  Target: ATXN1; (+) strand; PAM type: NRG; PAM sequence: AGG
tttcattacatgtgcttttc

SEQ ID NO: 96902 - DNA, 20 bp, Artificial Sequence
  Description of Artificial Sequence: Synthetic oligonucleotide
  Target: ATXN1; (+) strand; PAM type: NRG; PAM sequence: GGG
ttcattacatgtgcttttca

SEQ ID NO: 96903 - DNA, 20 bp, Artificial Sequence
  Description of Artificial Sequence: Synthetic oligonucleotide
  Target: ATXN1; (+) strand; PAM type: NRG; PAM sequence: AAG
tacatgtgcttttcagggac

SEQ ID NO: 96904 - DNA, 20 bp, Artificial Sequence
  Description of Artificial Sequence: Synthetic oligonucleotide
  Target: ATXN1; (+) strand; PAM type: NRG; PAM sequence: CAG
gacaagtcatctgtcgctac

SEQ ID NO: 96905 - DNA, 20 bp, Artificial Sequence
  Description of Artificial Sequence: Synthetic oligonucleotide
  Target: ATXN1; (+) strand; PAM type: NRG; PAM sequence: TAG
taccagtttgctgttgcctc

SEQ ID NO: 96906 - DNA, 20 bp, Artificial Sequence
  Description of Artificial Sequence: Synthetic oligonucleotide
  Target: ATXN1; (+) strand; PAM type: NRG; PAM sequence: AGG
accagtttgctgttgcctct

SEQ ID NO: 96907 - DNA, 20 bp, Artificial Sequence
  Description of Artificial Sequence: Synthetic oligonucleotide
  Target: ATXN1; (+) strand; PAM type: NRG; PAM sequence: AAG
agtttgctgttgcctctagg

SEQ ID NO: 96908 - DNA, 20 bp, Artificial Sequence
  Description of Artificial Sequence: Synthetic oligonucleotide
  Target: ATXN1; (+) strand; PAM type: NRG; PAM sequence: TGG
ctaggaagctgtccctgtcc

SEQ ID NO: 96909 - DNA, 20 bp, Artificial Sequence
  Description of Artificial Sequence: Synthetic oligonucleotide
  Target: ATXN1; (+) strand; PAM type: NRG; PAM sequence: CAG
atcttttttttcccccttct

SEQ ID NO: 96910 - DNA, 20 bp, Artificial Sequence
  Description of Artificial Sequence: Synthetic oligonucleotide
  Target: ATXN1; (+) strand; PAM type: NRG; PAM sequence: CAG
tgtcttaatttgaaattcca

SEQ ID NO: 96911 - DNA, 20 bp, Artificial Sequence
  Description of Artificial Sequence: Synthetic oligonucleotide
  Target: ATXN1; (+) strand; PAM type: NRG; PAM sequence: AGG
gtcttaatttgaaattccac

SEQ ID NO: 96912 - DNA, 20 bp, Artificial Sequence
  Description of Artificial Sequence: Synthetic oligonucleotide
  Target: ATXN1; (+) strand; PAM type: NRG; PAM sequence: TGG
aaattccacaggatgtttta

SEQ ID NO: 96913 - DNA, 20 bp, Artificial Sequence
  Description of Artificial Sequence: Synthetic oligonucleotide
  Target: ATXN1; (+) strand; PAM type: NRG; PAM sequence: GGG
aattccacaggatgttttat

SEQ ID NO: 96914 - DNA, 20 bp, Artificial Sequence
  Description of Artificial Sequence: Synthetic oligonucleotide
  Target: ATXN1; (+) strand; PAM type: NRG; PAM sequence: AAG
tccacaggatgttttatggg

SEQ ID NO: 96915 - DNA, 20 bp, Artificial Sequence
  Description of Artificial Sequence: Synthetic oligonucleotide
  Target: ATXN1; (+) strand; PAM type: NRG; PAM sequence: AGG
ccacaggatgttttatggga

SEQ ID NO: 96916 - DNA, 20 bp, Artificial Sequence
  Description of Artificial Sequence: Synthetic oligonucleotide
  Target: ATXN1; (+) strand; PAM type: NRG; PAM sequence: AAG
ttatgggaaggttgtctccc

SEQ ID NO: 96917 - DNA, 20 bp, Artificial Sequence
  Description of Artificial Sequence: Synthetic oligonucleotide
  Target: ATXN1; (+) strand; PAM type: NRG; PAM sequence: TAG
aaggttgtctcccaagaaat

SEQ ID NO: 96918 - DNA, 20 bp, Artificial Sequence
  Description of Artificial Sequence: Synthetic oligonucleotide
  Target: ATXN1; (+) strand; PAM type: NRG; PAM sequence: CAG
gttgtctcccaagaaattag

SEQ ID NO: 96919 - DNA, 20 bp, Artificial Sequence
  Description of Artificial Sequence: Synthetic oligonucleotide
  Target: ATXN1; (+) strand; PAM type: NRG; PAM sequence: AGG
ttgtctcccaagaaattagc

SEQ ID NO: 96920 - DNA, 20 bp, Artificial Sequence
  Description of Artificial Sequence: Synthetic oligonucleotide
  Target: ATXN1; (+) strand; PAM type: NRG; PAM sequence: TGG
tctcccaagaaattagcagg

SEQ ID NO: 96921 - DNA, 20 bp, Artificial Sequence
  Description of Artificial Sequence: Synthetic oligonucleotide
  Target: ATXN1; (+) strand; PAM type: NRG; PAM sequence: GAG
tcccaagaaattagcaggtg

SEQ ID NO: 96922 - DNA, 20 bp, Artificial Sequence
  Description of Artificial Sequence: Synthetic oligonucleotide
  Target: ATXN1; (+) strand; PAM type: NRG; PAM sequence: AAG
caggtggagtcacactgaaa

SEQ ID NO: 96923 - DNA, 20 bp, Artificial Sequence
  Description of Artificial Sequence: Synthetic oligonucleotide
  Target: ATXN1; (+) strand; PAM type: NRG; PAM sequence: GAG
ggtggagtcacactgaaaaa

SEQ ID NO: 96924 - DNA, 20 bp, Artificial Sequence
  Description of Artificial Sequence: Synthetic oligonucleotide
  Target: ATXN1; (+) strand; PAM type: NRG; PAM sequence: AAG
gtcacactgaaaaagagcca

SEQ ID NO: 96925 - DNA, 20 bp, Artificial Sequence
  Description of Artificial Sequence: Synthetic oligonucleotide
  Target: ATXN1; (+) strand; PAM type: NRG; PAM sequence: CAG
aaaagagccaaagctttgat

SEQ ID NO: 96926 - DNA, 20 bp, Artificial Sequence
  Description of Artificial Sequence: Synthetic oligonucleotide
  Target: ATXN1; (+) strand; PAM type: NRG; PAM sequence: TGG
agagccaaagctttgatcag

SEQ ID NO: 96927 - DNA, 20 bp, Artificial Sequence
  Description of Artificial Sequence: Synthetic oligonucleotide
  Target: ATXN1; (+) strand; PAM type: NRG; PAM sequence: AAG
tttgatcagtggcatcctaa

SEQ ID NO: 96928 - DNA, 20 bp, Artificial Sequence
  Description of Artificial Sequence: Synthetic oligonucleotide
  Target: ATXN1; (+) strand; PAM type: NRG; PAM sequence: AGG
ttgatcagtggcatcctaaa

SEQ ID NO: 96929 - DNA, 20 bp, Artificial Sequence
  Description of Artificial Sequence: Synthetic oligonucleotide
  Target: ATXN1; (+) strand; PAM type: NRG; PAM sequence: TGG
agtggcatcctaaaaggcat

SEQ ID NO: 96930 - DNA, 20 bp, Artificial Sequence
  Description of Artificial Sequence: Synthetic oligonucleotide
  Target: ATXN1; (+) strand; PAM type: NRG; PAM sequence: GAG
atcctaaaaggcattggttt

SEQ ID NO: 96931 - DNA, 20 bp, Artificial Sequence
  Description of Artificial Sequence: Synthetic oligonucleotide
  Target: ATXN1; (+) strand; PAM type: NRG; PAM sequence: GAG
aaggcattggtttgagacat

SEQ ID NO: 96932 - DNA, 20 bp, Artificial Sequence
  Description of Artificial Sequence: Synthetic oligonucleotide
  Target: ATXN1; (+) strand; PAM type: NRG; PAM sequence: TAG
cattggtttgagacatgagt

SEQ ID NO: 96933 - DNA, 20 bp, Artificial Sequence
  Description of Artificial Sequence: Synthetic oligonucleotide
  Target: ATXN1; (+) strand; PAM type: NRG; PAM sequence: GAG
ttggtttgagacatgagtta

SEQ ID NO: 96934 - DNA, 20 bp, Artificial Sequence
  Description of Artificial Sequence: Synthetic oligonucleotide
  Target: ATXN1; (+) strand; PAM type: NRG; PAM sequence: CAG
atgagttagagccattccct

SEQ ID NO: 96935 - DNA, 20 bp, Artificial Sequence
  Description of Artificial Sequence: Synthetic oligonucleotide
  Target: ATXN1; (+) strand; PAM type: NRG; PAM sequence: CAG
gagccattccctcagtgtgc

SEQ ID NO: 96936 - DNA, 20 bp, Artificial Sequence
  Description of Artificial Sequence: Synthetic oligonucleotide
  Target: ATXN1; (+) strand; PAM type: NRG; PAM sequence: CGG
tgtgccagtgaatcctttct

SEQ ID NO: 96937 - DNA, 20 bp, Artificial Sequence
  Description of Artificial Sequence: Synthetic oligonucleotide
  Target: ATXN1; (+) strand; PAM type: NRG; PAM sequence: AAG
gccagtgaatcctttctcgg

SEQ ID NO: 96938 - DNA, 20 bp, Artificial Sequence
  Description of Artificial Sequence: Synthetic oligonucleotide
  Target: ATXN1; (+) strand; PAM type: NRG; PAM sequence: AGG
ccagtgaatcctttctcgga

SEQ ID NO: 96939 - DNA, 20 bp, Artificial Sequence
  Description of Artificial Sequence: Synthetic oligonucleotide
  Target: ATXN1; (+) strand; PAM type: NRG; PAM sequence: TGG
cctttctcggaaggaccaca

SEQ ID NO: 96940 - DNA, 20 bp, Artificial Sequence
  Description of Artificial Sequence: Synthetic oligonucleotide
  Target: ATXN1; (+) strand; PAM type: NRG; PAM sequence: AAG
accacatggcactactgtat

SEQ ID NO: 96941 - DNA, 20 bp, Artificial Sequence
  Description of Artificial Sequence: Synthetic oligonucleotide
  Target: ATXN1; (+) strand; PAM type: NRG; PAM sequence: AGG
ccacatggcactactgtata

SEQ ID NO: 96942 - DNA, 20 bp, Artificial Sequence
  Description of Artificial Sequence: Synthetic oligonucleotide
  Target: ATXN1; (+) strand; PAM type: NRG; PAM sequence: GGG
cacatggcactactgtataa

SEQ ID NO: 96943 - DNA, 20 bp, Artificial Sequence
  Description of Artificial Sequence: Synthetic oligonucleotide
  Target: ATXN1; (+) strand; PAM type: NRG; PAM sequence: CAG
tggcactactgtataagggt

SEQ ID NO: 96944 - DNA, 20 bp, Artificial Sequence
  Description of Artificial Sequence: Synthetic oligonucleotide
  Target: ATXN1; (+) strand; PAM type: NRG; PAM sequence: CGG
actgtataagggtcagttaa

SEQ ID NO: 96945 - DNA, 20 bp, Artificial Sequence
  Description of Artificial Sequence: Synthetic oligonucleotide
  Target: ATXN1; (+) strand; PAM type: NRG; PAM sequence: GGG
ctgtataagggtcagttaac

SEQ ID NO: 96946 - DNA, 20 bp, Artificial Sequence
  Description of Artificial Sequence: Synthetic oligonucleotide
  Target: ATXN1; (+) strand; PAM type: NRG; PAM sequence: TGG
ataagggtcagttaacgggt

SEQ ID NO: 96947 - DNA, 20 bp, Artificial Sequence
  Description of Artificial Sequence: Synthetic oligonucleotide
  Target: ATXN1; (+) strand; PAM type: NRG; PAM sequence: GGG
taagggtcagttaacgggtt

SEQ ID NO: 96948 - DNA, 20 bp, Artificial Sequence
  Description of Artificial Sequence: Synthetic oligonucleotide
  Target: ATXN1; (+) strand; PAM type: NRG; PAM sequence: TGG
tgggaacaatgacattgtct

SEQ ID NO: 96949 - DNA, 20 bp, Artificial Sequence
  Description of Artificial Sequence: Synthetic oligonucleotide
  Target: ATXN1; (+) strand; PAM type: NRG; PAM sequence: GAG
ggaacaatgacattgtcttg

SEQ ID NO: 96950 - DNA, 20 bp, Artificial Sequence
  Description of Artificial Sequence: Synthetic oligonucleotide
  Target: ATXN1; (+) strand; PAM type: NRG; PAM sequence: TGG
atgacattgtcttggagaat

SEQ ID NO: 96951 - DNA, 20 bp, Artificial Sequence
  Description of Artificial Sequence: Synthetic oligonucleotide
  Target: ATXN1; (+) strand; PAM type: NRG; PAM sequence: CAG
tcttggagaattggcctctg

SEQ ID NO: 96952 - DNA, 20 bp, Artificial Sequence
  Description of Artificial Sequence: Synthetic oligonucleotide
  Target: ATXN1; (+) strand; PAM type: NRG; PAM sequence: CAG
tggcctctgcagctgacctg

SEQ ID NO: 96953 - DNA, 20 bp, Artificial Sequence
  Description of Artificial Sequence: Synthetic oligonucleotide
  Target: ATXN1; (+) strand; PAM type: NRG; PAM sequence: CAG
cctctgcagctgacctgcag

SEQ ID NO: 96954 - DNA, 20 bp, Artificial Sequence
  Description of Artificial Sequence: Synthetic oligonucleotide
  Target: ATXN1; (+) strand; PAM type: NRG; PAM sequence: CAG
gctgacctgcagcagtccac

SEQ ID NO: 96955 - DNA, 20 bp, Artificial Sequence
  Description of Artificial Sequence: Synthetic oligonucleotide
  Target: ATXN1; (+) strand; PAM type: NRG; PAM sequence: AGG
ctgacctgcagcagtccacc

SEQ ID NO: 96956 - DNA, 20 bp, Artificial Sequence
  Description of Artificial Sequence: Synthetic oligonucleotide
  Target: ATXN1; (+) strand; PAM type: NRG; PAM sequence: CAG
caccaggatgcttgtttaaa

SEQ ID NO: 96957 - DNA, 20 bp, Artificial Sequence
  Description of Artificial Sequence: Synthetic oligonucleotide
  Target: ATXN1; (+) strand; PAM type: NRG; PAM sequence: CAG
gcttgtttaaacagtgaacg

SEQ ID NO: 96958 - DNA, 20 bp, Artificial Sequence
  Description of Artificial Sequence: Synthetic oligonucleotide
  Target: ATXN1; (+) strand; PAM type: NRG; PAM sequence: AAG
tgtttaaacagtgaacgcag

SEQ ID NO: 96959 - DNA, 20 bp, Artificial Sequence
  Description of Artificial Sequence: Synthetic oligonucleotide
  Target: ATXN1; (+) strand; PAM type: NRG; PAM sequence: AAG
ttaaacagtgaacgcagaag

SEQ ID NO: 96960 - DNA, 20 bp, Artificial Sequence
  Description of Artificial Sequence: Synthetic oligonucleotide
  Target: ATXN1; (+) strand; PAM type: NRG; PAM sequence: CGG
aacgcagaagaagtgatgac

SEQ ID NO: 96961 - DNA, 20 bp, Artificial Sequence
  Description of Artificial Sequence: Synthetic oligonucleotide
  Target: ATXN1; (+) strand; PAM type: NRG; PAM sequence: AAG
tgaccggccgctaaactttg

SEQ ID NO: 96962 - DNA, 20 bp, Artificial Sequence
  Description of Artificial Sequence: Synthetic oligonucleotide
  Target: ATXN1; (+) strand; PAM type: NRG; PAM sequence: GAG
ccgctaaactttgaagtatt

SEQ ID NO: 96963 - DNA, 20 bp, Artificial Sequence
  Description of Artificial Sequence: Synthetic oligonucleotide
  Target: ATXN1; (+) strand; PAM type: NRG; PAM sequence: CAG
aactttgaagtattgagttc

SEQ ID NO: 96964 - DNA, 20 bp, Artificial Sequence
  Description of Artificial Sequence: Synthetic oligonucleotide
  Target: ATXN1; (+) strand; PAM type: NRG; PAM sequence: AGG
actttgaagtattgagttcc

SEQ ID NO: 96965 - DNA, 20 bp, Artificial Sequence
  Description of Artificial Sequence: Synthetic oligonucleotide
  Target: ATXN1; (+) strand; PAM type: NRG; PAM sequence: TGG
gaagtattgagttccaggcc

SEQ ID NO: 96966 - DNA, 20 bp, Artificial Sequence
  Description of Artificial Sequence: Synthetic oligonucleotide
  Target: ATXN1; (+) strand; PAM type: NRG; PAM sequence: AAG
tattgagttccaggcctgga

SEQ ID NO: 96967 - DNA, 20 bp, Artificial Sequence
  Description of Artificial Sequence: Synthetic oligonucleotide
  Target: ATXN1; (+) strand; PAM type: NRG; PAM sequence: CAG
ccaggcctggaaagcgtatg

SEQ ID NO: 96968 - DNA, 20 bp, Artificial Sequence
  Description of Artificial Sequence: Synthetic oligonucleotide
  Target: ATXN1; (+) strand; PAM type: NRG; PAM sequence: CAG
cctggaaagcgtatgcagat

SEQ ID NO: 96969 - DNA, 20 bp, Artificial Sequence
  Description of Artificial Sequence: Synthetic oligonucleotide
  Target: ATXN1; (+) strand; PAM type: NRG; PAM sequence: AGG
ctggaaagcgtatgcagatc

SEQ ID NO: 96970 - DNA, 20 bp, Artificial Sequence
  Description of Artificial Sequence: Synthetic oligonucleotide
  Target: ATXN1; (+) strand; PAM type: NRG; PAM sequence: AAG
gttttactttgctttttaat

SEQ ID NO: 96971 - DNA, 20 bp, Artificial Sequence
  Description of Artificial Sequence: Synthetic oligonucleotide
  Target: ATXN1; (+) strand; PAM type: NRG; PAM sequence: AGG
ttttactttgctttttaata

SEQ ID NO: 96972 - DNA, 20 bp, Artificial Sequence
  Description of Artificial Sequence: Synthetic oligonucleotide
  Target: ATXN1; (+) strand; PAM type: NRG; PAM sequence: AAG
tttgctttttaataaggctg

SEQ ID NO: 96973 - DNA, 20 bp, Artificial Sequence
  Description of Artificial Sequence: Synthetic oligonucleotide
  Target: ATXN1; (+) strand; PAM type: NRG; PAM sequence: GAG
tgctttttaataaggctgaa

SEQ ID NO: 96974 - DNA, 20 bp, Artificial Sequence
  Description of Artificial Sequence: Synthetic oligonucleotide
  Target: ATXN1; (+) strand; PAM type: NRG; PAM sequence: CAG
tttttaataaggctgaagag

SEQ ID NO: 96975 - DNA, 20 bp, Artificial Sequence
  Description of Artificial Sequence: Synthetic oligonucleotide
  Target: ATXN1; (+) strand; PAM type: NRG; PAM sequence: AAG
aggctgaagagcagatacac

SEQ ID NO: 96976 - DNA, 20 bp, Artificial Sequence
  Description of Artificial Sequence: Synthetic oligonucleotide
  Target: ATXN1; (+) strand; PAM type: NRG; PAM sequence: CAG
tgaagagcagatacacaagt

SEQ ID NO: 96977 - DNA, 20 bp, Artificial Sequence
  Description of Artificial Sequence: Synthetic oligonucleotide
  Target: ATXN1; (+) strand; PAM type: NRG; PAM sequence: TGG
atacacaagtcagttttctt

SEQ ID NO: 96978 - DNA, 20 bp, Artificial Sequence
  Description of Artificial Sequence: Synthetic oligonucleotide
  Target: ATXN1; (+) strand; PAM type: NRG; PAM sequence: AAG
acaagtcagttttctttgga

SEQ ID NO: 96979 - DNA, 20 bp, Artificial Sequence
  Description of Artificial Sequence: Synthetic oligonucleotide
  Target: ATXN1; (+) strand; PAM type: NRG; PAM sequence: AGG
caagtcagttttctttggaa

SEQ ID NO: 96980 - DNA, 20 bp, Artificial Sequence
  Description of Artificial Sequence: Synthetic oligonucleotide
  Target: ATXN1; (+) strand; PAM type: NRG; PAM sequence: AAG
tcagttttctttggaaaggc

SEQ ID NO: 96981 - DNA, 20 bp, Artificial Sequence
  Description of Artificial Sequence: Synthetic oligonucleotide
  Target: ATXN1; (+) strand; PAM type: NRG; PAM sequence: TGG
ggaaaggcaagcaatgaccc

SEQ ID NO: 96982 - DNA, 20 bp, Artificial Sequence
  Description of Artificial Sequence: Synthetic oligonucleotide
  Target: ATXN1; (+) strand; PAM type: NRG; PAM sequence: GAG
aaaggcaagcaatgaccctg

SEQ ID NO: 96983 - DNA, 20 bp, Artificial Sequence
  Description of Artificial Sequence: Synthetic oligonucleotide
  Target: ATXN1; (+) strand; PAM type: NRG; PAM sequence: TAG
ggcaagcaatgaccctggag

SEQ ID NO: 96984 - DNA, 20 bp, Artificial Sequence
  Description of Artificial Sequence: Synthetic oligonucleotide
  Target: ATXN1; (+) strand; PAM type: NRG; PAM sequence: GAG
caagcaatgaccctggagta

SEQ ID NO: 96985 - DNA, 20 bp, Artificial Sequence
  Description of Artificial Sequence: Synthetic oligonucleotide
  Target: ATXN1; (+) strand; PAM type: NRG; PAM sequence: AAG
gcaatgaccctggagtagag

SEQ ID NO: 96986 - DNA, 20 bp, Artificial Sequence
  Description of Artificial Sequence: Synthetic oligonucleotide
  Target: ATXN1; (+) strand; PAM type: NRG; PAM sequence: CAG
cctggagtagagaagatcca

SEQ ID NO: 96987 - DNA, 20 bp, Artificial Sequence
  Description of Artificial Sequence: Synthetic oligonucleotide
  Target: ATXN1; (+) strand; PAM type: NRG; PAM sequence: AGG
ctggagtagagaagatccac

SEQ ID NO: 96988 - DNA, 20 bp, Artificial Sequence
  Description of Artificial Sequence: Synthetic oligonucleotide
  Target: ATXN1; (+) strand; PAM type: NRG; PAM sequence: GGG
tggagtagagaagatccaca

SEQ ID NO: 96989 - DNA, 20 bp, Artificial Sequence
  Description of Artificial Sequence: Synthetic oligonucleotide
  Target: ATXN1; (+) strand; PAM type: NRG; PAM sequence: CAG
tccacagggtgctgctgtgc

SEQ ID NO: 96990 - DNA, 20 bp, Artificial Sequence
  Description of Artificial Sequence: Synthetic oligonucleotide
  Target: ATXN1; (+) strand; PAM type: NRG; PAM sequence: AGG
ccacagggtgctgctgtgcc

SEQ ID NO: 96991 - DNA, 20 bp, Artificial Sequence
  Description of Artificial Sequence: Synthetic oligonucleotide
  Target: ATXN1; (+) strand; PAM type: NRG; PAM sequence: GGG
cacagggtgctgctgtgcca

SEQ ID NO: 96992 - DNA, 20 bp, Artificial Sequence
  Description of Artificial Sequence: Synthetic oligonucleotide
  Target: ATXN1; (+) strand; PAM type: NRG; PAM sequence: TGG
gctgtgccagggtgaatgaa

SEQ ID NO: 96993 - DNA, 20 bp, Artificial Sequence
  Description of Artificial Sequence: Synthetic oligonucleotide
  Target: ATXN1; (+) strand; PAM type: NRG; PAM sequence: CAG
atgaatggcctgattgtcca

SEQ ID NO: 96994 - DNA, 20 bp, Artificial Sequence
  Description of Artificial Sequence: Synthetic oligonucleotide
  Target: ATXN1; (+) strand; PAM type: NRG; PAM sequence: TGG
tgattgtccacagtgaccga

SEQ ID NO: 96995 - DNA, 20 bp, Artificial Sequence
  Description of Artificial Sequence: Synthetic oligonucleotide
  Target: ATXN1; (+) strand; PAM type: NRG; PAM sequence: GAG
tccacagtgaccgatggcat

SEQ ID NO: 96996 - DNA, 20 bp, Artificial Sequence
  Description of Artificial Sequence: Synthetic oligonucleotide
  Target: ATXN1; (+) strand; PAM type: NRG; PAM sequence: AAG
acagtgaccgatggcatgag

SEQ ID NO: 96997 - DNA, 20 bp, Artificial Sequence
  Description of Artificial Sequence: Synthetic oligonucleotide
  Target: ATXN1; (+) strand; PAM type: NRG; PAM sequence: AGG
cagtgaccgatggcatgaga

SEQ ID NO: 96998 - DNA, 20 bp, Artificial Sequence
  Description of Artificial Sequence: Synthetic oligonucleotide
  Target: ATXN1; (+) strand; PAM type: NRG; PAM sequence: GGG
agtgaccgatggcatgagaa

SEQ ID NO: 96999 - DNA, 20 bp, Artificial Sequence
  Description of Artificial Sequence: Synthetic oligonucleotide
  Target: ATXN1; (+) strand; PAM type: NRG; PAM sequence: CAG
tggcatgagaagggtccaac

SEQ ID NO: 97000 - DNA, 20 bp, Artificial Sequence
  Description of Artificial Sequence: Synthetic oligonucleotide
  Target: ATXN1; (+) strand; PAM type: NRG; PAM sequence: GAG
gcatgagaagggtccaacca

SEQ ID NO: 97001 - DNA, 20 bp, Artificial Sequence
  Description of Artificial Sequence: Synthetic oligonucleotide
  Target: ATXN1; (+) strand; PAM type: NRG; PAM sequence: TGG
caaccagagctgtcacactc

SEQ ID NO: 97002 - DNA, 20 bp, Artificial Sequence
  Description of Artificial Sequence: Synthetic oligonucleotide
  Target: ATXN1; (+) strand; PAM type: NRG; PAM sequence: GGG
aaccagagctgtcacactct

SEQ ID NO: 97003 - DNA, 20 bp, Artificial Sequence
  Description of Artificial Sequence: Synthetic oligonucleotide
  Target: ATXN1; (+) strand; PAM type: NRG; PAM sequence: CAG
tgtcacactctgggataata

SEQ ID NO: 97004 - DNA, 20 bp, Artificial Sequence
  Description of Artificial Sequence: Synthetic oligonucleotide
  Target: ATXN1; (+) strand; PAM type: NRG; PAM sequence: AGG
gtcacactctgggataatac

SEQ ID NO: 97005 - DNA, 20 bp, Artificial Sequence
  Description of Artificial Sequence: Synthetic oligonucleotide
  Target: ATXN1; (+) strand; PAM type: NRG; PAM sequence: TGG
ggataatacaggcccactgt

SEQ ID NO: 97006 - DNA, 20 bp, Artificial Sequence
  Description of Artificial Sequence: Synthetic oligonucleotide
  Target: ATXN1; (+) strand; PAM type: NRG; PAM sequence: AAG
aggcccactgttggtccttt

SEQ ID NO: 97007 - DNA, 20 bp, Artificial Sequence
  Description of Artificial Sequence: Synthetic oligonucleotide
  Target: ATXN1; (+) strand; PAM type: NRG; PAM sequence: TAG
tggtcctttaagattatgtt

SEQ ID NO: 97008 - DNA, 20 bp, Artificial Sequence
  Description of Artificial Sequence: Synthetic oligonucleotide
  Target: ATXN1; (+) strand; PAM type: NRG; PAM sequence: GAG
gtcctttaagattatgttta

SEQ ID NO: 97009 - DNA, 20 bp, Artificial Sequence
  Description of Artificial Sequence: Synthetic oligonucleotide
  Target: ATXN1; (+) strand; PAM type: NRG; PAM sequence: CAG
taagattatgtttagagatc

SEQ ID NO: 97010 - DNA, 20 bp, Artificial Sequence
  Description of Artificial Sequence: Synthetic oligonucleotide
  Target: ATXN1; (+) strand; PAM type: NRG; PAM sequence: CAG
attatgtttagagatccagc

SEQ ID NO: 97011 - DNA, 20 bp, Artificial Sequence
  Description of Artificial Sequence: Synthetic oligonucleotide
  Target: ATXN1; (+) strand; PAM type: NRG; PAM sequence: CAG
atgtttagagatccagccag

SEQ ID NO: 97012 - DNA, 20 bp, Artificial Sequence
  Description of Artificial Sequence: Synthetic oligonucleotide
  Target: ATXN1; (+) strand; PAM type: NRG; PAM sequence: AAG
tttcccctactaaatccatt

SEQ ID NO: 97013 - DNA, 20 bp, Artificial Sequence
  Description of Artificial Sequence: Synthetic oligonucleotide
  Target: ATXN1; (+) strand; PAM type: NRG; PAM sequence: GAG
tcccctactaaatccattaa

SEQ ID NO: 97014 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttaattt

SEQ ID NO: 97015 - DNA, 20 bp, Artificial Sequence
  Description of Artificial Sequence: Synthetic oligonucleotide
  Target: ATXN1; (+) strand; PAM type: NRG; PAM sequence: CAG
tttttttttttaatttgaga

SEQ ID NO: 97016 - DNA, 20 bp, Artificial Sequence
  Description of Artificial Sequence: Synthetic oligonucleotide
  Target: ATXN1; (+) strand; PAM type: NRG; PAM sequence: AGG
ttttttttttaatttgagac

SEQ ID NO: 97017 - DNA, 20 bp, Artificial Sequence
  Description of Artificial Sequence: Synthetic oligonucleotide
  Target: ATXN1; (+) strand; PAM type: NRG; PAM sequence: GGG
tttttttttaatttgagaca

SEQ ID NO: 97018 - DNA, 20 bp, Artificial Sequence
  Description of Artificial Sequence: Synthetic oligonucleotide
  Target: ATXN1; (+) strand; PAM type: NRG; PAM sequence: CAG
gagacagggtctctgttgcc

SEQ ID NO: 97019 - DNA, 20 bp, Artificial Sequence
  Description of Artificial Sequence: Synthetic oligonucleotide
  Target: ATXN1; (+) strand; PAM type: NRG; PAM sequence: AGG
agacagggtctctgttgccc

SEQ ID NO: 97020 - DNA, 20 bp, Artificial Sequence
  Description of Artificial Sequence: Synthetic oligonucleotide
  Target: ATXN1; (+) strand; PAM type: NRG; PAM sequence: TGG
agggtctctgttgcccaggc

SEQ ID NO: 97021 - DNA, 20 bp, Artificial Sequence
  Description of Artificial Sequence: Synthetic oligonucleotide
  Target: ATXN1; (+) strand; PAM type: NRG; PAM sequence: GAG
ggtctctgttgcccaggctg

SEQ ID NO: 97022 - DNA, 20 bp, Artificial Sequence
  Description of Artificial Sequence: Synthetic oligonucleotide
  Target: ATXN1; (+) strand; PAM type: NRG; PAM sequence: CAG
ctgttgcccaggctggagtg

SEQ ID NO: 97023 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtgcag

SEQ ID NO: 97024 - DNA, 20 bp, Artificial Sequence
  Description of Artificial Sequence: Synthetic oligonucleotide
  Target: ATXN1; (+) strand; PAM type: NRG; PAM sequence: CAG
cccaggctggagtgcagtgg

SEQ ID NO: 97025 - DNA, 20 bp, Artificial Sequence
  Description of Artificial Sequence: Synthetic oligonucleotide
  Target: ATXN1; (+) strand; PAM type: NRG; PAM sequence: AGG
ccaggctggagtgcagtggc

SEQ ID NO: 97026 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggcaggatca

SEQ ID NO: 97027 - DNA, 20 bp, Artificial Sequence
  Description of Artificial Sequence: Synthetic oligonucleotide
  Target: ATXN1; (+) strand; PAM type: NRG; PAM sequence: CAG
ggcaggatcacagctcacca

SEQ ID NO: 97028 - DNA, 20 bp, Artificial Sequence
  Description of Artificial Sequence: Synthetic oligonucleotide
  Target: ATXN1; (+) strand; PAM type: NRG; PAM sequence: CGG
tcaccacagccttgacctcc

SEQ ID NO: 97029 - DNA, 20 bp, Artificial Sequence
  Description of Artificial Sequence: Synthetic oligonucleotide
  Target: ATXN1; (+) strand; PAM type: NRG; PAM sequence: GGG
caccacagccttgacctccc

SEQ ID NO: 97030 - DNA, 20 bp, Artificial Sequence
  Description of Artificial Sequence: Synthetic oligonucleotide
  Target: ATXN1; (+) strand; PAM type: NRG; PAM sequence: CAG
cagccttgacctcccgggct

SEQ ID NO: 97031 - DNA, 20 bp, Artificial Sequence
  Description of Artificial Sequence: Synthetic oligonucleotide
  Target: ATXN1; (+) strand; PAM type: NRG; PAM sequence: AGG
agccttgacctcccgggctc

SEQ ID NO: 97032 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgatcctctgacct

SEQ ID NO: 97033 - DNA, 20 bp, Artificial Sequence
  Description of Artificial Sequence: Synthetic oligonucleotide
  Target: ATXN1; (+) strand; PAM type: NRG; PAM sequence: AAG
tcctctgacctcagtctccc

SEQ ID NO: 97034 - DNA, 20 bp, Artificial Sequence
  Description of Artificial Sequence: Synthetic oligonucleotide
  Target: ATXN1; (+) strand; PAM type: NRG; PAM sequence: TAG
tctgacctcagtctcccaag

SEQ ID NO: 97035 - DNA, 20 bp, Artificial Sequence
  Description of Artificial Sequence: Synthetic oligonucleotide
  Target: ATXN1; (+) strand; PAM type: NRG; PAM sequence: TGG
acctcagtctcccaagtagc

SEQ ID NO: 97036 - DNA, 20 bp, Artificial Sequence
  Description of Artificial Sequence: Synthetic oligonucleotide
  Target: ATXN1; (+) strand; PAM type: NRG; PAM sequence: GGG
cctcagtctcccaagtagct

SEQ ID NO: 97037 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggacta

SEQ ID NO: 97038 - DNA, 20 bp, Artificial Sequence
  Description of Artificial Sequence: Synthetic oligonucleotide
  Target: ATXN1; (+) strand; PAM type: NRG; PAM sequence: CAG
cagacacctgctaccacgcc

SEQ ID NO: 97039 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttta

SEQ ID NO: 97040 - DNA, 20 bp, Artificial Sequence
  Description of Artificial Sequence: Synthetic oligonucleotide
  Target: ATXN1; (+) strand; PAM type: NRG; PAM sequence: GAG
taatttttgtattttttata

SEQ ID NO: 97041 - DNA, 20 bp, Artificial Sequence
  Description of Artificial Sequence: Synthetic oligonucleotide
  Target: ATXN1; (+) strand; PAM type: NRG; PAM sequence: CAG
ttttgtattttttatagaga

SEQ ID NO: 97042 - DNA, 20 bp, Artificial Sequence
  Description of Artificial Sequence: Synthetic oligonucleotide
  Target: ATXN1; (+) strand; PAM type: NRG; PAM sequence: AGG
tttgtattttttatagagac

SEQ ID NO: 97043 - DNA, 20 bp, Artificial Sequence
  Description of Artificial Sequence: Synthetic oligonucleotide
  Target: ATXN1; (+) strand; PAM type: NRG; PAM sequence: GGG
ttgtattttttatagagaca

SEQ ID NO: 97044 - DNA, 20 bp, Artificial Sequence
  Description of Artificial Sequence: Synthetic oligonucleotide
  Target: ATXN1; (+) strand; PAM type: NRG; PAM sequence: CAG
cagggtctcaccatgttgcc

SEQ ID NO: 97045 - DNA, 20 bp, Artificial Sequence
  Description of Artificial Sequence: Synthetic oligonucleotide
  Target: ATXN1; (+) strand; PAM type: NRG; PAM sequence: TGG
tctcaccatgttgcccagac

SEQ ID NO: 97046 - DNA, 20 bp, Artificial Sequence
  Description of Artificial Sequence: Synthetic oligonucleotide
  Target: ATXN1; (+) strand; PAM type: NRG; PAM sequence: CAG
cccagactggtctcaaactc

SEQ ID NO: 97047 - DNA, 20 bp, Artificial Sequence
  Description of Artificial Sequence: Synthetic oligonucleotide
  Target: ATXN1; (+) strand; PAM type: NRG; PAM sequence: AGG
ccagactggtctcaaactcc

SEQ ID NO: 97048 - DNA, 20 bp, Artificial Sequence
  Description of Artificial Sequence: Synthetic oligonucleotide
  Target: ATXN1; (+) strand; PAM type: NRG; PAM sequence: GGG
cagactggtctcaaactcca

SEQ ID NO: 97049 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactccagggctc

SEQ ID NO: 97050 - DNA, 20 bp, Artificial Sequence
  Description of Artificial Sequence: Synthetic oligonucleotide
  Target: ATXN1; (+) strand; PAM type: NRG; PAM sequence: AAG
cacctgcgtcaacctcccca

SEQ ID NO: 97051 - DNA, 20 bp, Artificial Sequence
  Description of Artificial Sequence: Synthetic oligonucleotide
  Target: ATXN1; (+) strand; PAM type: NRG; PAM sequence: TAG
cgtcaacctccccaaagtgc

SEQ ID NO: 97052 - DNA, 20 bp, Artificial Sequence
  Description of Artificial Sequence: Synthetic oligonucleotide
  Target: ATXN1; (+) strand; PAM type: NRG; PAM sequence: AGG
gtcaacctccccaaagtgct

SEQ ID NO: 97053 - DNA, 20 bp, Artificial Sequence
  Description of Artificial Sequence: Synthetic oligonucleotide
  Target: ATXN1; (+) strand; PAM type: NRG; PAM sequence: CAG
tccccaaagtgctaggatta

SEQ ID NO: 97054 - DNA, 20 bp, Artificial Sequence
  Description of Artificial Sequence: Synthetic oligonucleotide
  Target: ATXN1; (+) strand; PAM type: NRG; PAM sequence: AGG
ccccaaagtgctaggattac

SEQ ID NO: 97055 - DNA, 20 bp, Artificial Sequence
  Description of Artificial Sequence: Synthetic oligonucleotide
  Target: ATXN1; (+) strand; PAM type: NRG; PAM sequence: GAG
agtgctaggattacaggtgt

SEQ ID NO: 97056 - DNA, 20 bp, Artificial Sequence
  Description of Artificial Sequence: Synthetic oligonucleotide
  Target: ATXN1; (+) strand; PAM type: NRG; PAM sequence: CGG
caggtgtgagccactgtgcc

SEQ ID NO: 97057 - DNA, 20 bp, Artificial Sequence
  Description of Artificial Sequence: Synthetic oligonucleotide
  Target: ATXN1; (+) strand; PAM type: NRG; PAM sequence: AAG
gccactgtgcccggcccatt

SEQ ID NO: 97058 - DNA, 20 bp, Artificial Sequence
  Description of Artificial Sequence: Synthetic oligonucleotide
  Target: ATXN1; (+) strand; PAM type: NRG; PAM sequence: TAG
aagaataactcttgcacctg

SEQ ID NO: 97059 - DNA, 20 bp, Artificial Sequence
  Description of Artificial Sequence: Synthetic oligonucleotide
  Target: ATXN1; (+) strand; PAM type: NRG; PAM sequence: AAG
tcttgcacctgtagaaacac

SEQ ID NO: 97060 - DNA, 20 bp, Artificial Sequence
  Description of Artificial Sequence: Synthetic oligonucleotide
  Target: ATXN1; (+) strand; PAM type: NRG; PAM sequence: AGG
cttgcacctgtagaaacaca

SEQ ID NO: 97061 - DNA, 20 bp, Artificial Sequence
  Description of Artificial Sequence: Synthetic oligonucleotide
  Target: ATXN1; (+) strand; PAM type: NRG; PAM sequence: GGG
ttgcacctgtagaaacacaa

SEQ ID NO: 97062 - DNA, 20 bp, Artificial Sequence
  Description of Artificial Sequence: Synthetic oligonucleotide
  Target: ATXN1; (+) strand; PAM type: NRG; PAM sequence: TGG
gaaacacaagggctgcactt

SEQ ID NO: 97063 - DNA, 20 bp, Artificial Sequence
  Description of Artificial Sequence: Synthetic oligonucleotide
  Target: ATXN1; (+) strand; PAM type: NRG; PAM sequence: GAG
aacacaagggctgcactttg

SEQ ID NO: 97064 - DNA, 20 bp, Artificial Sequence
  Description of Artificial Sequence: Synthetic oligonucleotide
  Target: ATXN1; (+) strand; PAM type: NRG; PAM sequence: CGG
caagggctgcactttggaga

SEQ ID NO: 97065 - DNA, 20 bp, Artificial Sequence
  Description of Artificial Sequence: Synthetic oligonucleotide
  Target: ATXN1; (+) strand; PAM type: NRG; PAM sequence: GGG
aagggctgcactttggagac

SEQ ID NO: 97066 - DNA, 20 bp, Artificial Sequence
  Description of Artificial Sequence: Synthetic oligonucleotide
  Target: ATXN1; (+) strand; PAM type: NRG; PAM sequence: GAG
gggctgcactttggagacgg

SEQ ID NO: 97067 - DNA, 20 bp, Artificial Sequence
  Description of Artificial Sequence: Synthetic oligonucleotide
  Target: ATXN1; (+) strand; PAM type: NRG; PAM sequence: AGG
ggctgcactttggagacggg

SEQ ID NO: 97068 - DNA, 20 bp, Artificial Sequence
  Description of Artificial Sequence: Synthetic oligonucleotide
  Target: ATXN1; (+) strand; PAM type: NRG; PAM sequence: GGG
gctgcactttggagacggga

SEQ ID NO: 97069 - DNA, 20 bp, Artificial Sequence
  Description of Artificial Sequence: Synthetic oligonucleotide
  Target: ATXN1; (+) strand; PAM type: NRG; PAM sequence: AAG
actttggagacgggagggcc

SEQ ID NO: 97070 - DNA, 20 bp, Artificial Sequence
  Description of Artificial Sequence: Synthetic oligonucleotide
  Target: ATXN1; (+) strand; PAM type: NRG; PAM sequence: GAG
tttggagacgggagggccaa

SEQ ID NO: 97071 - DNA, 20 bp, Artificial Sequence
  Description of Artificial Sequence: Synthetic oligonucleotide
  Target: ATXN1; (+) strand; PAM type: NRG; PAM sequence: AGG
ttggagacgggagggccaag

SEQ ID NO: 97072 - DNA, 20 bp, Artificial Sequence
  Description of Artificial Sequence: Synthetic oligonucleotide
  Target: ATXN1; (+) strand; PAM type: NRG; PAM sequence: TGG
ggccaagaggcgatttaacg

SEQ ID NO: 97073 - DNA, 20 bp, Artificial Sequence
  Description of Artificial Sequence: Synthetic oligonucleotide
  Target: ATXN1; (+) strand; PAM type: NRG; PAM sequence: GAG
ccaagaggcgatttaacgtg

SEQ ID NO: 97074 - DNA, 20 bp, Artificial Sequence
  Description of Artificial Sequence: Synthetic oligonucleotide
  Target: ATXN1; (+) strand; PAM type: NRG; PAM sequence: AAG
gaggcgatttaacgtggagc

SEQ ID NO: 97075 - DNA, 20 bp, Artificial Sequence
  Description of Artificial Sequence: Synthetic oligonucleotide
  Target: ATXN1; (+) strand; PAM type: NRG; PAM sequence: TGG
atttaacgtggagcaagaca

SEQ ID NO: 97076 - DNA, 20 bp, Artificial Sequence
  Description of Artificial Sequence: Synthetic oligonucleotide
  Target: ATXN1; (+) strand; PAM type: NRG; PAM sequence: GGG
tttaacgtggagcaagacat

SEQ ID NO: 97077 - DNA, 20 bp, Artificial Sequence
  Description of Artificial Sequence: Synthetic oligonucleotide
  Target: ATXN1; (+) strand; PAM type: NRG; PAM sequence: GGG
ttaacgtggagcaagacatg

SEQ ID NO: 97078 - DNA, 20 bp, Artificial Sequence
  Description of Artificial Sequence: Synthetic oligonucleotide
  Target: ATXN1; (+) strand; PAM type: NRG; PAM sequence: TGG
gtggagcaagacatggggct

SEQ ID NO: 97079 - DNA, 20 bp, Artificial Sequence
  Description of Artificial Sequence: Synthetic oligonucleotide
  Target: ATXN1; (+) strand; PAM type: NRG; PAM sequence: CAG
caagacatggggcttggctg

SEQ ID NO: 97080 - DNA, 20 bp, Artificial Sequence
  Description of Artificial Sequence: Synthetic oligonucleotide
  Target: ATXN1; (+) strand; PAM type: NRG; PAM sequence: AGG
aagacatggggcttggctgc

SEQ ID NO: 97081 - DNA, 20 bp, Artificial Sequence
  Description of Artificial Sequence: Synthetic oligonucleotide
  Target: ATXN1; (+) strand; PAM type: NRG; PAM sequence: TGG
gctccccgccttgctctctg

SEQ ID NO: 97082 - DNA, 20 bp, Artificial Sequence
  Description of Artificial Sequence: Synthetic oligonucleotide
  Target: ATXN1; (+) strand; PAM type: NRG; PAM sequence: CAG
ccttgctctctgtggtcttc

SEQ ID NO: 97083 - DNA, 20 bp, Artificial Sequence
  Description of Artificial Sequence: Synthetic oligonucleotide
  Target: ATXN1; (+) strand; PAM type: NRG; PAM sequence: GAG
tcttccagctgcttgtaact

SEQ ID NO: 97084 - DNA, 20 bp, Artificial Sequence
  Description of Artificial Sequence: Synthetic oligonucleotide
  Target: ATXN1; (+) strand; PAM type: NRG; PAM sequence: TAG
tccagctgcttgtaactgag

SEQ ID NO: 97085 - DNA, 20 bp, Artificial Sequence
  Description of Artificial Sequence: Synthetic oligonucleotide
  Target: ATXN1; (+) strand; PAM type: NRG; PAM sequence: TAG
ttacaaaatcaaaaactcgt

SEQ ID NO: 97086 - DNA, 20 bp, Artificial Sequence
  Description of Artificial Sequence: Synthetic oligonucleotide
  Target: ATXN1; (+) strand; PAM type: NRG; PAM sequence: AGG
tacaaaatcaaaaactcgtt

SEQ ID NO: 97087 - DNA, 20 bp, Artificial Sequence
  Description of Artificial Sequence: Synthetic oligonucleotide
  Target: ATXN1; (+) strand; PAM type: NRG; PAM sequence: AAG
aactcgttaggaccattttg

SEQ ID NO: 97088 - DNA, 20 bp, Artificial Sequence
  Description of Artificial Sequence: Synthetic oligonucleotide
  Target: ATXN1; (+) strand; PAM type: NRG; PAM sequence: CAG
tcgttaggaccattttgaag

SEQ ID NO: 97089 - DNA, 20 bp, Artificial Sequence
  Description of Artificial Sequence: Synthetic oligonucleotide
  Target: ATXN1; (+) strand; PAM type: NRG; PAM sequence: GAG
gttaggaccattttgaagca

SEQ ID NO: 97090 - DNA, 20 bp, Artificial Sequence
  Description of Artificial Sequence: Synthetic oligonucleotide
  Target: ATXN1; (+) strand; PAM type: NRG; PAM sequence: CAG
ccattttgaagcagagcctt

SEQ ID NO: 97091 - DNA, 20 bp, Artificial Sequence
  Description of Artificial Sequence: Synthetic oligonucleotide
  Target: ATXN1; (+) strand; PAM type: NRG; PAM sequence: AAG
tttgaagcagagccttcaga

SEQ ID NO: 97092 - DNA, 20 bp, Artificial Sequence
  Description of Artificial Sequence: Synthetic oligonucleotide
  Target: ATXN1; (+) strand; PAM type: NRG; PAM sequence: GAG
tgaagcagagccttcagaaa

SEQ ID NO: 97093 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttcct

SEQ ID NO: 97094 - DNA, 20 bp, Artificial Sequence
  Description of Artificial Sequence: Synthetic oligonucleotide
  Target: ATXN1; (+) strand; PAM type: NRG; PAM sequence: AAG
tttttttttttcctgagacc

SEQ ID NO: 97095 - DNA, 20 bp, Artificial Sequence
  Description of Artificial Sequence: Synthetic oligonucleotide
  Target: ATXN1; (+) strand; PAM type: NRG; PAM sequence: CAG
ccaagtcttgctctgtcacc

SEQ ID NO: 97096 - DNA, 20 bp, Artificial Sequence
  Description of Artificial Sequence: Synthetic oligonucleotide
  Target: ATXN1; (+) strand; PAM type: NRG; PAM sequence: AGG
caagtcttgctctgtcaccc

SEQ ID NO: 97097 - DNA, 20 bp, Artificial Sequence
  Description of Artificial Sequence: Synthetic oligonucleotide
  Target: ATXN1; (+) strand; PAM type: NRG; PAM sequence: CAG
gtcttgctctgtcacccagg

SEQ ID NO: 97098 - DNA, 20 bp, Artificial Sequence
  Description of Artificial Sequence: Synthetic oligonucleotide
  Target: ATXN1; (+) strand; PAM type: NRG; PAM sequence: GAG
cttgctctgtcacccaggca

SEQ ID NO: 97099 - DNA, 20 bp, Artificial Sequence
  Description of Artificial Sequence: Synthetic oligonucleotide
  Target: ATXN1; (+) strand; PAM type: NRG; PAM sequence: CAG
tctgtcacccaggcagagtg

SEQ ID NO: 97100 - DNA, 20 bp, Artificial Sequence
  Description of Artificial Sequence: Synthetic oligonucleotide
  Target: ATXN1; (+) strand; PAM type: NRG; PAM sequence: TGG
gtcacccaggcagagtgcag

SEQ ID NO: 97101 - DNA, 20 bp, Artificial Sequence
  Description of Artificial Sequence: Synthetic oligonucleotide
  Target: ATXN1; (+) strand; PAM type: NRG; PAM sequence: CGG
agagtgcagtggcacaatct

SEQ ID NO: 97102 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctccgcctcc

SEQ ID NO: 97103 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctccgcctccc

SEQ ID NO: 97104 - DNA, 20 bp, Artificial Sequence
  Description of Artificial Sequence: Synthetic oligonucleotide
  Target: ATXN1; (+) strand; PAM type: NRG; PAM sequence: AAG
aacctccgcctcccaggttc

SEQ ID NO: 97105 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcgtgcct

SEQ ID NO: 97106 - DNA, 20 bp, Artificial Sequence
  Description of Artificial Sequence: Synthetic oligonucleotide
  Target: ATXN1; (+) strand; PAM type: NRG; PAM sequence: CAG
gattctcgtgcctcagcctt

SEQ ID NO: 97107 - DNA, 20 bp, Artificial Sequence
  Description of Artificial Sequence: Synthetic oligonucleotide
  Target: ATXN1; (+) strand; PAM type: NRG; PAM sequence: GAG
ttctcgtgcctcagccttca

SEQ ID NO: 97108 - DNA, 20 bp, Artificial Sequence
  Description of Artificial Sequence: Synthetic oligonucleotide
  Target: ATXN1; (+) strand; PAM type: NRG; PAM sequence: TAG
tcgtgcctcagccttcagag

SEQ ID NO: 97109 - DNA, 20 bp, Artificial Sequence
  Description of Artificial Sequence: Synthetic oligonucleotide
  Target: ATXN1; (+) strand; PAM type: NRG; PAM sequence: CGG
gcctcagccttcagagtagc

SEQ ID NO: 97110 - DNA, 20 bp, Artificial Sequence
  Description of Artificial Sequence: Synthetic oligonucleotide
  Target: ATXN1; (+) strand; PAM type: NRG; PAM sequence: GGG
cctcagccttcagagtagcc

SEQ ID NO: 97111 - DNA, 20 bp, Artificial Sequence
  Description of Artificial Sequence: Synthetic oligonucleotide
  Target: ATXN1; (+) strand; PAM type: NRG; PAM sequence: CAG
cttcagagtagccgggatta

SEQ ID NO: 97112 - DNA, 20 bp, Artificial Sequence
  Description of Artificial Sequence: Synthetic oligonucleotide
  Target: ATXN1; (+) strand; PAM type: NRG; PAM sequence: AGG
ttcagagtagccgggattac

SEQ ID NO: 97113 - DNA, 20 bp, Artificial Sequence
  Description of Artificial Sequence: Synthetic oligonucleotide
  Target: ATXN1; (+) strand; PAM type: NRG; PAM sequence: TGG
ttacaggtgcccgccacgtc

SEQ ID NO: 97114 - DNA, 20 bp, Artificial Sequence
  Description of Artificial Sequence: Synthetic oligonucleotide
  Target: ATXN1; (+) strand; PAM type: NRG; PAM sequence: TAG
ctggctaatgtttatgtttt

SEQ ID NO: 97115 - DNA, 20 bp, Artificial Sequence
  Description of Artificial Sequence: Synthetic oligonucleotide
  Target: ATXN1; (+) strand; PAM type: NRG; PAM sequence: TAG
gctaatgtttatgtttttag

SEQ ID NO: 97116 - DNA, 20 bp, Artificial Sequence
  Description of Artificial Sequence: Synthetic oligonucleotide
  Target: ATXN1; (+) strand; PAM type: NRG; PAM sequence: GAG
taatgtttatgtttttagta

SEQ ID NO: 97117 - DNA, 20 bp, Artificial Sequence
  Description of Artificial Sequence: Synthetic oligonucleotide
  Target: ATXN1; (+) strand; PAM type: NRG; PAM sequence: TGG
gtttatgtttttagtagaga

SEQ ID NO: 97118 - DNA, 20 bp, Artificial Sequence
  Description of Artificial Sequence: Synthetic oligonucleotide
  Target: ATXN1; (+) strand; PAM type: NRG; PAM sequence: GGG
tttatgtttttagtagagat

SEQ ID NO: 97119 - DNA, 20 bp, Artificial Sequence
  Description of Artificial Sequence: Synthetic oligonucleotide
  Target: ATXN1; (+) strand; PAM type: NRG; PAM sequence: CAG
tgggtttttgccatgttacc

SEQ ID NO: 97120 - DNA, 20 bp, Artificial Sequence
  Description of Artificial Sequence: Synthetic oligonucleotide
  Target: ATXN1; (+) strand; PAM type: NRG; PAM sequence: AGG
gggtttttgccatgttaccc

SEQ ID NO: 97121 - DNA, 20 bp, Artificial Sequence
  Description of Artificial Sequence: Synthetic oligonucleotide
  Target: ATXN1; (+) strand; PAM type: NRG; PAM sequence: TGG
ttttgccatgttacccaggc

SEQ ID NO: 97122 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtctcaaactcc

SEQ ID NO: 97123 - DNA, 20 bp, Artificial Sequence
  Description of Artificial Sequence: Synthetic oligonucleotide
  Target: ATXN1; (+) strand; PAM type: NRG; PAM sequence: GGG
caggctggtctcaaactcct

SEQ ID NO: 97124 - DNA, 20 bp, Artificial Sequence
  Description of Artificial Sequence: Synthetic oligonucleotide
  Target: ATXN1; (+) strand; PAM type: NRG; PAM sequence: CGG
tggtctcaaactcctgggct

SEQ ID NO: 97125 - DNA, 20 bp, Artificial Sequence
  Description of Artificial Sequence: Synthetic oligonucleotide
  Target: ATXN1; (+) strand; PAM type: NRG; PAM sequence: GGG
ggtctcaaactcctgggctc

SEQ ID NO: 97126 - DNA, 20 bp, Artificial Sequence
  Description of Artificial Sequence: Synthetic oligonucleotide
  Target: ATXN1; (+) strand; PAM type: NRG; PAM sequence: CAG
ctcgggtgatccacccacct

SEQ ID NO: 97127 - DNA, 20 bp, Artificial Sequence
  Description of Artificial Sequence: Synthetic oligonucleotide
  Target: ATXN1; (+) strand; PAM type: NRG; PAM sequence: AAG
ccacccacctcagcctccca

SEQ ID NO: 97128 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcccaaagtgc

SEQ ID NO: 97129 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgct

SEQ ID NO: 97130 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 97131 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 97132 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 97133 - DNA, 20 bp, Artificial Sequence
  Description of Artificial Sequence: Synthetic oligonucleotide
  Target: ATXN1; (+) strand; PAM type: NRG; PAM sequence: TGG
caggtgtgagccaccgcgcc

SEQ ID NO: 97134 - DNA, 20 bp, Artificial Sequence
  Description of Artificial Sequence: Synthetic oligonucleotide
  Target: ATXN1; (+) strand; PAM type: NRG; PAM sequence: AAG
gccaccgcgcctggcccata

SEQ ID NO: 97135 - DNA, 20 bp, Artificial Sequence
  Description of Artificial Sequence: Synthetic oligonucleotide
  Target: ATXN1; (+) strand; PAM type: NRG; PAM sequence: GAG
caccgcgcctggcccataaa

SEQ ID NO: 97136 - DNA, 20 bp, Artificial Sequence
  Description of Artificial Sequence: Synthetic oligonucleotide
  Target: ATXN1; (+) strand; PAM type: NRG; PAM sequence: AAG
ggcccataaagagaacttgt

SEQ ID NO: 97137 - DNA, 20 bp, Artificial Sequence
  Description of Artificial Sequence: Synthetic oligonucleotide
  Target: ATXN1; (+) strand; PAM type: NRG; PAM sequence: AGG
gcccataaagagaacttgta

SEQ ID NO: 97138 - DNA, 20 bp, Artificial Sequence
  Description of Artificial Sequence: Synthetic oligonucleotide
  Target: ATXN1; (+) strand; PAM type: NRG; PAM sequence: TAG
ggctccgtcaccgtttgcct

SEQ ID NO: 97139 - DNA, 20 bp, Artificial Sequence
  Description of Artificial Sequence: Synthetic oligonucleotide
  Target: ATXN1; (+) strand; PAM type: NRG; PAM sequence: CAG
tccgtcaccgtttgccttag

SEQ ID NO: 97140 - DNA, 20 bp, Artificial Sequence
  Description of Artificial Sequence: Synthetic oligonucleotide
  Target: ATXN1; (+) strand; PAM type: NRG; PAM sequence: AGG
ccgtcaccgtttgccttagc

SEQ ID NO: 97141 - DNA, 20 bp, Artificial Sequence
  Description of Artificial Sequence: Synthetic oligonucleotide
  Target: ATXN1; (+) strand; PAM type: NRG; PAM sequence: TAG
aggttcatctctgcctctga

SEQ ID NO: 97142 - DNA, 20 bp, Artificial Sequence
  Description of Artificial Sequence: Synthetic oligonucleotide
  Target: ATXN1; (+) strand; PAM type: NRG; PAM sequence: AGG
ggttcatctctgcctctgat

SEQ ID NO: 97143 - DNA, 20 bp, Artificial Sequence
  Description of Artificial Sequence: Synthetic oligonucleotide
  Target: ATXN1; (+) strand; PAM type: NRG; PAM sequence: GAG
ttcatctctgcctctgatag

SEQ ID NO: 97144 - DNA, 20 bp, Artificial Sequence
  Description of Artificial Sequence: Synthetic oligonucleotide
  Target: ATXN1; (+) strand; PAM type: NRG; PAM sequence: TGG
atctctgcctctgataggag

SEQ ID NO: 97145 - DNA, 20 bp, Artificial Sequence
  Description of Artificial Sequence: Synthetic oligonucleotide
  Target: ATXN1; (+) strand; PAM type: NRG; PAM sequence: GGG
tctctgcctctgataggagt

SEQ ID NO: 97146 - DNA, 20 bp, Artificial Sequence
  Description of Artificial Sequence: Synthetic oligonucleotide
  Target: ATXN1; (+) strand; PAM type: NRG; PAM sequence: GGG
ctctgcctctgataggagtg

SEQ ID NO: 97147 - DNA, 20 bp, Artificial Sequence
  Description of Artificial Sequence: Synthetic oligonucleotide
  Target: ATXN1; (+) strand; PAM type: NRG; PAM sequence: TGG
gcctctgataggagtggggc

SEQ ID NO: 97148 - DNA, 20 bp, Artificial Sequence
  Description of Artificial Sequence: Synthetic oligonucleotide
  Target: ATXN1; (+) strand; PAM type: NRG; PAM sequence: GGG
cctctgataggagtggggct

SEQ ID NO: 97149 - DNA, 20 bp, Artificial Sequence
  Description of Artificial Sequence: Synthetic oligonucleotide
  Target: ATXN1; (+) strand; PAM type: NRG; PAM sequence: GGG
ctctgataggagtggggctg

SEQ ID NO: 97150 - DNA, 20 bp, Artificial Sequence
  Description of Artificial Sequence: Synthetic oligonucleotide
  Target: ATXN1; (+) strand; PAM type: NRG; PAM sequence: GGG
tctgataggagtggggctgg

SEQ ID NO: 97151 - DNA, 20 bp, Artificial Sequence
  Description of Artificial Sequence: Synthetic oligonucleotide
  Target: ATXN1; (+) strand; PAM type: NRG; PAM sequence: GAG
tgataggagtggggctgggg

SEQ ID NO: 97152 - DNA, 20 bp, Artificial Sequence
  Description of Artificial Sequence: Synthetic oligonucleotide
  Target: ATXN1; (+) strand; PAM type: NRG; PAM sequence: CAG
ggggctgggggagcccacac

SEQ ID NO: 97153 - DNA, 20 bp, Artificial Sequence
  Description of Artificial Sequence: Synthetic oligonucleotide
  Target: ATXN1; (+) strand; PAM type: NRG; PAM sequence: GAG
ggctgggggagcccacacca

SEQ ID NO: 97154 - DNA, 20 bp, Artificial Sequence
  Description of Artificial Sequence: Synthetic oligonucleotide
  Target: ATXN1; (+) strand; PAM type: NRG; PAM sequence: TGG
gcccacaccagagtgtccct

SEQ ID NO: 97155 - DNA, 20 bp, Artificial Sequence
  Description of Artificial Sequence: Synthetic oligonucleotide
  Target: ATXN1; (+) strand; PAM type: NRG; PAM sequence: CGG
caccagagtgtcccttggac

SEQ ID NO: 97156 - DNA, 20 bp, Artificial Sequence
  Description of Artificial Sequence: Synthetic oligonucleotide
  Target: ATXN1; (+) strand; PAM type: NRG; PAM sequence: GGG
accagagtgtcccttggacc

SEQ ID NO: 97157 - DNA, 20 bp, Artificial Sequence
  Description of Artificial Sequence: Synthetic oligonucleotide
  Target: ATXN1; (+) strand; PAM type: NRG; PAM sequence: CAG
cccttggaccgggtgtccca

SEQ ID NO: 97158 - DNA, 20 bp, Artificial Sequence
  Description of Artificial Sequence: Synthetic oligonucleotide
  Target: ATXN1; (+) strand; PAM type: NRG; PAM sequence: AGG
ccttggaccgggtgtcccac

SEQ ID NO: 97159 - DNA, 20 bp, Artificial Sequence
  Description of Artificial Sequence: Synthetic oligonucleotide
  Target: ATXN1; (+) strand; PAM type: NRG; PAM sequence: TGG
accgggtgtcccacaggacc

SEQ ID NO: 97160 - DNA, 20 bp, Artificial Sequence
  Description of Artificial Sequence: Synthetic oligonucleotide
  Target: ATXN1; (+) strand; PAM type: NRG; PAM sequence: GAG
cgggtgtcccacaggacctg

SEQ ID NO: 97161 - DNA, 20 bp, Artificial Sequence
  Description of Artificial Sequence: Synthetic oligonucleotide
  Target: ATXN1; (+) strand; PAM type: NRG; PAM sequence: AAG
tcccacaggacctggagatg

SEQ ID NO: 97162 - DNA, 20 bp, Artificial Sequence
  Description of Artificial Sequence: Synthetic oligonucleotide
  Target: ATXN1; (+) strand; PAM type: NRG; PAM sequence: CAG
ggacctggagatgaagcatg

SEQ ID NO: 97163 - DNA, 20 bp, Artificial Sequence
  Description of Artificial Sequence: Synthetic oligonucleotide
  Target: ATXN1; (+) strand; PAM type: NRG; PAM sequence: TGG
cagctttgctgctgacccac

SEQ ID NO: 97164 - DNA, 20 bp, Artificial Sequence
  Description of Artificial Sequence: Synthetic oligonucleotide
  Target: ATXN1; (+) strand; PAM type: NRG; PAM sequence: GGG
agctttgctgctgacccact

SEQ ID NO: 97165 - DNA, 20 bp, Artificial Sequence
  Description of Artificial Sequence: Synthetic oligonucleotide
  Target: ATXN1; (+) strand; PAM type: NRG; PAM sequence: CAG
acccactgggcttcctgtgc

SEQ ID NO: 97166 - DNA, 20 bp, Artificial Sequence
  Description of Artificial Sequence: Synthetic oligonucleotide
  Target: ATXN1; (+) strand; PAM type: NRG; PAM sequence: GAG
ccactgggcttcctgtgcca

SEQ ID NO: 97167 - DNA, 20 bp, Artificial Sequence
  Description of Artificial Sequence: Synthetic oligonucleotide
  Target: ATXN1; (+) strand; PAM type: NRG; PAM sequence: TGG
tgggcttcctgtgccagagc

SEQ ID NO: 97168 - DNA, 20 bp, Artificial Sequence
  Description of Artificial Sequence: Synthetic oligonucleotide
  Target: ATXN1; (+) strand; PAM type: NRG; PAM sequence: GGG
gggcttcctgtgccagagct

SEQ ID NO: 97169 - DNA, 20 bp, Artificial Sequence
  Description of Artificial Sequence: Synthetic oligonucleotide
  Target: ATXN1; (+) strand; PAM type: NRG; PAM sequence: GGG
ggcttcctgtgccagagctg

SEQ ID NO: 97170 - DNA, 20 bp, Artificial Sequence
  Description of Artificial Sequence: Synthetic oligonucleotide
  Target: ATXN1; (+) strand; PAM type: NRG; PAM sequence: GGG
gcttcctgtgccagagctgg

SEQ ID NO: 97171 - DNA, 20 bp, Artificial Sequence
  Description of Artificial Sequence: Synthetic oligonucleotide
  Target: ATXN1; (+) strand; PAM type: NRG; PAM sequence: GAG
ttcctgtgccagagctgggg

SEQ ID NO: 97172 - DNA, 20 bp, Artificial Sequence
  Description of Artificial Sequence: Synthetic oligonucleotide
  Target: ATXN1; (+) strand; PAM type: NRG; PAM sequence: AGG
tcctgtgccagagctggggg

SEQ ID NO: 97173 - DNA, 20 bp, Artificial Sequence
  Description of Artificial Sequence: Synthetic oligonucleotide
  Target: ATXN1; (+) strand; PAM type: NRG; PAM sequence: GAG
ctgtgccagagctgggggag

SEQ ID NO: 97174 - DNA, 20 bp, Artificial Sequence
  Description of Artificial Sequence: Synthetic oligonucleotide
  Target: ATXN1; (+) strand; PAM type: NRG; PAM sequence: AGG
tgtgccagagctgggggagg

SEQ ID NO: 97175 - DNA, 20 bp, Artificial Sequence
  Description of Artificial Sequence: Synthetic oligonucleotide
  Target: ATXN1; (+) strand; PAM type: NRG; PAM sequence: GAG
tgccagagctgggggaggag

SEQ ID NO: 97176 - DNA, 20 bp, Artificial Sequence
  Description of Artificial Sequence: Synthetic oligonucleotide
  Target: ATXN1; (+) strand; PAM type: NRG; PAM sequence: AGG
gccagagctgggggaggagg

SEQ ID NO: 97177 - DNA, 20 bp, Artificial Sequence
  Description of Artificial Sequence: Synthetic oligonucleotide
  Target: ATXN1; (+) strand; PAM type: NRG; PAM sequence: CAG
gagctgggggaggaggagga

SEQ ID NO: 97178 - DNA, 20 bp, Artificial Sequence
  Description of Artificial Sequence: Synthetic oligonucleotide
  Target: ATXN1; (+) strand; PAM type: NRG; PAM sequence: CAG
tgggggaggaggaggacagc

SEQ ID NO: 97179 - DNA, 20 bp, Artificial Sequence
  Description of Artificial Sequence: Synthetic oligonucleotide
  Target: ATXN1; (+) strand; PAM type: NRG; PAM sequence: TGG
gaactcgacgccatttgcct

SEQ ID NO: 97180 - DNA, 20 bp, Artificial Sequence
  Description of Artificial Sequence: Synthetic oligonucleotide
  Target: ATXN1; (+) strand; PAM type: NRG; PAM sequence: GGG
aactcgacgccatttgcctt

SEQ ID NO: 97181 - DNA, 20 bp, Artificial Sequence
  Description of Artificial Sequence: Synthetic oligonucleotide
  Target: ATXN1; (+) strand; PAM type: NRG; PAM sequence: TGG
ccatttgccttgggccactc

SEQ ID NO: 97182 - DNA, 20 bp, Artificial Sequence
  Description of Artificial Sequence: Synthetic oligonucleotide
  Target: ATXN1; (+) strand; PAM type: NRG; PAM sequence: GAG
ccactctggccgttccatct

SEQ ID NO: 97183 - DNA, 20 bp, Artificial Sequence
  Description of Artificial Sequence: Synthetic oligonucleotide
  Target: ATXN1; (+) strand; PAM type: NRG; PAM sequence: AGG
cactctggccgttccatctg

SEQ ID NO: 97184 - DNA, 20 bp, Artificial Sequence
  Description of Artificial Sequence: Synthetic oligonucleotide
  Target: ATXN1; (+) strand; PAM type: NRG; PAM sequence: GGG
actctggccgttccatctga

SEQ ID NO: 97185 - DNA, 20 bp, Artificial Sequence
  Description of Artificial Sequence: Synthetic oligonucleotide
  Target: ATXN1; (+) strand; PAM type: NRG; PAM sequence: TGG
gccgttccatctgagggctc

SEQ ID NO: 97186 - DNA, 20 bp, Artificial Sequence
  Description of Artificial Sequence: Synthetic oligonucleotide
  Target: ATXN1; (+) strand; PAM type: NRG; PAM sequence: CAG
gttccatctgagggctctgg

SEQ ID NO: 97187 - DNA, 20 bp, Artificial Sequence
  Description of Artificial Sequence: Synthetic oligonucleotide
  Target: ATXN1; (+) strand; PAM type: NRG; PAM sequence: TGG
ggctctggcagtgcttttga

SEQ ID NO: 97188 - DNA, 20 bp, Artificial Sequence
  Description of Artificial Sequence: Synthetic oligonucleotide
  Target: ATXN1; (+) strand; PAM type: NRG; PAM sequence: AAG
gcagtgcttttgatggtttc

SEQ ID NO: 97189 - DNA, 20 bp, Artificial Sequence
  Description of Artificial Sequence: Synthetic oligonucleotide
  Target: ATXN1; (+) strand; PAM type: NRG; PAM sequence: CAG
tttcaagtcctgccccgctg

SEQ ID NO: 97190 - DNA, 20 bp, Artificial Sequence
  Description of Artificial Sequence: Synthetic oligonucleotide
  Target: ATXN1; (+) strand; PAM type: NRG; PAM sequence: AAG
ctgccccgctgcagcacctg

SEQ ID NO: 97191 - DNA, 20 bp, Artificial Sequence
  Description of Artificial Sequence: Synthetic oligonucleotide
  Target: ATXN1; (+) strand; PAM type: NRG; PAM sequence: AGG
tgccccgctgcagcacctga

SEQ ID NO: 97192 - DNA, 20 bp, Artificial Sequence
  Description of Artificial Sequence: Synthetic oligonucleotide
  Target: ATXN1; (+) strand; PAM type: NRG; PAM sequence: TGG
cgctgcagcacctgaaggta

SEQ ID NO: 97193 - DNA, 20 bp, Artificial Sequence
  Description of Artificial Sequence: Synthetic oligonucleotide
  Target: ATXN1; (+) strand; PAM type: NRG; PAM sequence: CAG
ttccccctaattgatttcac

SEQ ID NO: 97194 - DNA, 20 bp, Artificial Sequence
  Description of Artificial Sequence: Synthetic oligonucleotide
  Target: ATXN1; (+) strand; PAM type: NRG; PAM sequence: GAG
cctaattgatttcaccagct

SEQ ID NO: 97195 - DNA, 20 bp, Artificial Sequence
  Description of Artificial Sequence: Synthetic oligonucleotide
  Target: ATXN1; (+) strand; PAM type: NRG; PAM sequence: AGG
ctaattgatttcaccagctg

SEQ ID NO: 97196 - DNA, 20 bp, Artificial Sequence
  Description of Artificial Sequence: Synthetic oligonucleotide
  Target: ATXN1; (+) strand; PAM type: NRG; PAM sequence: AAG
ttgatttcaccagctgaggt

SEQ ID NO: 97197 - DNA, 20 bp, Artificial Sequence
  Description of Artificial Sequence: Synthetic oligonucleotide
  Target: ATXN1; (+) strand; PAM type: NRG; PAM sequence: CAG
accagctgaggtaagtaaca

SEQ ID NO: 97198 - DNA, 20 bp, Artificial Sequence
  Description of Artificial Sequence: Synthetic oligonucleotide
  Target: ATXN1; (+) strand; PAM type: NRG; PAM sequence: TGG
gaggtaagtaacacagccac

SEQ ID NO: 97199 - DNA, 20 bp, Artificial Sequence
  Description of Artificial Sequence: Synthetic oligonucleotide
  Target: ATXN1; (+) strand; PAM type: NRG; PAM sequence: CAG
ccactggaccccaaacttgt

SEQ ID NO: 97200 - DNA, 20 bp, Artificial Sequence
  Description of Artificial Sequence: Synthetic oligonucleotide
  Target: ATXN1; (+) strand; PAM type: NRG; PAM sequence: CAG
cccaaacttgtcagaacaat

SEQ ID NO: 97201 - DNA, 20 bp, Artificial Sequence
  Description of Artificial Sequence: Synthetic oligonucleotide
  Target: ATXN1; (+) strand; PAM type: NRG; PAM sequence: AAG
cagtatctcacacaaacaaa

SEQ ID NO: 97202 - DNA, 20 bp, Artificial Sequence
  Description of Artificial Sequence: Synthetic oligonucleotide
  Target: ATXN1; (+) strand; PAM type: NRG; PAM sequence: AGG
agtatctcacacaaacaaaa

SEQ ID NO: 97203 - DNA, 20 bp, Artificial Sequence
  Description of Artificial Sequence: Synthetic oligonucleotide
  Target: ATXN1; (+) strand; PAM type: NRG; PAM sequence: GGG
gtatctcacacaaacaaaaa

SEQ ID NO: 97204 - DNA, 20 bp, Artificial Sequence
  Description of Artificial Sequence: Synthetic oligonucleotide
  Target: ATXN1; (+) strand; PAM type: NRG; PAM sequence: AAG
tctcacacaaacaaaaaggg

SEQ ID NO: 97205 - DNA, 20 bp, Artificial Sequence
  Description of Artificial Sequence: Synthetic oligonucleotide
  Target: ATXN1; (+) strand; PAM type: NRG; PAM sequence: AGG
ctcacacaaacaaaaaggga

SEQ ID NO: 97206 - DNA, 20 bp, Artificial Sequence
  Description of Artificial Sequence: Synthetic oligonucleotide
  Target: ATXN1; (+) strand; PAM type: NRG; PAM sequence: CAG
acacaaacaaaaagggaagg

SEQ ID NO: 97207 - DNA, 20 bp, Artificial Sequence
  Description of Artificial Sequence: Synthetic oligonucleotide
  Target: ATXN1; (+) strand; PAM type: NRG; PAM sequence: GAG
acaaacaaaaagggaaggca

SEQ ID NO: 97208 - DNA, 20 bp, Artificial Sequence
  Description of Artificial Sequence: Synthetic oligonucleotide
  Target: ATXN1; (+) strand; PAM type: NRG; PAM sequence: CAG
aaaaagggaaggcagagatg

SEQ ID NO: 97209 - DNA, 20 bp, Artificial Sequence
  Description of Artificial Sequence: Synthetic oligonucleotide
  Target: ATXN1; (+) strand; PAM type: NRG; PAM sequence: GAG
gagatgcagactgctttgcc

SEQ ID NO: 97210 - DNA, 20 bp, Artificial Sequence
  Description of Artificial Sequence: Synthetic oligonucleotide
  Target: ATXN1; (+) strand; PAM type: NRG; PAM sequence: CAG
tgctttgccgagtttgccca

SEQ ID NO: 97211 - DNA, 20 bp, Artificial Sequence
  Description of Artificial Sequence: Synthetic oligonucleotide
  Target: ATXN1; (+) strand; PAM type: NRG; PAM sequence: CAG
ccgagtttgcccacagcaca

SEQ ID NO: 97212 - DNA, 20 bp, Artificial Sequence
  Description of Artificial Sequence: Synthetic oligonucleotide
  Target: ATXN1; (+) strand; PAM type: NRG; PAM sequence: AGG
cgagtttgcccacagcacac

SEQ ID NO: 97213 - DNA, 20 bp, Artificial Sequence
  Description of Artificial Sequence: Synthetic oligonucleotide
  Target: ATXN1; (+) strand; PAM type: NRG; PAM sequence: CGG
agcacacaggcacatttgcc

SEQ ID NO: 97214 - DNA, 20 bp, Artificial Sequence
  Description of Artificial Sequence: Synthetic oligonucleotide
  Target: ATXN1; (+) strand; PAM type: NRG; PAM sequence: GGG
gcacacaggcacatttgccc

SEQ ID NO: 97215 - DNA, 20 bp, Artificial Sequence
  Description of Artificial Sequence: Synthetic oligonucleotide
  Target: ATXN1; (+) strand; PAM type: NRG; PAM sequence: CAG
catttgcccgggctactcca

SEQ ID NO: 97216 - DNA, 20 bp, Artificial Sequence
  Description of Artificial Sequence: Synthetic oligonucleotide
  Target: ATXN1; (+) strand; PAM type: NRG; PAM sequence: AGG
atttgcccgggctactccac

SEQ ID NO: 97217 - DNA, 20 bp, Artificial Sequence
  Description of Artificial Sequence: Synthetic oligonucleotide
  Target: ATXN1; (+) strand; PAM type: NRG; PAM sequence: TGG
ccgggctactccacaggacc

SEQ ID NO: 97218 - DNA, 20 bp, Artificial Sequence
  Description of Artificial Sequence: Synthetic oligonucleotide
  Target: ATXN1; (+) strand; PAM type: NRG; PAM sequence: GGG
cgggctactccacaggacct

SEQ ID NO: 97219 - DNA, 20 bp, Artificial Sequence
  Description of Artificial Sequence: Synthetic oligonucleotide
  Target: ATXN1; (+) strand; PAM type: NRG; PAM sequence: GGG
gggctactccacaggacctg

SEQ ID NO: 97220 - DNA, 20 bp, Artificial Sequence
  Description of Artificial Sequence: Synthetic oligonucleotide
  Target: ATXN1; (+) strand; PAM type: NRG; PAM sequence: CAG
ctactccacaggacctgggg

SEQ ID NO: 97221 - DNA, 20 bp, Artificial Sequence
  Description of Artificial Sequence: Synthetic oligonucleotide
  Target: ATXN1; (+) strand; PAM type: NRG; PAM sequence: TAG
aggacctggggcagcccttg

SEQ ID NO: 97222 - DNA, 20 bp, Artificial Sequence
  Description of Artificial Sequence: Synthetic oligonucleotide
  Target: ATXN1; (+) strand; PAM type: NRG; PAM sequence: GAG
tggggcagcccttgtagcct

SEQ ID NO: 97223 - DNA, 20 bp, Artificial Sequence
  Description of Artificial Sequence: Synthetic oligonucleotide
  Target: ATXN1; (+) strand; PAM type: NRG; PAM sequence: CAG
tagcctgagttgcacctaca

SEQ ID NO: 97224 - DNA, 20 bp, Artificial Sequence
  Description of Artificial Sequence: Synthetic oligonucleotide
  Target: ATXN1; (+) strand; PAM type: NRG; PAM sequence: TGG
gagttgcacctacacagctc

SEQ ID NO: 97225 - DNA, 20 bp, Artificial Sequence
  Description of Artificial Sequence: Synthetic oligonucleotide
  Target: ATXN1; (+) strand; PAM type: NRG; PAM sequence: CAG
atatttattatataatgtgt

SEQ ID NO: 97226 - DNA, 20 bp, Artificial Sequence
  Description of Artificial Sequence: Synthetic oligonucleotide
  Target: ATXN1; (+) strand; PAM type: NRG; PAM sequence: AGG
tatttattatataatgtgtc

SEQ ID NO: 97227 - DNA, 20 bp, Artificial Sequence
  Description of Artificial Sequence: Synthetic oligonucleotide
  Target: ATXN1; (+) strand; PAM type: NRG; PAM sequence: CAG
caggacctcaactaaataat

SEQ ID NO: 97228 - DNA, 20 bp, Artificial Sequence
  Description of Artificial Sequence: Synthetic oligonucleotide
  Target: ATXN1; (+) strand; PAM type: NRG; PAM sequence: GAG
ggacctcaactaaataatca

SEQ ID NO: 97229 - DNA, 20 bp, Artificial Sequence
  Description of Artificial Sequence: Synthetic oligonucleotide
  Target: ATXN1; (+) strand; PAM type: NRG; PAM sequence: AGG
gacctcaactaaataatcag

SEQ ID NO: 97230 - DNA, 20 bp, Artificial Sequence
  Description of Artificial Sequence: Synthetic oligonucleotide
  Target: ATXN1; (+) strand; PAM type: NRG; PAM sequence: GAG
cctcaactaaataatcagag

SEQ ID NO: 97231 - DNA, 20 bp, Artificial Sequence
  Description of Artificial Sequence: Synthetic oligonucleotide
  Target: ATXN1; (+) strand; PAM type: NRG; PAM sequence: GAG
tcaactaaataatcagagga

SEQ ID NO: 97232 - DNA, 20 bp, Artificial Sequence
  Description of Artificial Sequence: Synthetic oligonucleotide
  Target: ATXN1; (+) strand; PAM type: NRG; PAM sequence: AAG
agagtccaaaacaccttccc

SEQ ID NO: 97233 - DNA, 20 bp, Artificial Sequence
  Description of Artificial Sequence: Synthetic oligonucleotide
  Target: ATXN1; (+) strand; PAM type: NRG; PAM sequence: AAG
gtccaaaacaccttcccaag

SEQ ID NO: 97234 - DNA, 20 bp, Artificial Sequence
  Description of Artificial Sequence: Synthetic oligonucleotide
  Target: ATXN1; (+) strand; PAM type: NRG; PAM sequence: TAG
aaaacaccttcccaagaaga

SEQ ID NO: 97235 - DNA, 20 bp, Artificial Sequence
  Description of Artificial Sequence: Synthetic oligonucleotide
  Target: ATXN1; (+) strand; PAM type: NRG; PAM sequence: TGG
ccaagaagatagttcctcct

SEQ ID NO: 97236 - DNA, 20 bp, Artificial Sequence
  Description of Artificial Sequence: Synthetic oligonucleotide
  Target: ATXN1; (+) strand; PAM type: NRG; PAM sequence: AAG
aagatagttcctccttggct

SEQ ID NO: 97237 - DNA, 20 bp, Artificial Sequence
  Description of Artificial Sequence: Synthetic oligonucleotide
  Target: ATXN1; (+) strand; PAM type: NRG; PAM sequence: AAG
gtgaaaatgaatttaacccc

SEQ ID NO: 97238 - DNA, 20 bp, Artificial Sequence
  Description of Artificial Sequence: Synthetic oligonucleotide
  Target: ATXN1; (+) strand; PAM type: NRG; PAM sequence: GAG
tcccacctctgtgtaacctt

SEQ ID NO: 97239 - DNA, 20 bp, Artificial Sequence
  Description of Artificial Sequence: Synthetic oligonucleotide
  Target: ATXN1; (+) strand; PAM type: NRG; PAM sequence: AGG
cccacctctgtgtaaccttg

SEQ ID NO: 97240 - DNA, 20 bp, Artificial Sequence
  Description of Artificial Sequence: Synthetic oligonucleotide
  Target: ATXN1; (+) strand; PAM type: NRG; PAM sequence: TGG
cctctgtgtaaccttgaggc

SEQ ID NO: 97241 - DNA, 20 bp, Artificial Sequence
  Description of Artificial Sequence: Synthetic oligonucleotide
  Target: ATXN1; (+) strand; PAM type: NRG; PAM sequence: AAG
ctgtgtaaccttgaggctgg

SEQ ID NO: 97242 - DNA, 20 bp, Artificial Sequence
  Description of Artificial Sequence: Synthetic oligonucleotide
  Target: ATXN1; (+) strand; PAM type: NRG; PAM sequence: AGG
tgtgtaaccttgaggctgga

SEQ ID NO: 97243 - DNA, 20 bp, Artificial Sequence
  Description of Artificial Sequence: Synthetic oligonucleotide
  Target: ATXN1; (+) strand; PAM type: NRG; PAM sequence: GAG
ccttgaggctggaaggtctt

SEQ ID NO: 97244 - DNA, 20 bp, Artificial Sequence
  Description of Artificial Sequence: Synthetic oligonucleotide
  Target: ATXN1; (+) strand; PAM type: NRG; PAM sequence: AGG
cttgaggctggaaggtcttg

SEQ ID NO: 97245 - DNA, 20 bp, Artificial Sequence
  Description of Artificial Sequence: Synthetic oligonucleotide
  Target: ATXN1; (+) strand; PAM type: NRG; PAM sequence: TGG
gaggctggaaggtcttgagg

SEQ ID NO: 97246 - DNA, 20 bp, Artificial Sequence
  Description of Artificial Sequence: Synthetic oligonucleotide
  Target: ATXN1; (+) strand; PAM type: NRG; PAM sequence: GGG
aggctggaaggtcttgaggt

SEQ ID NO: 97247 - DNA, 20 bp, Artificial Sequence
  Description of Artificial Sequence: Synthetic oligonucleotide
  Target: ATXN1; (+) strand; PAM type: NRG; PAM sequence: GAG
ggaaggtcttgaggtgggtt

SEQ ID NO: 97248 - DNA, 20 bp, Artificial Sequence
  Description of Artificial Sequence: Synthetic oligonucleotide
  Target: ATXN1; (+) strand; PAM type: NRG; PAM sequence: AGG
gaaggtcttgaggtgggttg

SEQ ID NO: 97249 - DNA, 20 bp, Artificial Sequence
  Description of Artificial Sequence: Synthetic oligonucleotide
  Target: ATXN1; (+) strand; PAM type: NRG; PAM sequence: TGG
ggtcttgaggtgggttgagg

SEQ ID NO: 97250 - DNA, 20 bp, Artificial Sequence
  Description of Artificial Sequence: Synthetic oligonucleotide
  Target: ATXN1; (+) strand; PAM type: NRG; PAM sequence: GGG
gtcttgaggtgggttgaggt

SEQ ID NO: 97251 - DNA, 20 bp, Artificial Sequence
  Description of Artificial Sequence: Synthetic oligonucleotide
  Target: ATXN1; (+) strand; PAM type: NRG; PAM sequence: GAG
gaggtgggttgaggtgggtt

SEQ ID NO: 97252 - DNA, 20 bp, Artificial Sequence
  Description of Artificial Sequence: Synthetic oligonucleotide
  Target: ATXN1; (+) strand; PAM type: NRG; PAM sequence: AGG
aggtgggttgaggtgggttg

SEQ ID NO: 97253 - DNA, 20 bp, Artificial Sequence
  Description of Artificial Sequence: Synthetic oligonucleotide
  Target: ATXN1; (+) strand; PAM type: NRG; PAM sequence: TGG
tgggttgaggtgggttgagg

SEQ ID NO: 97254 - DNA, 20 bp, Artificial Sequence
  Description of Artificial Sequence: Synthetic oligonucleotide
  Target: ATXN1; (+) strand; PAM type: NRG; PAM sequence: GGG
gggttgaggtgggttgaggt

SEQ ID NO: 97255 - DNA, 20 bp, Artificial Sequence
  Description of Artificial Sequence: Synthetic oligonucleotide
  Target: ATXN1; (+) strand; PAM type: NRG; PAM sequence: CAG
gaggtgggttgaggtgggtg

SEQ ID NO: 97256 - DNA, 20 bp, Artificial Sequence
  Description of Artificial Sequence: Synthetic oligonucleotide
  Target: ATXN1; (+) strand; PAM type: NRG; PAM sequence: AGG
aggtgggttgaggtgggtgc

SEQ ID NO: 97257 - DNA, 20 bp, Artificial Sequence
  Description of Artificial Sequence: Synthetic oligonucleotide
  Target: ATXN1; (+) strand; PAM type: NRG; PAM sequence: GGG
ggtgggttgaggtgggtgca

SEQ ID NO: 97258 - DNA, 20 bp, Artificial Sequence
  Description of Artificial Sequence: Synthetic oligonucleotide
  Target: ATXN1; (+) strand; PAM type: NRG; PAM sequence: GGG
gtgggttgaggtgggtgcag

SEQ ID NO: 97259 - DNA, 20 bp, Artificial Sequence
  Description of Artificial Sequence: Synthetic oligonucleotide
  Target: ATXN1; (+) strand; PAM type: NRG; PAM sequence: TGG
tgggtgcaggggattccacc

SEQ ID NO: 97260 - DNA, 20 bp, Artificial Sequence
  Description of Artificial Sequence: Synthetic oligonucleotide
  Target: ATXN1; (+) strand; PAM type: NRG; PAM sequence: AAG
gtgcaggggattccacctgg

SEQ ID NO: 97261 - DNA, 20 bp, Artificial Sequence
  Description of Artificial Sequence: Synthetic oligonucleotide
  Target: ATXN1; (+) strand; PAM type: NRG; PAM sequence: TGG
gggattccacctggaagcta

SEQ ID NO: 97262 - DNA, 20 bp, Artificial Sequence
  Description of Artificial Sequence: Synthetic oligonucleotide
  Target: ATXN1; (+) strand; PAM type: NRG; PAM sequence: GGG
ggattccacctggaagctat

SEQ ID NO: 97263 - DNA, 20 bp, Artificial Sequence
  Description of Artificial Sequence: Synthetic oligonucleotide
  Target: ATXN1; (+) strand; PAM type: NRG; PAM sequence: GAG
cctggaagctatgggttctt

SEQ ID NO: 97264 - DNA, 20 bp, Artificial Sequence
  Description of Artificial Sequence: Synthetic oligonucleotide
  Target: ATXN1; (+) strand; PAM type: NRG; PAM sequence: AGG
ctggaagctatgggttcttg

SEQ ID NO: 97265 - DNA, 20 bp, Artificial Sequence
  Description of Artificial Sequence: Synthetic oligonucleotide
  Target: ATXN1; (+) strand; PAM type: NRG; PAM sequence: TGG
tcttgaggaattactttttc

SEQ ID NO: 97266 - DNA, 20 bp, Artificial Sequence
  Description of Artificial Sequence: Synthetic oligonucleotide
  Target: ATXN1; (+) strand; PAM type: NRG; PAM sequence: AAG
ctttttctggcacaactgct

SEQ ID NO: 97267 - DNA, 20 bp, Artificial Sequence
  Description of Artificial Sequence: Synthetic oligonucleotide
  Target: ATXN1; (+) strand; PAM type: NRG; PAM sequence: AAG
ctgctaagccatatctttcc

SEQ ID NO: 97268 - DNA, 20 bp, Artificial Sequence
  Description of Artificial Sequence: Synthetic oligonucleotide
  Target: ATXN1; (+) strand; PAM type: NRG; PAM sequence: TGG
aagccatatctttccaagac

SEQ ID NO: 97269 - DNA, 20 bp, Artificial Sequence
  Description of Artificial Sequence: Synthetic oligonucleotide
  Target: ATXN1; (+) strand; PAM type: NRG; PAM sequence: GGG
agccatatctttccaagact

SEQ ID NO: 97270 - DNA, 20 bp, Artificial Sequence
  Description of Artificial Sequence: Synthetic oligonucleotide
  Target: ATXN1; (+) strand; PAM type: NRG; PAM sequence: CAG
tatctttccaagactgggcc

SEQ ID NO: 97271 - DNA, 20 bp, Artificial Sequence
  Description of Artificial Sequence: Synthetic oligonucleotide
  Target: ATXN1; (+) strand; PAM type: NRG; PAM sequence: AAG
ccaagactgggcccagtgca

SEQ ID NO: 97272 - DNA, 20 bp, Artificial Sequence
  Description of Artificial Sequence: Synthetic oligonucleotide
  Target: ATXN1; (+) strand; PAM type: NRG; PAM sequence: TGG
cccagtgcaaagctgtaatg

SEQ ID NO: 97273 - DNA, 20 bp, Artificial Sequence
  Description of Artificial Sequence: Synthetic oligonucleotide
  Target: ATXN1; (+) strand; PAM type: NRG; PAM sequence: GAG
agctgtaatgtggtactctt

SEQ ID NO: 97274 - DNA, 20 bp, Artificial Sequence
  Description of Artificial Sequence: Synthetic oligonucleotide
  Target: ATXN1; (+) strand; PAM type: NRG; PAM sequence: AGG
gctgtaatgtggtactcttg

SEQ ID NO: 97275 - DNA, 20 bp, Artificial Sequence
  Description of Artificial Sequence: Synthetic oligonucleotide
  Target: ATXN1; (+) strand; PAM type: NRG; PAM sequence: CGG
tgtggtactcttgaggtaaa

SEQ ID NO: 97276 - DNA, 20 bp, Artificial Sequence
  Description of Artificial Sequence: Synthetic oligonucleotide
  Target: ATXN1; (+) strand; PAM type: NRG; PAM sequence: GGG
gtggtactcttgaggtaaac

SEQ ID NO: 97277 - DNA, 20 bp, Artificial Sequence
  Description of Artificial Sequence: Synthetic oligonucleotide
  Target: ATXN1; (+) strand; PAM type: NRG; PAM sequence: GGG
tggtactcttgaggtaaacg

SEQ ID NO: 97278 - DNA, 20 bp, Artificial Sequence
  Description of Artificial Sequence: Synthetic oligonucleotide
  Target: ATXN1; (+) strand; PAM type: NRG; PAM sequence: GAG
gtactcttgaggtaaacggg

SEQ ID NO: 97279 - DNA, 20 bp, Artificial Sequence
  Description of Artificial Sequence: Synthetic oligonucleotide
  Target: ATXN1; (+) strand; PAM type: NRG; PAM sequence: GAG
ggggagttcctccacatgct

SEQ ID NO: 97280 - DNA, 20 bp, Artificial Sequence
  Description of Artificial Sequence: Synthetic oligonucleotide
  Target: ATXN1; (+) strand; PAM type: NRG; PAM sequence: GAG
ggagttcctccacatgctga

SEQ ID NO: 97281 - DNA, 20 bp, Artificial Sequence
  Description of Artificial Sequence: Synthetic oligonucleotide
  Target: ATXN1; (+) strand; PAM type: NRG; PAM sequence: GAG
acatgctgagagacctgctc

SEQ ID NO: 97282 - DNA, 20 bp, Artificial Sequence
  Description of Artificial Sequence: Synthetic oligonucleotide
  Target: ATXN1; (+) strand; PAM type: NRG; PAM sequence: AGG
catgctgagagacctgctcg

SEQ ID NO: 97283 - DNA, 20 bp, Artificial Sequence
  Description of Artificial Sequence: Synthetic oligonucleotide
  Target: ATXN1; (+) strand; PAM type: NRG; PAM sequence: GAG
tgctgagagacctgctcgag

SEQ ID NO: 97284 - DNA, 20 bp, Artificial Sequence
  Description of Artificial Sequence: Synthetic oligonucleotide
  Target: ATXN1; (+) strand; PAM type: NRG; PAM sequence: TGG
gagagacctgctcgaggagt

SEQ ID NO: 97285 - DNA, 20 bp, Artificial Sequence
  Description of Artificial Sequence: Synthetic oligonucleotide
  Target: ATXN1; (+) strand; PAM type: NRG; PAM sequence: GGG
agagacctgctcgaggagtt

SEQ ID NO: 97286 - DNA, 20 bp, Artificial Sequence
  Description of Artificial Sequence: Synthetic oligonucleotide
  Target: ATXN1; (+) strand; PAM type: NRG; PAM sequence: GAG
tgggttttttttttgttttt

SEQ ID NO: 97287 - DNA, 20 bp, Artificial Sequence
  Description of Artificial Sequence: Synthetic oligonucleotide
  Target: ATXN1; (+) strand; PAM type: NRG; PAM sequence: AGG
gggttttttttttgtttttg

SEQ ID NO: 97288 - DNA, 20 bp, Artificial Sequence
  Description of Artificial Sequence: Synthetic oligonucleotide
  Target: ATXN1; (+) strand; PAM type: NRG; PAM sequence: CAG
ttttttttttgtttttgagg

SEQ ID NO: 97289 - DNA, 20 bp, Artificial Sequence
  Description of Artificial Sequence: Synthetic oligonucleotide
  Target: ATXN1; (+) strand; PAM type: NRG; PAM sequence: GAG
ttttttttgtttttgaggca

SEQ ID NO: 97290 - DNA, 20 bp, Artificial Sequence
  Description of Artificial Sequence: Synthetic oligonucleotide
  Target: ATXN1; (+) strand; PAM type: NRG; PAM sequence: CAG
cagagttttgctctgtcgcc

SEQ ID NO: 97291 - DNA, 20 bp, Artificial Sequence
  Description of Artificial Sequence: Synthetic oligonucleotide
  Target: ATXN1; (+) strand; PAM type: NRG; PAM sequence: AGG
agagttttgctctgtcgccc

SEQ ID NO: 97292 - DNA, 20 bp, Artificial Sequence
  Description of Artificial Sequence: Synthetic oligonucleotide
  Target: ATXN1; (+) strand; PAM type: NRG; PAM sequence: TGG
ttttgctctgtcgcccaggc

SEQ ID NO: 97293 - DNA, 20 bp, Artificial Sequence
  Description of Artificial Sequence: Synthetic oligonucleotide
  Target: ATXN1; (+) strand; PAM type: NRG; PAM sequence: GAG
ttgctctgtcgcccaggctg

SEQ ID NO: 97294 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 97295 - DNA, 20 bp, Artificial Sequence
  Description of Artificial Sequence: Synthetic oligonucleotide
  Target: ATXN1; (+) strand; PAM type: NRG; PAM sequence: CGG
tcgcccaggctggagtgcag

SEQ ID NO: 97296 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagcggtatgatta

SEQ ID NO: 97297 - DNA, 20 bp, Artificial Sequence
  Description of Artificial Sequence: Synthetic oligonucleotide
  Target: ATXN1; (+) strand; PAM type: NRG; PAM sequence: CAG
ggtatgattatggctcactg

SEQ ID NO: 97298 - DNA, 20 bp, Artificial Sequence
  Description of Artificial Sequence: Synthetic oligonucleotide
  Target: ATXN1; (+) strand; PAM type: NRG; PAM sequence: TGG
tcactgcagcctcgacctcc

SEQ ID NO: 97299 - DNA, 20 bp, Artificial Sequence
  Description of Artificial Sequence: Synthetic oligonucleotide
  Target: ATXN1; (+) strand; PAM type: NRG; PAM sequence: CAG
cagcctcgacctcctggccc

SEQ ID NO: 97300 - DNA, 20 bp, Artificial Sequence
  Description of Artificial Sequence: Synthetic oligonucleotide
  Target: ATXN1; (+) strand; PAM type: NRG; PAM sequence: AGG
agcctcgacctcctggcccc

SEQ ID NO: 97301 - DNA, 20 bp, Artificial Sequence
  Description of Artificial Sequence: Synthetic oligonucleotide
  Target: ATXN1; (+) strand; PAM type: NRG; PAM sequence: CAG
cccaggcgatcctcccacct

SEQ ID NO: 97302 - DNA, 20 bp, Artificial Sequence
  Description of Artificial Sequence: Synthetic oligonucleotide
  Target: ATXN1; (+) strand; PAM type: NRG; PAM sequence: AAG
tcctcccacctcagtcccct

SEQ ID NO: 97303 - DNA, 20 bp, Artificial Sequence
  Description of Artificial Sequence: Synthetic oligonucleotide
  Target: ATXN1; (+) strand; PAM type: NRG; PAM sequence: TAG
tcccacctcagtcccctaag

SEQ ID NO: 97304 - DNA, 20 bp, Artificial Sequence
  Description of Artificial Sequence: Synthetic oligonucleotide
  Target: ATXN1; (+) strand; PAM type: NRG; PAM sequence: TGG
acctcagtcccctaagtagc

SEQ ID NO: 97305 - DNA, 20 bp, Artificial Sequence
  Description of Artificial Sequence: Synthetic oligonucleotide
  Target: ATXN1; (+) strand; PAM type: NRG; PAM sequence: GGG
cctcagtcccctaagtagct

SEQ ID NO: 97306 - DNA, 20 bp, Artificial Sequence
  Description of Artificial Sequence: Synthetic oligonucleotide
  Target: ATXN1; (+) strand; PAM type: NRG; PAM sequence: TAG
cccctaagtagctgggacca

SEQ ID NO: 97307 - DNA, 20 bp, Artificial Sequence
  Description of Artificial Sequence: Synthetic oligonucleotide
  Target: ATXN1; (+) strand; PAM type: NRG; PAM sequence: AGG
ccctaagtagctgggaccat

SEQ ID NO: 97308 - DNA, 20 bp, Artificial Sequence
  Description of Artificial Sequence: Synthetic oligonucleotide
  Target: ATXN1; (+) strand; PAM type: NRG; PAM sequence: CGG
taggtatgtgccaccacacc

SEQ ID NO: 97309 - DNA, 20 bp, Artificial Sequence
  Description of Artificial Sequence: Synthetic oligonucleotide
  Target: ATXN1; (+) strand; PAM type: NRG; PAM sequence: TAG
ccggctaatttcattttttg

SEQ ID NO: 97310 - DNA, 20 bp, Artificial Sequence
  Description of Artificial Sequence: Synthetic oligonucleotide
  Target: ATXN1; (+) strand; PAM type: NRG; PAM sequence: GAG
ggctaatttcattttttgta

SEQ ID NO: 97311 - DNA, 20 bp, Artificial Sequence
  Description of Artificial Sequence: Synthetic oligonucleotide
  Target: ATXN1; (+) strand; PAM type: NRG; PAM sequence: GAG
atttcattttttgtagagat

SEQ ID NO: 97312 - DNA, 20 bp, Artificial Sequence
  Description of Artificial Sequence: Synthetic oligonucleotide
  Target: ATXN1; (+) strand; PAM type: NRG; PAM sequence: AGG
tttcattttttgtagagatg

SEQ ID NO: 97313 - DNA, 20 bp, Artificial Sequence
  Description of Artificial Sequence: Synthetic oligonucleotide
  Target: ATXN1; (+) strand; PAM type: NRG; PAM sequence: TAG
tgaggtcttactatgttgac

SEQ ID NO: 97314 - DNA, 20 bp, Artificial Sequence
  Description of Artificial Sequence: Synthetic oligonucleotide
  Target: ATXN1; (+) strand; PAM type: NRG; PAM sequence: AGG
gaggtcttactatgttgact

SEQ ID NO: 97315 - DNA, 20 bp, Artificial Sequence
  Description of Artificial Sequence: Synthetic oligonucleotide
  Target: ATXN1; (+) strand; PAM type: NRG; PAM sequence: TGG
tcttactatgttgactaggc

SEQ ID NO: 97316 - DNA, 20 bp, Artificial Sequence
  Description of Artificial Sequence: Synthetic oligonucleotide
  Target: ATXN1; (+) strand; PAM type: NRG; PAM sequence: TGG
ctaggctggtctcgaactcc

SEQ ID NO: 97317 - DNA, 20 bp, Artificial Sequence
  Description of Artificial Sequence: Synthetic oligonucleotide
  Target: ATXN1; (+) strand; PAM type: NRG; PAM sequence: GGG
taggctggtctcgaactcct

SEQ ID NO: 97318 - DNA, 20 bp, Artificial Sequence
  Description of Artificial Sequence: Synthetic oligonucleotide
  Target: ATXN1; (+) strand; PAM type: NRG; PAM sequence: AAG
ggtctcgaactcctgggctc

SEQ ID NO: 97319 - DNA, 20 bp, Artificial Sequence
  Description of Artificial Sequence: Synthetic oligonucleotide
  Target: ATXN1; (+) strand; PAM type: NRG; PAM sequence: CAG
ctcgaactcctgggctcaag

SEQ ID NO: 97320 - DNA, 20 bp, Artificial Sequence
  Description of Artificial Sequence: Synthetic oligonucleotide
  Target: ATXN1; (+) strand; PAM type: NRG; PAM sequence: AGG
tcgaactcctgggctcaagc

SEQ ID NO: 97321 - DNA, 20 bp, Artificial Sequence
  Description of Artificial Sequence: Synthetic oligonucleotide
  Target: ATXN1; (+) strand; PAM type: NRG; PAM sequence: CGG
ctcaagcaggccttgtgcct

SEQ ID NO: 97322 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctccccaactgt

SEQ ID NO: 97323 - DNA, 20 bp, Artificial Sequence
  Description of Artificial Sequence: Synthetic oligonucleotide
  Target: ATXN1; (+) strand; PAM type: NRG; PAM sequence: GGG
cctcggcctccccaactgtt

SEQ ID NO: 97324 - DNA, 20 bp, Artificial Sequence
  Description of Artificial Sequence: Synthetic oligonucleotide
  Target: ATXN1; (+) strand; PAM type: NRG; PAM sequence: TGG
ctccccaactgttgggatta

SEQ ID NO: 97325 - DNA, 20 bp, Artificial Sequence
  Description of Artificial Sequence: Synthetic oligonucleotide
  Target: ATXN1; (+) strand; PAM type: NRG; PAM sequence: GGG
tccccaactgttgggattat

SEQ ID NO: 97326 - DNA, 20 bp, Artificial Sequence
  Description of Artificial Sequence: Synthetic oligonucleotide
  Target: ATXN1; (+) strand; PAM type: NRG; PAM sequence: GAG
actgttgggattatgggcgt

SEQ ID NO: 97327 - DNA, 20 bp, Artificial Sequence
  Description of Artificial Sequence: Synthetic oligonucleotide
  Target: ATXN1; (+) strand; PAM type: NRG; PAM sequence: CGG
tgggcgtgagccactgtgcc

SEQ ID NO: 97328 - DNA, 20 bp, Artificial Sequence
  Description of Artificial Sequence: Synthetic oligonucleotide
  Target: ATXN1; (+) strand; PAM type: NRG; PAM sequence: GAG
ctgctcgctgaatttctaat

SEQ ID NO: 97329 - DNA, 20 bp, Artificial Sequence
  Description of Artificial Sequence: Synthetic oligonucleotide
  Target: ATXN1; (+) strand; PAM type: NRG; PAM sequence: CAG
tttctaatgagcttgaatta

SEQ ID NO: 97330 - DNA, 20 bp, Artificial Sequence
  Description of Artificial Sequence: Synthetic oligonucleotide
  Target: ATXN1; (+) strand; PAM type: NRG; PAM sequence: AGG
ttctaatgagcttgaattac

SEQ ID NO: 97331 - DNA, 20 bp, Artificial Sequence
  Description of Artificial Sequence: Synthetic oligonucleotide
  Target: ATXN1; (+) strand; PAM type: NRG; PAM sequence: AAG
taatgagcttgaattacagg

SEQ ID NO: 97332 - DNA, 20 bp, Artificial Sequence
  Description of Artificial Sequence: Synthetic oligonucleotide
  Target: ATXN1; (+) strand; PAM type: NRG; PAM sequence: CAG
aaaaataaattttccactta

SEQ ID NO: 97333 - DNA, 20 bp, Artificial Sequence
  Description of Artificial Sequence: Synthetic oligonucleotide
  Target: ATXN1; (+) strand; PAM type: NRG; PAM sequence: CAG
tccacttacagaccactaac

SEQ ID NO: 97334 - DNA, 20 bp, Artificial Sequence
  Description of Artificial Sequence: Synthetic oligonucleotide
  Target: ATXN1; (+) strand; PAM type: NRG; PAM sequence: TAG
ttacagaccactaaccagtt

SEQ ID NO: 97335 - DNA, 20 bp, Artificial Sequence
  Description of Artificial Sequence: Synthetic oligonucleotide
  Target: ATXN1; (+) strand; PAM type: NRG; PAM sequence: GAG
acagaccactaaccagttta

SEQ ID NO: 97336 - DNA, 20 bp, Artificial Sequence
  Description of Artificial Sequence: Synthetic oligonucleotide
  Target: ATXN1; (+) strand; PAM type: NRG; PAM sequence: AAG
ccagtttagagcaaatctgt

SEQ ID NO: 97337 - DNA, 20 bp, Artificial Sequence
  Description of Artificial Sequence: Synthetic oligonucleotide
  Target: ATXN1; (+) strand; PAM type: NRG; PAM sequence: AGG
cagtttagagcaaatctgta

SEQ ID NO: 97338 - DNA, 20 bp, Artificial Sequence
  Description of Artificial Sequence: Synthetic oligonucleotide
  Target: ATXN1; (+) strand; PAM type: NRG; PAM sequence: GAG
gtttagagcaaatctgtaag

SEQ ID NO: 97339 - DNA, 20 bp, Artificial Sequence
  Description of Artificial Sequence: Synthetic oligonucleotide
  Target: ATXN1; (+) strand; PAM type: NRG; PAM sequence: TAG
gcaaatctgtaaggagtgta

SEQ ID NO: 97340 - DNA, 20 bp, Artificial Sequence
  Description of Artificial Sequence: Synthetic oligonucleotide
  Target: ATXN1; (+) strand; PAM type: NRG; PAM sequence: GAG
gtgtatagattatgccacac

SEQ ID NO: 97341 - DNA, 20 bp, Artificial Sequence
  Description of Artificial Sequence: Synthetic oligonucleotide
  Target: ATXN1; (+) strand; PAM type: NRG; PAM sequence: AAG
ttatgccacacgagcgcatg

SEQ ID NO: 97342 - DNA, 20 bp, Artificial Sequence
  Description of Artificial Sequence: Synthetic oligonucleotide
  Target: ATXN1; (+) strand; PAM type: NRG; PAM sequence: AAG
atgaagctaccacatgttta

SEQ ID NO: 97343 - DNA, 20 bp, Artificial Sequence
  Description of Artificial Sequence: Synthetic oligonucleotide
  Target: ATXN1; (+) strand; PAM type: NRG; PAM sequence: AAG
gctaccacatgtttaaagac

SEQ ID NO: 97344 - DNA, 20 bp, Artificial Sequence
  Description of Artificial Sequence: Synthetic oligonucleotide
  Target: ATXN1; (+) strand; PAM type: NRG; PAM sequence: CAG
acaagtatacctcttgtgaa

SEQ ID NO: 97345 - DNA, 20 bp, Artificial Sequence
  Description of Artificial Sequence: Synthetic oligonucleotide
  Target: ATXN1; (+) strand; PAM type: NRG; PAM sequence: CAG
agtatacctcttgtgaacag

SEQ ID NO: 97346 - DNA, 20 bp, Artificial Sequence
  Description of Artificial Sequence: Synthetic oligonucleotide
  Target: ATXN1; (+) strand; PAM type: NRG; PAM sequence: CAG
ctcttgtgaacagcagtgtt

SEQ ID NO: 97347 - DNA, 20 bp, Artificial Sequence
  Description of Artificial Sequence: Synthetic oligonucleotide
  Target: ATXN1; (+) strand; PAM type: NRG; PAM sequence: TAG
tgtgaacagcagtgttcagc

SEQ ID NO: 97348 - DNA, 20 bp, Artificial Sequence
  Description of Artificial Sequence: Synthetic oligonucleotide
  Target: ATXN1; (+) strand; PAM type: NRG; PAM sequence: AGG
gtgaacagcagtgttcagct

SEQ ID NO: 97349 - DNA, 20 bp, Artificial Sequence
  Description of Artificial Sequence: Synthetic oligonucleotide
  Target: ATXN1; (+) strand; PAM type: NRG; PAM sequence: GAG
gaacagcagtgttcagctag

SEQ ID NO: 97350 - DNA, 20 bp, Artificial Sequence
  Description of Artificial Sequence: Synthetic oligonucleotide
  Target: ATXN1; (+) strand; PAM type: NRG; PAM sequence: AGG
aacagcagtgttcagctagg

SEQ ID NO: 97351 - DNA, 20 bp, Artificial Sequence
  Description of Artificial Sequence: Synthetic oligonucleotide
  Target: ATXN1; (+) strand; PAM type: NRG; PAM sequence: AAG
ggaggcataaacatgaactg

SEQ ID NO: 97352 - DNA, 20 bp, Artificial Sequence
  Description of Artificial Sequence: Synthetic oligonucleotide
  Target: ATXN1; (+) strand; PAM type: NRG; PAM sequence: AAG
aaacatgaactgaagaaacc

SEQ ID NO: 97353 - DNA, 20 bp, Artificial Sequence
  Description of Artificial Sequence: Synthetic oligonucleotide
  Target: ATXN1; (+) strand; PAM type: NRG; PAM sequence: CAG
aactgaagaaaccaagacat

SEQ ID NO: 97354 - DNA, 20 bp, Artificial Sequence
  Description of Artificial Sequence: Synthetic oligonucleotide
  Target: ATXN1; (+) strand; PAM type: NRG; PAM sequence: AGG
actgaagaaaccaagacatc

SEQ ID NO: 97355 - DNA, 20 bp, Artificial Sequence
  Description of Artificial Sequence: Synthetic oligonucleotide
  Target: ATXN1; (+) strand; PAM type: NRG; PAM sequence: TGG
agaaaccaagacatcaggtg

SEQ ID NO: 97356 - DNA, 20 bp, Artificial Sequence
  Description of Artificial Sequence: Synthetic oligonucleotide
  Target: ATXN1; (+) strand; PAM type: NRG; PAM sequence: TAG
tggctgtgtgccttttatct

SEQ ID NO: 97357 - DNA, 20 bp, Artificial Sequence
  Description of Artificial Sequence: Synthetic oligonucleotide
  Target: ATXN1; (+) strand; PAM type: NRG; PAM sequence: TAG
tactcttccccccaaaacat

SEQ ID NO: 97358 - DNA, 20 bp, Artificial Sequence
  Description of Artificial Sequence: Synthetic oligonucleotide
  Target: ATXN1; (+) strand; PAM type: NRG; PAM sequence: CAG
tcttccccccaaaacattag

SEQ ID NO: 97359 - DNA, 20 bp, Artificial Sequence
  Description of Artificial Sequence: Synthetic oligonucleotide
  Target: ATXN1; (+) strand; PAM type: NRG; PAM sequence: AAG
cccccaaaacattagcagcg

SEQ ID NO: 97360 - DNA, 20 bp, Artificial Sequence
  Description of Artificial Sequence: Synthetic oligonucleotide
  Target: ATXN1; (+) strand; PAM type: NRG; PAM sequence: AGG
ccccaaaacattagcagcga

SEQ ID NO: 97361 - DNA, 20 bp, Artificial Sequence
  Description of Artificial Sequence: Synthetic oligonucleotide
  Target: ATXN1; (+) strand; PAM type: NRG; PAM sequence: CAG
ctccctacctccgacctacc

SEQ ID NO: 97362 - DNA, 20 bp, Artificial Sequence
  Description of Artificial Sequence: Synthetic oligonucleotide
  Target: ATXN1; (+) strand; PAM type: NRG; PAM sequence: AGG
tccctacctccgacctaccc

SEQ ID NO: 97363 - DNA, 20 bp, Artificial Sequence
  Description of Artificial Sequence: Synthetic oligonucleotide
  Target: ATXN1; (+) strand; PAM type: NRG; PAM sequence: GGG
ccctacctccgacctaccca

SEQ ID NO: 97364 - DNA, 20 bp, Artificial Sequence
  Description of Artificial Sequence: Synthetic oligonucleotide
  Target: ATXN1; (+) strand; PAM type: NRG; PAM sequence: GAG
ctacctccgacctacccagg

SEQ ID NO: 97365 - DNA, 20 bp, Artificial Sequence
  Description of Artificial Sequence: Synthetic oligonucleotide
  Target: ATXN1; (+) strand; PAM type: NRG; PAM sequence: GAG
cctacccagggagaactcgt

SEQ ID NO: 97366 - DNA, 20 bp, Artificial Sequence
  Description of Artificial Sequence: Synthetic oligonucleotide
  Target: ATXN1; (+) strand; PAM type: NRG; PAM sequence: CGG
acccagggagaactcgtgag

SEQ ID NO: 97367 - DNA, 20 bp, Artificial Sequence
  Description of Artificial Sequence: Synthetic oligonucleotide
  Target: ATXN1; (+) strand; PAM type: NRG; PAM sequence: GGG
cccagggagaactcgtgagc

SEQ ID NO: 97368 - DNA, 20 bp, Artificial Sequence
  Description of Artificial Sequence: Synthetic oligonucleotide
  Target: ATXN1; (+) strand; PAM type: NRG; PAM sequence: GGG
ccagggagaactcgtgagcg

SEQ ID NO: 97369 - DNA, 20 bp, Artificial Sequence
  Description of Artificial Sequence: Synthetic oligonucleotide
  Target: ATXN1; (+) strand; PAM type: NRG; PAM sequence: GGG
cagggagaactcgtgagcgg

SEQ ID NO: 97370 - DNA, 20 bp, Artificial Sequence
  Description of Artificial Sequence: Synthetic oligonucleotide
  Target: ATXN1; (+) strand; PAM type: NRG; PAM sequence: AAG
actcgtgagcgggggtcaat

SEQ ID NO: 97371 - DNA, 20 bp, Artificial Sequence
  Description of Artificial Sequence: Synthetic oligonucleotide
  Target: ATXN1; (+) strand; PAM type: NRG; PAM sequence: AGG
ctcgtgagcgggggtcaata

SEQ ID NO: 97372 - DNA, 20 bp, Artificial Sequence
  Description of Artificial Sequence: Synthetic oligonucleotide
  Target: ATXN1; (+) strand; PAM type: NRG; PAM sequence: GAG
cgtgagcgggggtcaataag

SEQ ID NO: 97373 - DNA, 20 bp, Artificial Sequence
  Description of Artificial Sequence: Synthetic oligonucleotide
  Target: ATXN1; (+) strand; PAM type: NRG; PAM sequence: AGG
gtgagcgggggtcaataagg

SEQ ID NO: 97374 - DNA, 20 bp, Artificial Sequence
  Description of Artificial Sequence: Synthetic oligonucleotide
  Target: ATXN1; (+) strand; PAM type: NRG; PAM sequence: GAG
gagcgggggtcaataaggag

SEQ ID NO: 97375 - DNA, 20 bp, Artificial Sequence
  Description of Artificial Sequence: Synthetic oligonucleotide
  Target: ATXN1; (+) strand; PAM type: NRG; PAM sequence: AGG
agcgggggtcaataaggagg

SEQ ID NO: 97376 - DNA, 20 bp, Artificial Sequence
  Description of Artificial Sequence: Synthetic oligonucleotide
  Target: ATXN1; (+) strand; PAM type: NRG; PAM sequence: TAG
ggtcaataaggaggaggaat

SEQ ID NO: 97377 - DNA, 20 bp, Artificial Sequence
  Description of Artificial Sequence: Synthetic oligonucleotide
  Target: ATXN1; (+) strand; PAM type: NRG; PAM sequence: TGG
aggaattagcactcttttcc

SEQ ID NO: 97378 - DNA, 20 bp, Artificial Sequence
  Description of Artificial Sequence: Synthetic oligonucleotide
  Target: ATXN1; (+) strand; PAM type: NRG; PAM sequence: GAG
cttttcctggcctcttcctt

SEQ ID NO: 97379 - DNA, 20 bp, Artificial Sequence
  Description of Artificial Sequence: Synthetic oligonucleotide
  Target: ATXN1; (+) strand; PAM type: NRG; PAM sequence: AGG
ttttcctggcctcttccttg

SEQ ID NO: 97380 - DNA, 20 bp, Artificial Sequence
  Description of Artificial Sequence: Synthetic oligonucleotide
  Target: ATXN1; (+) strand; PAM type: NRG; PAM sequence: CAG
cctcttccttgaggacccaa

SEQ ID NO: 97381 - DNA, 20 bp, Artificial Sequence
  Description of Artificial Sequence: Synthetic oligonucleotide
  Target: ATXN1; (+) strand; PAM type: NRG; PAM sequence: AAG
cttccttgaggacccaacag

SEQ ID NO: 97382 - DNA, 20 bp, Artificial Sequence
  Description of Artificial Sequence: Synthetic oligonucleotide
  Target: ATXN1; (+) strand; PAM type: NRG; PAM sequence: AGG
ttccttgaggacccaacaga

SEQ ID NO: 97383 - DNA, 20 bp, Artificial Sequence
  Description of Artificial Sequence: Synthetic oligonucleotide
  Target: ATXN1; (+) strand; PAM type: NRG; PAM sequence: AAG
tgaggacccaacagaaggca

SEQ ID NO: 97384 - DNA, 20 bp, Artificial Sequence
  Description of Artificial Sequence: Synthetic oligonucleotide
  Target: ATXN1; (+) strand; PAM type: NRG; PAM sequence: TGG
caaagacacacatctgcaat

SEQ ID NO: 97385 - DNA, 20 bp, Artificial Sequence
  Description of Artificial Sequence: Synthetic oligonucleotide
  Target: ATXN1; (+) strand; PAM type: NRG; PAM sequence: TAG
aattggcactgttattttat

SEQ ID NO: 97386 - DNA, 20 bp, Artificial Sequence
  Description of Artificial Sequence: Synthetic oligonucleotide
  Target: ATXN1; (+) strand; PAM type: NRG; PAM sequence: GAG
cactgttattttattagtac

SEQ ID NO: 97387 - DNA, 20 bp, Artificial Sequence
  Description of Artificial Sequence: Synthetic oligonucleotide
  Target: ATXN1; (+) strand; PAM type: NRG; PAM sequence: TGG
ctgaaacaataaacttgtac

SEQ ID NO: 97388 - DNA, 20 bp, Artificial Sequence
  Description of Artificial Sequence: Synthetic oligonucleotide
  Target: ATXN1; (+) strand; PAM type: NRG; PAM sequence: CAG
aataaacttgtactggtata

SEQ ID NO: 97389 - DNA, 20 bp, Artificial Sequence
  Description of Artificial Sequence: Synthetic oligonucleotide
  Target: ATXN1; (+) strand; PAM type: NRG; PAM sequence: TAG
ataatgaaataatttctacc

SEQ ID NO: 97390 - DNA, 20 bp, Artificial Sequence
  Description of Artificial Sequence: Synthetic oligonucleotide
  Target: ATXN1; (+) strand; PAM type: NRG; PAM sequence: AAG
tttctacctagaaaacctgc

SEQ ID NO: 97391 - DNA, 20 bp, Artificial Sequence
  Description of Artificial Sequence: Synthetic oligonucleotide
  Target: ATXN1; (+) strand; PAM type: NRG; PAM sequence: AAG
aaaacctgcaagcaccatca

SEQ ID NO: 97392 - DNA, 20 bp, Artificial Sequence
  Description of Artificial Sequence: Synthetic oligonucleotide
  Target: ATXN1; (+) strand; PAM type: NRG; PAM sequence: AAG
cctgcaagcaccatcaaaga

SEQ ID NO: 97393 - DNA, 20 bp, Artificial Sequence
  Description of Artificial Sequence: Synthetic oligonucleotide
  Target: ATXN1; (+) strand; PAM type: NRG; PAM sequence: AGG
ctgcaagcaccatcaaagaa

SEQ ID NO: 97394 - DNA, 20 bp, Artificial Sequence
  Description of Artificial Sequence: Synthetic oligonucleotide
  Target: ATXN1; (+) strand; PAM type: NRG; PAM sequence: GGG
tgcaagcaccatcaaagaaa

SEQ ID NO: 97395 - DNA, 20 bp, Artificial Sequence
  Description of Artificial Sequence: Synthetic oligonucleotide
  Target: ATXN1; (+) strand; PAM type: NRG; PAM sequence: CAG
ggaccataaaattcaataaa

SEQ ID NO: 97396 - DNA, 20 bp, Artificial Sequence
  Description of Artificial Sequence: Synthetic oligonucleotide
  Target: ATXN1; (+) strand; PAM type: NRG; PAM sequence: GAG
aaaattcaataaacagactc

SEQ ID NO: 97397 - DNA, 20 bp, Artificial Sequence
  Description of Artificial Sequence: Synthetic oligonucleotide
  Target: ATXN1; (+) strand; PAM type: NRG; PAM sequence: TAG
actcgagtgtatcctacaaa

SEQ ID NO: 97398 - DNA, 20 bp, Artificial Sequence
  Description of Artificial Sequence: Synthetic oligonucleotide
  Target: ATXN1; (+) strand; PAM type: NRG; PAM sequence: TAG
acaaatagacacaccacgat

SEQ ID NO: 97399 - DNA, 20 bp, Artificial Sequence
  Description of Artificial Sequence: Synthetic oligonucleotide
  Target: ATXN1; (+) strand; PAM type: NRG; PAM sequence: TAG
gacacaccacgattagaaaa

SEQ ID NO: 97400 - DNA, 20 bp, Artificial Sequence
  Description of Artificial Sequence: Synthetic oligonucleotide
  Target: ATXN1; (+) strand; PAM type: NRG; PAM sequence: AAG
tttttaatatttgtttaaaa

SEQ ID NO: 97401 - DNA, 20 bp, Artificial Sequence
  Description of Artificial Sequence: Synthetic oligonucleotide
  Target: ATXN1; (+) strand; PAM type: NRG; PAM sequence: TAG
taatatttgtttaaaaaagc

SEQ ID NO: 97402 - DNA, 20 bp, Artificial Sequence
  Description of Artificial Sequence: Synthetic oligonucleotide
  Target: ATXN1; (+) strand; PAM type: NRG; PAM sequence: AAG
ttgtttaaaaaagctagtgc

SEQ ID NO: 97403 - DNA, 20 bp, Artificial Sequence
  Description of Artificial Sequence: Synthetic oligonucleotide
  Target: ATXN1; (+) strand; PAM type: NRG; PAM sequence: TGG
gcaagtacaatattttacac

SEQ ID NO: 97404 - DNA, 20 bp, Artificial Sequence
  Description of Artificial Sequence: Synthetic oligonucleotide
  Target: ATXN1; (+) strand; PAM type: NRG; PAM sequence: CAG
aatattttacactggaatta

SEQ ID NO: 97405 - DNA, 20 bp, Artificial Sequence
  Description of Artificial Sequence: Synthetic oligonucleotide
  Target: ATXN1; (+) strand; PAM type: NRG; PAM sequence: GAG
tattttacactggaattaca

SEQ ID NO: 97406 - DNA, 20 bp, Artificial Sequence
  Description of Artificial Sequence: Synthetic oligonucleotide
  Target: ATXN1; (+) strand; PAM type: NRG; PAM sequence: GAG
ttttacactggaattacaga

SEQ ID NO: 97407 - DNA, 20 bp, Artificial Sequence
  Description of Artificial Sequence: Synthetic oligonucleotide
  Target: ATXN1; (+) strand; PAM type: NRG; PAM sequence: TGG
acagagagtatgcacgcata

SEQ ID NO: 97408 - DNA, 20 bp, Artificial Sequence
  Description of Artificial Sequence: Synthetic oligonucleotide
  Target: ATXN1; (+) strand; PAM type: NRG; PAM sequence: AAG
gtatgcacgcatatggaaaa

SEQ ID NO: 97409 - DNA, 20 bp, Artificial Sequence
  Description of Artificial Sequence: Synthetic oligonucleotide
  Target: ATXN1; (+) strand; PAM type: NRG; PAM sequence: AAG
aagttctcctgtcacaataa

SEQ ID NO: 97410 - DNA, 20 bp, Artificial Sequence
  Description of Artificial Sequence: Synthetic oligonucleotide
  Target: ATXN1; (+) strand; PAM type: NRG; PAM sequence: AAG
cttaaaattttcttttcaat

SEQ ID NO: 97411 - DNA, 20 bp, Artificial Sequence
  Description of Artificial Sequence: Synthetic oligonucleotide
  Target: ATXN1; (+) strand; PAM type: NRG; PAM sequence: AGG
ttaaaattttcttttcaata

SEQ ID NO: 97412 - DNA, 20 bp, Artificial Sequence
  Description of Artificial Sequence: Synthetic oligonucleotide
  Target: ATXN1; (+) strand; PAM type: NRG; PAM sequence: TAG
gcaaaacatcattccttccc

SEQ ID NO: 97413 - DNA, 20 bp, Artificial Sequence
  Description of Artificial Sequence: Synthetic oligonucleotide
  Target: ATXN1; (+) strand; PAM type: NRG; PAM sequence: TGG
tccctagttctcctctgtac

SEQ ID NO: 97414 - DNA, 20 bp, Artificial Sequence
  Description of Artificial Sequence: Synthetic oligonucleotide
  Target: ATXN1; (+) strand; PAM type: NRG; PAM sequence: CAG
ctcctctgtactggccatgt

SEQ ID NO: 97415 - DNA, 20 bp, Artificial Sequence
  Description of Artificial Sequence: Synthetic oligonucleotide
  Target: ATXN1; (+) strand; PAM type: NRG; PAM sequence: TGG
ctgtactggccatgtcagtc

SEQ ID NO: 97416 - DNA, 20 bp, Artificial Sequence
  Description of Artificial Sequence: Synthetic oligonucleotide
  Target: ATXN1; (+) strand; PAM type: NRG; PAM sequence: TAG
tactggccatgtcagtctgg

SEQ ID NO: 97417 - DNA, 20 bp, Artificial Sequence
  Description of Artificial Sequence: Synthetic oligonucleotide
  Target: ATXN1; (+) strand; PAM type: NRG; PAM sequence: AAG
tctggtagtgccctcaaccc

SEQ ID NO: 97418 - DNA, 20 bp, Artificial Sequence
  Description of Artificial Sequence: Synthetic oligonucleotide
  Target: ATXN1; (+) strand; PAM type: NRG; PAM sequence: TGG
agtgccctcaacccaagttc

SEQ ID NO: 97419 - DNA, 20 bp, Artificial Sequence
  Description of Artificial Sequence: Synthetic oligonucleotide
  Target: ATXN1; (+) strand; PAM type: NRG; PAM sequence: TGG
ttctggtgtctgttttccct

SEQ ID NO: 97420 - DNA, 20 bp, Artificial Sequence
  Description of Artificial Sequence: Synthetic oligonucleotide
  Target: ATXN1; (+) strand; PAM type: NRG; PAM sequence: TGG
gtctgttttcccttggcctg

SEQ ID NO: 97421 - DNA, 20 bp, Artificial Sequence
  Description of Artificial Sequence: Synthetic oligonucleotide
  Target: ATXN1; (+) strand; PAM type: NRG; PAM sequence: GGG
tctgttttcccttggcctgt

SEQ ID NO: 97422 - DNA, 20 bp, Artificial Sequence
  Description of Artificial Sequence: Synthetic oligonucleotide
  Target: ATXN1; (+) strand; PAM type: NRG; PAM sequence: GAG
tgttttcccttggcctgtgg

SEQ ID NO: 97423 - DNA, 20 bp, Artificial Sequence
  Description of Artificial Sequence: Synthetic oligonucleotide
  Target: ATXN1; (+) strand; PAM type: NRG; PAM sequence: AGG
gttttcccttggcctgtggg

SEQ ID NO: 97424 - DNA, 20 bp, Artificial Sequence
  Description of Artificial Sequence: Synthetic oligonucleotide
  Target: ATXN1; (+) strand; PAM type: NRG; PAM sequence: TGG
cttggcctgtgggaggcata

SEQ ID NO: 97425 - DNA, 20 bp, Artificial Sequence
  Description of Artificial Sequence: Synthetic oligonucleotide
  Target: ATXN1; (+) strand; PAM type: NRG; PAM sequence: TGG
ggcctgtgggaggcatatgg

SEQ ID NO: 97426 - DNA, 20 bp, Artificial Sequence
  Description of Artificial Sequence: Synthetic oligonucleotide
  Target: ATXN1; (+) strand; PAM type: NRG; PAM sequence: GGG
gcctgtgggaggcatatggt

SEQ ID NO: 97427 - DNA, 20 bp, Artificial Sequence
  Description of Artificial Sequence: Synthetic oligonucleotide
  Target: ATXN1; (+) strand; PAM type: NRG; PAM sequence: CAG
tgatctgatattaaaacatc

SEQ ID NO: 97428 - DNA, 20 bp, Artificial Sequence
  Description of Artificial Sequence: Synthetic oligonucleotide
  Target: ATXN1; (+) strand; PAM type: NRG; PAM sequence: TAG
tctgatattaaaacatccag

SEQ ID NO: 97429 - DNA, 20 bp, Artificial Sequence
  Description of Artificial Sequence: Synthetic oligonucleotide
  Target: ATXN1; (+) strand; PAM type: NRG; PAM sequence: GAG
attaaaacatccagtagtac

SEQ ID NO: 97430 - DNA, 20 bp, Artificial Sequence
  Description of Artificial Sequence: Synthetic oligonucleotide
  Target: ATXN1; (+) strand; PAM type: NRG; PAM sequence: CAG
acatccagtagtacgagtct

SEQ ID NO: 97431 - DNA, 20 bp, Artificial Sequence
  Description of Artificial Sequence: Synthetic oligonucleotide
  Target: ATXN1; (+) strand; PAM type: NRG; PAM sequence: GAG
atccagtagtacgagtctca

SEQ ID NO: 97432 - DNA, 20 bp, Artificial Sequence
  Description of Artificial Sequence: Synthetic oligonucleotide
  Target: ATXN1; (+) strand; PAM type: NRG; PAM sequence: TGG
agtagtacgagtctcagaga

SEQ ID NO: 97433 - DNA, 20 bp, Artificial Sequence
  Description of Artificial Sequence: Synthetic oligonucleotide
  Target: ATXN1; (+) strand; PAM type: NRG; PAM sequence: TGG
acgagtctcagagatggctc

SEQ ID NO: 97434 - DNA, 20 bp, Artificial Sequence
  Description of Artificial Sequence: Synthetic oligonucleotide
  Target: ATXN1; (+) strand; PAM type: NRG; PAM sequence: GAG
gagtctcagagatggctctg

SEQ ID NO: 97435 - DNA, 20 bp, Artificial Sequence
  Description of Artificial Sequence: Synthetic oligonucleotide
  Target: ATXN1; (+) strand; PAM type: NRG; PAM sequence: CAG
ctcagagatggctctggagc

SEQ ID NO: 97436 - DNA, 20 bp, Artificial Sequence
  Description of Artificial Sequence: Synthetic oligonucleotide
  Target: ATXN1; (+) strand; PAM type: NRG; PAM sequence: AGG
tcagagatggctctggagcc

SEQ ID NO: 97437 - DNA, 20 bp, Artificial Sequence
  Description of Artificial Sequence: Synthetic oligonucleotide
  Target: ATXN1; (+) strand; PAM type: NRG; PAM sequence: TGG
ctctggagccaggactccac

SEQ ID NO: 97438 - DNA, 20 bp, Artificial Sequence
  Description of Artificial Sequence: Synthetic oligonucleotide
  Target: ATXN1; (+) strand; PAM type: NRG; PAM sequence: TGG
ggagccaggactccactggc

SEQ ID NO: 97439 - DNA, 20 bp, Artificial Sequence
  Description of Artificial Sequence: Synthetic oligonucleotide
  Target: ATXN1; (+) strand; PAM type: NRG; PAM sequence: AAG
gactccactggctggaaatg

SEQ ID NO: 97440 - DNA, 20 bp, Artificial Sequence
  Description of Artificial Sequence: Synthetic oligonucleotide
  Target: ATXN1; (+) strand; PAM type: NRG; PAM sequence: AAG
aatgaagactgtctaatctg

SEQ ID NO: 97441 - DNA, 20 bp, Artificial Sequence
  Description of Artificial Sequence: Synthetic oligonucleotide
  Target: ATXN1; (+) strand; PAM type: NRG; PAM sequence: AGG
atgaagactgtctaatctga

SEQ ID NO: 97442 - DNA, 20 bp, Artificial Sequence
  Description of Artificial Sequence: Synthetic oligonucleotide
  Target: ATXN1; (+) strand; PAM type: NRG; PAM sequence: CAG
aaggtcaccacaaatactga

SEQ ID NO: 97443 - DNA, 20 bp, Artificial Sequence
  Description of Artificial Sequence: Synthetic oligonucleotide
  Target: ATXN1; (+) strand; PAM type: NRG; PAM sequence: AGG
aggtcaccacaaatactgac

SEQ ID NO: 97444 - DNA, 20 bp, Artificial Sequence
  Description of Artificial Sequence: Synthetic oligonucleotide
  Target: ATXN1; (+) strand; PAM type: NRG; PAM sequence: CGG
actatcttgaaacctccttt

SEQ ID NO: 97445 - DNA, 20 bp, Artificial Sequence
  Description of Artificial Sequence: Synthetic oligonucleotide
  Target: ATXN1; (+) strand; PAM type: NRG; PAM sequence: TGG
cctttcggctgacactaatt

SEQ ID NO: 97446 - DNA, 20 bp, Artificial Sequence
  Description of Artificial Sequence: Synthetic oligonucleotide
  Target: ATXN1; (+) strand; PAM type: NRG; PAM sequence: GGG
ctttcggctgacactaattt

SEQ ID NO: 97447 - DNA, 20 bp, Artificial Sequence
  Description of Artificial Sequence: Synthetic oligonucleotide
  Target: ATXN1; (+) strand; PAM type: NRG; PAM sequence: TAG
ggctgacactaatttgggtt

SEQ ID NO: 97448 - DNA, 20 bp, Artificial Sequence
  Description of Artificial Sequence: Synthetic oligonucleotide
  Target: ATXN1; (+) strand; PAM type: NRG; PAM sequence: GAG
ctgacactaatttgggttta

SEQ ID NO: 97449 - DNA, 20 bp, Artificial Sequence
  Description of Artificial Sequence: Synthetic oligonucleotide
  Target: ATXN1; (+) strand; PAM type: NRG; PAM sequence: GAG
actaatttgggtttagagtt

SEQ ID NO: 97450 - DNA, 20 bp, Artificial Sequence
  Description of Artificial Sequence: Synthetic oligonucleotide
  Target: ATXN1; (+) strand; PAM type: NRG; PAM sequence: CAG
aatttgggtttagagttgag

SEQ ID NO: 97451 - DNA, 20 bp, Artificial Sequence
  Description of Artificial Sequence: Synthetic oligonucleotide
  Target: ATXN1; (+) strand; PAM type: NRG; PAM sequence: CAG
gggtttagagttgagcagtt

SEQ ID NO: 97452 - DNA, 20 bp, Artificial Sequence
  Description of Artificial Sequence: Synthetic oligonucleotide
  Target: ATXN1; (+) strand; PAM type: NRG; PAM sequence: AGG
ggtttagagttgagcagttc

SEQ ID NO: 97453 - DNA, 20 bp, Artificial Sequence
  Description of Artificial Sequence: Synthetic oligonucleotide
  Target: ATXN1; (+) strand; PAM type: NRG; PAM sequence: TGG
tagagttgagcagttcaggc

SEQ ID NO: 97454 - DNA, 20 bp, Artificial Sequence
  Description of Artificial Sequence: Synthetic oligonucleotide
  Target: ATXN1; (+) strand; PAM type: NRG; PAM sequence: GGG
agagttgagcagttcaggct

SEQ ID NO: 97455 - DNA, 20 bp, Artificial Sequence
  Description of Artificial Sequence: Synthetic oligonucleotide
  Target: ATXN1; (+) strand; PAM type: NRG; PAM sequence: GGG
gagttgagcagttcaggctg

SEQ ID NO: 97456 - DNA, 20 bp, Artificial Sequence
  Description of Artificial Sequence: Synthetic oligonucleotide
  Target: ATXN1; (+) strand; PAM type: NRG; PAM sequence: GAG
gttgagcagttcaggctggg

SEQ ID NO: 97457 - DNA, 20 bp, Artificial Sequence
  Description of Artificial Sequence: Synthetic oligonucleotide
  Target: ATXN1; (+) strand; PAM type: NRG; PAM sequence: GAG
gcagttcaggctggggagat

SEQ ID NO: 97458 - DNA, 20 bp, Artificial Sequence
  Description of Artificial Sequence: Synthetic oligonucleotide
  Target: ATXN1; (+) strand; PAM type: NRG; PAM sequence: AGG
cagttcaggctggggagatg

SEQ ID NO: 97459 - DNA, 20 bp, Artificial Sequence
  Description of Artificial Sequence: Synthetic oligonucleotide
  Target: ATXN1; (+) strand; PAM type: NRG; PAM sequence: AAG
gatgaggaaaccccgccaaa

SEQ ID NO: 97460 - DNA, 20 bp, Artificial Sequence
  Description of Artificial Sequence: Synthetic oligonucleotide
  Target: ATXN1; (+) strand; PAM type: NRG; PAM sequence: AGG
atgaggaaaccccgccaaaa

SEQ ID NO: 97461 - DNA, 20 bp, Artificial Sequence
  Description of Artificial Sequence: Synthetic oligonucleotide
  Target: ATXN1; (+) strand; PAM type: NRG; PAM sequence: GGG
tgaggaaaccccgccaaaaa

SEQ ID NO: 97462 - DNA, 20 bp, Artificial Sequence
  Description of Artificial Sequence: Synthetic oligonucleotide
  Target: ATXN1; (+) strand; PAM type: NRG; PAM sequence: CAG
ggaaaccccgccaaaaaggg

SEQ ID NO: 97463 - DNA, 20 bp, Artificial Sequence
  Description of Artificial Sequence: Synthetic oligonucleotide
  Target: ATXN1; (+) strand; PAM type: NRG; PAM sequence: CAG
gccaaaaagggcagtattca

SEQ ID NO: 97464 - DNA, 20 bp, Artificial Sequence
  Description of Artificial Sequence: Synthetic oligonucleotide
  Target: ATXN1; (+) strand; PAM type: NRG; PAM sequence: CAG
tattcacagaactgaatgca

SEQ ID NO: 97465 - DNA, 20 bp, Artificial Sequence
  Description of Artificial Sequence: Synthetic oligonucleotide
  Target: ATXN1; (+) strand; PAM type: NRG; PAM sequence: AGG
attcacagaactgaatgcac

SEQ ID NO: 97466 - DNA, 20 bp, Artificial Sequence
  Description of Artificial Sequence: Synthetic oligonucleotide
  Target: ATXN1; (+) strand; PAM type: NRG; PAM sequence: AAG
gaactgaatgcacaggtatc

SEQ ID NO: 97467 - DNA, 20 bp, Artificial Sequence
  Description of Artificial Sequence: Synthetic oligonucleotide
  Target: ATXN1; (+) strand; PAM type: NRG; PAM sequence: AAG
aagttcaaatgcactaacta

SEQ ID NO: 97468 - DNA, 20 bp, Artificial Sequence
  Description of Artificial Sequence: Synthetic oligonucleotide
  Target: ATXN1; (+) strand; PAM type: NRG; PAM sequence: AGG
agttcaaatgcactaactaa

SEQ ID NO: 97469 - DNA, 20 bp, Artificial Sequence
  Description of Artificial Sequence: Synthetic oligonucleotide
  Target: ATXN1; (+) strand; PAM type: NRG; PAM sequence: TGG
taaaggatttaccccactcc

SEQ ID NO: 97470 - DNA, 20 bp, Artificial Sequence
  Description of Artificial Sequence: Synthetic oligonucleotide
  Target: ATXN1; (+) strand; PAM type: NRG; PAM sequence: GGG
aaaggatttaccccactcct

SEQ ID NO: 97471 - DNA, 20 bp, Artificial Sequence
  Description of Artificial Sequence: Synthetic oligonucleotide
  Target: ATXN1; (+) strand; PAM type: NRG; PAM sequence: CAG
gatttaccccactcctgggc

SEQ ID NO: 97472 - DNA, 20 bp, Artificial Sequence
  Description of Artificial Sequence: Synthetic oligonucleotide
  Target: ATXN1; (+) strand; PAM type: NRG; PAM sequence: AAG
ctcctgggccagaaaactga

SEQ ID NO: 97473 - DNA, 20 bp, Artificial Sequence
  Description of Artificial Sequence: Synthetic oligonucleotide
  Target: ATXN1; (+) strand; PAM type: NRG; PAM sequence: GAG
cctgggccagaaaactgaaa

SEQ ID NO: 97474 - DNA, 20 bp, Artificial Sequence
  Description of Artificial Sequence: Synthetic oligonucleotide
  Target: ATXN1; (+) strand; PAM type: NRG; PAM sequence: TAG
gggccagaaaactgaaagag

SEQ ID NO: 97475 - DNA, 20 bp, Artificial Sequence
  Description of Artificial Sequence: Synthetic oligonucleotide
  Target: ATXN1; (+) strand; PAM type: NRG; PAM sequence: AGG
ggccagaaaactgaaagagt

SEQ ID NO: 97476 - DNA, 20 bp, Artificial Sequence
  Description of Artificial Sequence: Synthetic oligonucleotide
  Target: ATXN1; (+) strand; PAM type: NRG; PAM sequence: TGG
cagaaaactgaaagagtagg

SEQ ID NO: 97477 - DNA, 20 bp, Artificial Sequence
  Description of Artificial Sequence: Synthetic oligonucleotide
  Target: ATXN1; (+) strand; PAM type: NRG; PAM sequence: AAG
aaagagtaggtggttcctgt

SEQ ID NO: 97478 - DNA, 20 bp, Artificial Sequence
  Description of Artificial Sequence: Synthetic oligonucleotide
  Target: ATXN1; (+) strand; PAM type: NRG; PAM sequence: CAG
taggtggttcctgtaagaac

SEQ ID NO: 97479 - DNA, 20 bp, Artificial Sequence
  Description of Artificial Sequence: Synthetic oligonucleotide
  Target: ATXN1; (+) strand; PAM type: NRG; PAM sequence: GAG
ggtggttcctgtaagaacca

SEQ ID NO: 97480 - DNA, 20 bp, Artificial Sequence
  Description of Artificial Sequence: Synthetic oligonucleotide
  Target: ATXN1; (+) strand; PAM type: NRG; PAM sequence: GAG
ccagagaaaacctgtgcacc

SEQ ID NO: 97481 - DNA, 20 bp, Artificial Sequence
  Description of Artificial Sequence: Synthetic oligonucleotide
  Target: ATXN1; (+) strand; PAM type: NRG; PAM sequence: TGG
aacctgtgcaccgagcttct

SEQ ID NO: 97482 - DNA, 20 bp, Artificial Sequence
  Description of Artificial Sequence: Synthetic oligonucleotide
  Target: ATXN1; (+) strand; PAM type: NRG; PAM sequence: AAG
gcttcttggtaactgctctg

SEQ ID NO: 97483 - DNA, 20 bp, Artificial Sequence
  Description of Artificial Sequence: Synthetic oligonucleotide
  Target: ATXN1; (+) strand; PAM type: NRG; PAM sequence: CAG
ggtaactgctctgaagacaa

SEQ ID NO: 97484 - DNA, 20 bp, Artificial Sequence
  Description of Artificial Sequence: Synthetic oligonucleotide
  Target: ATXN1; (+) strand; PAM type: NRG; PAM sequence: GAG
tgctctgaagacaacagctt

SEQ ID NO: 97485 - DNA, 20 bp, Artificial Sequence
  Description of Artificial Sequence: Synthetic oligonucleotide
  Target: ATXN1; (+) strand; PAM type: NRG; PAM sequence: TAG
ctgaagacaacagcttgagc

SEQ ID NO: 97486 - DNA, 20 bp, Artificial Sequence
  Description of Artificial Sequence: Synthetic oligonucleotide
  Target: ATXN1; (+) strand; PAM type: NRG; PAM sequence: TGG
agctagtgtcacctaatact

SEQ ID NO: 97487 - DNA, 20 bp, Artificial Sequence
  Description of Artificial Sequence: Synthetic oligonucleotide
  Target: ATXN1; (+) strand; PAM type: NRG; PAM sequence: TGG
tcacctaatacttggtattc

SEQ ID NO: 97488 - DNA, 20 bp, Artificial Sequence
  Description of Artificial Sequence: Synthetic oligonucleotide
  Target: ATXN1; (+) strand; PAM type: NRG; PAM sequence: GAG
acctaatacttggtattctg

SEQ ID NO: 97489 - DNA, 20 bp, Artificial Sequence
  Description of Artificial Sequence: Synthetic oligonucleotide
  Target: ATXN1; (+) strand; PAM type: NRG; PAM sequence: AGG
cctaatacttggtattctgg

SEQ ID NO: 97490 - DNA, 20 bp, Artificial Sequence
  Description of Artificial Sequence: Synthetic oligonucleotide
  Target: ATXN1; (+) strand; PAM type: NRG; PAM sequence: CAG
atacttggtattctggagga

SEQ ID NO: 97491 - DNA, 20 bp, Artificial Sequence
  Description of Artificial Sequence: Synthetic oligonucleotide
  Target: ATXN1; (+) strand; PAM type: NRG; PAM sequence: TGG
tggaggacagtatgttatct

SEQ ID NO: 97492 - DNA, 20 bp, Artificial Sequence
  Description of Artificial Sequence: Synthetic oligonucleotide
  Target: ATXN1; (+) strand; PAM type: NRG; PAM sequence: AAG
ggacagtatgttatcttggt

SEQ ID NO: 97493 - DNA, 20 bp, Artificial Sequence
  Description of Artificial Sequence: Synthetic oligonucleotide
  Target: ATXN1; (+) strand; PAM type: NRG; PAM sequence: AGG
gacagtatgttatcttggta

SEQ ID NO: 97494 - DNA, 20 bp, Artificial Sequence
  Description of Artificial Sequence: Synthetic oligonucleotide
  Target: ATXN1; (+) strand; PAM type: NRG; PAM sequence: AAG
tgtaaacaacacttccaacg

SEQ ID NO: 97495 - DNA, 20 bp, Artificial Sequence
  Description of Artificial Sequence: Synthetic oligonucleotide
  Target: ATXN1; (+) strand; PAM type: NRG; PAM sequence: AGG
gtaaacaacacttccaacga

SEQ ID NO: 97496 - DNA, 20 bp, Artificial Sequence
  Description of Artificial Sequence: Synthetic oligonucleotide
  Target: ATXN1; (+) strand; PAM type: NRG; PAM sequence: CAG
acacttccaacgaaggcctt

SEQ ID NO: 97497 - DNA, 20 bp, Artificial Sequence
  Description of Artificial Sequence: Synthetic oligonucleotide
  Target: ATXN1; (+) strand; PAM type: NRG; PAM sequence: TGG
tccaacgaaggccttcagat

SEQ ID NO: 97498 - DNA, 20 bp, Artificial Sequence
  Description of Artificial Sequence: Synthetic oligonucleotide
  Target: ATXN1; (+) strand; PAM type: NRG; PAM sequence: CAG
gaaggccttcagattggcca

SEQ ID NO: 97499 - DNA, 20 bp, Artificial Sequence
  Description of Artificial Sequence: Synthetic oligonucleotide
  Target: ATXN1; (+) strand; PAM type: NRG; PAM sequence: AAG
ccttcagattggccacagaa

SEQ ID NO: 97500 - DNA, 20 bp, Artificial Sequence
  Description of Artificial Sequence: Synthetic oligonucleotide
  Target: ATXN1; (+) strand; PAM type: NRG; PAM sequence: AGG
cttcagattggccacagaaa

SEQ ID NO: 97501 - DNA, 20 bp, Artificial Sequence
  Description of Artificial Sequence: Synthetic oligonucleotide
  Target: ATXN1; (+) strand; PAM type: NRG; PAM sequence: GAG
tcagattggccacagaaaag

SEQ ID NO: 97502 - DNA, 20 bp, Artificial Sequence
  Description of Artificial Sequence: Synthetic oligonucleotide
  Target: ATXN1; (+) strand; PAM type: NRG; PAM sequence: CAG
attggccacagaaaaggaga

SEQ ID NO: 97503 - DNA, 20 bp, Artificial Sequence
  Description of Artificial Sequence: Synthetic oligonucleotide
  Target: ATXN1; (+) strand; PAM type: NRG; PAM sequence: AGG
ttggccacagaaaaggagac

SEQ ID NO: 97504 - DNA, 20 bp, Artificial Sequence
  Description of Artificial Sequence: Synthetic oligonucleotide
  Target: ATXN1; (+) strand; PAM type: NRG; PAM sequence: TGG
agaaaaggagacaggctcat

SEQ ID NO: 97505 - DNA, 20 bp, Artificial Sequence
  Description of Artificial Sequence: Synthetic oligonucleotide
  Target: ATXN1; (+) strand; PAM type: NRG; PAM sequence: CAG
agacaggctcattggccatc

SEQ ID NO: 97506 - DNA, 20 bp, Artificial Sequence
  Description of Artificial Sequence: Synthetic oligonucleotide
  Target: ATXN1; (+) strand; PAM type: NRG; PAM sequence: CAG
aggctcattggccatccaga

SEQ ID NO: 97507 - DNA, 20 bp, Artificial Sequence
  Description of Artificial Sequence: Synthetic oligonucleotide
  Target: ATXN1; (+) strand; PAM type: NRG; PAM sequence: AAG
tccagacagcaaacaaacta

SEQ ID NO: 97508 - DNA, 20 bp, Artificial Sequence
  Description of Artificial Sequence: Synthetic oligonucleotide
  Target: ATXN1; (+) strand; PAM type: NRG; PAM sequence: AGG
ccagacagcaaacaaactaa

SEQ ID NO: 97509 - DNA, 20 bp, Artificial Sequence
  Description of Artificial Sequence: Synthetic oligonucleotide
  Target: ATXN1; (+) strand; PAM type: NRG; PAM sequence: GGG
cagacagcaaacaaactaaa

SEQ ID NO: 97510 - DNA, 20 bp, Artificial Sequence
  Description of Artificial Sequence: Synthetic oligonucleotide
  Target: ATXN1; (+) strand; PAM type: NRG; PAM sequence: AAG
cagcaaacaaactaaaggga

SEQ ID NO: 97511 - DNA, 20 bp, Artificial Sequence
  Description of Artificial Sequence: Synthetic oligonucleotide
  Target: ATXN1; (+) strand; PAM type: NRG; PAM sequence: TGG
aactaaagggaaagaaaacg

SEQ ID NO: 97512 - DNA, 20 bp, Artificial Sequence
  Description of Artificial Sequence: Synthetic oligonucleotide
  Target: ATXN1; (+) strand; PAM type: NRG; PAM sequence: GGG
actaaagggaaagaaaacgt

SEQ ID NO: 97513 - DNA, 20 bp, Artificial Sequence
  Description of Artificial Sequence: Synthetic oligonucleotide
  Target: ATXN1; (+) strand; PAM type: NRG; PAM sequence: AAG
agggaaagaaaacgtgggtg

SEQ ID NO: 97514 - DNA, 20 bp, Artificial Sequence
  Description of Artificial Sequence: Synthetic oligonucleotide
  Target: ATXN1; (+) strand; PAM type: NRG; PAM sequence: CAG
tgaagcctccaatgtatctg

SEQ ID NO: 97515 - DNA, 20 bp, Artificial Sequence
  Description of Artificial Sequence: Synthetic oligonucleotide
  Target: ATXN1; (+) strand; PAM type: NRG; PAM sequence: TGG
agcctccaatgtatctgcag

SEQ ID NO: 97516 - DNA, 20 bp, Artificial Sequence
  Description of Artificial Sequence: Synthetic oligonucleotide
  Target: ATXN1; (+) strand; PAM type: NRG; PAM sequence: AAG
ctccaatgtatctgcagtgg

SEQ ID NO: 97517 - DNA, 20 bp, Artificial Sequence
  Description of Artificial Sequence: Synthetic oligonucleotide
  Target: ATXN1; (+) strand; PAM type: NRG; PAM sequence: GAG
gtatctgcagtggaagactt

SEQ ID NO: 97518 - DNA, 20 bp, Artificial Sequence
  Description of Artificial Sequence: Synthetic oligonucleotide
  Target: ATXN1; (+) strand; PAM type: NRG; PAM sequence: CAG
gtggaagacttgagtccttt

SEQ ID NO: 97519 - DNA, 20 bp, Artificial Sequence
  Description of Artificial Sequence: Synthetic oligonucleotide
  Target: ATXN1; (+) strand; PAM type: NRG; PAM sequence: AAG
agacttgagtcctttcagat

SEQ ID NO: 97520 - DNA, 20 bp, Artificial Sequence
  Description of Artificial Sequence: Synthetic oligonucleotide
  Target: ATXN1; (+) strand; PAM type: NRG; PAM sequence: AAG
tgagtcctttcagataagaa

SEQ ID NO: 97521 - DNA, 20 bp, Artificial Sequence
  Description of Artificial Sequence: Synthetic oligonucleotide
  Target: ATXN1; (+) strand; PAM type: NRG; PAM sequence: TGG
ctttcagataagaaaagtta

SEQ ID NO: 97522 - DNA, 20 bp, Artificial Sequence
  Description of Artificial Sequence: Synthetic oligonucleotide
  Target: ATXN1; (+) strand; PAM type: NRG; PAM sequence: TAG
agaaaagttatggaaattct

SEQ ID NO: 97523 - DNA, 20 bp, Artificial Sequence
  Description of Artificial Sequence: Synthetic oligonucleotide
  Target: ATXN1; (+) strand; PAM type: NRG; PAM sequence: GAG
aaaagttatggaaattctta

SEQ ID NO: 97524 - DNA, 20 bp, Artificial Sequence
  Description of Artificial Sequence: Synthetic oligonucleotide
  Target: ATXN1; (+) strand; PAM type: NRG; PAM sequence: TAG
tagagattgttgttattgta

SEQ ID NO: 97525 - DNA, 20 bp, Artificial Sequence
  Description of Artificial Sequence: Synthetic oligonucleotide
  Target: ATXN1; (+) strand; PAM type: NRG; PAM sequence: TGG
attgtatagatactacctat

SEQ ID NO: 97526 - DNA, 20 bp, Artificial Sequence
  Description of Artificial Sequence: Synthetic oligonucleotide
  Target: ATXN1; (+) strand; PAM type: NRG; PAM sequence: CAG
aaatgcacttaattttaata

SEQ ID NO: 97527 - DNA, 20 bp, Artificial Sequence
  Description of Artificial Sequence: Synthetic oligonucleotide
  Target: ATXN1; (+) strand; PAM type: NRG; PAM sequence: AAG
cagttgaaccatttgtatgc

SEQ ID NO: 97528 - DNA, 20 bp, Artificial Sequence
  Description of Artificial Sequence: Synthetic oligonucleotide
  Target: ATXN1; (+) strand; PAM type: NRG; PAM sequence: TGG
aaccatttgtatgcaagtca

SEQ ID NO: 97529 - DNA, 20 bp, Artificial Sequence
  Description of Artificial Sequence: Synthetic oligonucleotide
  Target: ATXN1; (+) strand; PAM type: NRG; PAM sequence: GGG
accatttgtatgcaagtcat

SEQ ID NO: 97530 - DNA, 20 bp, Artificial Sequence
  Description of Artificial Sequence: Synthetic oligonucleotide
  Target: ATXN1; (+) strand; PAM type: NRG; PAM sequence: GGG
ccatttgtatgcaagtcatg

SEQ ID NO: 97531 - DNA, 20 bp, Artificial Sequence
  Description of Artificial Sequence: Synthetic oligonucleotide
  Target: ATXN1; (+) strand; PAM type: NRG; PAM sequence: AAG
catggggacatgaaaaactg

SEQ ID NO: 97532 - DNA, 20 bp, Artificial Sequence
  Description of Artificial Sequence: Synthetic oligonucleotide
  Target: ATXN1; (+) strand; PAM type: NRG; PAM sequence: CGG
gggacatgaaaaactgaagc

SEQ ID NO: 97533 - DNA, 20 bp, Artificial Sequence
  Description of Artificial Sequence: Synthetic oligonucleotide
  Target: ATXN1; (+) strand; PAM type: NRG; PAM sequence: CAG
tgttccctcccgccattaca

SEQ ID NO: 97534 - DNA, 20 bp, Artificial Sequence
  Description of Artificial Sequence: Synthetic oligonucleotide
  Target: ATXN1; (+) strand; PAM type: NRG; PAM sequence: AGG
gttccctcccgccattacac

SEQ ID NO: 97535 - DNA, 20 bp, Artificial Sequence
  Description of Artificial Sequence: Synthetic oligonucleotide
  Target: ATXN1; (+) strand; PAM type: NRG; PAM sequence: GAG
tccctcccgccattacacag

SEQ ID NO: 97536 - DNA, 20 bp, Artificial Sequence
  Description of Artificial Sequence: Synthetic oligonucleotide
  Target: ATXN1; (+) strand; PAM type: NRG; PAM sequence: AAG
tcccgccattacacaggaga

SEQ ID NO: 97537 - DNA, 20 bp, Artificial Sequence
  Description of Artificial Sequence: Synthetic oligonucleotide
  Target: ATXN1; (+) strand; PAM type: NRG; PAM sequence: TAG
gccattacacaggagaaagt

SEQ ID NO: 97538 - DNA, 20 bp, Artificial Sequence
  Description of Artificial Sequence: Synthetic oligonucleotide
  Target: ATXN1; (+) strand; PAM type: NRG; PAM sequence: CAG
cacaggagaaagttagctac

SEQ ID NO: 97539 - DNA, 20 bp, Artificial Sequence
  Description of Artificial Sequence: Synthetic oligonucleotide
  Target: ATXN1; (+) strand; PAM type: NRG; PAM sequence: CAG
gagaaagttagctaccagaa

SEQ ID NO: 97540 - DNA, 20 bp, Artificial Sequence
  Description of Artificial Sequence: Synthetic oligonucleotide
  Target: ATXN1; (+) strand; PAM type: NRG; PAM sequence: GAG
ccagaacagttgccttcaac

SEQ ID NO: 97541 - DNA, 20 bp, Artificial Sequence
  Description of Artificial Sequence: Synthetic oligonucleotide
  Target: ATXN1; (+) strand; PAM type: NRG; PAM sequence: AAG
gaacagttgccttcaacgag

SEQ ID NO: 97542 - DNA, 20 bp, Artificial Sequence
  Description of Artificial Sequence: Synthetic oligonucleotide
  Target: ATXN1; (+) strand; PAM type: NRG; PAM sequence: AGG
aacagttgccttcaacgaga

SEQ ID NO: 97543 - DNA, 20 bp, Artificial Sequence
  Description of Artificial Sequence: Synthetic oligonucleotide
  Target: ATXN1; (+) strand; PAM type: NRG; PAM sequence: GGG
acagttgccttcaacgagaa

SEQ ID NO: 97544 - DNA, 20 bp, Artificial Sequence
  Description of Artificial Sequence: Synthetic oligonucleotide
  Target: ATXN1; (+) strand; PAM type: NRG; PAM sequence: GAG
agttgccttcaacgagaagg

SEQ ID NO: 97545 - DNA, 20 bp, Artificial Sequence
  Description of Artificial Sequence: Synthetic oligonucleotide
  Target: ATXN1; (+) strand; PAM type: NRG; PAM sequence: AGG
gttgccttcaacgagaaggg

SEQ ID NO: 97546 - DNA, 20 bp, Artificial Sequence
  Description of Artificial Sequence: Synthetic oligonucleotide
  Target: ATXN1; (+) strand; PAM type: NRG; PAM sequence: GGG
ttgccttcaacgagaaggga

SEQ ID NO: 97547 - DNA, 20 bp, Artificial Sequence
  Description of Artificial Sequence: Synthetic oligonucleotide
  Target: ATXN1; (+) strand; PAM type: NRG; PAM sequence: GGG
tgccttcaacgagaagggag

SEQ ID NO: 97548 - DNA, 20 bp, Artificial Sequence
  Description of Artificial Sequence: Synthetic oligonucleotide
  Target: ATXN1; (+) strand; PAM type: NRG; PAM sequence: GAG
tcaacgagaagggaggggac

SEQ ID NO: 97549 - DNA, 20 bp, Artificial Sequence
  Description of Artificial Sequence: Synthetic oligonucleotide
  Target: ATXN1; (+) strand; PAM type: NRG; PAM sequence: AAG
ggggacgagattctgaattt

SEQ ID NO: 97550 - DNA, 20 bp, Artificial Sequence
  Description of Artificial Sequence: Synthetic oligonucleotide
  Target: ATXN1; (+) strand; PAM type: NRG; PAM sequence: AAG
attctgaatttaagaattgt

SEQ ID NO: 97551 - DNA, 20 bp, Artificial Sequence
  Description of Artificial Sequence: Synthetic oligonucleotide
  Target: ATXN1; (+) strand; PAM type: NRG; PAM sequence: TGG
ctgaatttaagaattgtaag

SEQ ID NO: 97552 - DNA, 20 bp, Artificial Sequence
  Description of Artificial Sequence: Synthetic oligonucleotide
  Target: ATXN1; (+) strand; PAM type: NRG; PAM sequence: GGG
tgaatttaagaattgtaagt

SEQ ID NO: 97553 - DNA, 20 bp, Artificial Sequence
  Description of Artificial Sequence: Synthetic oligonucleotide
  Target: ATXN1; (+) strand; PAM type: NRG; PAM sequence: GGG
gaatttaagaattgtaagtg

SEQ ID NO: 97554 - DNA, 20 bp, Artificial Sequence
  Description of Artificial Sequence: Synthetic oligonucleotide
  Target: ATXN1; (+) strand; PAM type: NRG; PAM sequence: GGG
aatttaagaattgtaagtgg

SEQ ID NO: 97555 - DNA, 20 bp, Artificial Sequence
  Description of Artificial Sequence: Synthetic oligonucleotide
  Target: ATXN1; (+) strand; PAM type: NRG; PAM sequence: CAG
gggggtgcttaatatcccca

SEQ ID NO: 97556 - DNA, 20 bp, Artificial Sequence
  Description of Artificial Sequence: Synthetic oligonucleotide
  Target: ATXN1; (+) strand; PAM type: NRG; PAM sequence: CAG
ttaatatccccacagctgtc

SEQ ID NO: 97557 - DNA, 20 bp, Artificial Sequence
  Description of Artificial Sequence: Synthetic oligonucleotide
  Target: ATXN1; (+) strand; PAM type: NRG; PAM sequence: CGG
gctgtccagtttccactgtc

SEQ ID NO: 97558 - DNA, 20 bp, Artificial Sequence
  Description of Artificial Sequence: Synthetic oligonucleotide
  Target: ATXN1; (+) strand; PAM type: NRG; PAM sequence: TGG
ccactgtccggcttgatttt

SEQ ID NO: 97559 - DNA, 20 bp, Artificial Sequence
  Description of Artificial Sequence: Synthetic oligonucleotide
  Target: ATXN1; (+) strand; PAM type: NRG; PAM sequence: CAG
tgtccggcttgatttttgga

SEQ ID NO: 97560 - DNA, 20 bp, Artificial Sequence
  Description of Artificial Sequence: Synthetic oligonucleotide
  Target: ATXN1; (+) strand; PAM type: NRG; PAM sequence: AGG
gtccggcttgatttttggac

SEQ ID NO: 97561 - DNA, 20 bp, Artificial Sequence
  Description of Artificial Sequence: Synthetic oligonucleotide
  Target: ATXN1; (+) strand; PAM type: NRG; PAM sequence: GAG
ttggacaggaatactattct

SEQ ID NO: 97562 - DNA, 20 bp, Artificial Sequence
  Description of Artificial Sequence: Synthetic oligonucleotide
  Target: ATXN1; (+) strand; PAM type: NRG; PAM sequence: AAG
gacaggaatactattctgag

SEQ ID NO: 97563 - DNA, 20 bp, Artificial Sequence
  Description of Artificial Sequence: Synthetic oligonucleotide
  Target: ATXN1; (+) strand; PAM type: NRG; PAM sequence: TGG
aagatgctccgtatttattc

SEQ ID NO: 97564 - DNA, 20 bp, Artificial Sequence
  Description of Artificial Sequence: Synthetic oligonucleotide
  Target: ATXN1; (+) strand; PAM type: NRG; PAM sequence: GAG
aaataaaactaaaataaaat

SEQ ID NO: 97565 - DNA, 20 bp, Artificial Sequence
  Description of Artificial Sequence: Synthetic oligonucleotide
  Target: ATXN1; (+) strand; PAM type: NRG; PAM sequence: AGG
aataaaactaaaataaaatg

SEQ ID NO: 97566 - DNA, 20 bp, Artificial Sequence
  Description of Artificial Sequence: Synthetic oligonucleotide
  Target: ATXN1; (+) strand; PAM type: NRG; PAM sequence: GAG
tttactccccccatttaaat

SEQ ID NO: 97567 - DNA, 20 bp, Artificial Sequence
  Description of Artificial Sequence: Synthetic oligonucleotide
  Target: ATXN1; (+) strand; PAM type: NRG; PAM sequence: AGG
ttactccccccatttaaatg

SEQ ID NO: 97568 - DNA, 20 bp, Artificial Sequence
  Description of Artificial Sequence: Synthetic oligonucleotide
  Target: ATXN1; (+) strand; PAM type: NRG; PAM sequence: TGG
ccccccatttaaatgaggtg

SEQ ID NO: 97569 - DNA, 20 bp, Artificial Sequence
  Description of Artificial Sequence: Synthetic oligonucleotide
  Target: ATXN1; (+) strand; PAM type: NRG; PAM sequence: GGG
cccccatttaaatgaggtgt

SEQ ID NO: 97570 - DNA, 20 bp, Artificial Sequence
  Description of Artificial Sequence: Synthetic oligonucleotide
  Target: ATXN1; (+) strand; PAM type: NRG; PAM sequence: GGG
ccccatttaaatgaggtgtg

SEQ ID NO: 97571 - DNA, 20 bp, Artificial Sequence
  Description of Artificial Sequence: Synthetic oligonucleotide
  Target: ATXN1; (+) strand; PAM type: NRG; PAM sequence: GGG
cccatttaaatgaggtgtgg

SEQ ID NO: 97572 - DNA, 20 bp, Artificial Sequence
  Description of Artificial Sequence: Synthetic oligonucleotide
  Target: ATXN1; (+) strand; PAM type: NRG; PAM sequence: GGG
ccatttaaatgaggtgtggg

SEQ ID NO: 97573 - DNA, 20 bp, Artificial Sequence
  Description of Artificial Sequence: Synthetic oligonucleotide
  Target: ATXN1; (+) strand; PAM type: NRG; PAM sequence: AAG
ttaaatgaggtgtgggggga

SEQ ID NO: 97574 - DNA, 20 bp, Artificial Sequence
  Description of Artificial Sequence: Synthetic oligonucleotide
  Target: ATXN1; (+) strand; PAM type: NRG; PAM sequence: AAG
aatgaggtgtggggggaaag

SEQ ID NO: 97575 - DNA, 20 bp, Artificial Sequence
  Description of Artificial Sequence: Synthetic oligonucleotide
  Target: ATXN1; (+) strand; PAM type: NRG; PAM sequence: AGG
atgaggtgtggggggaaaga

SEQ ID NO: 97576 - DNA, 20 bp, Artificial Sequence
  Description of Artificial Sequence: Synthetic oligonucleotide
  Target: ATXN1; (+) strand; PAM type: NRG; PAM sequence: GAG
tttttttttgtccccataat

SEQ ID NO: 97577 - DNA, 20 bp, Artificial Sequence
  Description of Artificial Sequence: Synthetic oligonucleotide
  Target: ATXN1; (+) strand; PAM type: NRG; PAM sequence: TGG
cataatgagtcctgtttgat

SEQ ID NO: 97578 - DNA, 20 bp, Artificial Sequence
  Description of Artificial Sequence: Synthetic oligonucleotide
  Target: ATXN1; (+) strand; PAM type: NRG; PAM sequence: TAG
aatgagtcctgtttgattgg

SEQ ID NO: 97579 - DNA, 20 bp, Artificial Sequence
  Description of Artificial Sequence: Synthetic oligonucleotide
  Target: ATXN1; (+) strand; PAM type: NRG; PAM sequence: TGG
gtcctgtttgattggtagcc

SEQ ID NO: 97580 - DNA, 20 bp, Artificial Sequence
  Description of Artificial Sequence: Synthetic oligonucleotide
  Target: ATXN1; (+) strand; PAM type: NRG; PAM sequence: AAG
gttacaaacacttcgtgttc

SEQ ID NO: 97581 - DNA, 20 bp, Artificial Sequence
  Description of Artificial Sequence: Synthetic oligonucleotide
  Target: ATXN1; (+) strand; PAM type: NRG; PAM sequence: TGG
gtgttcaagattatattctt

SEQ ID NO: 97582 - DNA, 20 bp, Artificial Sequence
  Description of Artificial Sequence: Synthetic oligonucleotide
  Target: ATXN1; (+) strand; PAM type: NRG; PAM sequence: GGG
tgttcaagattatattcttt

SEQ ID NO: 97583 - DNA, 20 bp, Artificial Sequence
  Description of Artificial Sequence: Synthetic oligonucleotide
  Target: ATXN1; (+) strand; PAM type: NRG; PAM sequence: TAG
gattatattctttgggttta

SEQ ID NO: 97584 - DNA, 20 bp, Artificial Sequence
  Description of Artificial Sequence: Synthetic oligonucleotide
  Target: ATXN1; (+) strand; PAM type: NRG; PAM sequence: AGG
attatattctttgggtttat

SEQ ID NO: 97585 - DNA, 20 bp, Artificial Sequence
  Description of Artificial Sequence: Synthetic oligonucleotide
  Target: ATXN1; (+) strand; PAM type: NRG; PAM sequence: CAG
attctttgggtttataggaa

SEQ ID NO: 97586 - DNA, 20 bp, Artificial Sequence
  Description of Artificial Sequence: Synthetic oligonucleotide
  Target: ATXN1; (+) strand; PAM type: NRG; PAM sequence: AGG
ttctttgggtttataggaac

SEQ ID NO: 97587 - DNA, 20 bp, Artificial Sequence
  Description of Artificial Sequence: Synthetic oligonucleotide
  Target: ATXN1; (+) strand; PAM type: NRG; PAM sequence: AAG
tttgggtttataggaacagg

SEQ ID NO: 97588 - DNA, 20 bp, Artificial Sequence
  Description of Artificial Sequence: Synthetic oligonucleotide
  Target: ATXN1; (+) strand; PAM type: NRG; PAM sequence: AAG
aatgtcaaacatcatctctg

SEQ ID NO: 97589 - DNA, 20 bp, Artificial Sequence
  Description of Artificial Sequence: Synthetic oligonucleotide
  Target: ATXN1; (+) strand; PAM type: NRG; PAM sequence: AAG
aaacatcatctctgaagaaa

SEQ ID NO: 97590 - DNA, 20 bp, Artificial Sequence
  Description of Artificial Sequence: Synthetic oligonucleotide
  Target: ATXN1; (+) strand; PAM type: NRG; PAM sequence: AAG
catcatctctgaagaaaaag

SEQ ID NO: 97591 - DNA, 20 bp, Artificial Sequence
  Description of Artificial Sequence: Synthetic oligonucleotide
  Target: ATXN1; (+) strand; PAM type: NRG; PAM sequence: TGG
tgaagaaaaagaagttgcaa

SEQ ID NO: 97592 - DNA, 20 bp, Artificial Sequence
  Description of Artificial Sequence: Synthetic oligonucleotide
  Target: ATXN1; (+) strand; PAM type: NRG; PAM sequence: AAG
aaaagaagttgcaatggctt

SEQ ID NO: 97593 - DNA, 20 bp, Artificial Sequence
  Description of Artificial Sequence: Synthetic oligonucleotide
  Target: ATXN1; (+) strand; PAM type: NRG; PAM sequence: GAG
aagaagttgcaatggcttaa

SEQ ID NO: 97594 - DNA, 20 bp, Artificial Sequence
  Description of Artificial Sequence: Synthetic oligonucleotide
  Target: ATXN1; (+) strand; PAM type: NRG; PAM sequence: TAG
gttgcaatggcttaagagtt

SEQ ID NO: 97595 - DNA, 20 bp, Artificial Sequence
  Description of Artificial Sequence: Synthetic oligonucleotide
  Target: ATXN1; (+) strand; PAM type: NRG; PAM sequence: AAG
atggcttaagagtttagact

SEQ ID NO: 97596 - DNA, 20 bp, Artificial Sequence
  Description of Artificial Sequence: Synthetic oligonucleotide
  Target: ATXN1; (+) strand; PAM type: NRG; PAM sequence: AAG
gcttaagagtttagactaag

SEQ ID NO: 97597 - DNA, 20 bp, Artificial Sequence
  Description of Artificial Sequence: Synthetic oligonucleotide
  Target: ATXN1; (+) strand; PAM type: NRG; PAM sequence: AGG
cttaagagtttagactaaga

SEQ ID NO: 97598 - DNA, 20 bp, Artificial Sequence
  Description of Artificial Sequence: Synthetic oligonucleotide
  Target: ATXN1; (+) strand; PAM type: NRG; PAM sequence: GGG
ttaagagtttagactaagaa

SEQ ID NO: 97599 - DNA, 20 bp, Artificial Sequence
  Description of Artificial Sequence: Synthetic oligonucleotide
  Target: ATXN1; (+) strand; PAM type: NRG; PAM sequence: GAG
aagagtttagactaagaagg

SEQ ID NO: 97600 - DNA, 20 bp, Artificial Sequence
  Description of Artificial Sequence: Synthetic oligonucleotide
  Target: ATXN1; (+) strand; PAM type: NRG; PAM sequence: CAG
tttagactaagaagggagct

SEQ ID NO: 97601 - DNA, 20 bp, Artificial Sequence
  Description of Artificial Sequence: Synthetic oligonucleotide
  Target: ATXN1; (+) strand; PAM type: NRG; PAM sequence: GAG
tagactaagaagggagctca

SEQ ID NO: 97602 - DNA, 20 bp, Artificial Sequence
  Description of Artificial Sequence: Synthetic oligonucleotide
  Target: ATXN1; (+) strand; PAM type: NRG; PAM sequence: AAG
actaagaagggagctcagag

SEQ ID NO: 97603 - DNA, 20 bp, Artificial Sequence
  Description of Artificial Sequence: Synthetic oligonucleotide
  Target: ATXN1; (+) strand; PAM type: NRG; PAM sequence: CAG
ggagctcagagaagtacttt

SEQ ID NO: 97604 - DNA, 20 bp, Artificial Sequence
  Description of Artificial Sequence: Synthetic oligonucleotide
  Target: ATXN1; (+) strand; PAM type: NRG; PAM sequence: TAG
tcagagaagtactttcagca

SEQ ID NO: 97605 - DNA, 20 bp, Artificial Sequence
  Description of Artificial Sequence: Synthetic oligonucleotide
  Target: ATXN1; (+) strand; PAM type: NRG; PAM sequence: AGG
cagagaagtactttcagcat

SEQ ID NO: 97606 - DNA, 20 bp, Artificial Sequence
  Description of Artificial Sequence: Synthetic oligonucleotide
  Target: ATXN1; (+) strand; PAM type: NRG; PAM sequence: CAG
actttcagcataggaatgaa

SEQ ID NO: 97607 - DNA, 20 bp, Artificial Sequence
  Description of Artificial Sequence: Synthetic oligonucleotide
  Target: ATXN1; (+) strand; PAM type: NRG; PAM sequence: CAG
tgaacagtattctcaaatcg

SEQ ID NO: 97608 - DNA, 20 bp, Artificial Sequence
  Description of Artificial Sequence: Synthetic oligonucleotide
  Target: ATXN1; (+) strand; PAM type: NRG; PAM sequence: GAG
ttctcaaatcgcagaatacc

SEQ ID NO: 97609 - DNA, 20 bp, Artificial Sequence
  Description of Artificial Sequence: Synthetic oligonucleotide
  Target: ATXN1; (+) strand; PAM type: NRG; PAM sequence: CAG
aataccgagttcccctccct

SEQ ID NO: 97610 - DNA, 20 bp, Artificial Sequence
  Description of Artificial Sequence: Synthetic oligonucleotide
  Target: ATXN1; (+) strand; PAM type: NRG; PAM sequence: GAG
cgagttcccctccctcagac

SEQ ID NO: 97611 - DNA, 20 bp, Artificial Sequence
  Description of Artificial Sequence: Synthetic oligonucleotide
  Target: ATXN1; (+) strand; PAM type: NRG; PAM sequence: AGG
gagttcccctccctcagacg

SEQ ID NO: 97612 - DNA, 20 bp, Artificial Sequence
  Description of Artificial Sequence: Synthetic oligonucleotide
  Target: ATXN1; (+) strand; PAM type: NRG; PAM sequence: GGG
agttcccctccctcagacga

SEQ ID NO: 97613 - DNA, 20 bp, Artificial Sequence
  Description of Artificial Sequence: Synthetic oligonucleotide
  Target: ATXN1; (+) strand; PAM type: NRG; PAM sequence: AAG
tatgtaacaaaaataacaat

SEQ ID NO: 97614 - DNA, 20 bp, Artificial Sequence
  Description of Artificial Sequence: Synthetic oligonucleotide
  Target: ATXN1; (+) strand; PAM type: NRG; PAM sequence: TAG
aacaaaaataacaataagca

SEQ ID NO: 97615 - DNA, 20 bp, Artificial Sequence
  Description of Artificial Sequence: Synthetic oligonucleotide
  Target: ATXN1; (+) strand; PAM type: NRG; PAM sequence: AGG
acaaaaataacaataagcat

SEQ ID NO: 97616 - DNA, 20 bp, Artificial Sequence
  Description of Artificial Sequence: Synthetic oligonucleotide
  Target: ATXN1; (+) strand; PAM type: NRG; PAM sequence: TAG
aataacaataagcataggta

SEQ ID NO: 97617 - DNA, 20 bp, Artificial Sequence
  Description of Artificial Sequence: Synthetic oligonucleotide
  Target: ATXN1; (+) strand; PAM type: NRG; PAM sequence: AAG
aataagcataggtatagttt

SEQ ID NO: 97618 - DNA, 20 bp, Artificial Sequence
  Description of Artificial Sequence: Synthetic oligonucleotide
  Target: ATXN1; (+) strand; PAM type: NRG; PAM sequence: GAG
taagcataggtatagtttaa

SEQ ID NO: 97619 - DNA, 20 bp, Artificial Sequence
  Description of Artificial Sequence: Synthetic oligonucleotide
  Target: ATXN1; (+) strand; PAM type: NRG; PAM sequence: TAG
tagtttaagagccttttacg

SEQ ID NO: 97620 - DNA, 20 bp, Artificial Sequence
  Description of Artificial Sequence: Synthetic oligonucleotide
  Target: ATXN1; (+) strand; PAM type: NRG; PAM sequence: CAG
cttttacgtagtaattcttc

SEQ ID NO: 97621 - DNA, 20 bp, Artificial Sequence
  Description of Artificial Sequence: Synthetic oligonucleotide
  Target: ATXN1; (+) strand; PAM type: NRG; PAM sequence: AGG
ttttacgtagtaattcttcc

SEQ ID NO: 97622 - DNA, 20 bp, Artificial Sequence
  Description of Artificial Sequence: Synthetic oligonucleotide
  Target: ATXN1; (+) strand; PAM type: NRG; PAM sequence: TAG
accatacaaatctgatcatt

SEQ ID NO: 97623 - DNA, 20 bp, Artificial Sequence
  Description of Artificial Sequence: Synthetic oligonucleotide
  Target: ATXN1; (+) strand; PAM type: NRG; PAM sequence: AAG
cttttttttttttacaaaca

SEQ ID NO: 97624 - DNA, 20 bp, Artificial Sequence
  Description of Artificial Sequence: Synthetic oligonucleotide
  Target: ATXN1; (+) strand; PAM type: NRG; PAM sequence: CAG
tatgaaactcattgtttcaa

SEQ ID NO: 97625 - DNA, 20 bp, Artificial Sequence
  Description of Artificial Sequence: Synthetic oligonucleotide
  Target: ATXN1; (+) strand; PAM type: NRG; PAM sequence: GAG
tgaaactcattgtttcaaca

SEQ ID NO: 97626 - DNA, 20 bp, Artificial Sequence
  Description of Artificial Sequence: Synthetic oligonucleotide
  Target: ATXN1; (+) strand; PAM type: NRG; PAM sequence: AAG
aacattacctgtactcctca

SEQ ID NO: 97627 - DNA, 20 bp, Artificial Sequence
  Description of Artificial Sequence: Synthetic oligonucleotide
  Target: ATXN1; (+) strand; PAM type: NRG; PAM sequence: GAG
ttacctgtactcctcaaagt

SEQ ID NO: 97628 - DNA, 20 bp, Artificial Sequence
  Description of Artificial Sequence: Synthetic oligonucleotide
  Target: ATXN1; (+) strand; PAM type: NRG; PAM sequence: CAG
cttcaaaattttgttttctt

SEQ ID NO: 97629 - DNA, 20 bp, Artificial Sequence
  Description of Artificial Sequence: Synthetic oligonucleotide
  Target: ATXN1; (+) strand; PAM type: NRG; PAM sequence: CAG
ttttcttcagcttctcaaat

SEQ ID NO: 97630 - DNA, 20 bp, Artificial Sequence
  Description of Artificial Sequence: Synthetic oligonucleotide
  Target: ATXN1; (+) strand; PAM type: NRG; PAM sequence: AGG
tttcttcagcttctcaaatc

SEQ ID NO: 97631 - DNA, 20 bp, Artificial Sequence
  Description of Artificial Sequence: Synthetic oligonucleotide
  Target: ATXN1; (+) strand; PAM type: NRG; PAM sequence: AAG
atttaaaaaaaaattcccac

SEQ ID NO: 97632 - DNA, 20 bp, Artificial Sequence
  Description of Artificial Sequence: Synthetic oligonucleotide
  Target: ATXN1; (+) strand; PAM type: NRG; PAM sequence: AGG
tttaaaaaaaaattcccaca

SEQ ID NO: 97633 - DNA, 20 bp, Artificial Sequence
  Description of Artificial Sequence: Synthetic oligonucleotide
  Target: ATXN1; (+) strand; PAM type: NRG; PAM sequence: TAG
aaaaaaattcccacaaggta

SEQ ID NO: 97634 - DNA, 20 bp, Artificial Sequence
  Description of Artificial Sequence: Synthetic oligonucleotide
  Target: ATXN1; (+) strand; PAM type: NRG; PAM sequence: AAG
cccacaaggtatagtgctac

SEQ ID NO: 97635 - DNA, 20 bp, Artificial Sequence
  Description of Artificial Sequence: Synthetic oligonucleotide
  Target: ATXN1; (+) strand; PAM type: NRG; PAM sequence: AAG
aaggtatagtgctacaagaa

SEQ ID NO: 97636 - DNA, 20 bp, Artificial Sequence
  Description of Artificial Sequence: Synthetic oligonucleotide
  Target: ATXN1; (+) strand; PAM type: NRG; PAM sequence: CAG
acaagaaaagatcctatcat

SEQ ID NO: 97637 - DNA, 20 bp, Artificial Sequence
  Description of Artificial Sequence: Synthetic oligonucleotide
  Target: ATXN1; (+) strand; PAM type: NRG; PAM sequence: AAG
gaaaagatcctatcatcagt

SEQ ID NO: 97638 - DNA, 20 bp, Artificial Sequence
  Description of Artificial Sequence: Synthetic oligonucleotide
  Target: ATXN1; (+) strand; PAM type: NRG; PAM sequence: AGG
aaaagatcctatcatcagta

SEQ ID NO: 97639 - DNA, 20 bp, Artificial Sequence
  Description of Artificial Sequence: Synthetic oligonucleotide
  Target: ATXN1; (+) strand; PAM type: NRG; PAM sequence: AAG
tcagtaaggtaacgtatttg

SEQ ID NO: 97640 - DNA, 20 bp, Artificial Sequence
  Description of Artificial Sequence: Synthetic oligonucleotide
  Target: ATXN1; (+) strand; PAM type: NRG; PAM sequence: GAG
taaggtaacgtatttgaagc

SEQ ID NO: 97641 - DNA, 20 bp, Artificial Sequence
  Description of Artificial Sequence: Synthetic oligonucleotide
  Target: ATXN1; (+) strand; PAM type: NRG; PAM sequence: AGG
aaggtaacgtatttgaagcg

SEQ ID NO: 97642 - DNA, 20 bp, Artificial Sequence
  Description of Artificial Sequence: Synthetic oligonucleotide
  Target: ATXN1; (+) strand; PAM type: NRG; PAM sequence: AAG
aagcgaggtcatctatgtaa

SEQ ID NO: 97643 - DNA, 20 bp, Artificial Sequence
  Description of Artificial Sequence: Synthetic oligonucleotide
  Target: ATXN1; (+) strand; PAM type: NRG; PAM sequence: CAG
catctatgtaaaagaaatct

SEQ ID NO: 97644 - DNA, 20 bp, Artificial Sequence
  Description of Artificial Sequence: Synthetic oligonucleotide
  Target: ATXN1; (+) strand; PAM type: NRG; PAM sequence: CGG
tgtaaaagaaatctcagctc

SEQ ID NO: 97645 - DNA, 20 bp, Artificial Sequence
  Description of Artificial Sequence: Synthetic oligonucleotide
  Target: ATXN1; (+) strand; PAM type: NRG; PAM sequence: GAG
taaaagaaatctcagctccg

SEQ ID NO: 97646 - DNA, 20 bp, Artificial Sequence
  Description of Artificial Sequence: Synthetic oligonucleotide
  Target: ATXN1; (+) strand; PAM type: NRG; PAM sequence: TAG
aagaaatctcagctccggag

SEQ ID NO: 97647 - DNA, 20 bp, Artificial Sequence
  Description of Artificial Sequence: Synthetic oligonucleotide
  Target: ATXN1; (+) strand; PAM type: NRG; PAM sequence: GAG
gaaatctcagctccggagta

SEQ ID NO: 97648 - DNA, 20 bp, Artificial Sequence
  Description of Artificial Sequence: Synthetic oligonucleotide
  Target: ATXN1; (+) strand; PAM type: NRG; PAM sequence: AGG
aaatctcagctccggagtag

SEQ ID NO: 97649 - DNA, 20 bp, Artificial Sequence
  Description of Artificial Sequence: Synthetic oligonucleotide
  Target: ATXN1; (+) strand; PAM type: NRG; PAM sequence: AAG
gctccggagtagaggtgtgc

SEQ ID NO: 97650 - DNA, 20 bp, Artificial Sequence
  Description of Artificial Sequence: Synthetic oligonucleotide
  Target: ATXN1; (+) strand; PAM type: NRG; PAM sequence: TGG
gtagaggtgtgcaagttgtt

SEQ ID NO: 97651 - DNA, 20 bp, Artificial Sequence
  Description of Artificial Sequence: Synthetic oligonucleotide
  Target: ATXN1; (+) strand; PAM type: NRG; PAM sequence: GAG
agaggtgtgcaagttgtttg

SEQ ID NO: 97652 - DNA, 20 bp, Artificial Sequence
  Description of Artificial Sequence: Synthetic oligonucleotide
  Target: ATXN1; (+) strand; PAM type: NRG; PAM sequence: CAG
tgtttggagtttccctatgc

SEQ ID NO: 97653 - DNA, 20 bp, Artificial Sequence
  Description of Artificial Sequence: Synthetic oligonucleotide
  Target: ATXN1; (+) strand; PAM type: NRG; PAM sequence: TGG
cagaaacacaacactgtccg

SEQ ID NO: 97654 - DNA, 20 bp, Artificial Sequence
  Description of Artificial Sequence: Synthetic oligonucleotide
  Target: ATXN1; (+) strand; PAM type: NRG; PAM sequence: AAG
acacaacactgtccgtggaa

SEQ ID NO: 97655 - DNA, 20 bp, Artificial Sequence
  Description of Artificial Sequence: Synthetic oligonucleotide
  Target: ATXN1; (+) strand; PAM type: NRG; PAM sequence: GAG
acaacactgtccgtggaaaa

SEQ ID NO: 97656 - DNA, 20 bp, Artificial Sequence
  Description of Artificial Sequence: Synthetic oligonucleotide
  Target: ATXN1; (+) strand; PAM type: NRG; PAM sequence: GAG
aacactgtccgtggaaaaga

SEQ ID NO: 97657 - DNA, 20 bp, Artificial Sequence
  Description of Artificial Sequence: Synthetic oligonucleotide
  Target: ATXN1; (+) strand; PAM type: NRG; PAM sequence: AGG
acactgtccgtggaaaagag

SEQ ID NO: 97658 - DNA, 20 bp, Artificial Sequence
  Description of Artificial Sequence: Synthetic oligonucleotide
  Target: ATXN1; (+) strand; PAM type: NRG; PAM sequence: TAG
aggaaaccaacccaacacaa

SEQ ID NO: 97659 - DNA, 20 bp, Artificial Sequence
  Description of Artificial Sequence: Synthetic oligonucleotide
  Target: ATXN1; (+) strand; PAM type: NRG; PAM sequence: CAG
aaaccaacccaacacaatag

SEQ ID NO: 97660 - DNA, 20 bp, Artificial Sequence
  Description of Artificial Sequence: Synthetic oligonucleotide
  Target: ATXN1; (+) strand; PAM type: NRG; PAM sequence: AAG
gatgcatgtgctttataaaa

SEQ ID NO: 97661 - DNA, 20 bp, Artificial Sequence
  Description of Artificial Sequence: Synthetic oligonucleotide
  Target: ATXN1; (+) strand; PAM type: NRG; PAM sequence: CAG
tgttcttaaattctctattt

SEQ ID NO: 97662 - DNA, 20 bp, Artificial Sequence
  Description of Artificial Sequence: Synthetic oligonucleotide
  Target: ATXN1; (+) strand; PAM type: NRG; PAM sequence: TGG
attctctatttcagaaattc

SEQ ID NO: 97663 - DNA, 20 bp, Artificial Sequence
  Description of Artificial Sequence: Synthetic oligonucleotide
  Target: ATXN1; (+) strand; PAM type: NRG; PAM sequence: GGG
ttctctatttcagaaattct

SEQ ID NO: 97664 - DNA, 20 bp, Artificial Sequence
  Description of Artificial Sequence: Synthetic oligonucleotide
  Target: ATXN1; (+) strand; PAM type: NRG; PAM sequence: TGG
ttctgggttaaaaacaaatg

SEQ ID NO: 97665 - DNA, 20 bp, Artificial Sequence
  Description of Artificial Sequence: Synthetic oligonucleotide
  Target: ATXN1; (+) strand; PAM type: NRG; PAM sequence: AAG
tgggttaaaaacaaatgtgg

SEQ ID NO: 97666 - DNA, 20 bp, Artificial Sequence
  Description of Artificial Sequence: Synthetic oligonucleotide
  Target: ATXN1; (+) strand; PAM type: NRG; PAM sequence: AAG
taaaaacaaatgtggaagca

SEQ ID NO: 97667 - DNA, 20 bp, Artificial Sequence
  Description of Artificial Sequence: Synthetic oligonucleotide
  Target: ATXN1; (+) strand; PAM type: NRG; PAM sequence: AGG
aaaaacaaatgtggaagcaa

SEQ ID NO: 97668 - DNA, 20 bp, Artificial Sequence
  Description of Artificial Sequence: Synthetic oligonucleotide
  Target: ATXN1; (+) strand; PAM type: NRG; PAM sequence: AAG
acgccacttaaaaaaaaaaa

SEQ ID NO: 97669 - DNA, 20 bp, Artificial Sequence
  Description of Artificial Sequence: Synthetic oligonucleotide
  Target: ATXN1; (+) strand; PAM type: NRG; PAM sequence: AAG
ctcctttcacatcaccaccg

SEQ ID NO: 97670 - DNA, 20 bp, Artificial Sequence
  Description of Artificial Sequence: Synthetic oligonucleotide
  Target: ATXN1; (+) strand; PAM type: NRG; PAM sequence: TGG
caccaccgaagaaaccgaat

SEQ ID NO: 97671 - DNA, 20 bp, Artificial Sequence
  Description of Artificial Sequence: Synthetic oligonucleotide
  Target: ATXN1; (+) strand; PAM type: NRG; PAM sequence: GGG
accaccgaagaaaccgaatt

SEQ ID NO: 97672 - DNA, 20 bp, Artificial Sequence
  Description of Artificial Sequence: Synthetic oligonucleotide
  Target: ATXN1; (+) strand; PAM type: NRG; PAM sequence: TGG
gaagaaaccgaattgggcca

SEQ ID NO: 97673 - DNA, 20 bp, Artificial Sequence
  Description of Artificial Sequence: Synthetic oligonucleotide
  Target: ATXN1; (+) strand; PAM type: NRG; PAM sequence: GAG
agaaaccgaattgggccatg

SEQ ID NO: 97674 - DNA, 20 bp, Artificial Sequence
  Description of Artificial Sequence: Synthetic oligonucleotide
  Target: ATXN1; (+) strand; PAM type: NRG; PAM sequence: TGG
aattgggccatggagtctgc

SEQ ID NO: 97675 - DNA, 20 bp, Artificial Sequence
  Description of Artificial Sequence: Synthetic oligonucleotide
  Target: ATXN1; (+) strand; PAM type: NRG; PAM sequence: TGG
ctgctggccctgttttcacc

SEQ ID NO: 97676 - DNA, 20 bp, Artificial Sequence
  Description of Artificial Sequence: Synthetic oligonucleotide
  Target: ATXN1; (+) strand; PAM type: NRG; PAM sequence: AAG
ttttcacctggtgcaaattg

SEQ ID NO: 97677 - DNA, 20 bp, Artificial Sequence
  Description of Artificial Sequence: Synthetic oligonucleotide
  Target: ATXN1; (+) strand; PAM type: NRG; PAM sequence: AAG
ctggtgcaaattgaagtgca

SEQ ID NO: 97678 - DNA, 20 bp, Artificial Sequence
  Description of Artificial Sequence: Synthetic oligonucleotide
  Target: ATXN1; (+) strand; PAM type: NRG; PAM sequence: AGG
tggtgcaaattgaagtgcaa

SEQ ID NO: 97679 - DNA, 20 bp, Artificial Sequence
  Description of Artificial Sequence: Synthetic oligonucleotide
  Target: ATXN1; (+) strand; PAM type: NRG; PAM sequence: GGG
ggtgcaaattgaagtgcaaa

SEQ ID NO: 97680 - DNA, 20 bp, Artificial Sequence
  Description of Artificial Sequence: Synthetic oligonucleotide
  Target: ATXN1; (+) strand; PAM type: NRG; PAM sequence: CAG
aattgaagtgcaaagggttt

SEQ ID NO: 97681 - DNA, 20 bp, Artificial Sequence
  Description of Artificial Sequence: Synthetic oligonucleotide
  Target: ATXN1; (+) strand; PAM type: NRG; PAM sequence: AAG
tgaagtgcaaagggtttcag

SEQ ID NO: 97682 - DNA, 20 bp, Artificial Sequence
  Description of Artificial Sequence: Synthetic oligonucleotide
  Target: ATXN1; (+) strand; PAM type: NRG; PAM sequence: AGG
gaagtgcaaagggtttcaga

SEQ ID NO: 97683 - DNA, 20 bp, Artificial Sequence
  Description of Artificial Sequence: Synthetic oligonucleotide
  Target: ATXN1; (+) strand; PAM type: NRG; PAM sequence: CAG
caaagggtttcagaaggcaa

SEQ ID NO: 97684 - DNA, 20 bp, Artificial Sequence
  Description of Artificial Sequence: Synthetic oligonucleotide
  Target: ATXN1; (+) strand; PAM type: NRG; PAM sequence: CAG
ggtttcagaaggcaacagac

SEQ ID NO: 97685 - DNA, 20 bp, Artificial Sequence
  Description of Artificial Sequence: Synthetic oligonucleotide
  Target: ATXN1; (+) strand; PAM type: NRG; PAM sequence: GAG
aggcaacagaccagtctgtt

SEQ ID NO: 97686 - DNA, 20 bp, Artificial Sequence
  Description of Artificial Sequence: Synthetic oligonucleotide
  Target: ATXN1; (+) strand; PAM type: NRG; PAM sequence: TGG
ccagtctgttgagctgcttg

SEQ ID NO: 97687 - DNA, 20 bp, Artificial Sequence
  Description of Artificial Sequence: Synthetic oligonucleotide
  Target: ATXN1; (+) strand; PAM type: NRG; PAM sequence: CAG
gctgcttgtggttcatgaaa

SEQ ID NO: 97688 - DNA, 20 bp, Artificial Sequence
  Description of Artificial Sequence: Synthetic oligonucleotide
  Target: ATXN1; (+) strand; PAM type: NRG; PAM sequence: TAG
gcttgtggttcatgaaacag

SEQ ID NO: 97689 - DNA, 20 bp, Artificial Sequence
  Description of Artificial Sequence: Synthetic oligonucleotide
  Target: ATXN1; (+) strand; PAM type: NRG; PAM sequence: CAG
agtagccatgacaaccaaca

SEQ ID NO: 97690 - DNA, 20 bp, Artificial Sequence
  Description of Artificial Sequence: Synthetic oligonucleotide
  Target: ATXN1; (+) strand; PAM type: NRG; PAM sequence: AAG
catgacaaccaacacagctc

SEQ ID NO: 97691 - DNA, 20 bp, Artificial Sequence
  Description of Artificial Sequence: Synthetic oligonucleotide
  Target: ATXN1; (+) strand; PAM type: NRG; PAM sequence: AAG
gacaaccaacacagctcaag

SEQ ID NO: 97692 - DNA, 20 bp, Artificial Sequence
  Description of Artificial Sequence: Synthetic oligonucleotide
  Target: ATXN1; (+) strand; PAM type: NRG; PAM sequence: CGG
ccaacacagctcaagaagcc

SEQ ID NO: 97693 - DNA, 20 bp, Artificial Sequence
  Description of Artificial Sequence: Synthetic oligonucleotide
  Target: ATXN1; (+) strand; PAM type: NRG; PAM sequence: CGG
agctcaagaagcccggcctt

SEQ ID NO: 97694 - DNA, 20 bp, Artificial Sequence
  Description of Artificial Sequence: Synthetic oligonucleotide
  Target: ATXN1; (+) strand; PAM type: NRG; PAM sequence: GAG
gaagcccggccttcggtacc

SEQ ID NO: 97695 - DNA, 20 bp, Artificial Sequence
  Description of Artificial Sequence: Synthetic oligonucleotide
  Target: ATXN1; (+) strand; PAM type: NRG; PAM sequence: GAG
agcccggccttcggtaccga

SEQ ID NO: 97696 - DNA, 20 bp, Artificial Sequence
  Description of Artificial Sequence: Synthetic oligonucleotide
  Target: ATXN1; (+) strand; PAM type: NRG; PAM sequence: TAG
ttcctcacccatatctgaaa

SEQ ID NO: 97697 - DNA, 20 bp, Artificial Sequence
  Description of Artificial Sequence: Synthetic oligonucleotide
  Target: ATXN1; (+) strand; PAM type: NRG; PAM sequence: CGG
cacccatatctgaaatagca

SEQ ID NO: 97698 - DNA, 20 bp, Artificial Sequence
  Description of Artificial Sequence: Synthetic oligonucleotide
  Target: ATXN1; (+) strand; PAM type: NRG; PAM sequence: TAG
tatctgaaatagcacggtat

SEQ ID NO: 97699 - DNA, 20 bp, Artificial Sequence
  Description of Artificial Sequence: Synthetic oligonucleotide
  Target: ATXN1; (+) strand; PAM type: NRG; PAM sequence: AAG
cacggtattagtgtcttcaa

SEQ ID NO: 97700 - DNA, 20 bp, Artificial Sequence
  Description of Artificial Sequence: Synthetic oligonucleotide
  Target: ATXN1; (+) strand; PAM type: NRG; PAM sequence: TGG
attagtgtcttcaaaagcat

SEQ ID NO: 97701 - DNA, 20 bp, Artificial Sequence
  Description of Artificial Sequence: Synthetic oligonucleotide
  Target: ATXN1; (+) strand; PAM type: NRG; PAM sequence: GAG
tagtgtcttcaaaagcattg

SEQ ID NO: 97702 - DNA, 20 bp, Artificial Sequence
  Description of Artificial Sequence: Synthetic oligonucleotide
  Target: ATXN1; (+) strand; PAM type: NRG; PAM sequence: AAG
ggagatttttctctctatga

SEQ ID NO: 97703 - DNA, 20 bp, Artificial Sequence
  Description of Artificial Sequence: Synthetic oligonucleotide
  Target: ATXN1; (+) strand; PAM type: NRG; PAM sequence: TAG
ttttctctctatgaaagaaa

SEQ ID NO: 97704 - DNA, 20 bp, Artificial Sequence
  Description of Artificial Sequence: Synthetic oligonucleotide
  Target: ATXN1; (+) strand; PAM type: NRG; PAM sequence: AGG
tttctctctatgaaagaaat

SEQ ID NO: 97705 - DNA, 20 bp, Artificial Sequence
  Description of Artificial Sequence: Synthetic oligonucleotide
  Target: ATXN1; (+) strand; PAM type: NRG; PAM sequence: TAG
atgaaagaaataggtttcct

SEQ ID NO: 97706 - DNA, 20 bp, Artificial Sequence
  Description of Artificial Sequence: Synthetic oligonucleotide
  Target: ATXN1; (+) strand; PAM type: NRG; PAM sequence: TAG
aaagaaataggtttccttag

SEQ ID NO: 97707 - DNA, 20 bp, Artificial Sequence
  Description of Artificial Sequence: Synthetic oligonucleotide
  Target: ATXN1; (+) strand; PAM type: NRG; PAM sequence: CAG
ataggtttccttagtagtca

SEQ ID NO: 97708 - DNA, 20 bp, Artificial Sequence
  Description of Artificial Sequence: Synthetic oligonucleotide
  Target: ATXN1; (+) strand; PAM type: NRG; PAM sequence: AAG
cttagtagtcacagatgtta

SEQ ID NO: 97709 - DNA, 20 bp, Artificial Sequence
  Description of Artificial Sequence: Synthetic oligonucleotide
  Target: ATXN1; (+) strand; PAM type: NRG; PAM sequence: AGG
ttagtagtcacagatgttaa

SEQ ID NO: 97710 - DNA, 20 bp, Artificial Sequence
  Description of Artificial Sequence: Synthetic oligonucleotide
  Target: ATXN1; (+) strand; PAM type: NRG; PAM sequence: GGG
tagtagtcacagatgttaaa

SEQ ID NO: 97711 - DNA, 20 bp, Artificial Sequence
  Description of Artificial Sequence: Synthetic oligonucleotide
  Target: ATXN1; (+) strand; PAM type: NRG; PAM sequence: CAG
aaacaaaacaaaacaaaatc

SEQ ID NO: 97712 - DNA, 20 bp, Artificial Sequence
  Description of Artificial Sequence: Synthetic oligonucleotide
  Target: ATXN1; (+) strand; PAM type: NRG; PAM sequence: GAG
acaaaacaaaacaaaatcca

SEQ ID NO: 97713 - DNA, 20 bp, Artificial Sequence
  Description of Artificial Sequence: Synthetic oligonucleotide
  Target: ATXN1; (+) strand; PAM type: NRG; PAM sequence: TGG
acaacaacaaaaataaattt

SEQ ID NO: 97714 - DNA, 20 bp, Artificial Sequence
  Description of Artificial Sequence: Synthetic oligonucleotide
  Target: ATXN1; (+) strand; PAM type: NRG; PAM sequence: CAG
taaattttggcaacatattt

SEQ ID NO: 97715 - DNA, 20 bp, Artificial Sequence
  Description of Artificial Sequence: Synthetic oligonucleotide
  Target: ATXN1; (+) strand; PAM type: NRG; PAM sequence: AAG
tttggcaacatatttcagta

SEQ ID NO: 97716 - DNA, 20 bp, Artificial Sequence
  Description of Artificial Sequence: Synthetic oligonucleotide
  Target: ATXN1; (+) strand; PAM type: NRG; PAM sequence: AAG
agtaaagatcaaactgtgca

SEQ ID NO: 97717 - DNA, 20 bp, Artificial Sequence
  Description of Artificial Sequence: Synthetic oligonucleotide
  Target: ATXN1; (+) strand; PAM type: NRG; PAM sequence: GAG
taaagatcaaactgtgcaaa

SEQ ID NO: 97718 - DNA, 20 bp, Artificial Sequence
  Description of Artificial Sequence: Synthetic oligonucleotide
  Target: ATXN1; (+) strand; PAM type: NRG; PAM sequence: TGG
agatcaaactgtgcaaagag

SEQ ID NO: 97719 - DNA, 20 bp, Artificial Sequence
  Description of Artificial Sequence: Synthetic oligonucleotide
  Target: ATXN1; (+) strand; PAM type: NRG; PAM sequence: TAG
agagtggattttatgattac

SEQ ID NO: 97720 - DNA, 20 bp, Artificial Sequence
  Description of Artificial Sequence: Synthetic oligonucleotide
  Target: ATXN1; (+) strand; PAM type: NRG; PAM sequence: AGG
gagtggattttatgattact

SEQ ID NO: 97721 - DNA, 20 bp, Artificial Sequence
  Description of Artificial Sequence: Synthetic oligonucleotide
  Target: ATXN1; (+) strand; PAM type: NRG; PAM sequence: GAG
gtggattttatgattactag

SEQ ID NO: 97722 - DNA, 20 bp, Artificial Sequence
  Description of Artificial Sequence: Synthetic oligonucleotide
  Target: ATXN1; (+) strand; PAM type: NRG; PAM sequence: CAG
tactgttcatcttgaacatg

SEQ ID NO: 97723 - DNA, 20 bp, Artificial Sequence
  Description of Artificial Sequence: Synthetic oligonucleotide
  Target: ATXN1; (+) strand; PAM type: NRG; PAM sequence: CGG
gcattatattgcaatctatg

SEQ ID NO: 97724 - DNA, 20 bp, Artificial Sequence
  Description of Artificial Sequence: Synthetic oligonucleotide
  Target: ATXN1; (+) strand; PAM type: NRG; PAM sequence: AAG
ttgcaatctatgcggtatct

SEQ ID NO: 97725 - DNA, 20 bp, Artificial Sequence
  Description of Artificial Sequence: Synthetic oligonucleotide
  Target: ATXN1; (+) strand; PAM type: NRG; PAM sequence: AGG
tgcaatctatgcggtatcta

SEQ ID NO: 97726 - DNA, 20 bp, Artificial Sequence
  Description of Artificial Sequence: Synthetic oligonucleotide
  Target: ATXN1; (+) strand; PAM type: NRG; PAM sequence: GAG
caatctatgcggtatctaag

SEQ ID NO: 97727 - DNA, 20 bp, Artificial Sequence
  Description of Artificial Sequence: Synthetic oligonucleotide
  Target: ATXN1; (+) strand; PAM type: NRG; PAM sequence: AAG
gtatctaaggagtaatccac

SEQ ID NO: 97728 - DNA, 20 bp, Artificial Sequence
  Description of Artificial Sequence: Synthetic oligonucleotide
  Target: ATXN1; (+) strand; PAM type: NRG; PAM sequence: CAG
aaggagtaatccacaagatg

SEQ ID NO: 97729 - DNA, 20 bp, Artificial Sequence
  Description of Artificial Sequence: Synthetic oligonucleotide
  Target: ATXN1; (+) strand; PAM type: NRG; PAM sequence: AGG
aggagtaatccacaagatgc

SEQ ID NO: 97730 - DNA, 20 bp, Artificial Sequence
  Description of Artificial Sequence: Synthetic oligonucleotide
  Target: ATXN1; (+) strand; PAM type: NRG; PAM sequence: CAG
gaaattgtacaaccctactc

SEQ ID NO: 97731 - DNA, 20 bp, Artificial Sequence
  Description of Artificial Sequence: Synthetic oligonucleotide
  Target: ATXN1; (+) strand; PAM type: NRG; PAM sequence: GAG
aattgtacaaccctactcca

SEQ ID NO: 97732 - DNA, 20 bp, Artificial Sequence
  Description of Artificial Sequence: Synthetic oligonucleotide
  Target: ATXN1; (+) strand; PAM type: NRG; PAM sequence: CAG
tgtacaaccctactccagag

SEQ ID NO: 97733 - DNA, 20 bp, Artificial Sequence
  Description of Artificial Sequence: Synthetic oligonucleotide
  Target: ATXN1; (+) strand; PAM type: NRG; PAM sequence: AAG
accctactccagagcagtca

SEQ ID NO: 97734 - DNA, 20 bp, Artificial Sequence
  Description of Artificial Sequence: Synthetic oligonucleotide
  Target: ATXN1; (+) strand; PAM type: NRG; PAM sequence: TGG
agcagtcaaagtgctgcttc

SEQ ID NO: 97735 - DNA, 20 bp, Artificial Sequence
  Description of Artificial Sequence: Synthetic oligonucleotide
  Target: ATXN1; (+) strand; PAM type: NRG; PAM sequence: CAG
agtgctgcttctggacacgt

SEQ ID NO: 97736 - DNA, 20 bp, Artificial Sequence
  Description of Artificial Sequence: Synthetic oligonucleotide
  Target: ATXN1; (+) strand; PAM type: NRG; PAM sequence: GAG
cacacacctgccccgtccct

SEQ ID NO: 97737 - DNA, 20 bp, Artificial Sequence
  Description of Artificial Sequence: Synthetic oligonucleotide
  Target: ATXN1; (+) strand; PAM type: NRG; PAM sequence: AAG
cacctgccccgtccctgaga

SEQ ID NO: 97738 - DNA, 20 bp, Artificial Sequence
  Description of Artificial Sequence: Synthetic oligonucleotide
  Target: ATXN1; (+) strand; PAM type: NRG; PAM sequence: GAG
cctgccccgtccctgagaaa

SEQ ID NO: 97739 - DNA, 20 bp, Artificial Sequence
  Description of Artificial Sequence: Synthetic oligonucleotide
  Target: ATXN1; (+) strand; PAM type: NRG; PAM sequence: AGG
ctgccccgtccctgagaaag

SEQ ID NO: 97740 - DNA, 20 bp, Artificial Sequence
  Description of Artificial Sequence: Synthetic oligonucleotide
  Target: ATXN1; (+) strand; PAM type: NRG; PAM sequence: AAG
tccctgagaaagaggtgtga

SEQ ID NO: 97741 - DNA, 20 bp, Artificial Sequence
  Description of Artificial Sequence: Synthetic oligonucleotide
  Target: ATXN1; (+) strand; PAM type: NRG; PAM sequence: AGG
ccctgagaaagaggtgtgaa

SEQ ID NO: 97742 - DNA, 20 bp, Artificial Sequence
  Description of Artificial Sequence: Synthetic oligonucleotide
  Target: ATXN1; (+) strand; PAM type: NRG; PAM sequence: CAG
aagaggtgtgaaaggttccg

SEQ ID NO: 97743 - DNA, 20 bp, Artificial Sequence
  Description of Artificial Sequence: Synthetic oligonucleotide
  Target: ATXN1; (+) strand; PAM type: NRG; PAM sequence: GAG
gaggtgtgaaaggttccgca

SEQ ID NO: 97744 - DNA, 20 bp, Artificial Sequence
  Description of Artificial Sequence: Synthetic oligonucleotide
  Target: ATXN1; (+) strand; PAM type: NRG; PAM sequence: TAG
aaggttccgcagagtccctt

SEQ ID NO: 97745 - DNA, 20 bp, Artificial Sequence
  Description of Artificial Sequence: Synthetic oligonucleotide
  Target: ATXN1; (+) strand; PAM type: NRG; PAM sequence: AGG
aggttccgcagagtcccttt

SEQ ID NO: 97746 - DNA, 20 bp, Artificial Sequence
  Description of Artificial Sequence: Synthetic oligonucleotide
  Target: ATXN1; (+) strand; PAM type: NRG; PAM sequence: GGG
ggttccgcagagtcccttta

SEQ ID NO: 97747 - DNA, 20 bp, Artificial Sequence
  Description of Artificial Sequence: Synthetic oligonucleotide
  Target: ATXN1; (+) strand; PAM type: NRG; PAM sequence: GGG
gttccgcagagtccctttag

SEQ ID NO: 97748 - DNA, 20 bp, Artificial Sequence
  Description of Artificial Sequence: Synthetic oligonucleotide
  Target: ATXN1; (+) strand; PAM type: NRG; PAM sequence: GAG
tccgcagagtccctttaggg

SEQ ID NO: 97749 - DNA, 20 bp, Artificial Sequence
  Description of Artificial Sequence: Synthetic oligonucleotide
  Target: ATXN1; (+) strand; PAM type: NRG; PAM sequence: AAG
gcagagtccctttaggggag

SEQ ID NO: 97750 - DNA, 20 bp, Artificial Sequence
  Description of Artificial Sequence: Synthetic oligonucleotide
  Target: ATXN1; (+) strand; PAM type: NRG; PAM sequence: AGG
cagagtccctttaggggaga

SEQ ID NO: 97751 - DNA, 20 bp, Artificial Sequence
  Description of Artificial Sequence: Synthetic oligonucleotide
  Target: ATXN1; (+) strand; PAM type: NRG; PAM sequence: GAG
gagtccctttaggggagaag

SEQ ID NO: 97752 - DNA, 20 bp, Artificial Sequence
  Description of Artificial Sequence: Synthetic oligonucleotide
  Target: ATXN1; (+) strand; PAM type: NRG; PAM sequence: AGG
agtccctttaggggagaagg

SEQ ID NO: 97753 - DNA, 20 bp, Artificial Sequence
  Description of Artificial Sequence: Synthetic oligonucleotide
  Target: ATXN1; (+) strand; PAM type: NRG; PAM sequence: GGG
gtccctttaggggagaagga

SEQ ID NO: 97754 - DNA, 20 bp, Artificial Sequence
  Description of Artificial Sequence: Synthetic oligonucleotide
  Target: ATXN1; (+) strand; PAM type: NRG; PAM sequence: TGG
ggagggatgctgccacttcc

SEQ ID NO: 97755 - DNA, 20 bp, Artificial Sequence
  Description of Artificial Sequence: Synthetic oligonucleotide
  Target: ATXN1; (+) strand; PAM type: NRG; PAM sequence: TGG
gggatgctgccacttcctgg

SEQ ID NO: 97756 - DNA, 20 bp, Artificial Sequence
  Description of Artificial Sequence: Synthetic oligonucleotide
  Target: ATXN1; (+) strand; PAM type: NRG; PAM sequence: GGG
ggatgctgccacttcctggt

SEQ ID NO: 97757 - DNA, 20 bp, Artificial Sequence
  Description of Artificial Sequence: Synthetic oligonucleotide
  Target: ATXN1; (+) strand; PAM type: NRG; PAM sequence: GGG
gatgctgccacttcctggtg

SEQ ID NO: 97758 - DNA, 20 bp, Artificial Sequence
  Description of Artificial Sequence: Synthetic oligonucleotide
  Target: ATXN1; (+) strand; PAM type: NRG; PAM sequence: GGG
atgctgccacttcctggtgg

SEQ ID NO: 97759 - DNA, 20 bp, Artificial Sequence
  Description of Artificial Sequence: Synthetic oligonucleotide
  Target: ATXN1; (+) strand; PAM type: NRG; PAM sequence: GGG
tgctgccacttcctggtggg

SEQ ID NO: 97760 - DNA, 20 bp, Artificial Sequence
  Description of Artificial Sequence: Synthetic oligonucleotide
  Target: ATXN1; (+) strand; PAM type: NRG; PAM sequence: CAG
aacccaacacactcacctaa

SEQ ID NO: 97761 - DNA, 20 bp, Artificial Sequence
  Description of Artificial Sequence: Synthetic oligonucleotide
  Target: ATXN1; (+) strand; PAM type: NRG; PAM sequence: TAG
cactcacctaacagaaaaca

SEQ ID NO: 97762 - DNA, 20 bp, Artificial Sequence
  Description of Artificial Sequence: Synthetic oligonucleotide
  Target: ATXN1; (+) strand; PAM type: NRG; PAM sequence: GAG
ctcacctaacagaaaacata

SEQ ID NO: 97763 - DNA, 20 bp, Artificial Sequence
  Description of Artificial Sequence: Synthetic oligonucleotide
  Target: ATXN1; (+) strand; PAM type: NRG; PAM sequence: AGG
tcacctaacagaaaacatag

SEQ ID NO: 97764 - DNA, 20 bp, Artificial Sequence
  Description of Artificial Sequence: Synthetic oligonucleotide
  Target: ATXN1; (+) strand; PAM type: NRG; PAM sequence: AAG
acatagaggctcacaattcc

SEQ ID NO: 97765 - DNA, 20 bp, Artificial Sequence
  Description of Artificial Sequence: Synthetic oligonucleotide
  Target: ATXN1; (+) strand; PAM type: NRG; PAM sequence: TAG
agaggctcacaattccaagt

SEQ ID NO: 97766 - DNA, 20 bp, Artificial Sequence
  Description of Artificial Sequence: Synthetic oligonucleotide
  Target: ATXN1; (+) strand; PAM type: NRG; PAM sequence: TGG
tcacaattccaagttagaaa

SEQ ID NO: 97767 - DNA, 20 bp, Artificial Sequence
  Description of Artificial Sequence: Synthetic oligonucleotide
  Target: ATXN1; (+) strand; PAM type: NRG; PAM sequence: GGG
cacaattccaagttagaaat

SEQ ID NO: 97768 - DNA, 20 bp, Artificial Sequence
  Description of Artificial Sequence: Synthetic oligonucleotide
  Target: ATXN1; (+) strand; PAM type: NRG; PAM sequence: CAG
agaaatgggatcaacaacaa

SEQ ID NO: 97769 - DNA, 20 bp, Artificial Sequence
  Description of Artificial Sequence: Synthetic oligonucleotide
  Target: ATXN1; (+) strand; PAM type: NRG; PAM sequence: TGG
caaatcatcccaaactaaac

SEQ ID NO: 97770 - DNA, 20 bp, Artificial Sequence
  Description of Artificial Sequence: Synthetic oligonucleotide
  Target: ATXN1; (+) strand; PAM type: NRG; PAM sequence: GGG
aaatcatcccaaactaaact

SEQ ID NO: 97771 - DNA, 20 bp, Artificial Sequence
  Description of Artificial Sequence: Synthetic oligonucleotide
  Target: ATXN1; (+) strand; PAM type: NRG; PAM sequence: GAG
catcccaaactaaactgggt

SEQ ID NO: 97772 - DNA, 20 bp, Artificial Sequence
  Description of Artificial Sequence: Synthetic oligonucleotide
  Target: ATXN1; (+) strand; PAM type: NRG; PAM sequence: TAG
ccaaactaaactgggtgagt

SEQ ID NO: 97773 - DNA, 20 bp, Artificial Sequence
  Description of Artificial Sequence: Synthetic oligonucleotide
  Target: ATXN1; (+) strand; PAM type: NRG; PAM sequence: AGG
caaactaaactgggtgagtt

SEQ ID NO: 97774 - DNA, 20 bp, Artificial Sequence
  Description of Artificial Sequence: Synthetic oligonucleotide
  Target: ATXN1; (+) strand; PAM type: NRG; PAM sequence: GGG
aaactaaactgggtgagtta

SEQ ID NO: 97775 - DNA, 20 bp, Artificial Sequence
  Description of Artificial Sequence: Synthetic oligonucleotide
  Target: ATXN1; (+) strand; PAM type: NRG; PAM sequence: AAG
ggtgagttagggaaaacgaa

SEQ ID NO: 97776 - DNA, 20 bp, Artificial Sequence
  Description of Artificial Sequence: Synthetic oligonucleotide
  Target: ATXN1; (+) strand; PAM type: NRG; PAM sequence: TAG
aaacgaaaagttgaccaaca

SEQ ID NO: 97777 - DNA, 20 bp, Artificial Sequence
  Description of Artificial Sequence: Synthetic oligonucleotide
  Target: ATXN1; (+) strand; PAM type: NRG; PAM sequence: AAG
aacatagaaaattatcctga

SEQ ID NO: 97778 - DNA, 20 bp, Artificial Sequence
  Description of Artificial Sequence: Synthetic oligonucleotide
  Target: ATXN1; (+) strand; PAM type: NRG; PAM sequence: TGG
gtccaaatgaaaattcaatt

SEQ ID NO: 97779 - DNA, 20 bp, Artificial Sequence
  Description of Artificial Sequence: Synthetic oligonucleotide
  Target: ATXN1; (+) strand; PAM type: NRG; PAM sequence: AAG
aatttggatttccactttaa

SEQ ID NO: 97780 - DNA, 20 bp, Artificial Sequence
  Description of Artificial Sequence: Synthetic oligonucleotide
  Target: ATXN1; (+) strand; PAM type: NRG; PAM sequence: GAG
atttccactttaaaagatct

SEQ ID NO: 97781 - DNA, 20 bp, Artificial Sequence
  Description of Artificial Sequence: Synthetic oligonucleotide
  Target: ATXN1; (+) strand; PAM type: NRG; PAM sequence: AGG
tttccactttaaaagatctg

SEQ ID NO: 97782 - DNA, 20 bp, Artificial Sequence
  Description of Artificial Sequence: Synthetic oligonucleotide
  Target: ATXN1; (+) strand; PAM type: NRG; PAM sequence: AAG
cactttaaaagatctgaggt

SEQ ID NO: 97783 - DNA, 20 bp, Artificial Sequence
  Description of Artificial Sequence: Synthetic oligonucleotide
  Target: ATXN1; (+) strand; PAM type: NRG; PAM sequence: TGG
tttaaaagatctgaggtaag

SEQ ID NO: 97784 - DNA, 20 bp, Artificial Sequence
  Description of Artificial Sequence: Synthetic oligonucleotide
  Target: ATXN1; (+) strand; PAM type: NRG; PAM sequence: CAG
cctccctcccccctctgccc

SEQ ID NO: 97785 - DNA, 20 bp, Artificial Sequence
  Description of Artificial Sequence: Synthetic oligonucleotide
  Target: ATXN1; (+) strand; PAM type: NRG; PAM sequence: TGG
ctcccccctctgccccagtg

SEQ ID NO: 97786 - DNA, 20 bp, Artificial Sequence
  Description of Artificial Sequence: Synthetic oligonucleotide
  Target: ATXN1; (+) strand; PAM type: NRG; PAM sequence: CAG
ccctctgccccagtgtggcc

SEQ ID NO: 97787 - DNA, 20 bp, Artificial Sequence
  Description of Artificial Sequence: Synthetic oligonucleotide
  Target: ATXN1; (+) strand; PAM type: NRG; PAM sequence: AAG
gacaaactgaaataattctt

SEQ ID NO: 97788 - DNA, 20 bp, Artificial Sequence
  Description of Artificial Sequence: Synthetic oligonucleotide
  Target: ATXN1; (+) strand; PAM type: NRG; PAM sequence: AAG
attcttaagttaaacattct

SEQ ID NO: 97789 - DNA, 20 bp, Artificial Sequence
  Description of Artificial Sequence: Synthetic oligonucleotide
  Target: ATXN1; (+) strand; PAM type: NRG; PAM sequence: AGG
ttcttaagttaaacattcta

SEQ ID NO: 97790 - DNA, 20 bp, Artificial Sequence
  Description of Artificial Sequence: Synthetic oligonucleotide
  Target: ATXN1; (+) strand; PAM type: NRG; PAM sequence: CAG
aagttaaacattctaaggaa

SEQ ID NO: 97791 - DNA, 20 bp, Artificial Sequence
  Description of Artificial Sequence: Synthetic oligonucleotide
  Target: ATXN1; (+) strand; PAM type: NRG; PAM sequence: TAG
gaacagtcattttatatatt

SEQ ID NO: 97792 - DNA, 20 bp, Artificial Sequence
  Description of Artificial Sequence: Synthetic oligonucleotide
  Target: ATXN1; (+) strand; PAM type: NRG; PAM sequence: TAG
tttatatatttagaaatccc

SEQ ID NO: 97793 - DNA, 20 bp, Artificial Sequence
  Description of Artificial Sequence: Synthetic oligonucleotide
  Target: ATXN1; (+) strand; PAM type: NRG; PAM sequence: AAG
tatatttagaaatccctaga

SEQ ID NO: 97794 - DNA, 20 bp, Artificial Sequence
  Description of Artificial Sequence: Synthetic oligonucleotide
  Target: ATXN1; (+) strand; PAM type: NRG; PAM sequence: GAG
tatttagaaatccctagaaa

SEQ ID NO: 97795 - DNA, 20 bp, Artificial Sequence
  Description of Artificial Sequence: Synthetic oligonucleotide
  Target: ATXN1; (+) strand; PAM type: NRG; PAM sequence: GAG
tttagaaatccctagaaaga

SEQ ID NO: 97796 - DNA, 20 bp, Artificial Sequence
  Description of Artificial Sequence: Synthetic oligonucleotide
  Target: ATXN1; (+) strand; PAM type: NRG; PAM sequence: AGG
ttagaaatccctagaaagag

SEQ ID NO: 97797 - DNA, 20 bp, Artificial Sequence
  Description of Artificial Sequence: Synthetic oligonucleotide
  Target: ATXN1; (+) strand; PAM type: NRG; PAM sequence: TGG
aaagagaggttcttgtttgt

SEQ ID NO: 97798 - DNA, 20 bp, Artificial Sequence
  Description of Artificial Sequence: Synthetic oligonucleotide
  Target: ATXN1; (+) strand; PAM type: NRG; PAM sequence: TAG
gtttgttggtttcttattaa

SEQ ID NO: 97799 - DNA, 20 bp, Artificial Sequence
  Description of Artificial Sequence: Synthetic oligonucleotide
  Target: ATXN1; (+) strand; PAM type: NRG; PAM sequence: TGG
tttcgccctgactaatttct

SEQ ID NO: 97800 - DNA, 20 bp, Artificial Sequence
  Description of Artificial Sequence: Synthetic oligonucleotide
  Target: ATXN1; (+) strand; PAM type: NRG; PAM sequence: AAG
gtgttccattgtaaacgcaa

SEQ ID NO: 97801 - DNA, 20 bp, Artificial Sequence
  Description of Artificial Sequence: Synthetic oligonucleotide
  Target: ATXN1; (+) strand; PAM type: NRG; PAM sequence: AGG
tgttccattgtaaacgcaaa

SEQ ID NO: 97802 - DNA, 20 bp, Artificial Sequence
  Description of Artificial Sequence: Synthetic oligonucleotide
  Target: ATXN1; (+) strand; PAM type: NRG; PAM sequence: TAG
cgcaaaaggcctgctgttac

SEQ ID NO: 97803 - DNA, 20 bp, Artificial Sequence
  Description of Artificial Sequence: Synthetic oligonucleotide
  Target: ATXN1; (+) strand; PAM type: NRG; PAM sequence: TGG
tgctgttactagtttaaaaa

SEQ ID NO: 97804 - DNA, 20 bp, Artificial Sequence
  Description of Artificial Sequence: Synthetic oligonucleotide
  Target: ATXN1; (+) strand; PAM type: NRG; PAM sequence: CAG
actagtttaaaaatggaaaa

SEQ ID NO: 97805 - DNA, 20 bp, Artificial Sequence
  Description of Artificial Sequence: Synthetic oligonucleotide
  Target: ATXN1; (+) strand; PAM type: NRG; PAM sequence: AGG
ctagtttaaaaatggaaaac

SEQ ID NO: 97806 - DNA, 20 bp, Artificial Sequence
  Description of Artificial Sequence: Synthetic oligonucleotide
  Target: ATXN1; (+) strand; PAM type: NRG; PAM sequence: AAG
tttaaaaatggaaaacagga

SEQ ID NO: 97807 - DNA, 20 bp, Artificial Sequence
  Description of Artificial Sequence: Synthetic oligonucleotide
  Target: ATXN1; (+) strand; PAM type: NRG; PAM sequence: AAG
aaaatggaaaacaggaaaga

SEQ ID NO: 97808 - DNA, 20 bp, Artificial Sequence
  Description of Artificial Sequence: Synthetic oligonucleotide
  Target: ATXN1; (+) strand; PAM type: NRG; PAM sequence: AAG
aaacaggaaagaaagaacaa

SEQ ID NO: 97809 - DNA, 20 bp, Artificial Sequence
  Description of Artificial Sequence: Synthetic oligonucleotide
  Target: ATXN1; (+) strand; PAM type: NRG; PAM sequence: CGG
aggaaagaaagaacaaaaga

SEQ ID NO: 97810 - DNA, 20 bp, Artificial Sequence
  Description of Artificial Sequence: Synthetic oligonucleotide
  Target: ATXN1; (+) strand; PAM type: NRG; PAM sequence: CGG
aaagaacaaaagacggctgt

SEQ ID NO: 97811 - DNA, 20 bp, Artificial Sequence
  Description of Artificial Sequence: Synthetic oligonucleotide
  Target: ATXN1; (+) strand; PAM type: NRG; PAM sequence: AAG
ggctgtcggtaaatattgca

SEQ ID NO: 97812 - DNA, 20 bp, Artificial Sequence
  Description of Artificial Sequence: Synthetic oligonucleotide
  Target: ATXN1; (+) strand; PAM type: NRG; PAM sequence: TGG
tgtcggtaaatattgcaaag

SEQ ID NO: 97813 - DNA, 20 bp, Artificial Sequence
  Description of Artificial Sequence: Synthetic oligonucleotide
  Target: ATXN1; (+) strand; PAM type: NRG; PAM sequence: TAG
taaatattgcaaagtggaca

SEQ ID NO: 97814 - DNA, 20 bp, Artificial Sequence
  Description of Artificial Sequence: Synthetic oligonucleotide
  Target: ATXN1; (+) strand; PAM type: NRG; PAM sequence: CAG
attgcaaagtggacatagta

SEQ ID NO: 97815 - DNA, 20 bp, Artificial Sequence
  Description of Artificial Sequence: Synthetic oligonucleotide
  Target: ATXN1; (+) strand; PAM type: NRG; PAM sequence: GAG
tgcaaagtggacatagtaca

SEQ ID NO: 97816 - DNA, 20 bp, Artificial Sequence
  Description of Artificial Sequence: Synthetic oligonucleotide
  Target: ATXN1; (+) strand; PAM type: NRG; PAM sequence: AGG
gcaaagtggacatagtacag

SEQ ID NO: 97817 - DNA, 20 bp, Artificial Sequence
  Description of Artificial Sequence: Synthetic oligonucleotide
  Target: ATXN1; (+) strand; PAM type: NRG; PAM sequence: TGG
ggacatagtacagaggcaca

SEQ ID NO: 97818 - DNA, 20 bp, Artificial Sequence
  Description of Artificial Sequence: Synthetic oligonucleotide
  Target: ATXN1; (+) strand; PAM type: NRG; PAM sequence: AAG
ggcacatggctgatccttgt

SEQ ID NO: 97819 - DNA, 20 bp, Artificial Sequence
  Description of Artificial Sequence: Synthetic oligonucleotide
  Target: ATXN1; (+) strand; PAM type: NRG; PAM sequence: CGG
gctgatccttgtaagctgaa

SEQ ID NO: 97820 - DNA, 20 bp, Artificial Sequence
  Description of Artificial Sequence: Synthetic oligonucleotide
  Target: ATXN1; (+) strand; PAM type: NRG; PAM sequence: AAG
ttgtaagctgaacggcaccg

SEQ ID NO: 97821 - DNA, 20 bp, Artificial Sequence
  Description of Artificial Sequence: Synthetic oligonucleotide
  Target: ATXN1; (+) strand; PAM type: NRG; PAM sequence: CAG
catcgttaatgtttgctaca

SEQ ID NO: 97822 - DNA, 20 bp, Artificial Sequence
  Description of Artificial Sequence: Synthetic oligonucleotide
  Target: ATXN1; (+) strand; PAM type: NRG; PAM sequence: AAG
cgttaatgtttgctacacag

SEQ ID NO: 97823 - DNA, 20 bp, Artificial Sequence
  Description of Artificial Sequence: Synthetic oligonucleotide
  Target: ATXN1; (+) strand; PAM type: NRG; PAM sequence: CGG
taatgtttgctacacagaag

SEQ ID NO: 97824 - DNA, 20 bp, Artificial Sequence
  Description of Artificial Sequence: Synthetic oligonucleotide
  Target: ATXN1; (+) strand; PAM type: NRG; PAM sequence: CAG
ttgctacacagaagcggtga

SEQ ID NO: 97825 - DNA, 20 bp, Artificial Sequence
  Description of Artificial Sequence: Synthetic oligonucleotide
  Target: ATXN1; (+) strand; PAM type: NRG; PAM sequence: GAG
gctacacagaagcggtgaca

SEQ ID NO: 97826 - DNA, 20 bp, Artificial Sequence
  Description of Artificial Sequence: Synthetic oligonucleotide
  Target: ATXN1; (+) strand; PAM type: NRG; PAM sequence: AGG
ctacacagaagcggtgacag

SEQ ID NO: 97827 - DNA, 20 bp, Artificial Sequence
  Description of Artificial Sequence: Synthetic oligonucleotide
  Target: ATXN1; (+) strand; PAM type: NRG; PAM sequence: TGG
agcggtgacagaggctgctc

SEQ ID NO: 97828 - DNA, 20 bp, Artificial Sequence
  Description of Artificial Sequence: Synthetic oligonucleotide
  Target: ATXN1; (+) strand; PAM type: NRG; PAM sequence: GGG
gcggtgacagaggctgctct

SEQ ID NO: 97829 - DNA, 20 bp, Artificial Sequence
  Description of Artificial Sequence: Synthetic oligonucleotide
  Target: ATXN1; (+) strand; PAM type: NRG; PAM sequence: GAG
ggtgacagaggctgctctgg

SEQ ID NO: 97830 - DNA, 20 bp, Artificial Sequence
  Description of Artificial Sequence: Synthetic oligonucleotide
  Target: ATXN1; (+) strand; PAM type: NRG; PAM sequence: CGG
agaggctgctctgggagcct

SEQ ID NO: 97831 - DNA, 20 bp, Artificial Sequence
  Description of Artificial Sequence: Synthetic oligonucleotide
  Target: ATXN1; (+) strand; PAM type: NRG; PAM sequence: GGG
gaggctgctctgggagcctc

SEQ ID NO: 97832 - DNA, 20 bp, Artificial Sequence
  Description of Artificial Sequence: Synthetic oligonucleotide
  Target: ATXN1; (+) strand; PAM type: NRG; PAM sequence: GGG
aggctgctctgggagcctcg

SEQ ID NO: 97833 - DNA, 20 bp, Artificial Sequence
  Description of Artificial Sequence: Synthetic oligonucleotide
  Target: ATXN1; (+) strand; PAM type: NRG; PAM sequence: CAG
ggcccgccaacgtctgcaaa

SEQ ID NO: 97834 - DNA, 20 bp, Artificial Sequence
  Description of Artificial Sequence: Synthetic oligonucleotide
  Target: ATXN1; (+) strand; PAM type: NRG; PAM sequence: AGG
gcccgccaacgtctgcaaac

SEQ ID NO: 97835 - DNA, 20 bp, Artificial Sequence
  Description of Artificial Sequence: Synthetic oligonucleotide
  Target: ATXN1; (+) strand; PAM type: NRG; PAM sequence: GAG
ccgccaacgtctgcaaacag

SEQ ID NO: 97836 - DNA, 20 bp, Artificial Sequence
  Description of Artificial Sequence: Synthetic oligonucleotide
  Target: ATXN1; (+) strand; PAM type: NRG; PAM sequence: AGG
cgccaacgtctgcaaacagg

SEQ ID NO: 97837 - DNA, 20 bp, Artificial Sequence
  Description of Artificial Sequence: Synthetic oligonucleotide
  Target: ATXN1; (+) strand; PAM type: NRG; PAM sequence: AAG
ctgtgcgttcttcctatttg

SEQ ID NO: 97838 - DNA, 20 bp, Artificial Sequence
  Description of Artificial Sequence: Synthetic oligonucleotide
  Target: ATXN1; (+) strand; PAM type: NRG; PAM sequence: GAG
gtgcgttcttcctatttgaa

SEQ ID NO: 97839 - DNA, 20 bp, Artificial Sequence
  Description of Artificial Sequence: Synthetic oligonucleotide
  Target: ATXN1; (+) strand; PAM type: NRG; PAM sequence: AAG
gttcttcctatttgaagaga

SEQ ID NO: 97840 - DNA, 20 bp, Artificial Sequence
  Description of Artificial Sequence: Synthetic oligonucleotide
  Target: ATXN1; (+) strand; PAM type: NRG; PAM sequence: AAG
tttgaagagaaagctgccac

SEQ ID NO: 97841 - DNA, 20 bp, Artificial Sequence
  Description of Artificial Sequence: Synthetic oligonucleotide
  Target: ATXN1; (+) strand; PAM type: NRG; PAM sequence: AGG
ttgaagagaaagctgccaca

SEQ ID NO: 97842 - DNA, 20 bp, Artificial Sequence
  Description of Artificial Sequence: Synthetic oligonucleotide
  Target: ATXN1; (+) strand; PAM type: NRG; PAM sequence: GGG
tgaagagaaagctgccacaa

SEQ ID NO: 97843 - DNA, 20 bp, Artificial Sequence
  Description of Artificial Sequence: Synthetic oligonucleotide
  Target: ATXN1; (+) strand; PAM type: NRG; PAM sequence: GAG
aagagaaagctgccacaagg

SEQ ID NO: 97844 - DNA, 20 bp, Artificial Sequence
  Description of Artificial Sequence: Synthetic oligonucleotide
  Target: ATXN1; (+) strand; PAM type: NRG; PAM sequence: TGG
agaaagctgccacaagggag

SEQ ID NO: 97845 - DNA, 20 bp, Artificial Sequence
  Description of Artificial Sequence: Synthetic oligonucleotide
  Target: ATXN1; (+) strand; PAM type: NRG; PAM sequence: TGG
ccacaagggagtggtgaccg

SEQ ID NO: 97846 - DNA, 20 bp, Artificial Sequence
  Description of Artificial Sequence: Synthetic oligonucleotide
  Target: ATXN1; (+) strand; PAM type: NRG; PAM sequence: GGG
cacaagggagtggtgaccgt

SEQ ID NO: 97847 - DNA, 20 bp, Artificial Sequence
  Description of Artificial Sequence: Synthetic oligonucleotide
  Target: ATXN1; (+) strand; PAM type: NRG; PAM sequence: TGG
aagggagtggtgaccgtggg

SEQ ID NO: 97848 - DNA, 20 bp, Artificial Sequence
  Description of Artificial Sequence: Synthetic oligonucleotide
  Target: ATXN1; (+) strand; PAM type: NRG; PAM sequence: CAG
ggagtggtgaccgtgggtgg

SEQ ID NO: 97849 - DNA, 20 bp, Artificial Sequence
  Description of Artificial Sequence: Synthetic oligonucleotide
  Target: ATXN1; (+) strand; PAM type: NRG; PAM sequence: AGG
gagtggtgaccgtgggtggc

SEQ ID NO: 97850 - DNA, 20 bp, Artificial Sequence
  Description of Artificial Sequence: Synthetic oligonucleotide
  Target: ATXN1; (+) strand; PAM type: NRG; PAM sequence: TGG
tggtgaccgtgggtggcagg

SEQ ID NO: 97851 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtggtcccctcca

SEQ ID NO: 97852 - DNA, 20 bp, Artificial Sequence
  Description of Artificial Sequence: Synthetic oligonucleotide
  Target: ATXN1; (+) strand; PAM type: NRG; PAM sequence: TGG
gtggtcccctccacagccac

SEQ ID NO: 97853 - DNA, 20 bp, Artificial Sequence
  Description of Artificial Sequence: Synthetic oligonucleotide
  Target: ATXN1; (+) strand; PAM type: NRG; PAM sequence: CAG
cagccactggccaacacgct

SEQ ID NO: 97854 - DNA, 20 bp, Artificial Sequence
  Description of Artificial Sequence: Synthetic oligonucleotide
  Target: ATXN1; (+) strand; PAM type: NRG; PAM sequence: CAG
ctcagaacgcacacacacaa

SEQ ID NO: 97855 - DNA, 20 bp, Artificial Sequence
  Description of Artificial Sequence: Synthetic oligonucleotide
  Target: ATXN1; (+) strand; PAM type: NRG; PAM sequence: AGG
tcagaacgcacacacacaac

SEQ ID NO: 97856 - DNA, 20 bp, Artificial Sequence
  Description of Artificial Sequence: Synthetic oligonucleotide
  Target: ATXN1; (+) strand; PAM type: NRG; PAM sequence: CAG
aacaggccacacttcccgtc

SEQ ID NO: 97857 - DNA, 20 bp, Artificial Sequence
  Description of Artificial Sequence: Synthetic oligonucleotide
  Target: ATXN1; (+) strand; PAM type: NRG; PAM sequence: AGG
acaggccacacttcccgtcc

SEQ ID NO: 97858 - DNA, 20 bp, Artificial Sequence
  Description of Artificial Sequence: Synthetic oligonucleotide
  Target: ATXN1; (+) strand; PAM type: NRG; PAM sequence: CAG
ccacacttcccgtccaggct

SEQ ID NO: 97859 - DNA, 20 bp, Artificial Sequence
  Description of Artificial Sequence: Synthetic oligonucleotide
  Target: ATXN1; (+) strand; PAM type: NRG; PAM sequence: GAG
acacttcccgtccaggctca

SEQ ID NO: 97860 - DNA, 20 bp, Artificial Sequence
  Description of Artificial Sequence: Synthetic oligonucleotide
  Target: ATXN1; (+) strand; PAM type: NRG; PAM sequence: AGG
cacttcccgtccaggctcag

SEQ ID NO: 97861 - DNA, 20 bp, Artificial Sequence
  Description of Artificial Sequence: Synthetic oligonucleotide
  Target: ATXN1; (+) strand; PAM type: NRG; PAM sequence: CAG
ttcccgtccaggctcagagg

SEQ ID NO: 97862 - DNA, 20 bp, Artificial Sequence
  Description of Artificial Sequence: Synthetic oligonucleotide
  Target: ATXN1; (+) strand; PAM type: NRG; PAM sequence: AGG
tcccgtccaggctcagaggc

SEQ ID NO: 97863 - DNA, 20 bp, Artificial Sequence
  Description of Artificial Sequence: Synthetic oligonucleotide
  Target: ATXN1; (+) strand; PAM type: NRG; PAM sequence: GGG
cccgtccaggctcagaggca

SEQ ID NO: 97864 - DNA, 20 bp, Artificial Sequence
  Description of Artificial Sequence: Synthetic oligonucleotide
  Target: ATXN1; (+) strand; PAM type: NRG; PAM sequence: AAG
aggctcagaggcagggctcc

SEQ ID NO: 97865 - DNA, 20 bp, Artificial Sequence
  Description of Artificial Sequence: Synthetic oligonucleotide
  Target: ATXN1; (+) strand; PAM type: NRG; PAM sequence: AAG
gaggcagggctccaagtctc

SEQ ID NO: 97866 - DNA, 20 bp, Artificial Sequence
  Description of Artificial Sequence: Synthetic oligonucleotide
  Target: ATXN1; (+) strand; PAM type: NRG; PAM sequence: AGG
aggcagggctccaagtctca

SEQ ID NO: 97867 - DNA, 20 bp, Artificial Sequence
  Description of Artificial Sequence: Synthetic oligonucleotide
  Target: ATXN1; (+) strand; PAM type: NRG; PAM sequence: CAG
ggctccaagtctcaaggaca

SEQ ID NO: 97868 - DNA, 20 bp, Artificial Sequence
  Description of Artificial Sequence: Synthetic oligonucleotide
  Target: ATXN1; (+) strand; PAM type: NRG; PAM sequence: GAG
gtctcaaggacacagacccc

SEQ ID NO: 97869 - DNA, 20 bp, Artificial Sequence
  Description of Artificial Sequence: Synthetic oligonucleotide
  Target: ATXN1; (+) strand; PAM type: NRG; PAM sequence: AGG
tctcaaggacacagaccccg

SEQ ID NO: 97870 - DNA, 20 bp, Artificial Sequence
  Description of Artificial Sequence: Synthetic oligonucleotide
  Target: ATXN1; (+) strand; PAM type: NRG; PAM sequence: GAG
tcaaggacacagaccccgag

SEQ ID NO: 97871 - DNA, 20 bp, Artificial Sequence
  Description of Artificial Sequence: Synthetic oligonucleotide
  Target: ATXN1; (+) strand; PAM type: NRG; PAM sequence: AGG
caaggacacagaccccgagg

SEQ ID NO: 97872 - DNA, 20 bp, Artificial Sequence
  Description of Artificial Sequence: Synthetic oligonucleotide
  Target: ATXN1; (+) strand; PAM type: NRG; PAM sequence: GGG
aaggacacagaccccgagga

SEQ ID NO: 97873 - DNA, 20 bp, Artificial Sequence
  Description of Artificial Sequence: Synthetic oligonucleotide
  Target: ATXN1; (+) strand; PAM type: NRG; PAM sequence: GGG
aggacacagaccccgaggag

SEQ ID NO: 97874 - DNA, 20 bp, Artificial Sequence
  Description of Artificial Sequence: Synthetic oligonucleotide
  Target: ATXN1; (+) strand; PAM type: NRG; PAM sequence: CAG
aggaggggcctgcccacttg

SEQ ID NO: 97875 - DNA, 20 bp, Artificial Sequence
  Description of Artificial Sequence: Synthetic oligonucleotide
  Target: ATXN1; (+) strand; PAM type: NRG; PAM sequence: AAG
gggcctgcccacttgcagaa

SEQ ID NO: 97876 - DNA, 20 bp, Artificial Sequence
  Description of Artificial Sequence: Synthetic oligonucleotide
  Target: ATXN1; (+) strand; PAM type: NRG; PAM sequence: TGG
cccacttgcagaaaagaccg

SEQ ID NO: 97877 - DNA, 20 bp, Artificial Sequence
  Description of Artificial Sequence: Synthetic oligonucleotide
  Target: ATXN1; (+) strand; PAM type: NRG; PAM sequence: TGG
gcagaaaagaccgtggaaaa

SEQ ID NO: 97878 - DNA, 20 bp, Artificial Sequence
  Description of Artificial Sequence: Synthetic oligonucleotide
  Target: ATXN1; (+) strand; PAM type: NRG; PAM sequence: GGG
cagaaaagaccgtggaaaat

SEQ ID NO: 97879 - DNA, 20 bp, Artificial Sequence
  Description of Artificial Sequence: Synthetic oligonucleotide
  Target: ATXN1; (+) strand; PAM type: NRG; PAM sequence: CAG
cgtggaaaatgggttgactc

SEQ ID NO: 97880 - DNA, 20 bp, Artificial Sequence
  Description of Artificial Sequence: Synthetic oligonucleotide
  Target: ATXN1; (+) strand; PAM type: NRG; PAM sequence: AGG
gtggaaaatgggttgactcc

SEQ ID NO: 97881 - DNA, 20 bp, Artificial Sequence
  Description of Artificial Sequence: Synthetic oligonucleotide
  Target: ATXN1; (+) strand; PAM type: NRG; PAM sequence: TGG
tgggttgactccaggctaca

SEQ ID NO: 97882 - DNA, 20 bp, Artificial Sequence
  Description of Artificial Sequence: Synthetic oligonucleotide
  Target: ATXN1; (+) strand; PAM type: NRG; PAM sequence: CAG
gactccaggctacatggctc

SEQ ID NO: 97883 - DNA, 20 bp, Artificial Sequence
  Description of Artificial Sequence: Synthetic oligonucleotide
  Target: ATXN1; (+) strand; PAM type: NRG; PAM sequence: GAG
ctccaggctacatggctcca

SEQ ID NO: 97884 - DNA, 20 bp, Artificial Sequence
  Description of Artificial Sequence: Synthetic oligonucleotide
  Target: ATXN1; (+) strand; PAM type: NRG; PAM sequence: TAG
catggctccagagtgcgtct

SEQ ID NO: 97885 - DNA, 20 bp, Artificial Sequence
  Description of Artificial Sequence: Synthetic oligonucleotide
  Target: ATXN1; (+) strand; PAM type: NRG; PAM sequence: TGG
tccacattcactattccgtg

SEQ ID NO: 97886 - DNA, 20 bp, Artificial Sequence
  Description of Artificial Sequence: Synthetic oligonucleotide
  Target: ATXN1; (+) strand; PAM type: NRG; PAM sequence: CAG
ttcactattccgtgtggtga

SEQ ID NO: 97887 - DNA, 20 bp, Artificial Sequence
  Description of Artificial Sequence: Synthetic oligonucleotide
  Target: ATXN1; (+) strand; PAM type: NRG; PAM sequence: AGG
tcactattccgtgtggtgac

SEQ ID NO: 97888 - DNA, 20 bp, Artificial Sequence
  Description of Artificial Sequence: Synthetic oligonucleotide
  Target: ATXN1; (+) strand; PAM type: NRG; PAM sequence: GGG
cactattccgtgtggtgaca

SEQ ID NO: 97889 - DNA, 20 bp, Artificial Sequence
  Description of Artificial Sequence: Synthetic oligonucleotide
  Target: ATXN1; (+) strand; PAM type: NRG; PAM sequence: GGG
actattccgtgtggtgacag

SEQ ID NO: 97890 - DNA, 20 bp, Artificial Sequence
  Description of Artificial Sequence: Synthetic oligonucleotide
  Target: ATXN1; (+) strand; PAM type: NRG; PAM sequence: CGG
tgtggtgacaggggacactg

SEQ ID NO: 97891 - DNA, 20 bp, Artificial Sequence
  Description of Artificial Sequence: Synthetic oligonucleotide
  Target: ATXN1; (+) strand; PAM type: NRG; PAM sequence: CGG
ggacactgcggttcctcccc

SEQ ID NO: 97892 - DNA, 20 bp, Artificial Sequence
  Description of Artificial Sequence: Synthetic oligonucleotide
  Target: ATXN1; (+) strand; PAM type: NRG; PAM sequence: GGG
gacactgcggttcctccccc

SEQ ID NO: 97893 - DNA, 20 bp, Artificial Sequence
  Description of Artificial Sequence: Synthetic oligonucleotide
  Target: ATXN1; (+) strand; PAM type: NRG; PAM sequence: TGG
gttcctcccccgggtctcct

SEQ ID NO: 97894 - DNA, 20 bp, Artificial Sequence
  Description of Artificial Sequence: Synthetic oligonucleotide
  Target: ATXN1; (+) strand; PAM type: NRG; PAM sequence: TGG
ctcccccgggtctccttggc

SEQ ID NO: 97895 - DNA, 20 bp, Artificial Sequence
  Description of Artificial Sequence: Synthetic oligonucleotide
  Target: ATXN1; (+) strand; PAM type: NRG; PAM sequence: TGG
ggctggctctttctgcaacg

SEQ ID NO: 97896 - DNA, 20 bp, Artificial Sequence
  Description of Artificial Sequence: Synthetic oligonucleotide
  Target: ATXN1; (+) strand; PAM type: NRG; PAM sequence: CGG
tggctctttctgcaacgtgg

SEQ ID NO: 97897 - DNA, 20 bp, Artificial Sequence
  Description of Artificial Sequence: Synthetic oligonucleotide
  Target: ATXN1; (+) strand; PAM type: NRG; PAM sequence: CAG
ctctttctgcaacgtggcgg

SEQ ID NO: 97898 - DNA, 20 bp, Artificial Sequence
  Description of Artificial Sequence: Synthetic oligonucleotide
  Target: ATXN1; (+) strand; PAM type: NRG; PAM sequence: CGG
gcaacgtggcggcagacgca

SEQ ID NO: 97899 - DNA, 20 bp, Artificial Sequence
  Description of Artificial Sequence: Synthetic oligonucleotide
  Target: ATXN1; (+) strand; PAM type: NRG; PAM sequence: GGG
caacgtggcggcagacgcac

SEQ ID NO: 97900 - DNA, 20 bp, Artificial Sequence
  Description of Artificial Sequence: Synthetic oligonucleotide
  Target: ATXN1; (+) strand; PAM type: NRG; PAM sequence: GGG
aacgtggcggcagacgcacg

SEQ ID NO: 97901 - DNA, 20 bp, Artificial Sequence
  Description of Artificial Sequence: Synthetic oligonucleotide
  Target: ATXN1; (+) strand; PAM type: NRG; PAM sequence: AAG
gcagacgcacggggctcctg

SEQ ID NO: 97902 - DNA, 20 bp, Artificial Sequence
  Description of Artificial Sequence: Synthetic oligonucleotide
  Target: ATXN1; (+) strand; PAM type: NRG; PAM sequence: AGG
cagacgcacggggctcctga

SEQ ID NO: 97903 - DNA, 20 bp, Artificial Sequence
  Description of Artificial Sequence: Synthetic oligonucleotide
  Target: ATXN1; (+) strand; PAM type: NRG; PAM sequence: CAG
ctcctgaaggctccccgccc

SEQ ID NO: 97904 - DNA, 20 bp, Artificial Sequence
  Description of Artificial Sequence: Synthetic oligonucleotide
  Target: ATXN1; (+) strand; PAM type: NRG; PAM sequence: CAG
aggctccccgccccagcact

SEQ ID NO: 97905 - DNA, 20 bp, Artificial Sequence
  Description of Artificial Sequence: Synthetic oligonucleotide
  Target: ATXN1; (+) strand; PAM type: NRG; PAM sequence: CAG
gccccagcactcagcatccg

SEQ ID NO: 97906 - DNA, 20 bp, Artificial Sequence
  Description of Artificial Sequence: Synthetic oligonucleotide
  Target: ATXN1; (+) strand; PAM type: NRG; PAM sequence: CAG
ccagcactcagcatccgcag

SEQ ID NO: 97907 - DNA, 20 bp, Artificial Sequence
  Description of Artificial Sequence: Synthetic oligonucleotide
  Target: ATXN1; (+) strand; PAM type: NRG; PAM sequence: AGG
cagcactcagcatccgcagc

SEQ ID NO: 97908 - DNA, 20 bp, Artificial Sequence
  Description of Artificial Sequence: Synthetic oligonucleotide
  Target: ATXN1; (+) strand; PAM type: NRG; PAM sequence: GGG
agcactcagcatccgcagca

SEQ ID NO: 97909 - DNA, 20 bp, Artificial Sequence
  Description of Artificial Sequence: Synthetic oligonucleotide
  Target: ATXN1; (+) strand; PAM type: NRG; PAM sequence: GGG
gcactcagcatccgcagcag

SEQ ID NO: 97910 - DNA, 20 bp, Artificial Sequence
  Description of Artificial Sequence: Synthetic oligonucleotide
  Target: ATXN1; (+) strand; PAM type: NRG; PAM sequence: AAG
tcagcatccgcagcagggga

SEQ ID NO: 97911 - DNA, 20 bp, Artificial Sequence
  Description of Artificial Sequence: Synthetic oligonucleotide
  Target: ATXN1; (+) strand; PAM type: NRG; PAM sequence: AGG
cagcatccgcagcaggggaa

SEQ ID NO: 97912 - DNA, 20 bp, Artificial Sequence
  Description of Artificial Sequence: Synthetic oligonucleotide
  Target: ATXN1; (+) strand; PAM type: NRG; PAM sequence: TGG
catccgcagcaggggaaagg

SEQ ID NO: 97913 - DNA, 20 bp, Artificial Sequence
  Description of Artificial Sequence: Synthetic oligonucleotide
  Target: ATXN1; (+) strand; PAM type: NRG; PAM sequence: GGG
atccgcagcaggggaaaggt

SEQ ID NO: 97914 - DNA, 20 bp, Artificial Sequence
  Description of Artificial Sequence: Synthetic oligonucleotide
  Target: ATXN1; (+) strand; PAM type: NRG; PAM sequence: GAG
ccgcagcaggggaaaggtgg

SEQ ID NO: 97915 - DNA, 20 bp, Artificial Sequence
  Description of Artificial Sequence: Synthetic oligonucleotide
  Target: ATXN1; (+) strand; PAM type: NRG; PAM sequence: AGG
cgcagcaggggaaaggtggg

SEQ ID NO: 97916 - DNA, 20 bp, Artificial Sequence
  Description of Artificial Sequence: Synthetic oligonucleotide
  Target: ATXN1; (+) strand; PAM type: NRG; PAM sequence: TGG
gtgggaggctctctccctcc

SEQ ID NO: 97917 - DNA, 20 bp, Artificial Sequence
  Description of Artificial Sequence: Synthetic oligonucleotide
  Target: ATXN1; (+) strand; PAM type: NRG; PAM sequence: CAG
ccctcctggctccttccctc

SEQ ID NO: 97918 - DNA, 20 bp, Artificial Sequence
  Description of Artificial Sequence: Synthetic oligonucleotide
  Target: ATXN1; (+) strand; PAM type: NRG; PAM sequence: TGG
ccttccctccagccctgctc

SEQ ID NO: 97919 - DNA, 20 bp, Artificial Sequence
  Description of Artificial Sequence: Synthetic oligonucleotide
  Target: ATXN1; (+) strand; PAM type: NRG; PAM sequence: CAG
ccctccagccctgctctggc

SEQ ID NO: 97920 - DNA, 20 bp, Artificial Sequence
  Description of Artificial Sequence: Synthetic oligonucleotide
  Target: ATXN1; (+) strand; PAM type: NRG; PAM sequence: TGG
cagccctgctctggccagaa

SEQ ID NO: 97921 - DNA, 20 bp, Artificial Sequence
  Description of Artificial Sequence: Synthetic oligonucleotide
  Target: ATXN1; (+) strand; PAM type: NRG; PAM sequence: GGG
agccctgctctggccagaat

SEQ ID NO: 97922 - DNA, 20 bp, Artificial Sequence
  Description of Artificial Sequence: Synthetic oligonucleotide
  Target: ATXN1; (+) strand; PAM type: NRG; PAM sequence: GGG
gccctgctctggccagaatg

SEQ ID NO: 97923 - DNA, 20 bp, Artificial Sequence
  Description of Artificial Sequence: Synthetic oligonucleotide
  Target: ATXN1; (+) strand; PAM type: NRG; PAM sequence: AAG
ctgctctggccagaatgggg

SEQ ID NO: 97924 - DNA, 20 bp, Artificial Sequence
  Description of Artificial Sequence: Synthetic oligonucleotide
  Target: ATXN1; (+) strand; PAM type: NRG; PAM sequence: AAG
atggggaagatcaaccaaac

SEQ ID NO: 97925 - DNA, 20 bp, Artificial Sequence
  Description of Artificial Sequence: Synthetic oligonucleotide
  Target: ATXN1; (+) strand; PAM type: NRG; PAM sequence: AGG
tggggaagatcaaccaaaca

SEQ ID NO: 97926 - DNA, 20 bp, Artificial Sequence
  Description of Artificial Sequence: Synthetic oligonucleotide
  Target: ATXN1; (+) strand; PAM type: NRG; PAM sequence: AAG
agatcaaccaaacaaggaaa

SEQ ID NO: 97927 - DNA, 20 bp, Artificial Sequence
  Description of Artificial Sequence: Synthetic oligonucleotide
  Target: ATXN1; (+) strand; PAM type: NRG; PAM sequence: AAG
ccaaacaaggaaaaagccaa

SEQ ID NO: 97928 - DNA, 20 bp, Artificial Sequence
  Description of Artificial Sequence: Synthetic oligonucleotide
  Target: ATXN1; (+) strand; PAM type: NRG; PAM sequence: AGG
caaacaaggaaaaagccaaa

SEQ ID NO: 97929 - DNA, 20 bp, Artificial Sequence
  Description of Artificial Sequence: Synthetic oligonucleotide
  Target: ATXN1; (+) strand; PAM type: NRG; PAM sequence: GGG
aaacaaggaaaaagccaaaa

SEQ ID NO: 97930 - DNA, 20 bp, Artificial Sequence
  Description of Artificial Sequence: Synthetic oligonucleotide
  Target: ATXN1; (+) strand; PAM type: NRG; PAM sequence: GAG
ggaaaaagccaaaagggaat

SEQ ID NO: 97931 - DNA, 20 bp, Artificial Sequence
  Description of Artificial Sequence: Synthetic oligonucleotide
  Target: ATXN1; (+) strand; PAM type: NRG; PAM sequence: TAG
gggaatgagctttaactata

SEQ ID NO: 97932 - DNA, 20 bp, Artificial Sequence
  Description of Artificial Sequence: Synthetic oligonucleotide
  Target: ATXN1; (+) strand; PAM type: NRG; PAM sequence: TGG
gctttaactatatagcacac

SEQ ID NO: 97933 - DNA, 20 bp, Artificial Sequence
  Description of Artificial Sequence: Synthetic oligonucleotide
  Target: ATXN1; (+) strand; PAM type: NRG; PAM sequence: CAG
taactatatagcacactggt

SEQ ID NO: 97934 - DNA, 20 bp, Artificial Sequence
  Description of Artificial Sequence: Synthetic oligonucleotide
  Target: ATXN1; (+) strand; PAM type: NRG; PAM sequence: TGG
gcacactggtcagactctat

SEQ ID NO: 97935 - DNA, 20 bp, Artificial Sequence
  Description of Artificial Sequence: Synthetic oligonucleotide
  Target: ATXN1; (+) strand; PAM type: NRG; PAM sequence: CAG
ctggtcagactctattggca

SEQ ID NO: 97936 - DNA, 20 bp, Artificial Sequence
  Description of Artificial Sequence: Synthetic oligonucleotide
  Target: ATXN1; (+) strand; PAM type: NRG; PAM sequence: AAG
tcagactctattggcacaga

SEQ ID NO: 97937 - DNA, 20 bp, Artificial Sequence
  Description of Artificial Sequence: Synthetic oligonucleotide
  Target: ATXN1; (+) strand; PAM type: NRG; PAM sequence: AAG
aagtattgcacatgctaaaa

SEQ ID NO: 97938 - DNA, 20 bp, Artificial Sequence
  Description of Artificial Sequence: Synthetic oligonucleotide
  Target: ATXN1; (+) strand; PAM type: NRG; PAM sequence: AAG
attgcacatgctaaaaaagc

SEQ ID NO: 97939 - DNA, 20 bp, Artificial Sequence
  Description of Artificial Sequence: Synthetic oligonucleotide
  Target: ATXN1; (+) strand; PAM type: NRG; PAM sequence: GAG
tgcacatgctaaaaaagcaa

SEQ ID NO: 97940 - DNA, 20 bp, Artificial Sequence
  Description of Artificial Sequence: Synthetic oligonucleotide
  Target: ATXN1; (+) strand; PAM type: NRG; PAM sequence: TGG
aaaaaagcaagagaatgaaa

SEQ ID NO: 97941 - DNA, 20 bp, Artificial Sequence
  Description of Artificial Sequence: Synthetic oligonucleotide
  Target: ATXN1; (+) strand; PAM type: NRG; PAM sequence: GGG
aaaaagcaagagaatgaaat

SEQ ID NO: 97942 - DNA, 20 bp, Artificial Sequence
  Description of Artificial Sequence: Synthetic oligonucleotide
  Target: ATXN1; (+) strand; PAM type: NRG; PAM sequence: AAG
gcaagagaatgaaatgggac

SEQ ID NO: 97943 - DNA, 20 bp, Artificial Sequence
  Description of Artificial Sequence: Synthetic oligonucleotide
  Target: ATXN1; (+) strand; PAM type: NRG; PAM sequence: TAG
aatgaaatgggacaagtgtt

SEQ ID NO: 97944 - DNA, 20 bp, Artificial Sequence
  Description of Artificial Sequence: Synthetic oligonucleotide
  Target: ATXN1; (+) strand; PAM type: NRG; PAM sequence: AAG
aaatgggacaagtgtttaga

SEQ ID NO: 97945 - DNA, 20 bp, Artificial Sequence
  Description of Artificial Sequence: Synthetic oligonucleotide
  Target: ATXN1; (+) strand; PAM type: NRG; PAM sequence: TAG
tataattcctatacctgaaa

SEQ ID NO: 97946 - DNA, 20 bp, Artificial Sequence
  Description of Artificial Sequence: Synthetic oligonucleotide
  Target: ATXN1; (+) strand; PAM type: NRG; PAM sequence: TAG
ccatgtgtgttttcccatct

SEQ ID NO: 97947 - DNA, 20 bp, Artificial Sequence
  Description of Artificial Sequence: Synthetic oligonucleotide
  Target: ATXN1; (+) strand; PAM type: NRG; PAM sequence: TGG
gtgttttcccatcttagtgt

SEQ ID NO: 97948 - DNA, 20 bp, Artificial Sequence
  Description of Artificial Sequence: Synthetic oligonucleotide
  Target: ATXN1; (+) strand; PAM type: NRG; PAM sequence: TAG
ttcccatcttagtgttggtt

SEQ ID NO: 97949 - DNA, 20 bp, Artificial Sequence
  Description of Artificial Sequence: Synthetic oligonucleotide
  Target: ATXN1; (+) strand; PAM type: NRG; PAM sequence: TGG
ccatcttagtgttggtttag

SEQ ID NO: 97950 - DNA, 20 bp, Artificial Sequence
  Description of Artificial Sequence: Synthetic oligonucleotide
  Target: ATXN1; (+) strand; PAM type: NRG; PAM sequence: CAG
tagtgttggtttagtggatc

SEQ ID NO: 97951 - DNA, 20 bp, Artificial Sequence
  Description of Artificial Sequence: Synthetic oligonucleotide
  Target: ATXN1; (+) strand; PAM type: NRG; PAM sequence: AAG
tccagtcaattcaatactcg

SEQ ID NO: 97952 - DNA, 20 bp, Artificial Sequence
  Description of Artificial Sequence: Synthetic oligonucleotide
  Target: ATXN1; (+) strand; PAM type: NRG; PAM sequence: AAG
gtcaattcaatactcgaagt

SEQ ID NO: 97953 - DNA, 20 bp, Artificial Sequence
  Description of Artificial Sequence: Synthetic oligonucleotide
  Target: ATXN1; (+) strand; PAM type: NRG; PAM sequence: AAG
caatactcgaagtaagccaa

SEQ ID NO: 97954 - DNA, 20 bp, Artificial Sequence
  Description of Artificial Sequence: Synthetic oligonucleotide
  Target: ATXN1; (+) strand; PAM type: NRG; PAM sequence: AGG
aatactcgaagtaagccaaa

SEQ ID NO: 97955 - DNA, 20 bp, Artificial Sequence
  Description of Artificial Sequence: Synthetic oligonucleotide
  Target: ATXN1; (+) strand; PAM type: NRG; PAM sequence: TGG
actcgaagtaagccaaaagg

SEQ ID NO: 97956 - DNA, 20 bp, Artificial Sequence
  Description of Artificial Sequence: Synthetic oligonucleotide
  Target: ATXN1; (+) strand; PAM type: NRG; PAM sequence: GAG
aaggtggtgtgtgtttttct

SEQ ID NO: 97957 - DNA, 20 bp, Artificial Sequence
  Description of Artificial Sequence: Synthetic oligonucleotide
  Target: ATXN1; (+) strand; PAM type: NRG; PAM sequence: GAG
gtgtttttctgagtccacat

SEQ ID NO: 97958 - DNA, 20 bp, Artificial Sequence
  Description of Artificial Sequence: Synthetic oligonucleotide
  Target: ATXN1; (+) strand; PAM type: NRG; PAM sequence: TAG
gagtccacatgagttgtaaa

SEQ ID NO: 97959 - DNA, 20 bp, Artificial Sequence
  Description of Artificial Sequence: Synthetic oligonucleotide
  Target: ATXN1; (+) strand; PAM type: NRG; PAM sequence: GAG
ttgtaaatagtgatattaat

SEQ ID NO: 97960 - DNA, 20 bp, Artificial Sequence
  Description of Artificial Sequence: Synthetic oligonucleotide
  Target: ATXN1; (+) strand; PAM type: NRG; PAM sequence: AAG
tagtgatattaatgagaaca

SEQ ID NO: 97961 - DNA, 20 bp, Artificial Sequence
  Description of Artificial Sequence: Synthetic oligonucleotide
  Target: ATXN1; (+) strand; PAM type: NRG; PAM sequence: TGG
taatgagaacaaagtctatg

SEQ ID NO: 97962 - DNA, 20 bp, Artificial Sequence
  Description of Artificial Sequence: Synthetic oligonucleotide
  Target: ATXN1; (+) strand; PAM type: NRG; PAM sequence: CAG
tgagaacaaagtctatgtgg

SEQ ID NO: 97963 - DNA, 20 bp, Artificial Sequence
  Description of Artificial Sequence: Synthetic oligonucleotide
  Target: ATXN1; (+) strand; PAM type: NRG; PAM sequence: AAG
ccgtattcctcttaccatca

SEQ ID NO: 97964 - DNA, 20 bp, Artificial Sequence
  Description of Artificial Sequence: Synthetic oligonucleotide
  Target: ATXN1; (+) strand; PAM type: NRG; PAM sequence: AGG
cgtattcctcttaccatcaa

SEQ ID NO: 97965 - DNA, 20 bp, Artificial Sequence
  Description of Artificial Sequence: Synthetic oligonucleotide
  Target: ATXN1; (+) strand; PAM type: NRG; PAM sequence: AAG
atcaaaggctaaaaaacaaa

SEQ ID NO: 97966 - DNA, 20 bp, Artificial Sequence
  Description of Artificial Sequence: Synthetic oligonucleotide
  Target: ATXN1; (+) strand; PAM type: NRG; PAM sequence: AAG
aaacaaaacctaataattgc

SEQ ID NO: 97967 - DNA, 20 bp, Artificial Sequence
  Description of Artificial Sequence: Synthetic oligonucleotide
  Target: ATXN1; (+) strand; PAM type: NRG; PAM sequence: GAG
ctaataattgcaagtgccct

SEQ ID NO: 97968 - DNA, 20 bp, Artificial Sequence
  Description of Artificial Sequence: Synthetic oligonucleotide
  Target: ATXN1; (+) strand; PAM type: NRG; PAM sequence: CAG
ataattgcaagtgccctgag

SEQ ID NO: 97969 - DNA, 20 bp, Artificial Sequence
  Description of Artificial Sequence: Synthetic oligonucleotide
  Target: ATXN1; (+) strand; PAM type: NRG; PAM sequence: TGG
agtgccctgagcagaatata

SEQ ID NO: 97970 - DNA, 20 bp, Artificial Sequence
  Description of Artificial Sequence: Synthetic oligonucleotide
  Target: ATXN1; (+) strand; PAM type: NRG; PAM sequence: AAG
gccctgagcagaatatatgg

SEQ ID NO: 97971 - DNA, 20 bp, Artificial Sequence
  Description of Artificial Sequence: Synthetic oligonucleotide
  Target: ATXN1; (+) strand; PAM type: NRG; PAM sequence: AAG
agcagaatatatggaagatt

SEQ ID NO: 97972 - DNA, 20 bp, Artificial Sequence
  Description of Artificial Sequence: Synthetic oligonucleotide
  Target: ATXN1; (+) strand; PAM type: NRG; PAM sequence: AAG
gaatatatggaagattaagc

SEQ ID NO: 97973 - DNA, 20 bp, Artificial Sequence
  Description of Artificial Sequence: Synthetic oligonucleotide
  Target: ATXN1; (+) strand; PAM type: NRG; PAM sequence: CAG
gattaagcaagttctctgaa

SEQ ID NO: 97974 - DNA, 20 bp, Artificial Sequence
  Description of Artificial Sequence: Synthetic oligonucleotide
  Target: ATXN1; (+) strand; PAM type: NRG; PAM sequence: CAG
acagaaacgtttaaaaaata

SEQ ID NO: 97975 - DNA, 20 bp, Artificial Sequence
  Description of Artificial Sequence: Synthetic oligonucleotide
  Target: ATXN1; (+) strand; PAM type: NRG; PAM sequence: AAG
taaaaaatacagcactaaat

SEQ ID NO: 97976 - DNA, 20 bp, Artificial Sequence
  Description of Artificial Sequence: Synthetic oligonucleotide
  Target: ATXN1; (+) strand; PAM type: NRG; PAM sequence: CAG
aaaatacagcactaaataag

SEQ ID NO: 97977 - DNA, 20 bp, Artificial Sequence
  Description of Artificial Sequence: Synthetic oligonucleotide
  Target: ATXN1; (+) strand; PAM type: NRG; PAM sequence: AAG
taaataagcagtatgactgc

SEQ ID NO: 97978 - DNA, 20 bp, Artificial Sequence
  Description of Artificial Sequence: Synthetic oligonucleotide
  Target: ATXN1; (+) strand; PAM type: NRG; PAM sequence: GAG
agcagtatgactgcaagaat

SEQ ID NO: 97979 - DNA, 20 bp, Artificial Sequence
  Description of Artificial Sequence: Synthetic oligonucleotide
  Target: ATXN1; (+) strand; PAM type: NRG; PAM sequence: CAG
actgcaagaatgagcccacc

SEQ ID NO: 97980 - DNA, 20 bp, Artificial Sequence
  Description of Artificial Sequence: Synthetic oligonucleotide
  Target: ATXN1; (+) strand; PAM type: NRG; PAM sequence: AAG
gagcccacccagctctctgc

SEQ ID NO: 97981 - DNA, 20 bp, Artificial Sequence
  Description of Artificial Sequence: Synthetic oligonucleotide
  Target: ATXN1; (+) strand; PAM type: NRG; PAM sequence: GAG
cagctctctgcaagcatgct

SEQ ID NO: 97982 - DNA, 20 bp, Artificial Sequence
  Description of Artificial Sequence: Synthetic oligonucleotide
  Target: ATXN1; (+) strand; PAM type: NRG; PAM sequence: GAG
gctctctgcaagcatgctga

SEQ ID NO: 97983 - DNA, 20 bp, Artificial Sequence
  Description of Artificial Sequence: Synthetic oligonucleotide
  Target: ATXN1; (+) strand; PAM type: NRG; PAM sequence: AGG
ctctctgcaagcatgctgag

SEQ ID NO: 97984 - DNA, 20 bp, Artificial Sequence
  Description of Artificial Sequence: Synthetic oligonucleotide
  Target: ATXN1; (+) strand; PAM type: NRG; PAM sequence: GGG
tctctgcaagcatgctgaga

SEQ ID NO: 97985 - DNA, 20 bp, Artificial Sequence
  Description of Artificial Sequence: Synthetic oligonucleotide
  Target: ATXN1; (+) strand; PAM type: NRG; PAM sequence: GAG
ctgagagggtaatgaaattc

SEQ ID NO: 97986 - DNA, 20 bp, Artificial Sequence
  Description of Artificial Sequence: Synthetic oligonucleotide
  Target: ATXN1; (+) strand; PAM type: NRG; PAM sequence: AGG
tgagagggtaatgaaattcg

SEQ ID NO: 97987 - DNA, 20 bp, Artificial Sequence
  Description of Artificial Sequence: Synthetic oligonucleotide
  Target: ATXN1; (+) strand; PAM type: NRG; PAM sequence: AAG
agggtaatgaaattcgagga

SEQ ID NO: 97988 - DNA, 20 bp, Artificial Sequence
  Description of Artificial Sequence: Synthetic oligonucleotide
  Target: ATXN1; (+) strand; PAM type: NRG; PAM sequence: AAG
aatgaaattcgaggaaagtc

SEQ ID NO: 97989 - DNA, 20 bp, Artificial Sequence
  Description of Artificial Sequence: Synthetic oligonucleotide
  Target: ATXN1; (+) strand; PAM type: NRG; PAM sequence: AGG
atgaaattcgaggaaagtca

SEQ ID NO: 97990 - DNA, 20 bp, Artificial Sequence
  Description of Artificial Sequence: Synthetic oligonucleotide
  Target: ATXN1; (+) strand; PAM type: NRG; PAM sequence: TAG
ggaaagtcaaggaactattc

SEQ ID NO: 97991 - DNA, 20 bp, Artificial Sequence
  Description of Artificial Sequence: Synthetic oligonucleotide
  Target: ATXN1; (+) strand; PAM type: NRG; PAM sequence: TGG
taaacctattcaaatgtttt

SEQ ID NO: 97992 - DNA, 20 bp, Artificial Sequence
  Description of Artificial Sequence: Synthetic oligonucleotide
  Target: ATXN1; (+) strand; PAM type: NRG; PAM sequence: CAG
caaatgtttttggtacaccc

SEQ ID NO: 97993 - DNA, 20 bp, Artificial Sequence
  Description of Artificial Sequence: Synthetic oligonucleotide
  Target: ATXN1; (+) strand; PAM type: NRG; PAM sequence: CGG
ttttggtacaccccagaaaa

SEQ ID NO: 97994 - DNA, 20 bp, Artificial Sequence
  Description of Artificial Sequence: Synthetic oligonucleotide
  Target: ATXN1; (+) strand; PAM type: NRG; PAM sequence: TAG
aaacggtttataaaaatcat

SEQ ID NO: 97995 - DNA, 20 bp, Artificial Sequence
  Description of Artificial Sequence: Synthetic oligonucleotide
  Target: ATXN1; (+) strand; PAM type: NRG; PAM sequence: TGG
tttataaaaatcattagtcc

SEQ ID NO: 97996 - DNA, 20 bp, Artificial Sequence
  Description of Artificial Sequence: Synthetic oligonucleotide
  Target: ATXN1; (+) strand; PAM type: NRG; PAM sequence: TAG
ccctaaatgtaaatgaatac

SEQ ID NO: 97997 - DNA, 20 bp, Artificial Sequence
  Description of Artificial Sequence: Synthetic oligonucleotide
  Target: ATXN1; (+) strand; PAM type: NRG; PAM sequence: CAG
aaatgtaaatgaatactaga

SEQ ID NO: 97998 - DNA, 20 bp, Artificial Sequence
  Description of Artificial Sequence: Synthetic oligonucleotide
  Target: ATXN1; (+) strand; PAM type: NRG; PAM sequence: TGG
aatactagacagccaaaatg

SEQ ID NO: 97999 - DNA, 20 bp, Artificial Sequence
  Description of Artificial Sequence: Synthetic oligonucleotide
  Target: ATXN1; (+) strand; PAM type: NRG; PAM sequence: GGG
atactagacagccaaaatgt

SEQ ID NO: 98000 - DNA, 20 bp, Artificial Sequence
  Description of Artificial Sequence: Synthetic oligonucleotide
  Target: ATXN1; (+) strand; PAM type: NRG; PAM sequence: CAG
gccaaaatgtgggttgatac

SEQ ID NO: 98001 - DNA, 20 bp, Artificial Sequence
  Description of Artificial Sequence: Synthetic oligonucleotide
  Target: ATXN1; (+) strand; PAM type: NRG; PAM sequence: AAG
tttttttaatttgtgaaacg

SEQ ID NO: 98002 - DNA, 20 bp, Artificial Sequence
  Description of Artificial Sequence: Synthetic oligonucleotide
  Target: ATXN1; (+) strand; PAM type: NRG; PAM sequence: AAG
tttaatttgtgaaacgaaga

SEQ ID NO: 98003 - DNA, 20 bp, Artificial Sequence
  Description of Artificial Sequence: Synthetic oligonucleotide
  Target: ATXN1; (+) strand; PAM type: NRG; PAM sequence: TGG
gaagaaagtactattttcaa

SEQ ID NO: 98004 - DNA, 20 bp, Artificial Sequence
  Description of Artificial Sequence: Synthetic oligonucleotide
  Target: ATXN1; (+) strand; PAM type: NRG; PAM sequence: GGG
aagaaagtactattttcaat

SEQ ID NO: 98005 - DNA, 20 bp, Artificial Sequence
  Description of Artificial Sequence: Synthetic oligonucleotide
  Target: ATXN1; (+) strand; PAM type: NRG; PAM sequence: GGG
agaaagtactattttcaatg

SEQ ID NO: 98006 - DNA, 20 bp, Artificial Sequence
  Description of Artificial Sequence: Synthetic oligonucleotide
  Target: ATXN1; (+) strand; PAM type: NRG; PAM sequence: AAG
tactattttcaatggggtaa

SEQ ID NO: 98007 - DNA, 20 bp, Artificial Sequence
  Description of Artificial Sequence: Synthetic oligonucleotide
  Target: ATXN1; (+) strand; PAM type: NRG; PAM sequence: AAG
ttttcaatggggtaaaagaa

SEQ ID NO: 98008 - DNA, 20 bp, Artificial Sequence
  Description of Artificial Sequence: Synthetic oligonucleotide
  Target: ATXN1; (+) strand; PAM type: NRG; PAM sequence: CAG
caatggggtaaaagaaaagt

SEQ ID NO: 98009 - DNA, 20 bp, Artificial Sequence
  Description of Artificial Sequence: Synthetic oligonucleotide
  Target: ATXN1; (+) strand; PAM type: NRG; PAM sequence: AGG
aatggggtaaaagaaaagtc

SEQ ID NO: 98010 - DNA, 20 bp, Artificial Sequence
  Description of Artificial Sequence: Synthetic oligonucleotide
  Target: ATXN1; (+) strand; PAM type: NRG; PAM sequence: CAG
agaaaagtcaggtatttgtt

SEQ ID NO: 98011 - DNA, 20 bp, Artificial Sequence
  Description of Artificial Sequence: Synthetic oligonucleotide
  Target: ATXN1; (+) strand; PAM type: NRG; PAM sequence: TAG
agtcaggtatttgttcagtt

SEQ ID NO: 98012 - DNA, 20 bp, Artificial Sequence
  Description of Artificial Sequence: Synthetic oligonucleotide
  Target: ATXN1; (+) strand; PAM type: NRG; PAM sequence: CAG
gtatttgttcagtttagttg

SEQ ID NO: 98013 - DNA, 20 bp, Artificial Sequence
  Description of Artificial Sequence: Synthetic oligonucleotide
  Target: ATXN1; (+) strand; PAM type: NRG; PAM sequence: AAG
cagtttagttgcagccatcc

SEQ ID NO: 98014 - DNA, 20 bp, Artificial Sequence
  Description of Artificial Sequence: Synthetic oligonucleotide
  Target: ATXN1; (+) strand; PAM type: NRG; PAM sequence: AAG
ttagttgcagccatccaagt

SEQ ID NO: 98015 - DNA, 20 bp, Artificial Sequence
  Description of Artificial Sequence: Synthetic oligonucleotide
  Target: ATXN1; (+) strand; PAM type: NRG; PAM sequence: AAG
acttataaaactttttttta

SEQ ID NO: 98016 - DNA, 20 bp, Artificial Sequence
  Description of Artificial Sequence: Synthetic oligonucleotide
  Target: ATXN1; (+) strand; PAM type: NRG; PAM sequence: AAG
cttttttttaaagcacttta

SEQ ID NO: 98017 - DNA, 20 bp, Artificial Sequence
  Description of Artificial Sequence: Synthetic oligonucleotide
  Target: ATXN1; (+) strand; PAM type: NRG; PAM sequence: CGG
aaaacccacaaatgatattt

SEQ ID NO: 98018 - DNA, 20 bp, Artificial Sequence
  Description of Artificial Sequence: Synthetic oligonucleotide
  Target: ATXN1; (+) strand; PAM type: NRG; PAM sequence: TGG
caaatgatatttcggatctc

SEQ ID NO: 98019 - DNA, 20 bp, Artificial Sequence
  Description of Artificial Sequence: Synthetic oligonucleotide
  Target: ATXN1; (+) strand; PAM type: NRG; PAM sequence: GGG
aaatgatatttcggatctct

SEQ ID NO: 98020 - DNA, 20 bp, Artificial Sequence
  Description of Artificial Sequence: Synthetic oligonucleotide
  Target: ATXN1; (+) strand; PAM type: NRG; PAM sequence: AAG
tttcggatctctgggaatga

SEQ ID NO: 98021 - DNA, 20 bp, Artificial Sequence
  Description of Artificial Sequence: Synthetic oligonucleotide
  Target: ATXN1; (+) strand; PAM type: NRG; PAM sequence: AGG
ttcggatctctgggaatgaa

SEQ ID NO: 98022 - DNA, 20 bp, Artificial Sequence
  Description of Artificial Sequence: Synthetic oligonucleotide
  Target: ATXN1; (+) strand; PAM type: NRG; PAM sequence: TGG
aaactatgaaataccctttc

SEQ ID NO: 98023 - DNA, 20 bp, Artificial Sequence
  Description of Artificial Sequence: Synthetic oligonucleotide
  Target: ATXN1; (+) strand; PAM type: NRG; PAM sequence: GGG
aactatgaaataccctttct

SEQ ID NO: 98024 - DNA, 20 bp, Artificial Sequence
  Description of Artificial Sequence: Synthetic oligonucleotide
  Target: ATXN1; (+) strand; PAM type: NRG; PAM sequence: TAG
aatctcgatttgattttgaa

SEQ ID NO: 98025 - DNA, 20 bp, Artificial Sequence
  Description of Artificial Sequence: Synthetic oligonucleotide
  Target: ATXN1; (+) strand; PAM type: NRG; PAM sequence: AAG
gattttgaatagaaaaaaaa

SEQ ID NO: 98026 - DNA, 20 bp, Artificial Sequence
  Description of Artificial Sequence: Synthetic oligonucleotide
  Target: ATXN1; (+) strand; PAM type: NRG; PAM sequence: AAG
cattaataacaacaataata

SEQ ID NO: 98027 - DNA, 20 bp, Artificial Sequence
  Description of Artificial Sequence: Synthetic oligonucleotide
  Target: ATXN1; (+) strand; PAM type: NRG; PAM sequence: TGG
cacatatataaatgtcttta

SEQ ID NO: 98028 - DNA, 20 bp, Artificial Sequence
  Description of Artificial Sequence: Synthetic oligonucleotide
  Target: ATXN1; (+) strand; PAM type: NRG; PAM sequence: AAG
aaactctctcaatgaatctg

SEQ ID NO: 98029 - DNA, 20 bp, Artificial Sequence
  Description of Artificial Sequence: Synthetic oligonucleotide
  Target: ATXN1; (+) strand; PAM type: NRG; PAM sequence: CAG
atgaatctgaagaaaattct

SEQ ID NO: 98030 - DNA, 20 bp, Artificial Sequence
  Description of Artificial Sequence: Synthetic oligonucleotide
  Target: ATXN1; (+) strand; PAM type: NRG; PAM sequence: GAG
gaatctgaagaaaattctca

SEQ ID NO: 98031 - DNA, 20 bp, Artificial Sequence
  Description of Artificial Sequence: Synthetic oligonucleotide
  Target: ATXN1; (+) strand; PAM type: NRG; PAM sequence: AAG
agaaaattctcagagtttct

SEQ ID NO: 98032 - DNA, 20 bp, Artificial Sequence
  Description of Artificial Sequence: Synthetic oligonucleotide
  Target: ATXN1; (+) strand; PAM type: NRG; PAM sequence: GAG
aaaattctcagagtttctaa

SEQ ID NO: 98033 - DNA, 20 bp, Artificial Sequence
  Description of Artificial Sequence: Synthetic oligonucleotide
  Target: ATXN1; (+) strand; PAM type: NRG; PAM sequence: AAG
agagtttctaagagcccgct

SEQ ID NO: 98034 - DNA, 20 bp, Artificial Sequence
  Description of Artificial Sequence: Synthetic oligonucleotide
  Target: ATXN1; (+) strand; PAM type: NRG; PAM sequence: TGG
tctaagagcccgctaagacc

SEQ ID NO: 98035 - DNA, 20 bp, Artificial Sequence
  Description of Artificial Sequence: Synthetic oligonucleotide
  Target: ATXN1; (+) strand; PAM type: NRG; PAM sequence: CAG
taagacctggctttttgtga

SEQ ID NO: 98036 - DNA, 20 bp, Artificial Sequence
  Description of Artificial Sequence: Synthetic oligonucleotide
  Target: ATXN1; (+) strand; PAM type: NRG; PAM sequence: TGG
ctggctttttgtgacagatg

SEQ ID NO: 98037 - DNA, 20 bp, Artificial Sequence
  Description of Artificial Sequence: Synthetic oligonucleotide
  Target: ATXN1; (+) strand; PAM type: NRG; PAM sequence: AAG
tttgtgacagatgtggtaaa

SEQ ID NO: 98038 - DNA, 20 bp, Artificial Sequence
  Description of Artificial Sequence: Synthetic oligonucleotide
  Target: ATXN1; (+) strand; PAM type: NRG; PAM sequence: AAG
aagaccaaaatgaattttca

SEQ ID NO: 98039 - DNA, 20 bp, Artificial Sequence
  Description of Artificial Sequence: Synthetic oligonucleotide
  Target: ATXN1; (+) strand; PAM type: NRG; PAM sequence: AGG
agaccaaaatgaattttcaa

SEQ ID NO: 98040 - DNA, 20 bp, Artificial Sequence
  Description of Artificial Sequence: Synthetic oligonucleotide
  Target: ATXN1; (+) strand; PAM type: NRG; PAM sequence: TGG
aggaacataaccttataaaa

SEQ ID NO: 98041 - DNA, 20 bp, Artificial Sequence
  Description of Artificial Sequence: Synthetic oligonucleotide
  Target: ATXN1; (+) strand; PAM type: NRG; PAM sequence: TAG
cataaccttataaaatggcc

SEQ ID NO: 98042 - DNA, 20 bp, Artificial Sequence
  Description of Artificial Sequence: Synthetic oligonucleotide
  Target: ATXN1; (+) strand; PAM type: NRG; PAM sequence: GAG
taaccttataaaatggccta

SEQ ID NO: 98043 - DNA, 20 bp, Artificial Sequence
  Description of Artificial Sequence: Synthetic oligonucleotide
  Target: ATXN1; (+) strand; PAM type: NRG; PAM sequence: TAG
ttataaaatggcctagagtt

SEQ ID NO: 98044 - DNA, 20 bp, Artificial Sequence
  Description of Artificial Sequence: Synthetic oligonucleotide
  Target: ATXN1; (+) strand; PAM type: NRG; PAM sequence: AGG
tataaaatggcctagagttt

SEQ ID NO: 98045 - DNA, 20 bp, Artificial Sequence
  Description of Artificial Sequence: Synthetic oligonucleotide
  Target: ATXN1; (+) strand; PAM type: NRG; PAM sequence: CAG
aaaatggcctagagtttagg

SEQ ID NO: 98046 - DNA, 20 bp, Artificial Sequence
  Description of Artificial Sequence: Synthetic oligonucleotide
  Target: ATXN1; (+) strand; PAM type: NRG; PAM sequence: AGG
aaatggcctagagtttaggc

SEQ ID NO: 98047 - DNA, 20 bp, Artificial Sequence
  Description of Artificial Sequence: Synthetic oligonucleotide
  Target: ATXN1; (+) strand; PAM type: NRG; PAM sequence: TAG
ggcctagagtttaggcaggt

SEQ ID NO: 98048 - DNA, 20 bp, Artificial Sequence
  Description of Artificial Sequence: Synthetic oligonucleotide
  Target: ATXN1; (+) strand; PAM type: NRG; PAM sequence: AAG
tagagtttaggcaggttaga

SEQ ID NO: 98049 - DNA, 20 bp, Artificial Sequence
  Description of Artificial Sequence: Synthetic oligonucleotide
  Target: ATXN1; (+) strand; PAM type: NRG; PAM sequence: CAG
tacatttatttatgctcgtt

SEQ ID NO: 98050 - DNA, 20 bp, Artificial Sequence
  Description of Artificial Sequence: Synthetic oligonucleotide
  Target: ATXN1; (+) strand; PAM type: NRG; PAM sequence: TGG
aacctttcccacaatgttat

SEQ ID NO: 98051 - DNA, 20 bp, Artificial Sequence
  Description of Artificial Sequence: Synthetic oligonucleotide
  Target: ATXN1; (+) strand; PAM type: NRG; PAM sequence: CAG
atgttattggataaaaactg

SEQ ID NO: 98052 - DNA, 20 bp, Artificial Sequence
  Description of Artificial Sequence: Synthetic oligonucleotide
  Target: ATXN1; (+) strand; PAM type: NRG; PAM sequence: AGG
tgttattggataaaaactgc

SEQ ID NO: 98053 - DNA, 20 bp, Artificial Sequence
  Description of Artificial Sequence: Synthetic oligonucleotide
  Target: ATXN1; (+) strand; PAM type: NRG; PAM sequence: AAG
aaactgcaggaatatcacac

SEQ ID NO: 98054 - DNA, 20 bp, Artificial Sequence
  Description of Artificial Sequence: Synthetic oligonucleotide
  Target: ATXN1; (+) strand; PAM type: NRG; PAM sequence: AAG
actcaatatgtgcaaatcgc

SEQ ID NO: 98055 - DNA, 20 bp, Artificial Sequence
  Description of Artificial Sequence: Synthetic oligonucleotide
  Target: ATXN1; (+) strand; PAM type: NRG; PAM sequence: AGG
ctcaatatgtgcaaatcgca

SEQ ID NO: 98056 - DNA, 20 bp, Artificial Sequence
  Description of Artificial Sequence: Synthetic oligonucleotide
  Target: ATXN1; (+) strand; PAM type: NRG; PAM sequence: AAG
caaatcgcaaggttctttaa

SEQ ID NO: 98057 - DNA, 20 bp, Artificial Sequence
  Description of Artificial Sequence: Synthetic oligonucleotide
  Target: ATXN1; (+) strand; PAM type: NRG; PAM sequence: AAG
ctttaaaagttcatcttaaa

SEQ ID NO: 98058 - DNA, 20 bp, Artificial Sequence
  Description of Artificial Sequence: Synthetic oligonucleotide
  Target: ATXN1; (+) strand; PAM type: NRG; PAM sequence: TGG
catcttaaaaagaaaaacac

SEQ ID NO: 98059 - DNA, 20 bp, Artificial Sequence
  Description of Artificial Sequence: Synthetic oligonucleotide
  Target: ATXN1; (+) strand; PAM type: NRG; PAM sequence: GAG
gaaaaacactggacaaaaat

SEQ ID NO: 98060 - DNA, 20 bp, Artificial Sequence
  Description of Artificial Sequence: Synthetic oligonucleotide
  Target: ATXN1; (+) strand; PAM type: NRG; PAM sequence: CAG
cttctccatcccttttctct

SEQ ID NO: 98061 - DNA, 20 bp, Artificial Sequence
  Description of Artificial Sequence: Synthetic oligonucleotide
  Target: ATXN1; (+) strand; PAM type: NRG; PAM sequence: CAG
atatgccttgaactgattct

SEQ ID NO: 98062 - DNA, 20 bp, Artificial Sequence
  Description of Artificial Sequence: Synthetic oligonucleotide
  Target: ATXN1; (+) strand; PAM type: NRG; PAM sequence: AAG
gaactgattctcagacatca

SEQ ID NO: 98063 - DNA, 20 bp, Artificial Sequence
  Description of Artificial Sequence: Synthetic oligonucleotide
  Target: ATXN1; (+) strand; PAM type: NRG; PAM sequence: AAG
ttctcagacatcaaagtgaa

SEQ ID NO: 98064 - DNA, 20 bp, Artificial Sequence
  Description of Artificial Sequence: Synthetic oligonucleotide
  Target: ATXN1; (+) strand; PAM type: NRG; PAM sequence: CAG
aagtgaaaagtgcctcccgt

SEQ ID NO: 98065 - DNA, 20 bp, Artificial Sequence
  Description of Artificial Sequence: Synthetic oligonucleotide
  Target: ATXN1; (+) strand; PAM type: NRG; PAM sequence: AGG
agtgaaaagtgcctcccgtc

SEQ ID NO: 98066 - DNA, 20 bp, Artificial Sequence
  Description of Artificial Sequence: Synthetic oligonucleotide
  Target: ATXN1; (+) strand; PAM type: NRG; PAM sequence: TAG
gaaaagtgcctcccgtcagg

SEQ ID NO: 98067 - DNA, 20 bp, Artificial Sequence
  Description of Artificial Sequence: Synthetic oligonucleotide
  Target: ATXN1; (+) strand; PAM type: NRG; PAM sequence: TGG
gcctcccgtcaggtagtact

SEQ ID NO: 98068 - DNA, 20 bp, Artificial Sequence
  Description of Artificial Sequence: Synthetic oligonucleotide
  Target: ATXN1; (+) strand; PAM type: NRG; PAM sequence: TGG
tcccgtcaggtagtacttgg

SEQ ID NO: 98069 - DNA, 20 bp, Artificial Sequence
  Description of Artificial Sequence: Synthetic oligonucleotide
  Target: ATXN1; (+) strand; PAM type: NRG; PAM sequence: TAG
ggtcatttattgtcacatac

SEQ ID NO: 98070 - DNA, 20 bp, Artificial Sequence
  Description of Artificial Sequence: Synthetic oligonucleotide
  Target: ATXN1; (+) strand; PAM type: NRG; PAM sequence: CAG
actttcaatatcttgctctt

SEQ ID NO: 98071 - DNA, 20 bp, Artificial Sequence
  Description of Artificial Sequence: Synthetic oligonucleotide
  Target: ATXN1; (+) strand; PAM type: NRG; PAM sequence: CAG
cttgctcttcagcaattctg

SEQ ID NO: 98072 - DNA, 20 bp, Artificial Sequence
  Description of Artificial Sequence: Synthetic oligonucleotide
  Target: ATXN1; (+) strand; PAM type: NRG; PAM sequence: GAG
tgctcttcagcaattctgca

SEQ ID NO: 98073 - DNA, 20 bp, Artificial Sequence
  Description of Artificial Sequence: Synthetic oligonucleotide
  Target: ATXN1; (+) strand; PAM type: NRG; PAM sequence: TAG
aattctgcagagctgaaatg

SEQ ID NO: 98074 - DNA, 20 bp, Artificial Sequence
  Description of Artificial Sequence: Synthetic oligonucleotide
  Target: ATXN1; (+) strand; PAM type: NRG; PAM sequence: CAG
gcagagctgaaatgtagtta

SEQ ID NO: 98075 - DNA, 20 bp, Artificial Sequence
  Description of Artificial Sequence: Synthetic oligonucleotide
  Target: ATXN1; (+) strand; PAM type: NRG; PAM sequence: AAG
gtagttacagtgttgaaaaa

SEQ ID NO: 98076 - DNA, 20 bp, Artificial Sequence
  Description of Artificial Sequence: Synthetic oligonucleotide
  Target: ATXN1; (+) strand; PAM type: NRG; PAM sequence: AAG
ttacagtgttgaaaaaaaga

SEQ ID NO: 98077 - DNA, 20 bp, Artificial Sequence
  Description of Artificial Sequence: Synthetic oligonucleotide
  Target: ATXN1; (+) strand; PAM type: NRG; PAM sequence: TAG
ttgaaaaaaagaaagcaact

SEQ ID NO: 98078 - DNA, 20 bp, Artificial Sequence
  Description of Artificial Sequence: Synthetic oligonucleotide
  Target: ATXN1; (+) strand; PAM type: NRG; PAM sequence: AAG
ttgtttttgttttttcccca

SEQ ID NO: 98079 - DNA, 20 bp, Artificial Sequence
  Description of Artificial Sequence: Synthetic oligonucleotide
  Target: ATXN1; (+) strand; PAM type: NRG; PAM sequence: GAG
gtttttgttttttccccaaa

SEQ ID NO: 98080 - DNA, 20 bp, Artificial Sequence
  Description of Artificial Sequence: Synthetic oligonucleotide
  Target: ATXN1; (+) strand; PAM type: NRG; PAM sequence: AAG
ttttttccccaaagagttta

SEQ ID NO: 98081 - DNA, 20 bp, Artificial Sequence
  Description of Artificial Sequence: Synthetic oligonucleotide
  Target: ATXN1; (+) strand; PAM type: NRG; PAM sequence: GAG
ttccccaaagagtttaaagt

SEQ ID NO: 98082 - DNA, 20 bp, Artificial Sequence
  Description of Artificial Sequence: Synthetic oligonucleotide
  Target: ATXN1; (+) strand; PAM type: NRG; PAM sequence: CAG
aaagagtttaaagtgagata

SEQ ID NO: 98083 - DNA, 20 bp, Artificial Sequence
  Description of Artificial Sequence: Synthetic oligonucleotide
  Target: ATXN1; (+) strand; PAM type: NRG; PAM sequence: GAG
agatacagtacttgttgaat

SEQ ID NO: 98084 - DNA, 20 bp, Artificial Sequence
  Description of Artificial Sequence: Synthetic oligonucleotide
  Target: ATXN1; (+) strand; PAM type: NRG; PAM sequence: GAG
atacagtacttgttgaatga

SEQ ID NO: 98085 - DNA, 20 bp, Artificial Sequence
  Description of Artificial Sequence: Synthetic oligonucleotide
  Target: ATXN1; (+) strand; PAM type: NRG; PAM sequence: AAG
tacttgttgaatgagagacc

SEQ ID NO: 98086 - DNA, 20 bp, Artificial Sequence
  Description of Artificial Sequence: Synthetic oligonucleotide
  Target: ATXN1; (+) strand; PAM type: NRG; PAM sequence: TGG
gaatgagagaccaagatgct

SEQ ID NO: 98087 - DNA, 20 bp, Artificial Sequence
  Description of Artificial Sequence: Synthetic oligonucleotide
  Target: ATXN1; (+) strand; PAM type: NRG; PAM sequence: AAG
gaccaagatgcttggtaata

SEQ ID NO: 98088 - DNA, 20 bp, Artificial Sequence
  Description of Artificial Sequence: Synthetic oligonucleotide
  Target: ATXN1; (+) strand; PAM type: NRG; PAM sequence: CAG
gcttggtaataaagtgtgaa

SEQ ID NO: 98089 - DNA, 20 bp, Artificial Sequence
  Description of Artificial Sequence: Synthetic oligonucleotide
  Target: ATXN1; (+) strand; PAM type: NRG; PAM sequence: AAG
acagtatttttaaatgctta

SEQ ID NO: 98090 - DNA, 20 bp, Artificial Sequence
  Description of Artificial Sequence: Synthetic oligonucleotide
  Target: ATXN1; (+) strand; PAM type: NRG; PAM sequence: TAG
tatttttaaatgcttaaaga

SEQ ID NO: 98091 - DNA, 20 bp, Artificial Sequence
  Description of Artificial Sequence: Synthetic oligonucleotide
  Target: ATXN1; (+) strand; PAM type: NRG; PAM sequence: TGG
tctaattcctcatgtcacac

SEQ ID NO: 98092 - DNA, 20 bp, Artificial Sequence
  Description of Artificial Sequence: Synthetic oligonucleotide
  Target: ATXN1; (+) strand; PAM type: NRG; PAM sequence: AAG
tggaatctgaaaaaaaaaaa

SEQ ID NO: 98093 - DNA, 20 bp, Artificial Sequence
  Description of Artificial Sequence: Synthetic oligonucleotide
  Target: ATXN1; (+) strand; PAM type: NRG; PAM sequence: TGG
aatctgaaaaaaaaaaaaag

SEQ ID NO: 98094 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaagtggcaccc

SEQ ID NO: 98095 - DNA, 20 bp, Artificial Sequence
  Description of Artificial Sequence: Synthetic oligonucleotide
  Target: ATXN1; (+) strand; PAM type: NRG; PAM sequence: TAG
agtggcacccgagttgtcca

SEQ ID NO: 98096 - DNA, 20 bp, Artificial Sequence
  Description of Artificial Sequence: Synthetic oligonucleotide
  Target: ATXN1; (+) strand; PAM type: NRG; PAM sequence: CAG
ccatagtcatgaactataaa

SEQ ID NO: 98097 - DNA, 20 bp, Artificial Sequence
  Description of Artificial Sequence: Synthetic oligonucleotide
  Target: ATXN1; (+) strand; PAM type: NRG; PAM sequence: TAG
tcatgaactataaacagtac

SEQ ID NO: 98098 - DNA, 20 bp, Artificial Sequence
  Description of Artificial Sequence: Synthetic oligonucleotide
  Target: ATXN1; (+) strand; PAM type: NRG; PAM sequence: GAG
atgaactataaacagtacta

SEQ ID NO: 98099 - DNA, 20 bp, Artificial Sequence
  Description of Artificial Sequence: Synthetic oligonucleotide
  Target: ATXN1; (+) strand; PAM type: NRG; PAM sequence: AAG
ataaacagtactagagttca

SEQ ID NO: 98100 - DNA, 20 bp, Artificial Sequence
  Description of Artificial Sequence: Synthetic oligonucleotide
  Target: ATXN1; (+) strand; PAM type: NRG; PAM sequence: AAG
tactagagttcaaagacaaa

SEQ ID NO: 98101 - DNA, 20 bp, Artificial Sequence
  Description of Artificial Sequence: Synthetic oligonucleotide
  Target: ATXN1; (+) strand; PAM type: NRG; PAM sequence: AAG
gatttcgcaaactcaacgtg

SEQ ID NO: 98102 - DNA, 20 bp, Artificial Sequence
  Description of Artificial Sequence: Synthetic oligonucleotide
  Target: ATXN1; (+) strand; PAM type: NRG; PAM sequence: GAG
tttcgcaaactcaacgtgaa

SEQ ID NO: 98103 - DNA, 20 bp, Artificial Sequence
  Description of Artificial Sequence: Synthetic oligonucleotide
  Target: ATXN1; (+) strand; PAM type: NRG; PAM sequence: AAG
agcttctgttgctctcactg

SEQ ID NO: 98104 - DNA, 20 bp, Artificial Sequence
  Description of Artificial Sequence: Synthetic oligonucleotide
  Target: ATXN1; (+) strand; PAM type: NRG; PAM sequence: AGG
gcttctgttgctctcactga

SEQ ID NO: 98105 - DNA, 20 bp, Artificial Sequence
  Description of Artificial Sequence: Synthetic oligonucleotide
  Target: ATXN1; (+) strand; PAM type: NRG; PAM sequence: GGG
cttctgttgctctcactgaa

SEQ ID NO: 98106 - DNA, 20 bp, Artificial Sequence
  Description of Artificial Sequence: Synthetic oligonucleotide
  Target: ATXN1; (+) strand; PAM type: NRG; PAM sequence: CAG
ctgttgctctcactgaaggg

SEQ ID NO: 98107 - DNA, 20 bp, Artificial Sequence
  Description of Artificial Sequence: Synthetic oligonucleotide
  Target: ATXN1; (+) strand; PAM type: NRG; PAM sequence: TGG
ggcagtttgcatctacctct

SEQ ID NO: 98108 - DNA, 20 bp, Artificial Sequence
  Description of Artificial Sequence: Synthetic oligonucleotide
  Target: ATXN1; (+) strand; PAM type: NRG; PAM sequence: GGG
gcagtttgcatctacctctt

SEQ ID NO: 98109 - DNA, 20 bp, Artificial Sequence
  Description of Artificial Sequence: Synthetic oligonucleotide
  Target: ATXN1; (+) strand; PAM type: NRG; PAM sequence: GAG
agtttgcatctacctcttgg

SEQ ID NO: 98110 - DNA, 20 bp, Artificial Sequence
  Description of Artificial Sequence: Synthetic oligonucleotide
  Target: ATXN1; (+) strand; PAM type: NRG; PAM sequence: AAG
gcatctacctcttgggagtg

SEQ ID NO: 98111 - DNA, 20 bp, Artificial Sequence
  Description of Artificial Sequence: Synthetic oligonucleotide
  Target: ATXN1; (+) strand; PAM type: NRG; PAM sequence: TGG
agtcaatgcaataacctgat

SEQ ID NO: 98112 - DNA, 20 bp, Artificial Sequence
  Description of Artificial Sequence: Synthetic oligonucleotide
  Target: ATXN1; (+) strand; PAM type: NRG; PAM sequence: CAG
ttggttttcctaacactgca

SEQ ID NO: 98113 - DNA, 20 bp, Artificial Sequence
  Description of Artificial Sequence: Synthetic oligonucleotide
  Target: ATXN1; (+) strand; PAM type: NRG; PAM sequence: CAG
tcctaacactgcacagaaac

SEQ ID NO: 98114 - DNA, 20 bp, Artificial Sequence
  Description of Artificial Sequence: Synthetic oligonucleotide
  Target: ATXN1; (+) strand; PAM type: NRG; PAM sequence: TGG
acactgcacagaaaccagcg

SEQ ID NO: 98115 - DNA, 20 bp, Artificial Sequence
  Description of Artificial Sequence: Synthetic oligonucleotide
  Target: ATXN1; (+) strand; PAM type: NRG; PAM sequence: GGG
cactgcacagaaaccagcgt

SEQ ID NO: 98116 - DNA, 20 bp, Artificial Sequence
  Description of Artificial Sequence: Synthetic oligonucleotide
  Target: ATXN1; (+) strand; PAM type: NRG; PAM sequence: TGG
ccaaccccccttaccccatg

SEQ ID NO: 98117 - DNA, 20 bp, Artificial Sequence
  Description of Artificial Sequence: Synthetic oligonucleotide
  Target: ATXN1; (+) strand; PAM type: NRG; PAM sequence: GGG
caaccccccttaccccatgt

SEQ ID NO: 98118 - DNA, 20 bp, Artificial Sequence
  Description of Artificial Sequence: Synthetic oligonucleotide
  Target: ATXN1; (+) strand; PAM type: NRG; PAM sequence: GGG
aaccccccttaccccatgtg

SEQ ID NO: 98119 - DNA, 20 bp, Artificial Sequence
  Description of Artificial Sequence: Synthetic oligonucleotide
  Target: ATXN1; (+) strand; PAM type: NRG; PAM sequence: CAG
taccccatgtggggccatga

SEQ ID NO: 98120 - DNA, 20 bp, Artificial Sequence
  Description of Artificial Sequence: Synthetic oligonucleotide
  Target: ATXN1; (+) strand; PAM type: NRG; PAM sequence: CAG
cccatgtggggccatgacag

SEQ ID NO: 98121 - DNA, 20 bp, Artificial Sequence
  Description of Artificial Sequence: Synthetic oligonucleotide
  Target: ATXN1; (+) strand; PAM type: NRG; PAM sequence: AGG
ccatgtggggccatgacagc

SEQ ID NO: 98122 - DNA, 20 bp, Artificial Sequence
  Description of Artificial Sequence: Synthetic oligonucleotide
  Target: ATXN1; (+) strand; PAM type: NRG; PAM sequence: GGG
catgtggggccatgacagca

SEQ ID NO: 98123 - DNA, 20 bp, Artificial Sequence
  Description of Artificial Sequence: Synthetic oligonucleotide
  Target: ATXN1; (+) strand; PAM type: NRG; PAM sequence: GGG
atgtggggccatgacagcag

SEQ ID NO: 98124 - DNA, 20 bp, Artificial Sequence
  Description of Artificial Sequence: Synthetic oligonucleotide
  Target: ATXN1; (+) strand; PAM type: NRG; PAM sequence: TGG
ccctgtccaccacaacaccc

SEQ ID NO: 98125 - DNA, 20 bp, Artificial Sequence
  Description of Artificial Sequence: Synthetic oligonucleotide
  Target: ATXN1; (+) strand; PAM type: NRG; PAM sequence: TAG
ccctggtgacatcgctgcac

SEQ ID NO: 98126 - DNA, 20 bp, Artificial Sequence
  Description of Artificial Sequence: Synthetic oligonucleotide
  Target: ATXN1; (+) strand; PAM type: NRG; PAM sequence: AAG
gacatcgctgcactagtaaa

SEQ ID NO: 98127 - DNA, 20 bp, Artificial Sequence
  Description of Artificial Sequence: Synthetic oligonucleotide
  Target: ATXN1; (+) strand; PAM type: NRG; PAM sequence: CAG
atcgctgcactagtaaaaag

SEQ ID NO: 98128 - DNA, 20 bp, Artificial Sequence
  Description of Artificial Sequence: Synthetic oligonucleotide
  Target: ATXN1; (+) strand; PAM type: NRG; PAM sequence: TGG
cagaaatgaaatcccgcatg

SEQ ID NO: 98129 - DNA, 20 bp, Artificial Sequence
  Description of Artificial Sequence: Synthetic oligonucleotide
  Target: ATXN1; (+) strand; PAM type: NRG; PAM sequence: CAG
aaatgaaatcccgcatgtgg

SEQ ID NO: 98130 - DNA, 20 bp, Artificial Sequence
  Description of Artificial Sequence: Synthetic oligonucleotide
  Target: ATXN1; (+) strand; PAM type: NRG; PAM sequence: CAG
tctttaaaaaaaatatatat

SEQ ID NO: 98131 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaatatatatcagtg

SEQ ID NO: 98132 - DNA, 20 bp, Artificial Sequence
  Description of Artificial Sequence: Synthetic oligonucleotide
  Target: ATXN1; (+) strand; PAM type: NRG; PAM sequence: CAG
aaaatatatatcagtgcagt

SEQ ID NO: 98133 - DNA, 20 bp, Artificial Sequence
  Description of Artificial Sequence: Synthetic oligonucleotide
  Target: ATXN1; (+) strand; PAM type: NRG; PAM sequence: AGG
aaatatatatcagtgcagtc

SEQ ID NO: 98134 - DNA, 20 bp, Artificial Sequence
  Description of Artificial Sequence: Synthetic oligonucleotide
  Target: ATXN1; (+) strand; PAM type: NRG; PAM sequence: TAG
atcagtgcagtcaggcccca

SEQ ID NO: 98135 - DNA, 20 bp, Artificial Sequence
  Description of Artificial Sequence: Synthetic oligonucleotide
  Target: ATXN1; (+) strand; PAM type: NRG; PAM sequence: AGG
tcagtgcagtcaggccccat

SEQ ID NO: 98136 - DNA, 20 bp, Artificial Sequence
  Description of Artificial Sequence: Synthetic oligonucleotide
  Target: ATXN1; (+) strand; PAM type: NRG; PAM sequence: GGG
cagtgcagtcaggccccata

SEQ ID NO: 98137 - DNA, 20 bp, Artificial Sequence
  Description of Artificial Sequence: Synthetic oligonucleotide
  Target: ATXN1; (+) strand; PAM type: NRG; PAM sequence: GGG
agtgcagtcaggccccatag

SEQ ID NO: 98138 - DNA, 20 bp, Artificial Sequence
  Description of Artificial Sequence: Synthetic oligonucleotide
  Target: ATXN1; (+) strand; PAM type: NRG; PAM sequence: GGG
gtgcagtcaggccccatagg

SEQ ID NO: 98139 - DNA, 20 bp, Artificial Sequence
  Description of Artificial Sequence: Synthetic oligonucleotide
  Target: ATXN1; (+) strand; PAM type: NRG; PAM sequence: AAG
atatatatctatacaattaa

SEQ ID NO: 98140 - DNA, 20 bp, Artificial Sequence
  Description of Artificial Sequence: Synthetic oligonucleotide
  Target: ATXN1; (+) strand; PAM type: NRG; PAM sequence: TGG
gcttttattgtaaaatatgt

SEQ ID NO: 98141 - DNA, 20 bp, Artificial Sequence
  Description of Artificial Sequence: Synthetic oligonucleotide
  Target: ATXN1; (+) strand; PAM type: NRG; PAM sequence: GAG
ttttattgtaaaatatgttg

SEQ ID NO: 98142 - DNA, 20 bp, Artificial Sequence
  Description of Artificial Sequence: Synthetic oligonucleotide
  Target: ATXN1; (+) strand; PAM type: NRG; PAM sequence: GAG
ttattgtaaaatatgttgga

SEQ ID NO: 98143 - DNA, 20 bp, Artificial Sequence
  Description of Artificial Sequence: Synthetic oligonucleotide
  Target: ATXN1; (+) strand; PAM type: NRG; PAM sequence: TGG
gagaaaaatgttcttttaaa

SEQ ID NO: 98144 - DNA, 20 bp, Artificial Sequence
  Description of Artificial Sequence: Synthetic oligonucleotide
  Target: ATXN1; (+) strand; PAM type: NRG; PAM sequence: AAG
cgcgtctccgcgatgccctg

SEQ ID NO: 98145 - DNA, 20 bp, Artificial Sequence
  Description of Artificial Sequence: Synthetic oligonucleotide
  Target: ATXN1; (+) strand; PAM type: NRG; PAM sequence: TGG
tctccgcgatgccctgaagc

SEQ ID NO: 98146 - DNA, 20 bp, Artificial Sequence
  Description of Artificial Sequence: Synthetic oligonucleotide
  Target: ATXN1; (+) strand; PAM type: NRG; PAM sequence: GGG
ctccgcgatgccctgaagct

SEQ ID NO: 98147 - DNA, 20 bp, Artificial Sequence
  Description of Artificial Sequence: Synthetic oligonucleotide
  Target: ATXN1; (+) strand; PAM type: NRG; PAM sequence: TGG
cctgatgttgattttgcacg

SEQ ID NO: 98148 - DNA, 20 bp, Artificial Sequence
  Description of Artificial Sequence: Synthetic oligonucleotide
  Target: ATXN1; (+) strand; PAM type: NRG; PAM sequence: GGG
ctgatgttgattttgcacgt

SEQ ID NO: 98149 - DNA, 20 bp, Artificial Sequence
  Description of Artificial Sequence: Synthetic oligonucleotide
  Target: ATXN1; (+) strand; PAM type: NRG; PAM sequence: CAG
gattttgcacgtgggaaccc

SEQ ID NO: 98150 - DNA, 20 bp, Artificial Sequence
  Description of Artificial Sequence: Synthetic oligonucleotide
  Target: ATXN1; (+) strand; PAM type: NRG; PAM sequence: AGG
attttgcacgtgggaacccc

SEQ ID NO: 98151 - DNA, 20 bp, Artificial Sequence
  Description of Artificial Sequence: Synthetic oligonucleotide
  Target: ATXN1; (+) strand; PAM type: NRG; PAM sequence: GAG
tttgcacgtgggaaccccag

SEQ ID NO: 98152 - DNA, 20 bp, Artificial Sequence
  Description of Artificial Sequence: Synthetic oligonucleotide
  Target: ATXN1; (+) strand; PAM type: NRG; PAM sequence: AGG
ttgcacgtgggaaccccagg

SEQ ID NO: 98153 - DNA, 20 bp, Artificial Sequence
  Description of Artificial Sequence: Synthetic oligonucleotide
  Target: ATXN1; (+) strand; PAM type: NRG; PAM sequence: CGG
gacactgctctgaacccccc

SEQ ID NO: 98154 - DNA, 20 bp, Artificial Sequence
  Description of Artificial Sequence: Synthetic oligonucleotide
  Target: ATXN1; (+) strand; PAM type: NRG; PAM sequence: TAG
acccccccggcccatgccga

SEQ ID NO: 98155 - DNA, 20 bp, Artificial Sequence
  Description of Artificial Sequence: Synthetic oligonucleotide
  Target: ATXN1; (+) strand; PAM type: NRG; PAM sequence: AAG
ccccggcccatgccgatagc

SEQ ID NO: 98156 - DNA, 20 bp, Artificial Sequence
  Description of Artificial Sequence: Synthetic oligonucleotide
  Target: ATXN1; (+) strand; PAM type: NRG; PAM sequence: GAG
ccggcccatgccgatagcaa

SEQ ID NO: 98157 - DNA, 20 bp, Artificial Sequence
  Description of Artificial Sequence: Synthetic oligonucleotide
  Target: ATXN1; (+) strand; PAM type: NRG; PAM sequence: GAG
ggcccatgccgatagcaaga

SEQ ID NO: 98158 - DNA, 20 bp, Artificial Sequence
  Description of Artificial Sequence: Synthetic oligonucleotide
  Target: ATXN1; (+) strand; PAM type: NRG; PAM sequence: GAG
catgccgatagcaagagagt

SEQ ID NO: 98159 - DNA, 20 bp, Artificial Sequence
  Description of Artificial Sequence: Synthetic oligonucleotide
  Target: ATXN1; (+) strand; PAM type: NRG; PAM sequence: AGG
atgccgatagcaagagagtg

SEQ ID NO: 98160 - DNA, 20 bp, Artificial Sequence
  Description of Artificial Sequence: Synthetic oligonucleotide
  Target: ATXN1; (+) strand; PAM type: NRG; PAM sequence: CAG
ccgatagcaagagagtgagg

SEQ ID NO: 98161 - DNA, 20 bp, Artificial Sequence
  Description of Artificial Sequence: Synthetic oligonucleotide
  Target: ATXN1; (+) strand; PAM type: NRG; PAM sequence: GAG
gatagcaagagagtgaggca

SEQ ID NO: 98162 - DNA, 20 bp, Artificial Sequence
  Description of Artificial Sequence: Synthetic oligonucleotide
  Target: ATXN1; (+) strand; PAM type: NRG; PAM sequence: AGG
atagcaagagagtgaggcag

SEQ ID NO: 98163 - DNA, 20 bp, Artificial Sequence
  Description of Artificial Sequence: Synthetic oligonucleotide
  Target: ATXN1; (+) strand; PAM type: NRG; PAM sequence: GGG
tagcaagagagtgaggcaga

SEQ ID NO: 98164 - DNA, 20 bp, Artificial Sequence
  Description of Artificial Sequence: Synthetic oligonucleotide
  Target: ATXN1; (+) strand; PAM type: NRG; PAM sequence: GAG
gcaagagagtgaggcagagg

SEQ ID NO: 98165 - DNA, 20 bp, Artificial Sequence
  Description of Artificial Sequence: Synthetic oligonucleotide
  Target: ATXN1; (+) strand; PAM type: NRG; PAM sequence: AGG
caagagagtgaggcagaggg

SEQ ID NO: 98166 - DNA, 20 bp, Artificial Sequence
  Description of Artificial Sequence: Synthetic oligonucleotide
  Target: ATXN1; (+) strand; PAM type: NRG; PAM sequence: CAG
gagagtgaggcagagggagg

SEQ ID NO: 98167 - DNA, 20 bp, Artificial Sequence
  Description of Artificial Sequence: Synthetic oligonucleotide
  Target: ATXN1; (+) strand; PAM type: NRG; PAM sequence: GAG
gagtgaggcagagggaggca

SEQ ID NO: 98168 - DNA, 20 bp, Artificial Sequence
  Description of Artificial Sequence: Synthetic oligonucleotide
  Target: ATXN1; (+) strand; PAM type: NRG; PAM sequence: AAG
ggcagagggaggcagagaaa

SEQ ID NO: 98169 - DNA, 20 bp, Artificial Sequence
  Description of Artificial Sequence: Synthetic oligonucleotide
  Target: ATXN1; (+) strand; PAM type: NRG; PAM sequence: GAG
cagagggaggcagagaaaaa

SEQ ID NO: 98170 - DNA, 20 bp, Artificial Sequence
  Description of Artificial Sequence: Synthetic oligonucleotide
  Target: ATXN1; (+) strand; PAM type: NRG; PAM sequence: CAG
gagaccctcactcgccgcca

SEQ ID NO: 98171 - DNA, 20 bp, Artificial Sequence
  Description of Artificial Sequence: Synthetic oligonucleotide
  Target: ATXN1; (+) strand; PAM type: NRG; PAM sequence: CAG
cgtgcaaccctgcacccctg

SEQ ID NO: 98172 - DNA, 20 bp, Artificial Sequence
  Description of Artificial Sequence: Synthetic oligonucleotide
  Target: ATXN1; (+) strand; PAM type: NRG; PAM sequence: AGG
gtgcaaccctgcacccctgc

SEQ ID NO: 98173 - DNA, 20 bp, Artificial Sequence
  Description of Artificial Sequence: Synthetic oligonucleotide
  Target: ATXN1; (+) strand; PAM type: NRG; PAM sequence: CGG
cccctgcaggacccttccca

SEQ ID NO: 98174 - DNA, 20 bp, Artificial Sequence
  Description of Artificial Sequence: Synthetic oligonucleotide
  Target: ATXN1; (+) strand; PAM type: NRG; PAM sequence: GGG
ccctgcaggacccttcccac

SEQ ID NO: 98175 - DNA, 20 bp, Artificial Sequence
  Description of Artificial Sequence: Synthetic oligonucleotide
  Target: ATXN1; (+) strand; PAM type: NRG; PAM sequence: TAG
cgggacttttctcctgacac

SEQ ID NO: 98176 - DNA, 20 bp, Artificial Sequence
  Description of Artificial Sequence: Synthetic oligonucleotide
  Target: ATXN1; (+) strand; PAM type: NRG; PAM sequence: CGG
gacttttctcctgacactag

SEQ ID NO: 98177 - DNA, 20 bp, Artificial Sequence
  Description of Artificial Sequence: Synthetic oligonucleotide
  Target: ATXN1; (+) strand; PAM type: NRG; PAM sequence: GGG
acttttctcctgacactagc

SEQ ID NO: 98178 - DNA, 20 bp, Artificial Sequence
  Description of Artificial Sequence: Synthetic oligonucleotide
  Target: ATXN1; (+) strand; PAM type: NRG; PAM sequence: GAG
ttttctcctgacactagcgg

SEQ ID NO: 98179 - DNA, 20 bp, Artificial Sequence
  Description of Artificial Sequence: Synthetic oligonucleotide
  Target: ATXN1; (+) strand; PAM type: NRG; PAM sequence: CAG
ctcctgacactagcgggagt

SEQ ID NO: 98180 - DNA, 20 bp, Artificial Sequence
  Description of Artificial Sequence: Synthetic oligonucleotide
  Target: ATXN1; (+) strand; PAM type: NRG; PAM sequence: CGG
ctagcgggagtcagcgcccc

SEQ ID NO: 98181 - DNA, 20 bp, Artificial Sequence
  Description of Artificial Sequence: Synthetic oligonucleotide
  Target: ATXN1; (+) strand; PAM type: NRG; PAM sequence: TAG
cccggctgcttctgtgccgc

SEQ ID NO: 98182 - DNA, 20 bp, Artificial Sequence
  Description of Artificial Sequence: Synthetic oligonucleotide
  Target: ATXN1; (+) strand; PAM type: NRG; PAM sequence: GAG
cggctgcttctgtgccgcta

SEQ ID NO: 98183 - DNA, 20 bp, Artificial Sequence
  Description of Artificial Sequence: Synthetic oligonucleotide
  Target: ATXN1; (+) strand; PAM type: NRG; PAM sequence: AAG
ctgcttctgtgccgctagag

SEQ ID NO: 98184 - DNA, 20 bp, Artificial Sequence
  Description of Artificial Sequence: Synthetic oligonucleotide
  Target: ATXN1; (+) strand; PAM type: NRG; PAM sequence: AGG
tgcttctgtgccgctagaga

SEQ ID NO: 98185 - DNA, 20 bp, Artificial Sequence
  Description of Artificial Sequence: Synthetic oligonucleotide
  Target: ATXN1; (+) strand; PAM type: NRG; PAM sequence: CAG
ttctgtgccgctagagaagg

SEQ ID NO: 98186 - DNA, 20 bp, Artificial Sequence
  Description of Artificial Sequence: Synthetic oligonucleotide
  Target: ATXN1; (+) strand; PAM type: NRG; PAM sequence: AGG
tctgtgccgctagagaaggc

SEQ ID NO: 98187 - DNA, 20 bp, Artificial Sequence
  Description of Artificial Sequence: Synthetic oligonucleotide
  Target: ATXN1; (+) strand; PAM type: NRG; PAM sequence: AAG
tagagaaggcaggcactgtg

SEQ ID NO: 98188 - DNA, 20 bp, Artificial Sequence
  Description of Artificial Sequence: Synthetic oligonucleotide
  Target: ATXN1; (+) strand; PAM type: NRG; PAM sequence: CGG
agccccgttcctttcttccc

SEQ ID NO: 98189 - DNA, 20 bp, Artificial Sequence
  Description of Artificial Sequence: Synthetic oligonucleotide
  Target: ATXN1; (+) strand; PAM type: NRG; PAM sequence: GGG
gccccgttcctttcttcccc

SEQ ID NO: 98190 - DNA, 20 bp, Artificial Sequence
  Description of Artificial Sequence: Synthetic oligonucleotide
  Target: ATXN1; (+) strand; PAM type: NRG; PAM sequence: GGG
ccccgttcctttcttccccg

SEQ ID NO: 98191 - DNA, 20 bp, Artificial Sequence
  Description of Artificial Sequence: Synthetic oligonucleotide
  Target: ATXN1; (+) strand; PAM type: NRG; PAM sequence: TGG
ctttcttccccggggatgcc

SEQ ID NO: 98192 - DNA, 20 bp, Artificial Sequence
  Description of Artificial Sequence: Synthetic oligonucleotide
  Target: ATXN1; (+) strand; PAM type: NRG; PAM sequence: GAG
ttcttccccggggatgcctg

SEQ ID NO: 98193 - DNA, 20 bp, Artificial Sequence
  Description of Artificial Sequence: Synthetic oligonucleotide
  Target: ATXN1; (+) strand; PAM type: NRG; PAM sequence: CAG
tcctcccgcccgctcactga

SEQ ID NO: 98194 - DNA, 20 bp, Artificial Sequence
  Description of Artificial Sequence: Synthetic oligonucleotide
  Target: ATXN1; (+) strand; PAM type: NRG; PAM sequence: TGG
cgctcactgacagacactcg

SEQ ID NO: 98195 - DNA, 20 bp, Artificial Sequence
  Description of Artificial Sequence: Synthetic oligonucleotide
  Target: ATXN1; (+) strand; PAM type: NRG; PAM sequence: AAG
ctgacagacactcgtggaaa

SEQ ID NO: 98196 - DNA, 20 bp, Artificial Sequence
  Description of Artificial Sequence: Synthetic oligonucleotide
  Target: ATXN1; (+) strand; PAM type: NRG; PAM sequence: CAG
cgtggaaaaagcatatgcac

SEQ ID NO: 98197 - DNA, 20 bp, Artificial Sequence
  Description of Artificial Sequence: Synthetic oligonucleotide
  Target: ATXN1; (+) strand; PAM type: NRG; PAM sequence: AAG
cctgctgtaactctaatgac

SEQ ID NO: 98198 - DNA, 20 bp, Artificial Sequence
  Description of Artificial Sequence: Synthetic oligonucleotide
  Target: ATXN1; (+) strand; PAM type: NRG; PAM sequence: AGG
ctgctgtaactctaatgaca

SEQ ID NO: 98199 - DNA, 20 bp, Artificial Sequence
  Description of Artificial Sequence: Synthetic oligonucleotide
  Target: ATXN1; (+) strand; PAM type: NRG; PAM sequence: TAG
tgtaactctaatgacaaggt

SEQ ID NO: 98200 - DNA, 20 bp, Artificial Sequence
  Description of Artificial Sequence: Synthetic oligonucleotide
  Target: ATXN1; (+) strand; PAM type: NRG; PAM sequence: CAG
ctctaatgacaaggttagaa

SEQ ID NO: 98201 - DNA, 20 bp, Artificial Sequence
  Description of Artificial Sequence: Synthetic oligonucleotide
  Target: ATXN1; (+) strand; PAM type: NRG; PAM sequence: AAG
tagaacagaaacctaaaatt

SEQ ID NO: 98202 - DNA, 20 bp, Artificial Sequence
  Description of Artificial Sequence: Synthetic oligonucleotide
  Target: ATXN1; (+) strand; PAM type: NRG; PAM sequence: AAG
aacagaaacctaaaattaag

SEQ ID NO: 98203 - DNA, 20 bp, Artificial Sequence
  Description of Artificial Sequence: Synthetic oligonucleotide
  Target: ATXN1; (+) strand; PAM type: NRG; PAM sequence: TAG
atgtaaatactgtgttattt

SEQ ID NO: 98204 - DNA, 20 bp, Artificial Sequence
  Description of Artificial Sequence: Synthetic oligonucleotide
  Target: ATXN1; (+) strand; PAM type: NRG; PAM sequence: CAG
tactgtgttattttagccta

SEQ ID NO: 98205 - DNA, 20 bp, Artificial Sequence
  Description of Artificial Sequence: Synthetic oligonucleotide
  Target: ATXN1; (+) strand; PAM type: NRG; PAM sequence: CAG
tgttattttagcctacagta

SEQ ID NO: 98206 - DNA, 20 bp, Artificial Sequence
  Description of Artificial Sequence: Synthetic oligonucleotide
  Target: ATXN1; (+) strand; PAM type: NRG; PAM sequence: TGG
tagcctacagtacagtaatc

SEQ ID NO: 98207 - DNA, 20 bp, Artificial Sequence
  Description of Artificial Sequence: Synthetic oligonucleotide
  Target: ATXN1; (+) strand; PAM type: NRG; PAM sequence: AAG
gtaatctggatacaaatgat

SEQ ID NO: 98208 - DNA, 20 bp, Artificial Sequence
  Description of Artificial Sequence: Synthetic oligonucleotide
  Target: ATXN1; (+) strand; PAM type: NRG; PAM sequence: AGG
taatctggatacaaatgata

SEQ ID NO: 98209 - DNA, 20 bp, Artificial Sequence
  Description of Artificial Sequence: Synthetic oligonucleotide
  Target: ATXN1; (+) strand; PAM type: NRG; PAM sequence: GGG
aatctggatacaaatgataa

SEQ ID NO: 98210 - DNA, 20 bp, Artificial Sequence
  Description of Artificial Sequence: Synthetic oligonucleotide
  Target: ATXN1; (+) strand; PAM type: NRG; PAM sequence: GAG
tctggatacaaatgataagg

SEQ ID NO: 98211 - DNA, 20 bp, Artificial Sequence
  Description of Artificial Sequence: Synthetic oligonucleotide
  Target: ATXN1; (+) strand; PAM type: NRG; PAM sequence: GAG
tggatacaaatgataaggga

SEQ ID NO: 98212 - DNA, 20 bp, Artificial Sequence
  Description of Artificial Sequence: Synthetic oligonucleotide
  Target: ATXN1; (+) strand; PAM type: NRG; PAM sequence: TAG
ctgcctctacttgcctacat

SEQ ID NO: 98213 - DNA, 20 bp, Artificial Sequence
  Description of Artificial Sequence: Synthetic oligonucleotide
  Target: ATXN1; (+) strand; PAM type: NRG; PAM sequence: CGG
tctacttgcctacattagac

SEQ ID NO: 98214 - DNA, 20 bp, Artificial Sequence
  Description of Artificial Sequence: Synthetic oligonucleotide
  Target: ATXN1; (+) strand; PAM type: NRG; PAM sequence: GAG
aatgcaaatcttaacctcct

SEQ ID NO: 98215 - DNA, 20 bp, Artificial Sequence
  Description of Artificial Sequence: Synthetic oligonucleotide
  Target: ATXN1; (+) strand; PAM type: NRG; PAM sequence: AGG
atgcaaatcttaacctcctg

SEQ ID NO: 98216 - DNA, 20 bp, Artificial Sequence
  Description of Artificial Sequence: Synthetic oligonucleotide
  Target: ATXN1; (+) strand; PAM type: NRG; PAM sequence: TAG
atcttaacctcctgaggaat

SEQ ID NO: 98217 - DNA, 20 bp, Artificial Sequence
  Description of Artificial Sequence: Synthetic oligonucleotide
  Target: ATXN1; (+) strand; PAM type: NRG; PAM sequence: GAG
cttaacctcctgaggaatta

SEQ ID NO: 98218 - DNA, 20 bp, Artificial Sequence
  Description of Artificial Sequence: Synthetic oligonucleotide
  Target: ATXN1; (+) strand; PAM type: NRG; PAM sequence: AAG
aacctcctgaggaattagag

SEQ ID NO: 98219 - DNA, 20 bp, Artificial Sequence
  Description of Artificial Sequence: Synthetic oligonucleotide
  Target: ATXN1; (+) strand; PAM type: NRG; PAM sequence: AGG
acctcctgaggaattagaga

SEQ ID NO: 98220 - DNA, 20 bp, Artificial Sequence
  Description of Artificial Sequence: Synthetic oligonucleotide
  Target: ATXN1; (+) strand; PAM type: NRG; PAM sequence: TAG
ctgaggaattagagaaggct

SEQ ID NO: 98221 - DNA, 20 bp, Artificial Sequence
  Description of Artificial Sequence: Synthetic oligonucleotide
  Target: ATXN1; (+) strand; PAM type: NRG; PAM sequence: AGG
tgaggaattagagaaggctt

SEQ ID NO: 98222 - DNA, 20 bp, Artificial Sequence
  Description of Artificial Sequence: Synthetic oligonucleotide
  Target: ATXN1; (+) strand; PAM type: NRG; PAM sequence: AAG
ggaattagagaaggcttagg

SEQ ID NO: 98223 - DNA, 20 bp, Artificial Sequence
  Description of Artificial Sequence: Synthetic oligonucleotide
  Target: ATXN1; (+) strand; PAM type: NRG; PAM sequence: GAG
aattagagaaggcttaggaa

SEQ ID NO: 98224 - DNA, 20 bp, Artificial Sequence
  Description of Artificial Sequence: Synthetic oligonucleotide
  Target: ATXN1; (+) strand; PAM type: NRG; PAM sequence: AAG
agaaggcttaggaagagtca

SEQ ID NO: 98225 - DNA, 20 bp, Artificial Sequence
  Description of Artificial Sequence: Synthetic oligonucleotide
  Target: ATXN1; (+) strand; PAM type: NRG; PAM sequence: AGG
gaaggcttaggaagagtcaa

SEQ ID NO: 98226 - DNA, 20 bp, Artificial Sequence
  Description of Artificial Sequence: Synthetic oligonucleotide
  Target: ATXN1; (+) strand; PAM type: NRG; PAM sequence: TGG
ggcttaggaagagtcaaagg

SEQ ID NO: 98227 - DNA, 20 bp, Artificial Sequence
  Description of Artificial Sequence: Synthetic oligonucleotide
  Target: ATXN1; (+) strand; PAM type: NRG; PAM sequence: CAG
ggttcgtcttctgacttctc

SEQ ID NO: 98228 - DNA, 20 bp, Artificial Sequence
  Description of Artificial Sequence: Synthetic oligonucleotide
  Target: ATXN1; (+) strand; PAM type: NRG; PAM sequence: CGG
cttctgacttctccagtttg

SEQ ID NO: 98229 - DNA, 20 bp, Artificial Sequence
  Description of Artificial Sequence: Synthetic oligonucleotide
  Target: ATXN1; (+) strand; PAM type: NRG; PAM sequence: TGG
ttctccagtttgcggctctc

SEQ ID NO: 98230 - DNA, 20 bp, Artificial Sequence
  Description of Artificial Sequence: Synthetic oligonucleotide
  Target: ATXN1; (+) strand; PAM type: NRG; PAM sequence: CGG
cctcctcttcctcgttgccg

SEQ ID NO: 98231 - DNA, 20 bp, Artificial Sequence
  Description of Artificial Sequence: Synthetic oligonucleotide
  Target: ATXN1; (+) strand; PAM type: NRG; PAM sequence: GGG
ctcctcttcctcgttgccgc

SEQ ID NO: 98232 - DNA, 20 bp, Artificial Sequence
  Description of Artificial Sequence: Synthetic oligonucleotide
  Target: ATXN1; (+) strand; PAM type: NRG; PAM sequence: TGG
cctcgttgccgcgggcttgc

SEQ ID NO: 98233 - DNA, 20 bp, Artificial Sequence
  Description of Artificial Sequence: Synthetic oligonucleotide
  Target: ATXN1; (+) strand; PAM type: NRG; PAM sequence: GGG
ctcgttgccgcgggcttgct

SEQ ID NO: 98234 - DNA, 20 bp, Artificial Sequence
  Description of Artificial Sequence: Synthetic oligonucleotide
  Target: ATXN1; (+) strand; PAM type: NRG; PAM sequence: TGG
gggcttgctgggttctattt

SEQ ID NO: 98235 - DNA, 20 bp, Artificial Sequence
  Description of Artificial Sequence: Synthetic oligonucleotide
  Target: ATXN1; (+) strand; PAM type: NRG; PAM sequence: GAG
ttgctgggttctattttggt

SEQ ID NO: 98236 - DNA, 20 bp, Artificial Sequence
  Description of Artificial Sequence: Synthetic oligonucleotide
  Target: ATXN1; (+) strand; PAM type: NRG; PAM sequence: AGG
tgctgggttctattttggtg

SEQ ID NO: 98237 - DNA, 20 bp, Artificial Sequence
  Description of Artificial Sequence: Synthetic oligonucleotide
  Target: ATXN1; (+) strand; PAM type: NRG; PAM sequence: AAG
tgggttctattttggtgagg

SEQ ID NO: 98238 - DNA, 20 bp, Artificial Sequence
  Description of Artificial Sequence: Synthetic oligonucleotide
  Target: ATXN1; (+) strand; PAM type: NRG; PAM sequence: AGG
gggttctattttggtgagga

SEQ ID NO: 98239 - DNA, 20 bp, Artificial Sequence
  Description of Artificial Sequence: Synthetic oligonucleotide
  Target: ATXN1; (+) strand; PAM type: NRG; PAM sequence: GGG
ggttctattttggtgaggaa

SEQ ID NO: 98240 - DNA, 20 bp, Artificial Sequence
  Description of Artificial Sequence: Synthetic oligonucleotide
  Target: ATXN1; (+) strand; PAM type: NRG; PAM sequence: CAG
tttggtgaggaagggcgctg

SEQ ID NO: 98241 - DNA, 20 bp, Artificial Sequence
  Description of Artificial Sequence: Synthetic oligonucleotide
  Target: ATXN1; (+) strand; PAM type: NRG; PAM sequence: AGG
ttggtgaggaagggcgctgc

SEQ ID NO: 98242 - DNA, 20 bp, Artificial Sequence
  Description of Artificial Sequence: Synthetic oligonucleotide
  Target: ATXN1; (+) strand; PAM type: NRG; PAM sequence: TGG
gcaggcaatcccattttctc

SEQ ID NO: 98243 - DNA, 20 bp, Artificial Sequence
  Description of Artificial Sequence: Synthetic oligonucleotide
  Target: ATXN1; (+) strand; PAM type: NRG; PAM sequence: CAG
cccattttctctggaaactt

SEQ ID NO: 98244 - DNA, 20 bp, Artificial Sequence
  Description of Artificial Sequence: Synthetic oligonucleotide
  Target: ATXN1; (+) strand; PAM type: NRG; PAM sequence: CAG
aaacttcagttcgccattct

SEQ ID NO: 98245 - DNA, 20 bp, Artificial Sequence
  Description of Artificial Sequence: Synthetic oligonucleotide
  Target: ATXN1; (+) strand; PAM type: NRG; PAM sequence: GAG
acttcagttcgccattctca

SEQ ID NO: 98246 - DNA, 20 bp, Artificial Sequence
  Description of Artificial Sequence: Synthetic oligonucleotide
  Target: ATXN1; (+) strand; PAM type: NRG; PAM sequence: GAG
ttcagttcgccattctcaga

SEQ ID NO: 98247 - DNA, 20 bp, Artificial Sequence
  Description of Artificial Sequence: Synthetic oligonucleotide
  Target: ATXN1; (+) strand; PAM type: NRG; PAM sequence: TGG
cgccattctcagagagcatc

SEQ ID NO: 98248 - DNA, 20 bp, Artificial Sequence
  Description of Artificial Sequence: Synthetic oligonucleotide
  Target: ATXN1; (+) strand; PAM type: NRG; PAM sequence: GGG
gccattctcagagagcatct

SEQ ID NO: 98249 - DNA, 20 bp, Artificial Sequence
  Description of Artificial Sequence: Synthetic oligonucleotide
  Target: ATXN1; (+) strand; PAM type: NRG; PAM sequence: TGG
agagcatctgggcactcccc

SEQ ID NO: 98250 - DNA, 20 bp, Artificial Sequence
  Description of Artificial Sequence: Synthetic oligonucleotide
  Target: ATXN1; (+) strand; PAM type: NRG; PAM sequence: CGG
gttgattccgttttcctgct

SEQ ID NO: 98251 - DNA, 20 bp, Artificial Sequence
  Description of Artificial Sequence: Synthetic oligonucleotide
  Target: ATXN1; (+) strand; PAM type: NRG; PAM sequence: CAG
tacctgtgtctgctgcccgc

SEQ ID NO: 98252 - DNA, 20 bp, Artificial Sequence
  Description of Artificial Sequence: Synthetic oligonucleotide
  Target: ATXN1; (+) strand; PAM type: NRG; PAM sequence: AGG
acctgtgtctgctgcccgcc

SEQ ID NO: 98253 - DNA, 20 bp, Artificial Sequence
  Description of Artificial Sequence: Synthetic oligonucleotide
  Target: ATXN1; (+) strand; PAM type: NRG; PAM sequence: CGG
tctgctgcccgccaggccgt

SEQ ID NO: 98254 - DNA, 20 bp, Artificial Sequence
  Description of Artificial Sequence: Synthetic oligonucleotide
  Target: ATXN1; (+) strand; PAM type: NRG; PAM sequence: GAG
ccgccaggccgtcggccttt

SEQ ID NO: 98255 - DNA, 20 bp, Artificial Sequence
  Description of Artificial Sequence: Synthetic oligonucleotide
  Target: ATXN1; (+) strand; PAM type: NRG; PAM sequence: CAG
ccgtcggcctttgagtgctt

SEQ ID NO: 98256 - DNA, 20 bp, Artificial Sequence
  Description of Artificial Sequence: Synthetic oligonucleotide
  Target: ATXN1; (+) strand; PAM type: NRG; PAM sequence: CAG
tcggcctttgagtgcttcag

SEQ ID NO: 98257 - DNA, 20 bp, Artificial Sequence
  Description of Artificial Sequence: Synthetic oligonucleotide
  Target: ATXN1; (+) strand; PAM type: NRG; PAM sequence: AGG
cggcctttgagtgcttcagc

SEQ ID NO: 98258 - DNA, 20 bp, Artificial Sequence
  Description of Artificial Sequence: Synthetic oligonucleotide
  Target: ATXN1; (+) strand; PAM type: NRG; PAM sequence: TGG
tgagtgcttcagcaggacgc

SEQ ID NO: 98259 - DNA, 20 bp, Artificial Sequence
  Description of Artificial Sequence: Synthetic oligonucleotide
  Target: ATXN1; (+) strand; PAM type: NRG; PAM sequence: CGG
gtgcttcagcaggacgctgg

SEQ ID NO: 98260 - DNA, 20 bp, Artificial Sequence
  Description of Artificial Sequence: Synthetic oligonucleotide
  Target: ATXN1; (+) strand; PAM type: NRG; PAM sequence: GGG
tgcttcagcaggacgctggc

SEQ ID NO: 98261 - DNA, 20 bp, Artificial Sequence
  Description of Artificial Sequence: Synthetic oligonucleotide
  Target: ATXN1; (+) strand; PAM type: NRG; PAM sequence: CGG
caggacgctggcgggatcca

SEQ ID NO: 98262 - DNA, 20 bp, Artificial Sequence
  Description of Artificial Sequence: Synthetic oligonucleotide
  Target: ATXN1; (+) strand; PAM type: NRG; PAM sequence: GGG
aggacgctggcgggatccac

SEQ ID NO: 98263 - DNA, 20 bp, Artificial Sequence
  Description of Artificial Sequence: Synthetic oligonucleotide
  Target: ATXN1; (+) strand; PAM type: NRG; PAM sequence: TGG
cgctggcgggatccacgggc

SEQ ID NO: 98264 - DNA, 20 bp, Artificial Sequence
  Description of Artificial Sequence: Synthetic oligonucleotide
  Target: ATXN1; (+) strand; PAM type: NRG; PAM sequence: CAG
cacgggctggccctttttaa

SEQ ID NO: 98265 - DNA, 20 bp, Artificial Sequence
  Description of Artificial Sequence: Synthetic oligonucleotide
  Target: ATXN1; (+) strand; PAM type: NRG; PAM sequence: GAG
cgggctggccctttttaaca

SEQ ID NO: 98266 - DNA, 20 bp, Artificial Sequence
  Description of Artificial Sequence: Synthetic oligonucleotide
  Target: ATXN1; (+) strand; PAM type: NRG; PAM sequence: CAG
tttttaacagagccgttctt

SEQ ID NO: 98267 - DNA, 20 bp, Artificial Sequence
  Description of Artificial Sequence: Synthetic oligonucleotide
  Target: ATXN1; (+) strand; PAM type: NRG; PAM sequence: AGG
ttttaacagagccgttcttc

SEQ ID NO: 98268 - DNA, 20 bp, Artificial Sequence
  Description of Artificial Sequence: Synthetic oligonucleotide
  Target: ATXN1; (+) strand; PAM type: NRG; PAM sequence: GAG
gagccgttcttcaggttctt

SEQ ID NO: 98269 - DNA, 20 bp, Artificial Sequence
  Description of Artificial Sequence: Synthetic oligonucleotide
  Target: ATXN1; (+) strand; PAM type: NRG; PAM sequence: AGG
agccgttcttcaggttcttg

SEQ ID NO: 98270 - DNA, 20 bp, Artificial Sequence
  Description of Artificial Sequence: Synthetic oligonucleotide
  Target: ATXN1; (+) strand; PAM type: NRG; PAM sequence: GGG
gccgttcttcaggttcttga

SEQ ID NO: 98271 - DNA, 20 bp, Artificial Sequence
  Description of Artificial Sequence: Synthetic oligonucleotide
  Target: ATXN1; (+) strand; PAM type: NRG; PAM sequence: AAG
ttcttcaggttcttgagggt

SEQ ID NO: 98272 - DNA, 20 bp, Artificial Sequence
  Description of Artificial Sequence: Synthetic oligonucleotide
  Target: ATXN1; (+) strand; PAM type: NRG; PAM sequence: GAG
tcaggttcttgagggtaagc

SEQ ID NO: 98273 - DNA, 20 bp, Artificial Sequence
  Description of Artificial Sequence: Synthetic oligonucleotide
  Target: ATXN1; (+) strand; PAM type: NRG; PAM sequence: CAG
tcttgagggtaagcgagatg

SEQ ID NO: 98274 - DNA, 20 bp, Artificial Sequence
  Description of Artificial Sequence: Synthetic oligonucleotide
  Target: ATXN1; (+) strand; PAM type: NRG; PAM sequence: GAG
agatgcagacatccccaact

SEQ ID NO: 98275 - DNA, 20 bp, Artificial Sequence
  Description of Artificial Sequence: Synthetic oligonucleotide
  Target: ATXN1; (+) strand; PAM type: NRG; PAM sequence: GAG
atgcagacatccccaactga

SEQ ID NO: 98276 - DNA, 20 bp, Artificial Sequence
  Description of Artificial Sequence: Synthetic oligonucleotide
  Target: ATXN1; (+) strand; PAM type: NRG; PAM sequence: TGG
gacatccccaactgagagtt

SEQ ID NO: 98277 - DNA, 20 bp, Artificial Sequence
  Description of Artificial Sequence: Synthetic oligonucleotide
  Target: ATXN1; (+) strand; PAM type: NRG; PAM sequence: CGG
ccaactgagagtttggaaca

SEQ ID NO: 98278 - DNA, 20 bp, Artificial Sequence
  Description of Artificial Sequence: Synthetic oligonucleotide
  Target: ATXN1; (+) strand; PAM type: NRG; PAM sequence: AAG
gtttggaacacggcaaatca

SEQ ID NO: 98279 - DNA, 20 bp, Artificial Sequence
  Description of Artificial Sequence: Synthetic oligonucleotide
  Target: ATXN1; (+) strand; PAM type: NRG; PAM sequence: GAG
ttggaacacggcaaatcaaa

SEQ ID NO: 98280 - DNA, 20 bp, Artificial Sequence
  Description of Artificial Sequence: Synthetic oligonucleotide
  Target: ATXN1; (+) strand; PAM type: NRG; PAM sequence: TGG
aacacggcaaatcaaagagc

SEQ ID NO: 98281 - DNA, 20 bp, Artificial Sequence
  Description of Artificial Sequence: Synthetic oligonucleotide
  Target: ATXN1; (+) strand; PAM type: NRG; PAM sequence: TGG
cggcaaatcaaagagctggc

SEQ ID NO: 98282 - DNA, 20 bp, Artificial Sequence
  Description of Artificial Sequence: Synthetic oligonucleotide
  Target: ATXN1; (+) strand; PAM type: NRG; PAM sequence: CGG
aagagctggctggttctctc

SEQ ID NO: 98283 - DNA, 20 bp, Artificial Sequence
  Description of Artificial Sequence: Synthetic oligonucleotide
  Target: ATXN1; (+) strand; PAM type: NRG; PAM sequence: CAG
gctggctggttctctccgga

SEQ ID NO: 98284 - DNA, 20 bp, Artificial Sequence
  Description of Artificial Sequence: Synthetic oligonucleotide
  Target: ATXN1; (+) strand; PAM type: NRG; PAM sequence: CAG
ggctggttctctccggacag

SEQ ID NO: 98285 - DNA, 20 bp, Artificial Sequence
  Description of Artificial Sequence: Synthetic oligonucleotide
  Target: ATXN1; (+) strand; PAM type: NRG; PAM sequence: AGG
gctggttctctccggacagc

SEQ ID NO: 98286 - DNA, 20 bp, Artificial Sequence
  Description of Artificial Sequence: Synthetic oligonucleotide
  Target: ATXN1; (+) strand; PAM type: NRG; PAM sequence: CAG
tctccggacagcaggatgac

SEQ ID NO: 98287 - DNA, 20 bp, Artificial Sequence
  Description of Artificial Sequence: Synthetic oligonucleotide
  Target: ATXN1; (+) strand; PAM type: NRG; PAM sequence: AAG
gccctgtccaaacacaaaaa

SEQ ID NO: 98288 - DNA, 20 bp, Artificial Sequence
  Description of Artificial Sequence: Synthetic oligonucleotide
  Target: ATXN1; (+) strand; PAM type: NRG; PAM sequence: AGG
ccctgtccaaacacaaaaaa

SEQ ID NO: 98289 - DNA, 20 bp, Artificial Sequence
  Description of Artificial Sequence: Synthetic oligonucleotide
  Target: ATXN1; (+) strand; PAM type: NRG; PAM sequence: TGG
aaaacttcaacgctgacctg

SEQ ID NO: 98290 - DNA, 20 bp, Artificial Sequence
  Description of Artificial Sequence: Synthetic oligonucleotide
  Target: ATXN1; (+) strand; PAM type: NRG; PAM sequence: CAG
tcaacgctgacctgtggaaa

SEQ ID NO: 98291 - DNA, 20 bp, Artificial Sequence
  Description of Artificial Sequence: Synthetic oligonucleotide
  Target: ATXN1; (+) strand; PAM type: NRG; PAM sequence: AGG
caacgctgacctgtggaaac

SEQ ID NO: 98292 - DNA, 20 bp, Artificial Sequence
  Description of Artificial Sequence: Synthetic oligonucleotide
  Target: ATXN1; (+) strand; PAM type: NRG; PAM sequence: GGG
aacgctgacctgtggaaaca

SEQ ID NO: 98293 - DNA, 20 bp, Artificial Sequence
  Description of Artificial Sequence: Synthetic oligonucleotide
  Target: ATXN1; (+) strand; PAM type: NRG; PAM sequence: GAG
cgctgacctgtggaaacagg

SEQ ID NO: 98294 - DNA, 20 bp, Artificial Sequence
  Description of Artificial Sequence: Synthetic oligonucleotide
  Target: ATXN1; (+) strand; PAM type: NRG; PAM sequence: GAG
ctgacctgtggaaacaggga

SEQ ID NO: 98295 - DNA, 20 bp, Artificial Sequence
  Description of Artificial Sequence: Synthetic oligonucleotide
  Target: ATXN1; (+) strand; PAM type: NRG; PAM sequence: CAG
cctgtggaaacagggagaga

SEQ ID NO: 98296 - DNA, 20 bp, Artificial Sequence
  Description of Artificial Sequence: Synthetic oligonucleotide
  Target: ATXN1; (+) strand; PAM type: NRG; PAM sequence: GAG
tgtggaaacagggagagaca

SEQ ID NO: 98297 - DNA, 20 bp, Artificial Sequence
  Description of Artificial Sequence: Synthetic oligonucleotide
  Target: ATXN1; (+) strand; PAM type: NRG; PAM sequence: GAG
tggaaacagggagagacaga

SEQ ID NO: 98298 - DNA, 20 bp, Artificial Sequence
  Description of Artificial Sequence: Synthetic oligonucleotide
  Target: ATXN1; (+) strand; PAM type: NRG; PAM sequence: GAG
gaaacagggagagacagaga

SEQ ID NO: 98299 - DNA, 20 bp, Artificial Sequence
  Description of Artificial Sequence: Synthetic oligonucleotide
  Target: ATXN1; (+) strand; PAM type: NRG; PAM sequence: AGG
aaacagggagagacagagag

SEQ ID NO: 98300 - DNA, 20 bp, Artificial Sequence
  Description of Artificial Sequence: Synthetic oligonucleotide
  Target: ATXN1; (+) strand; PAM type: NRG; PAM sequence: AAG
cagggagagacagagagagg

SEQ ID NO: 98301 - DNA, 20 bp, Artificial Sequence
  Description of Artificial Sequence: Synthetic oligonucleotide
  Target: ATXN1; (+) strand; PAM type: NRG; PAM sequence: AAG
ggagagacagagagaggaag

SEQ ID NO: 98302 - DNA, 20 bp, Artificial Sequence
  Description of Artificial Sequence: Synthetic oligonucleotide
  Target: ATXN1; (+) strand; PAM type: NRG; PAM sequence: AGG
gagagacagagagaggaaga

SEQ ID NO: 98303 - DNA, 20 bp, Artificial Sequence
  Description of Artificial Sequence: Synthetic oligonucleotide
  Target: ATXN1; (+) strand; PAM type: NRG; PAM sequence: AAG
agacagagagaggaagaagg

SEQ ID NO: 98304 - DNA, 20 bp, Artificial Sequence
  Description of Artificial Sequence: Synthetic oligonucleotide
  Target: ATXN1; (+) strand; PAM type: NRG; PAM sequence: AGG
gacagagagaggaagaagga

SEQ ID NO: 98305 - DNA, 20 bp, Artificial Sequence
  Description of Artificial Sequence: Synthetic oligonucleotide
  Target: ATXN1; (+) strand; PAM type: NRG; PAM sequence: GGG
acagagagaggaagaaggaa

SEQ ID NO: 98306 - DNA, 20 bp, Artificial Sequence
  Description of Artificial Sequence: Synthetic oligonucleotide
  Target: ATXN1; (+) strand; PAM type: NRG; PAM sequence: CAG
tttgattttatgcacacaca

SEQ ID NO: 98307 - DNA, 20 bp, Artificial Sequence
  Description of Artificial Sequence: Synthetic oligonucleotide
  Target: ATXN1; (+) strand; PAM type: NRG; PAM sequence: AGG
ttgattttatgcacacacac

SEQ ID NO: 98308 - DNA, 20 bp, Artificial Sequence
  Description of Artificial Sequence: Synthetic oligonucleotide
  Target: ATXN1; (+) strand; PAM type: NRG; PAM sequence: CAG
cacacaggtatgaactcaca

SEQ ID NO: 98309 - DNA, 20 bp, Artificial Sequence
  Description of Artificial Sequence: Synthetic oligonucleotide
  Target: ATXN1; (+) strand; PAM type: NRG; PAM sequence: CAG
tgaactcacacagacacaca

SEQ ID NO: 98310 - DNA, 20 bp, Artificial Sequence
  Description of Artificial Sequence: Synthetic oligonucleotide
  Target: ATXN1; (+) strand; PAM type: NRG; PAM sequence: AGG
gaactcacacagacacacac

SEQ ID NO: 98311 - DNA, 20 bp, Artificial Sequence
  Description of Artificial Sequence: Synthetic oligonucleotide
  Target: ATXN1; (+) strand; PAM type: NRG; PAM sequence: TGG
acagacacacacaggctgaa

SEQ ID NO: 98312 - DNA, 20 bp, Artificial Sequence
  Description of Artificial Sequence: Synthetic oligonucleotide
  Target: ATXN1; (+) strand; PAM type: NRG; PAM sequence: GGG
cagacacacacaggctgaat

SEQ ID NO: 98313 - DNA, 20 bp, Artificial Sequence
  Description of Artificial Sequence: Synthetic oligonucleotide
  Target: ATXN1; (+) strand; PAM type: NRG; PAM sequence: GGG
agacacacacaggctgaatg

SEQ ID NO: 98314 - DNA, 20 bp, Artificial Sequence
  Description of Artificial Sequence: Synthetic oligonucleotide
  Target: ATXN1; (+) strand; PAM type: NRG; PAM sequence: GGG
gacacacacaggctgaatgg

SEQ ID NO: 98315 - DNA, 20 bp, Artificial Sequence
  Description of Artificial Sequence: Synthetic oligonucleotide
  Target: ATXN1; (+) strand; PAM type: NRG; PAM sequence: CAG
ctgaatgggggaaaatgact

SEQ ID NO: 98316 - DNA, 20 bp, Artificial Sequence
  Description of Artificial Sequence: Synthetic oligonucleotide
  Target: ATXN1; (+) strand; PAM type: NRG; PAM sequence: CAG
ttgcaaacctccctctcccc

SEQ ID NO: 98317 - DNA, 20 bp, Artificial Sequence
  Description of Artificial Sequence: Synthetic oligonucleotide
  Target: ATXN1; (+) strand; PAM type: NRG; PAM sequence: GAG
cccagccacacactataaat

SEQ ID NO: 98318 - DNA, 20 bp, Artificial Sequence
  Description of Artificial Sequence: Synthetic oligonucleotide
  Target: ATXN1; (+) strand; PAM type: NRG; PAM sequence: AGG
ccagccacacactataaatg

SEQ ID NO: 98319 - DNA, 20 bp, Artificial Sequence
  Description of Artificial Sequence: Synthetic oligonucleotide
  Target: ATXN1; (+) strand; PAM type: NRG; PAM sequence: TGG
ataaatgaggctcttctctt

SEQ ID NO: 98320 - DNA, 20 bp, Artificial Sequence
  Description of Artificial Sequence: Synthetic oligonucleotide
  Target: ATXN1; (+) strand; PAM type: NRG; PAM sequence: GGG
taaatgaggctcttctcttt

SEQ ID NO: 98321 - DNA, 20 bp, Artificial Sequence
  Description of Artificial Sequence: Synthetic oligonucleotide
  Target: ATXN1; (+) strand; PAM type: NRG; PAM sequence: TAG
ggttgtacctctacttgcca

SEQ ID NO: 98322 - DNA, 20 bp, Artificial Sequence
  Description of Artificial Sequence: Synthetic oligonucleotide
  Target: ATXN1; (+) strand; PAM type: NRG; PAM sequence: AGG
gttgtacctctacttgccat

SEQ ID NO: 98323 - DNA, 20 bp, Artificial Sequence
  Description of Artificial Sequence: Synthetic oligonucleotide
  Target: ATXN1; (+) strand; PAM type: NRG; PAM sequence: CAG
gtacctctacttgccatagg

SEQ ID NO: 98324 - DNA, 20 bp, Artificial Sequence
  Description of Artificial Sequence: Synthetic oligonucleotide
  Target: ATXN1; (+) strand; PAM type: NRG; PAM sequence: AAG
cctctacttgccataggcag

SEQ ID NO: 98325 - DNA, 20 bp, Artificial Sequence
  Description of Artificial Sequence: Synthetic oligonucleotide
  Target: ATXN1; (+) strand; PAM type: NRG; PAM sequence: CAG
tacttgccataggcagaagc

SEQ ID NO: 98326 - DNA, 20 bp, Artificial Sequence
  Description of Artificial Sequence: Synthetic oligonucleotide
  Target: ATXN1; (+) strand; PAM type: NRG; PAM sequence: AAG
cataggcagaagccagtgaa

SEQ ID NO: 98327 - DNA, 20 bp, Artificial Sequence
  Description of Artificial Sequence: Synthetic oligonucleotide
  Target: ATXN1; (+) strand; PAM type: NRG; PAM sequence: AGG
ataggcagaagccagtgaaa

SEQ ID NO: 98328 - DNA, 20 bp, Artificial Sequence
  Description of Artificial Sequence: Synthetic oligonucleotide
  Target: ATXN1; (+) strand; PAM type: NRG; PAM sequence: AAG
aatattcaaaatattccatc

SEQ ID NO: 98329 - DNA, 20 bp, Artificial Sequence
  Description of Artificial Sequence: Synthetic oligonucleotide
  Target: ATXN1; (+) strand; PAM type: NRG; PAM sequence: TAG
caaaatattccatcaagtgt

SEQ ID NO: 98330 - DNA, 20 bp, Artificial Sequence
  Description of Artificial Sequence: Synthetic oligonucleotide
  Target: ATXN1; (+) strand; PAM type: NRG; PAM sequence: TAG
tccatcaagtgttagctcta

SEQ ID NO: 98331 - DNA, 20 bp, Artificial Sequence
  Description of Artificial Sequence: Synthetic oligonucleotide
  Target: ATXN1; (+) strand; PAM type: NRG; PAM sequence: TGG
tcaagtgttagctctatagc

SEQ ID NO: 98332 - DNA, 20 bp, Artificial Sequence
  Description of Artificial Sequence: Synthetic oligonucleotide
  Target: ATXN1; (+) strand; PAM type: NRG; PAM sequence: TAG
gctctatagctggtctctgt

SEQ ID NO: 98333 - DNA, 20 bp, Artificial Sequence
  Description of Artificial Sequence: Synthetic oligonucleotide
  Target: ATXN1; (+) strand; PAM type: NRG; PAM sequence: CAG
tagctggtctctgttagaac

SEQ ID NO: 98334 - DNA, 20 bp, Artificial Sequence
  Description of Artificial Sequence: Synthetic oligonucleotide
  Target: ATXN1; (+) strand; PAM type: NRG; PAM sequence: CAG
agaaccagtcaatcgaaccc

SEQ ID NO: 98335 - DNA, 20 bp, Artificial Sequence
  Description of Artificial Sequence: Synthetic oligonucleotide
  Target: ATXN1; (+) strand; PAM type: NRG; PAM sequence: CAG
caatcgaaccccagtaatga

SEQ ID NO: 98336 - DNA, 20 bp, Artificial Sequence
  Description of Artificial Sequence: Synthetic oligonucleotide
  Target: ATXN1; (+) strand; PAM type: NRG; PAM sequence: GAG
atcgaaccccagtaatgaca

SEQ ID NO: 98337 - DNA, 20 bp, Artificial Sequence
  Description of Artificial Sequence: Synthetic oligonucleotide
  Target: ATXN1; (+) strand; PAM type: NRG; PAM sequence: TAG
gtaatgacagagcacccact

SEQ ID NO: 98338 - DNA, 20 bp, Artificial Sequence
  Description of Artificial Sequence: Synthetic oligonucleotide
  Target: ATXN1; (+) strand; PAM type: NRG; PAM sequence: CAG
cagagcacccacttagcttt

SEQ ID NO: 98339 - DNA, 20 bp, Artificial Sequence
  Description of Artificial Sequence: Synthetic oligonucleotide
  Target: ATXN1; (+) strand; PAM type: NRG; PAM sequence: AAG
cccacttagctttcagcacc

SEQ ID NO: 98340 - DNA, 20 bp, Artificial Sequence
  Description of Artificial Sequence: Synthetic oligonucleotide
  Target: ATXN1; (+) strand; PAM type: NRG; PAM sequence: TAG
cttagctttcagcaccaagc

SEQ ID NO: 98341 - DNA, 20 bp, Artificial Sequence
  Description of Artificial Sequence: Synthetic oligonucleotide
  Target: ATXN1; (+) strand; PAM type: NRG; PAM sequence: AGG
ttagctttcagcaccaagct

SEQ ID NO: 98342 - DNA, 20 bp, Artificial Sequence
  Description of Artificial Sequence: Synthetic oligonucleotide
  Target: ATXN1; (+) strand; PAM type: NRG; PAM sequence: CAG
cagcaccaagctaggctctg

SEQ ID NO: 98343 - DNA, 20 bp, Artificial Sequence
  Description of Artificial Sequence: Synthetic oligonucleotide
  Target: ATXN1; (+) strand; PAM type: NRG; PAM sequence: AGG
agcaccaagctaggctctgc

SEQ ID NO: 98344 - DNA, 20 bp, Artificial Sequence
  Description of Artificial Sequence: Synthetic oligonucleotide
  Target: ATXN1; (+) strand; PAM type: NRG; PAM sequence: TGG
accaagctaggctctgcagg

SEQ ID NO: 98345 - DNA, 20 bp, Artificial Sequence
  Description of Artificial Sequence: Synthetic oligonucleotide
  Target: ATXN1; (+) strand; PAM type: NRG; PAM sequence: AAG
aggctctgcaggtggctcac

SEQ ID NO: 98346 - DNA, 20 bp, Artificial Sequence
  Description of Artificial Sequence: Synthetic oligonucleotide
  Target: ATXN1; (+) strand; PAM type: NRG; PAM sequence: CAG
ctgcaggtggctcacaagcc

SEQ ID NO: 98347 - DNA, 20 bp, Artificial Sequence
  Description of Artificial Sequence: Synthetic oligonucleotide
  Target: ATXN1; (+) strand; PAM type: NRG; PAM sequence: CGG
ggtggctcacaagcccagcg

SEQ ID NO: 98348 - DNA, 20 bp, Artificial Sequence
  Description of Artificial Sequence: Synthetic oligonucleotide
  Target: ATXN1; (+) strand; PAM type: NRG; PAM sequence: TAG
tcacaagcccagcgcggtct

SEQ ID NO: 98349 - DNA, 20 bp, Artificial Sequence
  Description of Artificial Sequence: Synthetic oligonucleotide
  Target: ATXN1; (+) strand; PAM type: NRG; PAM sequence: GAG
agcgcggtcttagattttat

SEQ ID NO: 98350 - DNA, 20 bp, Artificial Sequence
  Description of Artificial Sequence: Synthetic oligonucleotide
  Target: ATXN1; (+) strand; PAM type: NRG; PAM sequence: TGG
cttagattttatgagctcaa

SEQ ID NO: 98351 - DNA, 20 bp, Artificial Sequence
  Description of Artificial Sequence: Synthetic oligonucleotide
  Target: ATXN1; (+) strand; PAM type: NRG; PAM sequence: CAG
ggacaactgctattatcata

SEQ ID NO: 98352 - DNA, 20 bp, Artificial Sequence
  Description of Artificial Sequence: Synthetic oligonucleotide
  Target: ATXN1; (+) strand; PAM type: NRG; PAM sequence: AGG
gacaactgctattatcatac

SEQ ID NO: 98353 - DNA, 20 bp, Artificial Sequence
  Description of Artificial Sequence: Synthetic oligonucleotide
  Target: ATXN1; (+) strand; PAM type: NRG; PAM sequence: CAG
actgctattatcatacagga

SEQ ID NO: 98354 - DNA, 20 bp, Artificial Sequence
  Description of Artificial Sequence: Synthetic oligonucleotide
  Target: ATXN1; (+) strand; PAM type: NRG; PAM sequence: AGG
ctgctattatcatacaggac

SEQ ID NO: 98355 - DNA, 20 bp, Artificial Sequence
  Description of Artificial Sequence: Synthetic oligonucleotide
  Target: ATXN1; (+) strand; PAM type: NRG; PAM sequence: TGG
atacaggacaggactaaaca

SEQ ID NO: 98356 - DNA, 20 bp, Artificial Sequence
  Description of Artificial Sequence: Synthetic oligonucleotide
  Target: ATXN1; (+) strand; PAM type: NRG; PAM sequence: CAG
ggacaggactaaacatggat

SEQ ID NO: 98357 - DNA, 20 bp, Artificial Sequence
  Description of Artificial Sequence: Synthetic oligonucleotide
  Target: ATXN1; (+) strand; PAM type: NRG; PAM sequence: GAG
acaggactaaacatggatca

SEQ ID NO: 98358 - DNA, 20 bp, Artificial Sequence
  Description of Artificial Sequence: Synthetic oligonucleotide
  Target: ATXN1; (+) strand; PAM type: NRG; PAM sequence: GAG
gactaaacatggatcagagt

SEQ ID NO: 98359 - DNA, 20 bp, Artificial Sequence
  Description of Artificial Sequence: Synthetic oligonucleotide
  Target: ATXN1; (+) strand; PAM type: NRG; PAM sequence: GAG
atggatcagagtgagactgt

SEQ ID NO: 98360 - DNA, 20 bp, Artificial Sequence
  Description of Artificial Sequence: Synthetic oligonucleotide
  Target: ATXN1; (+) strand; PAM type: NRG; PAM sequence: AAG
agagtgagactgtgagttcc

SEQ ID NO: 98361 - DNA, 20 bp, Artificial Sequence
  Description of Artificial Sequence: Synthetic oligonucleotide
  Target: ATXN1; (+) strand; PAM type: NRG; PAM sequence: AAG
gtgagactgtgagttccaag

SEQ ID NO: 98362 - DNA, 20 bp, Artificial Sequence
  Description of Artificial Sequence: Synthetic oligonucleotide
  Target: ATXN1; (+) strand; PAM type: NRG; PAM sequence: CAG
agactgtgagttccaagaag

SEQ ID NO: 98363 - DNA, 20 bp, Artificial Sequence
  Description of Artificial Sequence: Synthetic oligonucleotide
  Target: ATXN1; (+) strand; PAM type: NRG; PAM sequence: AGG
gactgtgagttccaagaagc

SEQ ID NO: 98364 - DNA, 20 bp, Artificial Sequence
  Description of Artificial Sequence: Synthetic oligonucleotide
  Target: ATXN1; (+) strand; PAM type: NRG; PAM sequence: CAG
tgagttccaagaagcaggca

SEQ ID NO: 98365 - DNA, 20 bp, Artificial Sequence
  Description of Artificial Sequence: Synthetic oligonucleotide
  Target: ATXN1; (+) strand; PAM type: NRG; PAM sequence: GAG
ggcacagtgtgtttatcact

SEQ ID NO: 98366 - DNA, 20 bp, Artificial Sequence
  Description of Artificial Sequence: Synthetic oligonucleotide
  Target: ATXN1; (+) strand; PAM type: NRG; PAM sequence: CAG
tgtgtttatcactgagtccc

SEQ ID NO: 98367 - DNA, 20 bp, Artificial Sequence
  Description of Artificial Sequence: Synthetic oligonucleotide
  Target: ATXN1; (+) strand; PAM type: NRG; PAM sequence: AAG
actgagtccccagcccctaa

SEQ ID NO: 98368 - DNA, 20 bp, Artificial Sequence
  Description of Artificial Sequence: Synthetic oligonucleotide
  Target: ATXN1; (+) strand; PAM type: NRG; PAM sequence: AGG
ctgagtccccagcccctaaa

SEQ ID NO: 98369 - DNA, 20 bp, Artificial Sequence
  Description of Artificial Sequence: Synthetic oligonucleotide
  Target: ATXN1; (+) strand; PAM type: NRG; PAM sequence: TGG
ccagcccctaaaaggatgct

SEQ ID NO: 98370 - DNA, 20 bp, Artificial Sequence
  Description of Artificial Sequence: Synthetic oligonucleotide
  Target: ATXN1; (+) strand; PAM type: NRG; PAM sequence: TGG
gcccctaaaaggatgcttgg

SEQ ID NO: 98371 - DNA, 20 bp, Artificial Sequence
  Description of Artificial Sequence: Synthetic oligonucleotide
  Target: ATXN1; (+) strand; PAM type: NRG; PAM sequence: TGG
ctaaaaggatgcttggtggc

SEQ ID NO: 98372 - DNA, 20 bp, Artificial Sequence
  Description of Artificial Sequence: Synthetic oligonucleotide
  Target: ATXN1; (+) strand; PAM type: NRG; PAM sequence: GGG
taaaaggatgcttggtggct

SEQ ID NO: 98373 - DNA, 20 bp, Artificial Sequence
  Description of Artificial Sequence: Synthetic oligonucleotide
  Target: ATXN1; (+) strand; PAM type: NRG; PAM sequence: CAG
ggatgcttggtggctgggca

SEQ ID NO: 98374 - DNA, 20 bp, Artificial Sequence
  Description of Artificial Sequence: Synthetic oligonucleotide
  Target: ATXN1; (+) strand; PAM type: NRG; PAM sequence: TGG
tgcttggtggctgggcacag

SEQ ID NO: 98375 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 98376 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 98377 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 98378 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggacacc

SEQ ID NO: 98379 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggacacca

SEQ ID NO: 98380 - DNA, 20 bp, Artificial Sequence
  Description of Artificial Sequence: Synthetic oligonucleotide
  Target: ATXN1; (+) strand; PAM type: NRG; PAM sequence: TGG
agcactttgggacaccaagg

SEQ ID NO: 98381 - DNA, 20 bp, Artificial Sequence
  Description of Artificial Sequence: Synthetic oligonucleotide
  Target: ATXN1; (+) strand; PAM type: NRG; PAM sequence: GGG
gcactttgggacaccaaggt

SEQ ID NO: 98382 - DNA, 20 bp, Artificial Sequence
  Description of Artificial Sequence: Synthetic oligonucleotide
  Target: ATXN1; (+) strand; PAM type: NRG; PAM sequence: TGG
ctttgggacaccaaggtggg

SEQ ID NO: 98383 - DNA, 20 bp, Artificial Sequence
  Description of Artificial Sequence: Synthetic oligonucleotide
  Target: ATXN1; (+) strand; PAM type: NRG; PAM sequence: GAG
ccaaggtgggtggatcattt

SEQ ID NO: 98384 - DNA, 20 bp, Artificial Sequence
  Description of Artificial Sequence: Synthetic oligonucleotide
  Target: ATXN1; (+) strand; PAM type: NRG; PAM sequence: AGG
caaggtgggtggatcatttg

SEQ ID NO: 98385 - DNA, 20 bp, Artificial Sequence
  Description of Artificial Sequence: Synthetic oligonucleotide
  Target: ATXN1; (+) strand; PAM type: NRG; PAM sequence: CAG
gtgggtggatcatttgaggt

SEQ ID NO: 98386 - DNA, 20 bp, Artificial Sequence
  Description of Artificial Sequence: Synthetic oligonucleotide
  Target: ATXN1; (+) strand; PAM type: NRG; PAM sequence: AGG
tgggtggatcatttgaggtc

SEQ ID NO: 98387 - DNA, 20 bp, Artificial Sequence
  Description of Artificial Sequence: Synthetic oligonucleotide
  Target: ATXN1; (+) strand; PAM type: NRG; PAM sequence: GAG
ggtggatcatttgaggtcag

SEQ ID NO: 98388 - DNA, 20 bp, Artificial Sequence
  Description of Artificial Sequence: Synthetic oligonucleotide
  Target: ATXN1; (+) strand; PAM type: NRG; PAM sequence: AAG
tcatttgaggtcaggagttc

SEQ ID NO: 98389 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 98390 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 98391 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaaca

SEQ ID NO: 98392 - DNA, 20 bp, Artificial Sequence
  Description of Artificial Sequence: Synthetic oligonucleotide
  Target: ATXN1; (+) strand; PAM type: NRG; PAM sequence: GGG
aagaccagcctggccaacat

SEQ ID NO: 98393 - DNA, 20 bp, Artificial Sequence
  Description of Artificial Sequence: Synthetic oligonucleotide
  Target: ATXN1; (+) strand; PAM type: NRG; PAM sequence: GGG
agaccagcctggccaacatg

SEQ ID NO: 98394 - DNA, 20 bp, Artificial Sequence
  Description of Artificial Sequence: Synthetic oligonucleotide
  Target: ATXN1; (+) strand; PAM type: NRG; PAM sequence: TAG
taaaaataaaaaaaaaaaat

SEQ ID NO: 98395 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaattagccatgcg

SEQ ID NO: 98396 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccatgcgtgg

SEQ ID NO: 98397 - DNA, 20 bp, Artificial Sequence
  Description of Artificial Sequence: Synthetic oligonucleotide
  Target: ATXN1; (+) strand; PAM type: NRG; PAM sequence: CGG
aaattagccatgcgtggtgg

SEQ ID NO: 98398 - DNA, 20 bp, Artificial Sequence
  Description of Artificial Sequence: Synthetic oligonucleotide
  Target: ATXN1; (+) strand; PAM type: NRG; PAM sequence: GGG
aattagccatgcgtggtggc

SEQ ID NO: 98399 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcacctgtaatcc

SEQ ID NO: 98400 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagctact

SEQ ID NO: 98401 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctactt

SEQ ID NO: 98402 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 98403 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 98404 - DNA, 20 bp, Artificial Sequence
  Description of Artificial Sequence: Synthetic oligonucleotide
  Target: ATXN1; (+) strand; PAM type: NRG; PAM sequence: TAG
tacttgggaggctgaaacac

SEQ ID NO: 98405 - DNA, 20 bp, Artificial Sequence
  Description of Artificial Sequence: Synthetic oligonucleotide
  Target: ATXN1; (+) strand; PAM type: NRG; PAM sequence: CAG
acactagaatcacttgaacc

SEQ ID NO: 98406 - DNA, 20 bp, Artificial Sequence
  Description of Artificial Sequence: Synthetic oligonucleotide
  Target: ATXN1; (+) strand; PAM type: NRG; PAM sequence: AGG
cactagaatcacttgaaccc

SEQ ID NO: 98407 - DNA, 20 bp, Artificial Sequence
  Description of Artificial Sequence: Synthetic oligonucleotide
  Target: ATXN1; (+) strand; PAM type: NRG; PAM sequence: GAG
ctagaatcacttgaacccag

SEQ ID NO: 98408 - DNA, 20 bp, Artificial Sequence
  Description of Artificial Sequence: Synthetic oligonucleotide
  Target: ATXN1; (+) strand; PAM type: NRG; PAM sequence: AGG
tagaatcacttgaacccagg

SEQ ID NO: 98409 - DNA, 20 bp, Artificial Sequence
  Description of Artificial Sequence: Synthetic oligonucleotide
  Target: ATXN1; (+) strand; PAM type: NRG; PAM sequence: CAG
aatcacttgaacccaggagg

SEQ ID NO: 98410 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcagatgttg

SEQ ID NO: 98411 - DNA, 20 bp, Artificial Sequence
  Description of Artificial Sequence: Synthetic oligonucleotide
  Target: ATXN1; (+) strand; PAM type: NRG; PAM sequence: GAG
caggaggcagatgttgcagc

SEQ ID NO: 98412 - DNA, 20 bp, Artificial Sequence
  Description of Artificial Sequence: Synthetic oligonucleotide
  Target: ATXN1; (+) strand; PAM type: NRG; PAM sequence: GAG
ggcagatgttgcagcgagcc

SEQ ID NO: 98413 - DNA, 20 bp, Artificial Sequence
  Description of Artificial Sequence: Synthetic oligonucleotide
  Target: ATXN1; (+) strand; PAM type: NRG; PAM sequence: TGG
gcgagccgagatcgtgccac

SEQ ID NO: 98414 - DNA, 20 bp, Artificial Sequence
  Description of Artificial Sequence: Synthetic oligonucleotide
  Target: ATXN1; (+) strand; PAM type: NRG; PAM sequence: GGG
cgagccgagatcgtgccact

SEQ ID NO: 98415 - DNA, 20 bp, Artificial Sequence
  Description of Artificial Sequence: Synthetic oligonucleotide
  Target: ATXN1; (+) strand; PAM type: NRG; PAM sequence: CAG
gatcgtgccactgggcgatc

SEQ ID NO: 98416 - DNA, 20 bp, Artificial Sequence
  Description of Artificial Sequence: Synthetic oligonucleotide
  Target: ATXN1; (+) strand; PAM type: NRG; PAM sequence: TGG
tgccactgggcgatccagcc

SEQ ID NO: 98417 - DNA, 20 bp, Artificial Sequence
  Description of Artificial Sequence: Synthetic oligonucleotide
  Target: ATXN1; (+) strand; PAM type: NRG; PAM sequence: GGG
gccactgggcgatccagcct

SEQ ID NO: 98418 - DNA, 20 bp, Artificial Sequence
  Description of Artificial Sequence: Synthetic oligonucleotide
  Target: ATXN1; (+) strand; PAM type: NRG; PAM sequence: CAG
gggcgatccagcctgggcca

SEQ ID NO: 98419 - DNA, 20 bp, Artificial Sequence
  Description of Artificial Sequence: Synthetic oligonucleotide
  Target: ATXN1; (+) strand; PAM type: NRG; PAM sequence: GAG
gcgatccagcctgggccaca

SEQ ID NO: 98420 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggccacagagt

SEQ ID NO: 98421 - DNA, 20 bp, Artificial Sequence
  Description of Artificial Sequence: Synthetic oligonucleotide
  Target: ATXN1; (+) strand; PAM type: NRG; PAM sequence: AAG
gtctcaaaaaaaaaaaaaaa

SEQ ID NO: 98422 - DNA, 20 bp, Artificial Sequence
  Description of Artificial Sequence: Synthetic oligonucleotide
  Target: ATXN1; (+) strand; PAM type: NRG; PAM sequence: TAG
tcaatttccaatgtcctttc

SEQ ID NO: 98423 - DNA, 20 bp, Artificial Sequence
  Description of Artificial Sequence: Synthetic oligonucleotide
  Target: ATXN1; (+) strand; PAM type: NRG; PAM sequence: TAG
tccaatgtcctttctagatg

SEQ ID NO: 98424 - DNA, 20 bp, Artificial Sequence
  Description of Artificial Sequence: Synthetic oligonucleotide
  Target: ATXN1; (+) strand; PAM type: NRG; PAM sequence: TAG
aatgtcctttctagatgtag

SEQ ID NO: 98425 - DNA, 20 bp, Artificial Sequence
  Description of Artificial Sequence: Synthetic oligonucleotide
  Target: ATXN1; (+) strand; PAM type: NRG; PAM sequence: TAG
cctttctagatgtagtagac

SEQ ID NO: 98426 - DNA, 20 bp, Artificial Sequence
  Description of Artificial Sequence: Synthetic oligonucleotide
  Target: ATXN1; (+) strand; PAM type: NRG; PAM sequence: AGG
ctttctagatgtagtagact

SEQ ID NO: 98427 - DNA, 20 bp, Artificial Sequence
  Description of Artificial Sequence: Synthetic oligonucleotide
  Target: ATXN1; (+) strand; PAM type: NRG; PAM sequence: TGG
atgtagtagactaggtaatt

SEQ ID NO: 98428 - DNA, 20 bp, Artificial Sequence
  Description of Artificial Sequence: Synthetic oligonucleotide
  Target: ATXN1; (+) strand; PAM type: NRG; PAM sequence: GAG
tttggaccaaccctccttct

SEQ ID NO: 98429 - DNA, 20 bp, Artificial Sequence
  Description of Artificial Sequence: Synthetic oligonucleotide
  Target: ATXN1; (+) strand; PAM type: NRG; PAM sequence: AGG
ttggaccaaccctccttctg

SEQ ID NO: 98430 - DNA, 20 bp, Artificial Sequence
  Description of Artificial Sequence: Synthetic oligonucleotide
  Target: ATXN1; (+) strand; PAM type: NRG; PAM sequence: AAG
aaaactctgaacaaaaatat

SEQ ID NO: 98431 - DNA, 20 bp, Artificial Sequence
  Description of Artificial Sequence: Synthetic oligonucleotide
  Target: ATXN1; (+) strand; PAM type: NRG; PAM sequence: TGG
acaaataaatttaaaaactc

SEQ ID NO: 98432 - DNA, 20 bp, Artificial Sequence
  Description of Artificial Sequence: Synthetic oligonucleotide
  Target: ATXN1; (+) strand; PAM type: NRG; PAM sequence: TAG
tgtttaaactttttttctta

SEQ ID NO: 98433 - DNA, 20 bp, Artificial Sequence
  Description of Artificial Sequence: Synthetic oligonucleotide
  Target: ATXN1; (+) strand; PAM type: NRG; PAM sequence: TGG
aactttttttcttatagtac

SEQ ID NO: 98434 - DNA, 20 bp, Artificial Sequence
  Description of Artificial Sequence: Synthetic oligonucleotide
  Target: ATXN1; (+) strand; PAM type: NRG; PAM sequence: CAG
ttttttcttatagtactgga

SEQ ID NO: 98435 - DNA, 20 bp, Artificial Sequence
  Description of Artificial Sequence: Synthetic oligonucleotide
  Target: ATXN1; (+) strand; PAM type: NRG; PAM sequence: AAG
tatagtactggacagcaaat

SEQ ID NO: 98436 - DNA, 20 bp, Artificial Sequence
  Description of Artificial Sequence: Synthetic oligonucleotide
  Target: ATXN1; (+) strand; PAM type: NRG; PAM sequence: TAG
gtactggacagcaaataaga

SEQ ID NO: 98437 - DNA, 20 bp, Artificial Sequence
  Description of Artificial Sequence: Synthetic oligonucleotide
  Target: ATXN1; (+) strand; PAM type: NRG; PAM sequence: AAG
acagcaaataagatagtaaa

SEQ ID NO: 98438 - DNA, 20 bp, Artificial Sequence
  Description of Artificial Sequence: Synthetic oligonucleotide
  Target: ATXN1; (+) strand; PAM type: NRG; PAM sequence: AGG
cagcaaataagatagtaaaa

SEQ ID NO: 98439 - DNA, 20 bp, Artificial Sequence
  Description of Artificial Sequence: Synthetic oligonucleotide
  Target: ATXN1; (+) strand; PAM type: NRG; PAM sequence: CAG
aaataagatagtaaaaaggc

SEQ ID NO: 98440 - DNA, 20 bp, Artificial Sequence
  Description of Artificial Sequence: Synthetic oligonucleotide
  Target: ATXN1; (+) strand; PAM type: NRG; PAM sequence: AGG
aataagatagtaaaaaggcc

SEQ ID NO: 98441 - DNA, 20 bp, Artificial Sequence
  Description of Artificial Sequence: Synthetic oligonucleotide
  Target: ATXN1; (+) strand; PAM type: NRG; PAM sequence: CGG
gatagtaaaaaggccaggcg

SEQ ID NO: 98442 - DNA, 20 bp, Artificial Sequence
  Description of Artificial Sequence: Synthetic oligonucleotide
  Target: ATXN1; (+) strand; PAM type: NRG; PAM sequence: TGG
agtaaaaaggccaggcgcgg

SEQ ID NO: 98443 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 98444 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 98445 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 98446 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 98447 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 98448 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 98449 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 98450 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcgcg

SEQ ID NO: 98451 - DNA, 20 bp, Artificial Sequence
  Description of Artificial Sequence: Synthetic oligonucleotide
  Target: ATXN1; (+) strand; PAM type: NRG; PAM sequence: GAG
ccaaggcgcgtggatcacct

SEQ ID NO: 98452 - DNA, 20 bp, Artificial Sequence
  Description of Artificial Sequence: Synthetic oligonucleotide
  Target: ATXN1; (+) strand; PAM type: NRG; PAM sequence: AGG
caaggcgcgtggatcacctg

SEQ ID NO: 98453 - DNA, 20 bp, Artificial Sequence
  Description of Artificial Sequence: Synthetic oligonucleotide
  Target: ATXN1; (+) strand; PAM type: NRG; PAM sequence: CAG
gcgcgtggatcacctgaggt

SEQ ID NO: 98454 - DNA, 20 bp, Artificial Sequence
  Description of Artificial Sequence: Synthetic oligonucleotide
  Target: ATXN1; (+) strand; PAM type: NRG; PAM sequence: AGG
cgcgtggatcacctgaggtc

SEQ ID NO: 98455 - DNA, 20 bp, Artificial Sequence
  Description of Artificial Sequence: Synthetic oligonucleotide
  Target: ATXN1; (+) strand; PAM type: NRG; PAM sequence: GAG
cgtggatcacctgaggtcag

SEQ ID NO: 98456 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttt

SEQ ID NO: 98457 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagtttgagac

SEQ ID NO: 98458 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccagcc

SEQ ID NO: 98459 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggctacca

SEQ ID NO: 98460 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaact

SEQ ID NO: 98461 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaacttagc

SEQ ID NO: 98462 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaacttagcc

SEQ ID NO: 98463 - DNA, 20 bp, Artificial Sequence
  Description of Artificial Sequence: Synthetic oligonucleotide
  Target: ATXN1; (+) strand; PAM type: NRG; PAM sequence: TGG
atacaaaacttagccaggtg

SEQ ID NO: 98464 - DNA, 20 bp, Artificial Sequence
  Description of Artificial Sequence: Synthetic oligonucleotide
  Target: ATXN1; (+) strand; PAM type: NRG; PAM sequence: TGG
caaaacttagccaggtgtgg

SEQ ID NO: 98465 - DNA, 20 bp, Artificial Sequence
  Description of Artificial Sequence: Synthetic oligonucleotide
  Target: ATXN1; (+) strand; PAM type: NRG; PAM sequence: TGG
aacttagccaggtgtggtgg

SEQ ID NO: 98466 - DNA, 20 bp, Artificial Sequence
  Description of Artificial Sequence: Synthetic oligonucleotide
  Target: ATXN1; (+) strand; PAM type: NRG; PAM sequence: GGG
acttagccaggtgtggtggt

SEQ ID NO: 98467 - DNA, 20 bp, Artificial Sequence
  Description of Artificial Sequence: Synthetic oligonucleotide
  Target: ATXN1; (+) strand; PAM type: NRG; PAM sequence: CAG
gtggtgggcccctataatcc

SEQ ID NO: 98468 - DNA, 20 bp, Artificial Sequence
  Description of Artificial Sequence: Synthetic oligonucleotide
  Target: ATXN1; (+) strand; PAM type: NRG; PAM sequence: CAG
cccctataatcccagctact

SEQ ID NO: 98469 - DNA, 20 bp, Artificial Sequence
  Description of Artificial Sequence: Synthetic oligonucleotide
  Target: ATXN1; (+) strand; PAM type: NRG; PAM sequence: AGG
ccctataatcccagctactc

SEQ ID NO: 98470 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagctactcag

SEQ ID NO: 98471 - DNA, 20 bp, Artificial Sequence
  Description of Artificial Sequence: Synthetic oligonucleotide
  Target: ATXN1; (+) strand; PAM type: NRG; PAM sequence: AGG
tataatcccagctactcagg

SEQ ID NO: 98472 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 98473 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 98474 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 98475 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 98476 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 98477 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggagaatcgttt

SEQ ID NO: 98478 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcgtttgagtc

SEQ ID NO: 98479 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgtttgagtcc

SEQ ID NO: 98480 - DNA, 20 bp, Artificial Sequence
  Description of Artificial Sequence: Synthetic oligonucleotide
  Target: ATXN1; (+) strand; PAM type: NRG; PAM sequence: GGG
aggagaatcgtttgagtccg

SEQ ID NO: 98481 - DNA, 20 bp, Artificial Sequence
  Description of Artificial Sequence: Synthetic oligonucleotide
  Target: ATXN1; (+) strand; PAM type: NRG; PAM sequence: GGG
ggagaatcgtttgagtccgg

SEQ ID NO: 98482 - DNA, 20 bp, Artificial Sequence
  Description of Artificial Sequence: Synthetic oligonucleotide
  Target: ATXN1; (+) strand; PAM type: NRG; PAM sequence: AAG
tcgtttgagtccgggggacg

SEQ ID NO: 98483 - DNA, 20 bp, Artificial Sequence
  Description of Artificial Sequence: Synthetic oligonucleotide
  Target: ATXN1; (+) strand; PAM type: NRG; PAM sequence: AGG
cgtttgagtccgggggacga

SEQ ID NO: 98484 - DNA, 20 bp, Artificial Sequence
  Description of Artificial Sequence: Synthetic oligonucleotide
  Target: ATXN1; (+) strand; PAM type: NRG; PAM sequence: CAG
agtccgggggacgaaggttg

SEQ ID NO: 98485 - DNA, 20 bp, Artificial Sequence
  Description of Artificial Sequence: Synthetic oligonucleotide
  Target: ATXN1; (+) strand; PAM type: NRG; PAM sequence: GAG
cgggggacgaaggttgcagt

SEQ ID NO: 98486 - DNA, 20 bp, Artificial Sequence
  Description of Artificial Sequence: Synthetic oligonucleotide
  Target: ATXN1; (+) strand; PAM type: NRG; PAM sequence: AAG
gacgaaggttgcagtgagcc

SEQ ID NO: 98487 - DNA, 20 bp, Artificial Sequence
  Description of Artificial Sequence: Synthetic oligonucleotide
  Target: ATXN1; (+) strand; PAM type: NRG; PAM sequence: GAG
agatcgtgccactttactct

SEQ ID NO: 98488 - DNA, 20 bp, Artificial Sequence
  Description of Artificial Sequence: Synthetic oligonucleotide
  Target: ATXN1; (+) strand; PAM type: NRG; PAM sequence: CAG
gtgccactttactctgagac

SEQ ID NO: 98489 - DNA, 20 bp, Artificial Sequence
  Description of Artificial Sequence: Synthetic oligonucleotide
  Target: ATXN1; (+) strand; PAM type: NRG; PAM sequence: TGG
actttactctgagaccagcc

SEQ ID NO: 98490 - DNA, 20 bp, Artificial Sequence
  Description of Artificial Sequence: Synthetic oligonucleotide
  Target: ATXN1; (+) strand; PAM type: NRG; PAM sequence: CAG
tactctgagaccagcctggc

SEQ ID NO: 98491 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggccagca

SEQ ID NO: 98492 - DNA, 20 bp, Artificial Sequence
  Description of Artificial Sequence: Synthetic oligonucleotide
  Target: ATXN1; (+) strand; PAM type: NRG; PAM sequence: TAG
cctactaaaaatacaaaaat

SEQ ID NO: 98493 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 98494 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 98495 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggtg

SEQ ID NO: 98496 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggtgtgg

SEQ ID NO: 98497 - DNA, 20 bp, Artificial Sequence
  Description of Artificial Sequence: Synthetic oligonucleotide
  Target: ATXN1; (+) strand; PAM type: NRG; PAM sequence: CAG
aaattagccaggtgtggtgg

SEQ ID NO: 98498 - DNA, 20 bp, Artificial Sequence
  Description of Artificial Sequence: Synthetic oligonucleotide
  Target: ATXN1; (+) strand; PAM type: NRG; PAM sequence: AGG
aattagccaggtgtggtggc

SEQ ID NO: 98499 - DNA, 20 bp, Artificial Sequence
  Description of Artificial Sequence: Synthetic oligonucleotide
  Target: ATXN1; (+) strand; PAM type: NRG; PAM sequence: CAG
gtggcaggcgcctataatcc

SEQ ID NO: 98500 - DNA, 20 bp, Artificial Sequence
  Description of Artificial Sequence: Synthetic oligonucleotide
  Target: ATXN1; (+) strand; PAM type: NRG; PAM sequence: CAG
cgcctataatcccagctact

SEQ ID NO: 98501 - DNA, 20 bp, Artificial Sequence
  Description of Artificial Sequence: Synthetic oligonucleotide
  Target: ATXN1; (+) strand; PAM type: NRG; PAM sequence: AGG
gcctataatcccagctactc

SEQ ID NO: 98502 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagctactcag

SEQ ID NO: 98503 - DNA, 20 bp, Artificial Sequence
  Description of Artificial Sequence: Synthetic oligonucleotide
  Target: ATXN1; (+) strand; PAM type: NRG; PAM sequence: AGG
tataatcccagctactcagg

SEQ ID NO: 98504 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 98505 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 98506 - DNA, 20 bp, Artificial Sequence
  Description of Artificial Sequence: Synthetic oligonucleotide
  Target: ATXN1; (+) strand; PAM type: NRG; PAM sequence: AAG
gctactcaggaggctgaggc

SEQ ID NO: 98507 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcaa

SEQ ID NO: 98508 - DNA, 20 bp, Artificial Sequence
  Description of Artificial Sequence: Synthetic oligonucleotide
  Target: ATXN1; (+) strand; PAM type: NRG; PAM sequence: CGG
gcaagagaatcgcttgaacc

SEQ ID NO: 98509 - DNA, 20 bp, Artificial Sequence
  Description of Artificial Sequence: Synthetic oligonucleotide
  Target: ATXN1; (+) strand; PAM type: NRG; PAM sequence: GGG
caagagaatcgcttgaaccc

SEQ ID NO: 98510 - DNA, 20 bp, Artificial Sequence
  Description of Artificial Sequence: Synthetic oligonucleotide
  Target: ATXN1; (+) strand; PAM type: NRG; PAM sequence: GAG
agagaatcgcttgaacccgg

SEQ ID NO: 98511 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccggg

SEQ ID NO: 98512 - DNA, 20 bp, Artificial Sequence
  Description of Artificial Sequence: Synthetic oligonucleotide
  Target: ATXN1; (+) strand; PAM type: NRG; PAM sequence: CGG
aatcgcttgaacccgggagg

SEQ ID NO: 98513 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccgggaggcg

SEQ ID NO: 98514 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccgggaggcgg

SEQ ID NO: 98515 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcggaggctg

SEQ ID NO: 98516 - DNA, 20 bp, Artificial Sequence
  Description of Artificial Sequence: Synthetic oligonucleotide
  Target: ATXN1; (+) strand; PAM type: NRG; PAM sequence: GAG
ggcggaggctgcagtgaacc

SEQ ID NO: 98517 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccacttcactc

SEQ ID NO: 98518 - DNA, 20 bp, Artificial Sequence
  Description of Artificial Sequence: Synthetic oligonucleotide
  Target: ATXN1; (+) strand; PAM type: NRG; PAM sequence: TGG
catgccacttcactccagcc

SEQ ID NO: 98519 - DNA, 20 bp, Artificial Sequence
  Description of Artificial Sequence: Synthetic oligonucleotide
  Target: ATXN1; (+) strand; PAM type: NRG; PAM sequence: GGG
atgccacttcactccagcct

SEQ ID NO: 98520 - DNA, 20 bp, Artificial Sequence
  Description of Artificial Sequence: Synthetic oligonucleotide
  Target: ATXN1; (+) strand; PAM type: NRG; PAM sequence: CAG
cttcactccagcctgggcga

SEQ ID NO: 98521 - DNA, 20 bp, Artificial Sequence
  Description of Artificial Sequence: Synthetic oligonucleotide
  Target: ATXN1; (+) strand; PAM type: NRG; PAM sequence: GAG
tcactccagcctgggcgaca

SEQ ID NO: 98522 - DNA, 20 bp, Artificial Sequence
  Description of Artificial Sequence: Synthetic oligonucleotide
  Target: ATXN1; (+) strand; PAM type: NRG; PAM sequence: TGG
acacacacacacacacttcc

SEQ ID NO: 98523 - DNA, 20 bp, Artificial Sequence
  Description of Artificial Sequence: Synthetic oligonucleotide
  Target: ATXN1; (+) strand; PAM type: NRG; PAM sequence: GGG
cacacacacacacacttcct

SEQ ID NO: 98524 - DNA, 20 bp, Artificial Sequence
  Description of Artificial Sequence: Synthetic oligonucleotide
  Target: ATXN1; (+) strand; PAM type: NRG; PAM sequence: TGG
cacacacacacttcctgggt

SEQ ID NO: 98525 - DNA, 20 bp, Artificial Sequence
  Description of Artificial Sequence: Synthetic oligonucleotide
  Target: ATXN1; (+) strand; PAM type: NRG; PAM sequence: CAG
acacacttcctgggttggat

SEQ ID NO: 98526 - DNA, 20 bp, Artificial Sequence
  Description of Artificial Sequence: Synthetic oligonucleotide
  Target: ATXN1; (+) strand; PAM type: NRG; PAM sequence: AGG
cacacttcctgggttggatc

SEQ ID NO: 98527 - DNA, 20 bp, Artificial Sequence
  Description of Artificial Sequence: Synthetic oligonucleotide
  Target: ATXN1; (+) strand; PAM type: NRG; PAM sequence: AAG
ttcctgggttggatcaggaa

SEQ ID NO: 98528 - DNA, 20 bp, Artificial Sequence
  Description of Artificial Sequence: Synthetic oligonucleotide
  Target: ATXN1; (+) strand; PAM type: NRG; PAM sequence: TGG
gttggatcaggaaaagatga

SEQ ID NO: 98529 - DNA, 20 bp, Artificial Sequence
  Description of Artificial Sequence: Synthetic oligonucleotide
  Target: ATXN1; (+) strand; PAM type: NRG; PAM sequence: CAG
atcaggaaaagatgatggcc

SEQ ID NO: 98530 - DNA, 20 bp, Artificial Sequence
  Description of Artificial Sequence: Synthetic oligonucleotide
  Target: ATXN1; (+) strand; PAM type: NRG; PAM sequence: GAG
caggaaaagatgatggccca

SEQ ID NO: 98531 - DNA, 20 bp, Artificial Sequence
  Description of Artificial Sequence: Synthetic oligonucleotide
  Target: ATXN1; (+) strand; PAM type: NRG; PAM sequence: GAG
ggaaaagatgatggcccaga

SEQ ID NO: 98532 - DNA, 20 bp, Artificial Sequence
  Description of Artificial Sequence: Synthetic oligonucleotide
  Target: ATXN1; (+) strand; PAM type: NRG; PAM sequence: AGG
gaaaagatgatggcccagag

SEQ ID NO: 98533 - DNA, 20 bp, Artificial Sequence
  Description of Artificial Sequence: Synthetic oligonucleotide
  Target: ATXN1; (+) strand; PAM type: NRG; PAM sequence: AAG
gatgatggcccagagaggtg

SEQ ID NO: 98534 - DNA, 20 bp, Artificial Sequence
  Description of Artificial Sequence: Synthetic oligonucleotide
  Target: ATXN1; (+) strand; PAM type: NRG; PAM sequence: TGG
atggcccagagaggtgaagc

SEQ ID NO: 98535 - DNA, 20 bp, Artificial Sequence
  Description of Artificial Sequence: Synthetic oligonucleotide
  Target: ATXN1; (+) strand; PAM type: NRG; PAM sequence: TGG
cagagaggtgaagctggtgt

SEQ ID NO: 98536 - DNA, 20 bp, Artificial Sequence
  Description of Artificial Sequence: Synthetic oligonucleotide
  Target: ATXN1; (+) strand; PAM type: NRG; PAM sequence: GGG
agagaggtgaagctggtgtt

SEQ ID NO: 98537 - DNA, 20 bp, Artificial Sequence
  Description of Artificial Sequence: Synthetic oligonucleotide
  Target: ATXN1; (+) strand; PAM type: NRG; PAM sequence: GGG
gagaggtgaagctggtgttg

SEQ ID NO: 98538 - DNA, 20 bp, Artificial Sequence
  Description of Artificial Sequence: Synthetic oligonucleotide
  Target: ATXN1; (+) strand; PAM type: NRG; PAM sequence: GGG
agaggtgaagctggtgttgg

SEQ ID NO: 98539 - DNA, 20 bp, Artificial Sequence
  Description of Artificial Sequence: Synthetic oligonucleotide
  Target: ATXN1; (+) strand; PAM type: NRG; PAM sequence: AAG
tgggggcctgttttctcctg

SEQ ID NO: 98540 - DNA, 20 bp, Artificial Sequence
  Description of Artificial Sequence: Synthetic oligonucleotide
  Target: ATXN1; (+) strand; PAM type: NRG; PAM sequence: AGG
gggggcctgttttctcctga

SEQ ID NO: 98541 - DNA, 20 bp, Artificial Sequence
  Description of Artificial Sequence: Synthetic oligonucleotide
  Target: ATXN1; (+) strand; PAM type: NRG; PAM sequence: AAG
gaaggcacttgaacattcca

SEQ ID NO: 98542 - DNA, 20 bp, Artificial Sequence
  Description of Artificial Sequence: Synthetic oligonucleotide
  Target: ATXN1; (+) strand; PAM type: NRG; PAM sequence: TGG
ggcacttgaacattccaaag

SEQ ID NO: 98543 - DNA, 20 bp, Artificial Sequence
  Description of Artificial Sequence: Synthetic oligonucleotide
  Target: ATXN1; (+) strand; PAM type: NRG; PAM sequence: GAG
cacttgaacattccaaagtg

SEQ ID NO: 98544 - DNA, 20 bp, Artificial Sequence
  Description of Artificial Sequence: Synthetic oligonucleotide
  Target: ATXN1; (+) strand; PAM type: NRG; PAM sequence: CAG
ttgaacattccaaagtggag

SEQ ID NO: 98545 - DNA, 20 bp, Artificial Sequence
  Description of Artificial Sequence: Synthetic oligonucleotide
  Target: ATXN1; (+) strand; PAM type: NRG; PAM sequence: TGG
acattccaaagtggagcagt

SEQ ID NO: 98546 - DNA, 20 bp, Artificial Sequence
  Description of Artificial Sequence: Synthetic oligonucleotide
  Target: ATXN1; (+) strand; PAM type: NRG; PAM sequence: GGG
cattccaaagtggagcagtt

SEQ ID NO: 98547 - DNA, 20 bp, Artificial Sequence
  Description of Artificial Sequence: Synthetic oligonucleotide
  Target: ATXN1; (+) strand; PAM type: NRG; PAM sequence: AAG
agtggagcagttgggaaacc

SEQ ID NO: 98548 - DNA, 20 bp, Artificial Sequence
  Description of Artificial Sequence: Synthetic oligonucleotide
  Target: ATXN1; (+) strand; PAM type: NRG; PAM sequence: TGG
ggagcagttgggaaaccaag

SEQ ID NO: 98549 - DNA, 20 bp, Artificial Sequence
  Description of Artificial Sequence: Synthetic oligonucleotide
  Target: ATXN1; (+) strand; PAM type: NRG; PAM sequence: GGG
gagcagttgggaaaccaagt

SEQ ID NO: 98550 - DNA, 20 bp, Artificial Sequence
  Description of Artificial Sequence: Synthetic oligonucleotide
  Target: ATXN1; (+) strand; PAM type: NRG; PAM sequence: TAG
gaaaccaagtgggcttttga

SEQ ID NO: 98551 - DNA, 20 bp, Artificial Sequence
  Description of Artificial Sequence: Synthetic oligonucleotide
  Target: ATXN1; (+) strand; PAM type: NRG; PAM sequence: AAG
agtgggcttttgatagtgtt

SEQ ID NO: 98552 - DNA, 20 bp, Artificial Sequence
  Description of Artificial Sequence: Synthetic oligonucleotide
  Target: ATXN1; (+) strand; PAM type: NRG; PAM sequence: GAG
tgggcttttgatagtgttaa

SEQ ID NO: 98553 - DNA, 20 bp, Artificial Sequence
  Description of Artificial Sequence: Synthetic oligonucleotide
  Target: ATXN1; (+) strand; PAM type: NRG; PAM sequence: TAG
ttttgatagtgttaagagca

SEQ ID NO: 98554 - DNA, 20 bp, Artificial Sequence
  Description of Artificial Sequence: Synthetic oligonucleotide
  Target: ATXN1; (+) strand; PAM type: NRG; PAM sequence: AGG
tttgatagtgttaagagcat

SEQ ID NO: 98555 - DNA, 20 bp, Artificial Sequence
  Description of Artificial Sequence: Synthetic oligonucleotide
  Target: ATXN1; (+) strand; PAM type: NRG; PAM sequence: GGG
ttgatagtgttaagagcata

SEQ ID NO: 98556 - DNA, 20 bp, Artificial Sequence
  Description of Artificial Sequence: Synthetic oligonucleotide
  Target: ATXN1; (+) strand; PAM type: NRG; PAM sequence: CAG
agtgttaagagcatagggaa

SEQ ID NO: 98557 - DNA, 20 bp, Artificial Sequence
  Description of Artificial Sequence: Synthetic oligonucleotide
  Target: ATXN1; (+) strand; PAM type: NRG; PAM sequence: AGG
gtgttaagagcatagggaac

SEQ ID NO: 98558 - DNA, 20 bp, Artificial Sequence
  Description of Artificial Sequence: Synthetic oligonucleotide
  Target: ATXN1; (+) strand; PAM type: NRG; PAM sequence: TGG
agagcatagggaacaggtaa

SEQ ID NO: 98559 - DNA, 20 bp, Artificial Sequence
  Description of Artificial Sequence: Synthetic oligonucleotide
  Target: ATXN1; (+) strand; PAM type: NRG; PAM sequence: GAG
agcatagggaacaggtaatg

SEQ ID NO: 98560 - DNA, 20 bp, Artificial Sequence
  Description of Artificial Sequence: Synthetic oligonucleotide
  Target: ATXN1; (+) strand; PAM type: NRG; PAM sequence: CAG
agggaacaggtaatggagtt

SEQ ID NO: 98561 - DNA, 20 bp, Artificial Sequence
  Description of Artificial Sequence: Synthetic oligonucleotide
  Target: ATXN1; (+) strand; PAM type: NRG; PAM sequence: AGG
gggaacaggtaatggagttc

SEQ ID NO: 98562 - DNA, 20 bp, Artificial Sequence
  Description of Artificial Sequence: Synthetic oligonucleotide
  Target: ATXN1; (+) strand; PAM type: NRG; PAM sequence: AAG
aatggagttcaggatacacc

SEQ ID NO: 98563 - DNA, 20 bp, Artificial Sequence
  Description of Artificial Sequence: Synthetic oligonucleotide
  Target: ATXN1; (+) strand; PAM type: NRG; PAM sequence: AGG
atggagttcaggatacacca

SEQ ID NO: 98564 - DNA, 20 bp, Artificial Sequence
  Description of Artificial Sequence: Synthetic oligonucleotide
  Target: ATXN1; (+) strand; PAM type: NRG; PAM sequence: GGG
tggagttcaggatacaccaa

SEQ ID NO: 98565 - DNA, 20 bp, Artificial Sequence
  Description of Artificial Sequence: Synthetic oligonucleotide
  Target: ATXN1; (+) strand; PAM type: NRG; PAM sequence: GAG
gagttcaggatacaccaagg

SEQ ID NO: 98566 - DNA, 20 bp, Artificial Sequence
  Description of Artificial Sequence: Synthetic oligonucleotide
  Target: ATXN1; (+) strand; PAM type: NRG; PAM sequence: AGG
agttcaggatacaccaaggg

SEQ ID NO: 98567 - DNA, 20 bp, Artificial Sequence
  Description of Artificial Sequence: Synthetic oligonucleotide
  Target: ATXN1; (+) strand; PAM type: NRG; PAM sequence: GGG
gttcaggatacaccaaggga

SEQ ID NO: 98568 - DNA, 20 bp, Artificial Sequence
  Description of Artificial Sequence: Synthetic oligonucleotide
  Target: ATXN1; (+) strand; PAM type: NRG; PAM sequence: TGG
caccaagggagggtgttctc

SEQ ID NO: 98569 - DNA, 20 bp, Artificial Sequence
  Description of Artificial Sequence: Synthetic oligonucleotide
  Target: ATXN1; (+) strand; PAM type: NRG; PAM sequence: GAG
aagggagggtgttctctggt

SEQ ID NO: 98570 - DNA, 20 bp, Artificial Sequence
  Description of Artificial Sequence: Synthetic oligonucleotide
  Target: ATXN1; (+) strand; PAM type: NRG; PAM sequence: GAG
ctggtgagccccattctttt

SEQ ID NO: 98571 - DNA, 20 bp, Artificial Sequence
  Description of Artificial Sequence: Synthetic oligonucleotide
  Target: ATXN1; (+) strand; PAM type: NRG; PAM sequence: AAG
tcttttgagttgtgacccca

SEQ ID NO: 98572 - DNA, 20 bp, Artificial Sequence
  Description of Artificial Sequence: Synthetic oligonucleotide
  Target: ATXN1; (+) strand; PAM type: NRG; PAM sequence: TAG
gaccccaaagcactgtccct

SEQ ID NO: 98573 - DNA, 20 bp, Artificial Sequence
  Description of Artificial Sequence: Synthetic oligonucleotide
  Target: ATXN1; (+) strand; PAM type: NRG; PAM sequence: GAG
ccccaaagcactgtccctta

SEQ ID NO: 98574 - DNA, 20 bp, Artificial Sequence
  Description of Artificial Sequence: Synthetic oligonucleotide
  Target: ATXN1; (+) strand; PAM type: NRG; PAM sequence: AGG
cccaaagcactgtcccttag

SEQ ID NO: 98575 - DNA, 20 bp, Artificial Sequence
  Description of Artificial Sequence: Synthetic oligonucleotide
  Target: ATXN1; (+) strand; PAM type: NRG; PAM sequence: GAG
caaagcactgtcccttagag

SEQ ID NO: 98576 - DNA, 20 bp, Artificial Sequence
  Description of Artificial Sequence: Synthetic oligonucleotide
  Target: ATXN1; (+) strand; PAM type: NRG; PAM sequence: CAG
gcactgtcccttagaggaga

SEQ ID NO: 98577 - DNA, 20 bp, Artificial Sequence
  Description of Artificial Sequence: Synthetic oligonucleotide
  Target: ATXN1; (+) strand; PAM type: NRG; PAM sequence: AAG
tagaggagacagtgaaccac

SEQ ID NO: 98578 - DNA, 20 bp, Artificial Sequence
  Description of Artificial Sequence: Synthetic oligonucleotide
  Target: ATXN1; (+) strand; PAM type: NRG; PAM sequence: CAG
gacagtgaaccacaagccaa

SEQ ID NO: 98579 - DNA, 20 bp, Artificial Sequence
  Description of Artificial Sequence: Synthetic oligonucleotide
  Target: ATXN1; (+) strand; PAM type: NRG; PAM sequence: AGG
acagtgaaccacaagccaac

SEQ ID NO: 98580 - DNA, 20 bp, Artificial Sequence
  Description of Artificial Sequence: Synthetic oligonucleotide
  Target: ATXN1; (+) strand; PAM type: NRG; PAM sequence: AAG
cacaagccaacaggcctttc

SEQ ID NO: 98581 - DNA, 20 bp, Artificial Sequence
  Description of Artificial Sequence: Synthetic oligonucleotide
  Target: ATXN1; (+) strand; PAM type: NRG; PAM sequence: AGG
acaagccaacaggcctttca

SEQ ID NO: 98582 - DNA, 20 bp, Artificial Sequence
  Description of Artificial Sequence: Synthetic oligonucleotide
  Target: ATXN1; (+) strand; PAM type: NRG; PAM sequence: AAG
aacaggcctttcaaggtctg

SEQ ID NO: 98583 - DNA, 20 bp, Artificial Sequence
  Description of Artificial Sequence: Synthetic oligonucleotide
  Target: ATXN1; (+) strand; PAM type: NRG; PAM sequence: CAG
gcctttcaaggtctgaagct

SEQ ID NO: 98584 - DNA, 20 bp, Artificial Sequence
  Description of Artificial Sequence: Synthetic oligonucleotide
  Target: ATXN1; (+) strand; PAM type: NRG; PAM sequence: GAG
aagctcagattgactcatct

SEQ ID NO: 98585 - DNA, 20 bp, Artificial Sequence
  Description of Artificial Sequence: Synthetic oligonucleotide
  Target: ATXN1; (+) strand; PAM type: NRG; PAM sequence: TGG
ctcatctgagtccctaaaac

SEQ ID NO: 98586 - DNA, 20 bp, Artificial Sequence
  Description of Artificial Sequence: Synthetic oligonucleotide
  Target: ATXN1; (+) strand; PAM type: NRG; PAM sequence: AAG
tgagtccctaaaactggatt

SEQ ID NO: 98587 - DNA, 20 bp, Artificial Sequence
  Description of Artificial Sequence: Synthetic oligonucleotide
  Target: ATXN1; (+) strand; PAM type: NRG; PAM sequence: AGG
gagtccctaaaactggatta

SEQ ID NO: 98588 - DNA, 20 bp, Artificial Sequence
  Description of Artificial Sequence: Synthetic oligonucleotide
  Target: ATXN1; (+) strand; PAM type: NRG; PAM sequence: AAG
tttcacaattttgcaaataa

SEQ ID NO: 98589 - DNA, 20 bp, Artificial Sequence
  Description of Artificial Sequence: Synthetic oligonucleotide
  Target: ATXN1; (+) strand; PAM type: NRG; PAM sequence: AAG
taaaagcattcaatttaaaa

SEQ ID NO: 98590 - DNA, 20 bp, Artificial Sequence
  Description of Artificial Sequence: Synthetic oligonucleotide
  Target: ATXN1; (+) strand; PAM type: NRG; PAM sequence: AGG
aaaagcattcaatttaaaaa

SEQ ID NO: 98591 - DNA, 20 bp, Artificial Sequence
  Description of Artificial Sequence: Synthetic oligonucleotide
  Target: ATXN1; (+) strand; PAM type: NRG; PAM sequence: GGG
aaagcattcaatttaaaaaa

SEQ ID NO: 98592 - DNA, 20 bp, Artificial Sequence
  Description of Artificial Sequence: Synthetic oligonucleotide
  Target: ATXN1; (+) strand; PAM type: NRG; PAM sequence: GGG
aagcattcaatttaaaaaag

SEQ ID NO: 98593 - DNA, 20 bp, Artificial Sequence
  Description of Artificial Sequence: Synthetic oligonucleotide
  Target: ATXN1; (+) strand; PAM type: NRG; PAM sequence: GGG
agcattcaatttaaaaaagg

SEQ ID NO: 98594 - DNA, 20 bp, Artificial Sequence
  Description of Artificial Sequence: Synthetic oligonucleotide
  Target: ATXN1; (+) strand; PAM type: NRG; PAM sequence: GGG
gcattcaatttaaaaaaggg

SEQ ID NO: 98595 - DNA, 20 bp, Artificial Sequence
  Description of Artificial Sequence: Synthetic oligonucleotide
  Target: ATXN1; (+) strand; PAM type: NRG; PAM sequence: TGG
ttcaatttaaaaaagggggg

SEQ ID NO: 98596 - DNA, 20 bp, Artificial Sequence
  Description of Artificial Sequence: Synthetic oligonucleotide
  Target: ATXN1; (+) strand; PAM type: NRG; PAM sequence: TGG
aatttaaaaaaggggggtgg

SEQ ID NO: 98597 - DNA, 20 bp, Artificial Sequence
  Description of Artificial Sequence: Synthetic oligonucleotide
  Target: ATXN1; (+) strand; PAM type: NRG; PAM sequence: GAG
aaaaggggggtggtggtcat

SEQ ID NO: 98598 - DNA, 20 bp, Artificial Sequence
  Description of Artificial Sequence: Synthetic oligonucleotide
  Target: ATXN1; (+) strand; PAM type: NRG; PAM sequence: AGG
aaaggggggtggtggtcatg

SEQ ID NO: 98599 - DNA, 20 bp, Artificial Sequence
  Description of Artificial Sequence: Synthetic oligonucleotide
  Target: ATXN1; (+) strand; PAM type: NRG; PAM sequence: GAG
aggggggtggtggtcatgag

SEQ ID NO: 98600 - DNA, 20 bp, Artificial Sequence
  Description of Artificial Sequence: Synthetic oligonucleotide
  Target: ATXN1; (+) strand; PAM type: NRG; PAM sequence: CAG
ggtggtggtcatgaggagac

SEQ ID NO: 98601 - DNA, 20 bp, Artificial Sequence
  Description of Artificial Sequence: Synthetic oligonucleotide
  Target: ATXN1; (+) strand; PAM type: NRG; PAM sequence: TAG
gtggtcatgaggagaccaga

SEQ ID NO: 98602 - DNA, 20 bp, Artificial Sequence
  Description of Artificial Sequence: Synthetic oligonucleotide
  Target: ATXN1; (+) strand; PAM type: NRG; PAM sequence: AAG
ggagaccagatagcttgtat

SEQ ID NO: 98603 - DNA, 20 bp, Artificial Sequence
  Description of Artificial Sequence: Synthetic oligonucleotide
  Target: ATXN1; (+) strand; PAM type: NRG; PAM sequence: TAG
cagatagcttgtataagcac

SEQ ID NO: 98604 - DNA, 20 bp, Artificial Sequence
  Description of Artificial Sequence: Synthetic oligonucleotide
  Target: ATXN1; (+) strand; PAM type: NRG; PAM sequence: CAG
tataagcactagcaaaatat

SEQ ID NO: 98605 - DNA, 20 bp, Artificial Sequence
  Description of Artificial Sequence: Synthetic oligonucleotide
  Target: ATXN1; (+) strand; PAM type: NRG; PAM sequence: AAG
caaaatatcagatcttaaaa

SEQ ID NO: 98606 - DNA, 20 bp, Artificial Sequence
  Description of Artificial Sequence: Synthetic oligonucleotide
  Target: ATXN1; (+) strand; PAM type: NRG; PAM sequence: AGG
aaaatatcagatcttaaaaa

SEQ ID NO: 98607 - DNA, 20 bp, Artificial Sequence
  Description of Artificial Sequence: Synthetic oligonucleotide
  Target: ATXN1; (+) strand; PAM type: NRG; PAM sequence: CAG
gatcttaaaaaaggatgcac

SEQ ID NO: 98608 - DNA, 20 bp, Artificial Sequence
  Description of Artificial Sequence: Synthetic oligonucleotide
  Target: ATXN1; (+) strand; PAM type: NRG; PAM sequence: AGG
atcttaaaaaaggatgcacc

SEQ ID NO: 98609 - DNA, 20 bp, Artificial Sequence
  Description of Artificial Sequence: Synthetic oligonucleotide
  Target: ATXN1; (+) strand; PAM type: NRG; PAM sequence: GGG
tcttaaaaaaggatgcacca

SEQ ID NO: 98610 - DNA, 20 bp, Artificial Sequence
  Description of Artificial Sequence: Synthetic oligonucleotide
  Target: ATXN1; (+) strand; PAM type: NRG; PAM sequence: TAG
atgcaccagggcttctcata

SEQ ID NO: 98611 - DNA, 20 bp, Artificial Sequence
  Description of Artificial Sequence: Synthetic oligonucleotide
  Target: ATXN1; (+) strand; PAM type: NRG; PAM sequence: GAG
gcaccagggcttctcatata

SEQ ID NO: 98612 - DNA, 20 bp, Artificial Sequence
  Description of Artificial Sequence: Synthetic oligonucleotide
  Target: ATXN1; (+) strand; PAM type: NRG; PAM sequence: TAG
ctcatatagagtcatacata

SEQ ID NO: 98613 - DNA, 20 bp, Artificial Sequence
  Description of Artificial Sequence: Synthetic oligonucleotide
  Target: ATXN1; (+) strand; PAM type: NRG; PAM sequence: AAG
tcatacatatagactttaca

SEQ ID NO: 98614 - DNA, 20 bp, Artificial Sequence
  Description of Artificial Sequence: Synthetic oligonucleotide
  Target: ATXN1; (+) strand; PAM type: NRG; PAM sequence: AAG
agactatgcttacaataatt

SEQ ID NO: 98615 - DNA, 20 bp, Artificial Sequence
  Description of Artificial Sequence: Synthetic oligonucleotide
  Target: ATXN1; (+) strand; PAM type: NRG; PAM sequence: AAG
ctatgcttacaataattaag

SEQ ID NO: 98616 - DNA, 20 bp, Artificial Sequence
  Description of Artificial Sequence: Synthetic oligonucleotide
  Target: ATXN1; (+) strand; PAM type: NRG; PAM sequence: AAG
tacaataattaagaagatta

SEQ ID NO: 98617 - DNA, 20 bp, Artificial Sequence
  Description of Artificial Sequence: Synthetic oligonucleotide
  Target: ATXN1; (+) strand; PAM type: NRG; PAM sequence: CAG
ataattaagaagattaaaga

SEQ ID NO: 98618 - DNA, 20 bp, Artificial Sequence
  Description of Artificial Sequence: Synthetic oligonucleotide
  Target: ATXN1; (+) strand; PAM type: NRG; PAM sequence: GAG
aagaagattaaagacagctt

SEQ ID NO: 98619 - DNA, 20 bp, Artificial Sequence
  Description of Artificial Sequence: Synthetic oligonucleotide
  Target: ATXN1; (+) strand; PAM type: NRG; PAM sequence: TAG
agacagcttgagaattttga

SEQ ID NO: 98620 - DNA, 20 bp, Artificial Sequence
  Description of Artificial Sequence: Synthetic oligonucleotide
  Target: ATXN1; (+) strand; PAM type: NRG; PAM sequence: AGG
gacagcttgagaattttgat

SEQ ID NO: 98621 - DNA, 20 bp, Artificial Sequence
  Description of Artificial Sequence: Synthetic oligonucleotide
  Target: ATXN1; (+) strand; PAM type: NRG; PAM sequence: TAG
tgagaattttgataggaaac

SEQ ID NO: 98622 - DNA, 20 bp, Artificial Sequence
  Description of Artificial Sequence: Synthetic oligonucleotide
  Target: ATXN1; (+) strand; PAM type: NRG; PAM sequence: AAG
aaactagaatctgtttttaa

SEQ ID NO: 98623 - DNA, 20 bp, Artificial Sequence
  Description of Artificial Sequence: Synthetic oligonucleotide
  Target: ATXN1; (+) strand; PAM type: NRG; PAM sequence: AAG
ctgtttttaaaagatccatg

SEQ ID NO: 98624 - DNA, 20 bp, Artificial Sequence
  Description of Artificial Sequence: Synthetic oligonucleotide
  Target: ATXN1; (+) strand; PAM type: NRG; PAM sequence: CAG
ttttaaaagatccatgaagc

SEQ ID NO: 98625 - DNA, 20 bp, Artificial Sequence
  Description of Artificial Sequence: Synthetic oligonucleotide
  Target: ATXN1; (+) strand; PAM type: NRG; PAM sequence: AGG
tttaaaagatccatgaagcc

SEQ ID NO: 98626 - DNA, 20 bp, Artificial Sequence
  Description of Artificial Sequence: Synthetic oligonucleotide
  Target: ATXN1; (+) strand; PAM type: NRG; PAM sequence: TGG
aagatccatgaagccaggca

SEQ ID NO: 98627 - DNA, 20 bp, Artificial Sequence
  Description of Artificial Sequence: Synthetic oligonucleotide
  Target: ATXN1; (+) strand; PAM type: NRG; PAM sequence: TGG
atccatgaagccaggcatgg

SEQ ID NO: 98628 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatct

SEQ ID NO: 98629 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatctcagtactt

SEQ ID NO: 98630 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatctcagtacttt

SEQ ID NO: 98631 - DNA, 20 bp, Artificial Sequence
  Description of Artificial Sequence: Synthetic oligonucleotide
  Target: ATXN1; (+) strand; PAM type: NRG; PAM sequence: GAG
ctgtaatctcagtactttgg

SEQ ID NO: 98632 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagtactttggg

SEQ ID NO: 98633 - DNA, 20 bp, Artificial Sequence
  Description of Artificial Sequence: Synthetic oligonucleotide
  Target: ATXN1; (+) strand; PAM type: NRG; PAM sequence: GAG
tctcagtactttgggaggct

SEQ ID NO: 98634 - DNA, 20 bp, Artificial Sequence
  Description of Artificial Sequence: Synthetic oligonucleotide
  Target: ATXN1; (+) strand; PAM type: NRG; PAM sequence: CAG
agtactttgggaggctgaga

SEQ ID NO: 98635 - DNA, 20 bp, Artificial Sequence
  Description of Artificial Sequence: Synthetic oligonucleotide
  Target: ATXN1; (+) strand; PAM type: NRG; PAM sequence: AGG
gtactttgggaggctgagac

SEQ ID NO: 98636 - DNA, 20 bp, Artificial Sequence
  Description of Artificial Sequence: Synthetic oligonucleotide
  Target: ATXN1; (+) strand; PAM type: NRG; PAM sequence: GGG
tactttgggaggctgagaca

SEQ ID NO: 98637 - DNA, 20 bp, Artificial Sequence
  Description of Artificial Sequence: Synthetic oligonucleotide
  Target: ATXN1; (+) strand; PAM type: NRG; PAM sequence: GAG
ctttgggaggctgagacagg

SEQ ID NO: 98638 - DNA, 20 bp, Artificial Sequence
  Description of Artificial Sequence: Synthetic oligonucleotide
  Target: ATXN1; (+) strand; PAM type: NRG; PAM sequence: AGG
tttgggaggctgagacaggg

SEQ ID NO: 98639 - DNA, 20 bp, Artificial Sequence
  Description of Artificial Sequence: Synthetic oligonucleotide
  Target: ATXN1; (+) strand; PAM type: NRG; PAM sequence: GAG
tgagacagggaggatcactt

SEQ ID NO: 98640 - DNA, 20 bp, Artificial Sequence
  Description of Artificial Sequence: Synthetic oligonucleotide
  Target: ATXN1; (+) strand; PAM type: NRG; PAM sequence: AGG
gagacagggaggatcacttg

SEQ ID NO: 98641 - DNA, 20 bp, Artificial Sequence
  Description of Artificial Sequence: Synthetic oligonucleotide
  Target: ATXN1; (+) strand; PAM type: NRG; PAM sequence: CAG
cagggaggatcacttgaggc

SEQ ID NO: 98642 - DNA, 20 bp, Artificial Sequence
  Description of Artificial Sequence: Synthetic oligonucleotide
  Target: ATXN1; (+) strand; PAM type: NRG; PAM sequence: AGG
agggaggatcacttgaggcc

SEQ ID NO: 98643 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgaggccag

SEQ ID NO: 98644 - DNA, 20 bp, Artificial Sequence
  Description of Artificial Sequence: Synthetic oligonucleotide
  Target: ATXN1; (+) strand; PAM type: NRG; PAM sequence: CAG
tcacttgaggccaggagttt

SEQ ID NO: 98645 - DNA, 20 bp, Artificial Sequence
  Description of Artificial Sequence: Synthetic oligonucleotide
  Target: ATXN1; (+) strand; PAM type: NRG; PAM sequence: CAG
tgaggccaggagtttcagac

SEQ ID NO: 98646 - DNA, 20 bp, Artificial Sequence
  Description of Artificial Sequence: Synthetic oligonucleotide
  Target: ATXN1; (+) strand; PAM type: NRG; PAM sequence: TGG
ccaggagtttcagaccagtc

SEQ ID NO: 98647 - DNA, 20 bp, Artificial Sequence
  Description of Artificial Sequence: Synthetic oligonucleotide
  Target: ATXN1; (+) strand; PAM type: NRG; PAM sequence: GGG
caggagtttcagaccagtct

SEQ ID NO: 98648 - DNA, 20 bp, Artificial Sequence
  Description of Artificial Sequence: Synthetic oligonucleotide
  Target: ATXN1; (+) strand; PAM type: NRG; PAM sequence: GAG
accagtctgggcaacaaaat

SEQ ID NO: 98649 - DNA, 20 bp, Artificial Sequence
  Description of Artificial Sequence: Synthetic oligonucleotide
  Target: ATXN1; (+) strand; PAM type: NRG; PAM sequence: CAG
aaaatgagaccccgtttcta

SEQ ID NO: 98650 - DNA, 20 bp, Artificial Sequence
  Description of Artificial Sequence: Synthetic oligonucleotide
  Target: ATXN1; (+) strand; PAM type: NRG; PAM sequence: TAG
tacagaaatttaaaaaaaaa

SEQ ID NO: 98651 - DNA, 20 bp, Artificial Sequence
  Description of Artificial Sequence: Synthetic oligonucleotide
  Target: ATXN1; (+) strand; PAM type: NRG; PAM sequence: TAG
aaatttaaaaaaaaatagcc

SEQ ID NO: 98652 - DNA, 20 bp, Artificial Sequence
  Description of Artificial Sequence: Synthetic oligonucleotide
  Target: ATXN1; (+) strand; PAM type: NRG; PAM sequence: TGG
taaaaaaaaatagcctagtg

SEQ ID NO: 98653 - DNA, 20 bp, Artificial Sequence
  Description of Artificial Sequence: Synthetic oligonucleotide
  Target: ATXN1; (+) strand; PAM type: NRG; PAM sequence: TAG
agtgtggtgatgcgtgcctg

SEQ ID NO: 98654 - DNA, 20 bp, Artificial Sequence
  Description of Artificial Sequence: Synthetic oligonucleotide
  Target: ATXN1; (+) strand; PAM type: NRG; PAM sequence: CAG
tgcctgtagtcccaactact

SEQ ID NO: 98655 - DNA, 20 bp, Artificial Sequence
  Description of Artificial Sequence: Synthetic oligonucleotide
  Target: ATXN1; (+) strand; PAM type: NRG; PAM sequence: AGG
gcctgtagtcccaactactc

SEQ ID NO: 98656 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccaactactcag

SEQ ID NO: 98657 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccaactactcagg

SEQ ID NO: 98658 - DNA, 20 bp, Artificial Sequence
  Description of Artificial Sequence: Synthetic oligonucleotide
  Target: ATXN1; (+) strand; PAM type: NRG; PAM sequence: GAG
tcccaactactcaggaggct

SEQ ID NO: 98659 - DNA, 20 bp, Artificial Sequence
  Description of Artificial Sequence: Synthetic oligonucleotide
  Target: ATXN1; (+) strand; PAM type: NRG; PAM sequence: AGG
cccaactactcaggaggctg

SEQ ID NO: 98660 - DNA, 20 bp, Artificial Sequence
  Description of Artificial Sequence: Synthetic oligonucleotide
  Target: ATXN1; (+) strand; PAM type: NRG; PAM sequence: CAG
aactactcaggaggctgagg

SEQ ID NO: 98661 - DNA, 20 bp, Artificial Sequence
  Description of Artificial Sequence: Synthetic oligonucleotide
  Target: ATXN1; (+) strand; PAM type: NRG; PAM sequence: AGG
actactcaggaggctgaggc

SEQ ID NO: 98662 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 98663 - DNA, 20 bp, Artificial Sequence
  Description of Artificial Sequence: Synthetic oligonucleotide
  Target: ATXN1; (+) strand; PAM type: NRG; PAM sequence: AGG
actcaggaggctgaggcagg

SEQ ID NO: 98664 - DNA, 20 bp, Artificial Sequence
  Description of Artificial Sequence: Synthetic oligonucleotide
  Target: ATXN1; (+) strand; PAM type: NRG; PAM sequence: GAG
ggctgaggcaggaggatctt

SEQ ID NO: 98665 - DNA, 20 bp, Artificial Sequence
  Description of Artificial Sequence: Synthetic oligonucleotide
  Target: ATXN1; (+) strand; PAM type: NRG; PAM sequence: CAG
aggcaggaggatcttgagcc

SEQ ID NO: 98666 - DNA, 20 bp, Artificial Sequence
  Description of Artificial Sequence: Synthetic oligonucleotide
  Target: ATXN1; (+) strand; PAM type: NRG; PAM sequence: AGG
ggcaggaggatcttgagccc

SEQ ID NO: 98667 - DNA, 20 bp, Artificial Sequence
  Description of Artificial Sequence: Synthetic oligonucleotide
  Target: ATXN1; (+) strand; PAM type: NRG; PAM sequence: GAG
caggaggatcttgagcccag

SEQ ID NO: 98668 - DNA, 20 bp, Artificial Sequence
  Description of Artificial Sequence: Synthetic oligonucleotide
  Target: ATXN1; (+) strand; PAM type: NRG; PAM sequence: TAG
aggatcttgagcccaggagt

SEQ ID NO: 98669 - DNA, 20 bp, Artificial Sequence
  Description of Artificial Sequence: Synthetic oligonucleotide
  Target: ATXN1; (+) strand; PAM type: NRG; PAM sequence: GAG
gatcttgagcccaggagtta

SEQ ID NO: 98670 - DNA, 20 bp, Artificial Sequence
  Description of Artificial Sequence: Synthetic oligonucleotide
  Target: ATXN1; (+) strand; PAM type: NRG; PAM sequence: AGG
atcttgagcccaggagttag

SEQ ID NO: 98671 - DNA, 20 bp, Artificial Sequence
  Description of Artificial Sequence: Synthetic oligonucleotide
  Target: ATXN1; (+) strand; PAM type: NRG; PAM sequence: CAG
agcccaggagttagaggttg

SEQ ID NO: 98672 - DNA, 20 bp, Artificial Sequence
  Description of Artificial Sequence: Synthetic oligonucleotide
  Target: ATXN1; (+) strand; PAM type: NRG; PAM sequence: GAG
caggagttagaggttgcagt

SEQ ID NO: 98673 - DNA, 20 bp, Artificial Sequence
  Description of Artificial Sequence: Synthetic oligonucleotide
  Target: ATXN1; (+) strand; PAM type: NRG; PAM sequence: AAG
ttgcagtgagctatgatcac

SEQ ID NO: 98674 - DNA, 20 bp, Artificial Sequence
  Description of Artificial Sequence: Synthetic oligonucleotide
  Target: ATXN1; (+) strand; PAM type: NRG; PAM sequence: CAG
atgatcacaagactgcactc

SEQ ID NO: 98675 - DNA, 20 bp, Artificial Sequence
  Description of Artificial Sequence: Synthetic oligonucleotide
  Target: ATXN1; (+) strand; PAM type: NRG; PAM sequence: TGG
cacaagactgcactccagcc

SEQ ID NO: 98676 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctggacaa

SEQ ID NO: 98677 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctggacaaca

SEQ ID NO: 98678 - DNA, 20 bp, Artificial Sequence
  Description of Artificial Sequence: Synthetic oligonucleotide
  Target: ATXN1; (+) strand; PAM type: NRG; PAM sequence: GAG
tccagcctggacaacagagt

SEQ ID NO: 98679 - DNA, 20 bp, Artificial Sequence
  Description of Artificial Sequence: Synthetic oligonucleotide
  Target: ATXN1; (+) strand; PAM type: NRG; PAM sequence: AAG
taataattaattaattaaaa

SEQ ID NO: 98680 - DNA, 20 bp, Artificial Sequence
  Description of Artificial Sequence: Synthetic oligonucleotide
  Target: ATXN1; (+) strand; PAM type: NRG; PAM sequence: AGG
aataattaattaattaaaaa

SEQ ID NO: 98681 - DNA, 20 bp, Artificial Sequence
  Description of Artificial Sequence: Synthetic oligonucleotide
  Target: ATXN1; (+) strand; PAM type: NRG; PAM sequence: GAG
attaattaaaaaaggtctat

SEQ ID NO: 98682 - DNA, 20 bp, Artificial Sequence
  Description of Artificial Sequence: Synthetic oligonucleotide
  Target: ATXN1; (+) strand; PAM type: NRG; PAM sequence: TAG
aaaaaggtctatgagaattg

SEQ ID NO: 98683 - DNA, 20 bp, Artificial Sequence
  Description of Artificial Sequence: Synthetic oligonucleotide
  Target: ATXN1; (+) strand; PAM type: NRG; PAM sequence: AAG
aaatatacaccactgaaatc

SEQ ID NO: 98684 - DNA, 20 bp, Artificial Sequence
  Description of Artificial Sequence: Synthetic oligonucleotide
  Target: ATXN1; (+) strand; PAM type: NRG; PAM sequence: GAG
actgaaatcaagaatgcaat

SEQ ID NO: 98685 - DNA, 20 bp, Artificial Sequence
  Description of Artificial Sequence: Synthetic oligonucleotide
  Target: ATXN1; (+) strand; PAM type: NRG; PAM sequence: CAG
caagaatgcaatgagctttc

SEQ ID NO: 98686 - DNA, 20 bp, Artificial Sequence
  Description of Artificial Sequence: Synthetic oligonucleotide
  Target: ATXN1; (+) strand; PAM type: NRG; PAM sequence: TAG
caatgagctttccagttgaa

SEQ ID NO: 98687 - DNA, 20 bp, Artificial Sequence
  Description of Artificial Sequence: Synthetic oligonucleotide
  Target: ATXN1; (+) strand; PAM type: NRG; PAM sequence: TGG
gctttccagttgaatagaca

SEQ ID NO: 98688 - DNA, 20 bp, Artificial Sequence
  Description of Artificial Sequence: Synthetic oligonucleotide
  Target: ATXN1; (+) strand; PAM type: NRG; PAM sequence: AAG
cagttgaatagacatggatt

SEQ ID NO: 98689 - DNA, 20 bp, Artificial Sequence
  Description of Artificial Sequence: Synthetic oligonucleotide
  Target: ATXN1; (+) strand; PAM type: NRG; PAM sequence: AAG
tgaatagacatggattaaga

SEQ ID NO: 98690 - DNA, 20 bp, Artificial Sequence
  Description of Artificial Sequence: Synthetic oligonucleotide
  Target: ATXN1; (+) strand; PAM type: NRG; PAM sequence: CAG
acatggattaagaaagaatt

SEQ ID NO: 98691 - DNA, 20 bp, Artificial Sequence
  Description of Artificial Sequence: Synthetic oligonucleotide
  Target: ATXN1; (+) strand; PAM type: NRG; PAM sequence: AGG
catggattaagaaagaattc

SEQ ID NO: 98692 - DNA, 20 bp, Artificial Sequence
  Description of Artificial Sequence: Synthetic oligonucleotide
  Target: ATXN1; (+) strand; PAM type: NRG; PAM sequence: TGG
ttaagaaagaattcaggaac

SEQ ID NO: 98693 - DNA, 20 bp, Artificial Sequence
  Description of Artificial Sequence: Synthetic oligonucleotide
  Target: ATXN1; (+) strand; PAM type: NRG; PAM sequence: TAG
caggaactggattctctaat

SEQ ID NO: 98694 - DNA, 20 bp, Artificial Sequence
  Description of Artificial Sequence: Synthetic oligonucleotide
  Target: ATXN1; (+) strand; PAM type: NRG; PAM sequence: GAG
ggaactggattctctaatta

SEQ ID NO: 98695 - DNA, 20 bp, Artificial Sequence
  Description of Artificial Sequence: Synthetic oligonucleotide
  Target: ATXN1; (+) strand; PAM type: NRG; PAM sequence: TAG
ggattctctaattagagctt

SEQ ID NO: 98696 - DNA, 20 bp, Artificial Sequence
  Description of Artificial Sequence: Synthetic oligonucleotide
  Target: ATXN1; (+) strand; PAM type: NRG; PAM sequence: AAG
ttctctaattagagctttag

SEQ ID NO: 98697 - DNA, 20 bp, Artificial Sequence
  Description of Artificial Sequence: Synthetic oligonucleotide
  Target: ATXN1; (+) strand; PAM type: NRG; PAM sequence: GAG
ctctaattagagctttagaa

SEQ ID NO: 98698 - DNA, 20 bp, Artificial Sequence
  Description of Artificial Sequence: Synthetic oligonucleotide
  Target: ATXN1; (+) strand; PAM type: NRG; PAM sequence: CAG
gagctttagaagagactcca

SEQ ID NO: 98699 - DNA, 20 bp, Artificial Sequence
  Description of Artificial Sequence: Synthetic oligonucleotide
  Target: ATXN1; (+) strand; PAM type: NRG; PAM sequence: GAG
gctttagaagagactccaca

SEQ ID NO: 98700 - DNA, 20 bp, Artificial Sequence
  Description of Artificial Sequence: Synthetic oligonucleotide
  Target: ATXN1; (+) strand; PAM type: NRG; PAM sequence: TAG
gagactccacagagtgaaca

SEQ ID NO: 98701 - DNA, 20 bp, Artificial Sequence
  Description of Artificial Sequence: Synthetic oligonucleotide
  Target: ATXN1; (+) strand; PAM type: NRG; PAM sequence: GAG
gactccacagagtgaacata

SEQ ID NO: 98702 - DNA, 20 bp, Artificial Sequence
  Description of Artificial Sequence: Synthetic oligonucleotide
  Target: ATXN1; (+) strand; PAM type: NRG; PAM sequence: AAG
agagtgaacatagagacaaa

SEQ ID NO: 98703 - DNA, 20 bp, Artificial Sequence
  Description of Artificial Sequence: Synthetic oligonucleotide
  Target: ATXN1; (+) strand; PAM type: NRG; PAM sequence: TGG
tgaacatagagacaaaaaga

SEQ ID NO: 98704 - DNA, 20 bp, Artificial Sequence
  Description of Artificial Sequence: Synthetic oligonucleotide
  Target: ATXN1; (+) strand; PAM type: NRG; PAM sequence: TGG
agacaaaaagatggtcaata

SEQ ID NO: 98705 - DNA, 20 bp, Artificial Sequence
  Description of Artificial Sequence: Synthetic oligonucleotide
  Target: ATXN1; (+) strand; PAM type: NRG; PAM sequence: GAG
acaaaaagatggtcaatatg

SEQ ID NO: 98706 - DNA, 20 bp, Artificial Sequence
  Description of Artificial Sequence: Synthetic oligonucleotide
  Target: ATXN1; (+) strand; PAM type: NRG; PAM sequence: AGG
caaaaagatggtcaatatgg

SEQ ID NO: 98707 - DNA, 20 bp, Artificial Sequence
  Description of Artificial Sequence: Synthetic oligonucleotide
  Target: ATXN1; (+) strand; PAM type: NRG; PAM sequence: GAG
aaaagatggtcaatatggag

SEQ ID NO: 98708 - DNA, 20 bp, Artificial Sequence
  Description of Artificial Sequence: Synthetic oligonucleotide
  Target: ATXN1; (+) strand; PAM type: NRG; PAM sequence: GAG
aagatggtcaatatggagga

SEQ ID NO: 98709 - DNA, 20 bp, Artificial Sequence
  Description of Artificial Sequence: Synthetic oligonucleotide
  Target: ATXN1; (+) strand; PAM type: NRG; PAM sequence: AGG
agatggtcaatatggaggag

SEQ ID NO: 98710 - DNA, 20 bp, Artificial Sequence
  Description of Artificial Sequence: Synthetic oligonucleotide
  Target: ATXN1; (+) strand; PAM type: NRG; PAM sequence: GGG
gatggtcaatatggaggaga

SEQ ID NO: 98711 - DNA, 20 bp, Artificial Sequence
  Description of Artificial Sequence: Synthetic oligonucleotide
  Target: ATXN1; (+) strand; PAM type: NRG; PAM sequence: AAG
gtcaatatggaggagagggt

SEQ ID NO: 98712 - DNA, 20 bp, Artificial Sequence
  Description of Artificial Sequence: Synthetic oligonucleotide
  Target: ATXN1; (+) strand; PAM type: NRG; PAM sequence: GAG
caatatggaggagagggtaa

SEQ ID NO: 98713 - DNA, 20 bp, Artificial Sequence
  Description of Artificial Sequence: Synthetic oligonucleotide
  Target: ATXN1; (+) strand; PAM type: NRG; PAM sequence: TAG
aggagagggtaagagacaca

SEQ ID NO: 98714 - DNA, 20 bp, Artificial Sequence
  Description of Artificial Sequence: Synthetic oligonucleotide
  Target: ATXN1; (+) strand; PAM type: NRG; PAM sequence: AGG
ggagagggtaagagacacat

SEQ ID NO: 98715 - DNA, 20 bp, Artificial Sequence
  Description of Artificial Sequence: Synthetic oligonucleotide
  Target: ATXN1; (+) strand; PAM type: NRG; PAM sequence: GAG
agagacacataggatacatt

SEQ ID NO: 98716 - DNA, 20 bp, Artificial Sequence
  Description of Artificial Sequence: Synthetic oligonucleotide
  Target: ATXN1; (+) strand; PAM type: NRG; PAM sequence: GAG
agacacataggatacattga

SEQ ID NO: 98717 - DNA, 20 bp, Artificial Sequence
  Description of Artificial Sequence: Synthetic oligonucleotide
  Target: ATXN1; (+) strand; PAM type: NRG; PAM sequence: AGG
gacacataggatacattgag

SEQ ID NO: 98718 - DNA, 20 bp, Artificial Sequence
  Description of Artificial Sequence: Synthetic oligonucleotide
  Target: ATXN1; (+) strand; PAM type: NRG; PAM sequence: GGG
acacataggatacattgaga

SEQ ID NO: 98719 - DNA, 20 bp, Artificial Sequence
  Description of Artificial Sequence: Synthetic oligonucleotide
  Target: ATXN1; (+) strand; PAM type: NRG; PAM sequence: GGG
cacataggatacattgagag

SEQ ID NO: 98720 - DNA, 20 bp, Artificial Sequence
  Description of Artificial Sequence: Synthetic oligonucleotide
  Target: ATXN1; (+) strand; PAM type: NRG; PAM sequence: CAG
gatacattgagaggggctaa

SEQ ID NO: 98721 - DNA, 20 bp, Artificial Sequence
  Description of Artificial Sequence: Synthetic oligonucleotide
  Target: ATXN1; (+) strand; PAM type: NRG; PAM sequence: TAG
cagacacataatttgaatcc

SEQ ID NO: 98722 - DNA, 20 bp, Artificial Sequence
  Description of Artificial Sequence: Synthetic oligonucleotide
  Target: ATXN1; (+) strand; PAM type: NRG; PAM sequence: AGG
agacacataatttgaatcct

SEQ ID NO: 98723 - DNA, 20 bp, Artificial Sequence
  Description of Artificial Sequence: Synthetic oligonucleotide
  Target: ATXN1; (+) strand; PAM type: NRG; PAM sequence: GAG
acacataatttgaatcctag

SEQ ID NO: 98724 - DNA, 20 bp, Artificial Sequence
  Description of Artificial Sequence: Synthetic oligonucleotide
  Target: ATXN1; (+) strand; PAM type: NRG; PAM sequence: AGG
cacataatttgaatcctagg

SEQ ID NO: 98725 - DNA, 20 bp, Artificial Sequence
  Description of Artificial Sequence: Synthetic oligonucleotide
  Target: ATXN1; (+) strand; PAM type: NRG; PAM sequence: GAG
cataatttgaatcctaggag

SEQ ID NO: 98726 - DNA, 20 bp, Artificial Sequence
  Description of Artificial Sequence: Synthetic oligonucleotide
  Target: ATXN1; (+) strand; PAM type: NRG; PAM sequence: AGG
ataatttgaatcctaggagg

SEQ ID NO: 98727 - DNA, 20 bp, Artificial Sequence
  Description of Artificial Sequence: Synthetic oligonucleotide
  Target: ATXN1; (+) strand; PAM type: NRG; PAM sequence: AAG
atttgaatcctaggaggagg

SEQ ID NO: 98728 - DNA, 20 bp, Artificial Sequence
  Description of Artificial Sequence: Synthetic oligonucleotide
  Target: ATXN1; (+) strand; PAM type: NRG; PAM sequence: GAG
ttgaatcctaggaggaggaa

SEQ ID NO: 98729 - DNA, 20 bp, Artificial Sequence
  Description of Artificial Sequence: Synthetic oligonucleotide
  Target: ATXN1; (+) strand; PAM type: NRG; PAM sequence: GAG
gaatcctaggaggaggaaga

SEQ ID NO: 98730 - DNA, 20 bp, Artificial Sequence
  Description of Artificial Sequence: Synthetic oligonucleotide
  Target: ATXN1; (+) strand; PAM type: NRG; PAM sequence: AGG
aatcctaggaggaggaagag

SEQ ID NO: 98731 - DNA, 20 bp, Artificial Sequence
  Description of Artificial Sequence: Synthetic oligonucleotide
  Target: ATXN1; (+) strand; PAM type: NRG; PAM sequence: GGG
atcctaggaggaggaagaga

SEQ ID NO: 98732 - DNA, 20 bp, Artificial Sequence
  Description of Artificial Sequence: Synthetic oligonucleotide
  Target: ATXN1; (+) strand; PAM type: NRG; PAM sequence: GAG
cctaggaggaggaagagagg

SEQ ID NO: 98733 - DNA, 20 bp, Artificial Sequence
  Description of Artificial Sequence: Synthetic oligonucleotide
  Target: ATXN1; (+) strand; PAM type: NRG; PAM sequence: TAG
ggaggaagagagggagataa

SEQ ID NO: 98734 - DNA, 20 bp, Artificial Sequence
  Description of Artificial Sequence: Synthetic oligonucleotide
  Target: ATXN1; (+) strand; PAM type: NRG; PAM sequence: AGG
gaggaagagagggagataat

SEQ ID NO: 98735 - DNA, 20 bp, Artificial Sequence
  Description of Artificial Sequence: Synthetic oligonucleotide
  Target: ATXN1; (+) strand; PAM type: NRG; PAM sequence: GGG
aggaagagagggagataata

SEQ ID NO: 98736 - DNA, 20 bp, Artificial Sequence
  Description of Artificial Sequence: Synthetic oligonucleotide
  Target: ATXN1; (+) strand; PAM type: NRG; PAM sequence: CAG
aagagagggagataataggg

SEQ ID NO: 98737 - DNA, 20 bp, Artificial Sequence
  Description of Artificial Sequence: Synthetic oligonucleotide
  Target: ATXN1; (+) strand; PAM type: NRG; PAM sequence: AAG
agagggagataatagggcag

SEQ ID NO: 98738 - DNA, 20 bp, Artificial Sequence
  Description of Artificial Sequence: Synthetic oligonucleotide
  Target: ATXN1; (+) strand; PAM type: NRG; PAM sequence: GAG
tagggcagaagttaatactt

SEQ ID NO: 98739 - DNA, 20 bp, Artificial Sequence
  Description of Artificial Sequence: Synthetic oligonucleotide
  Target: ATXN1; (+) strand; PAM type: NRG; PAM sequence: AGG
agggcagaagttaatacttg

SEQ ID NO: 98740 - DNA, 20 bp, Artificial Sequence
  Description of Artificial Sequence: Synthetic oligonucleotide
  Target: ATXN1; (+) strand; PAM type: NRG; PAM sequence: GAG
ggcagaagttaatacttgag

SEQ ID NO: 98741 - DNA, 20 bp, Artificial Sequence
  Description of Artificial Sequence: Synthetic oligonucleotide
  Target: ATXN1; (+) strand; PAM type: NRG; PAM sequence: AGG
gcagaagttaatacttgagg

SEQ ID NO: 98742 - DNA, 20 bp, Artificial Sequence
  Description of Artificial Sequence: Synthetic oligonucleotide
  Target: ATXN1; (+) strand; PAM type: NRG; PAM sequence: TGG
gttaatacttgaggaggtaa

SEQ ID NO: 98743 - DNA, 20 bp, Artificial Sequence
  Description of Artificial Sequence: Synthetic oligonucleotide
  Target: ATXN1; (+) strand; PAM type: NRG; PAM sequence: AAG
tacttgaggaggtaatggct

SEQ ID NO: 98744 - DNA, 20 bp, Artificial Sequence
  Description of Artificial Sequence: Synthetic oligonucleotide
  Target: ATXN1; (+) strand; PAM type: NRG; PAM sequence: AAG
ctaagaattttcccaaactg

SEQ ID NO: 98745 - DNA, 20 bp, Artificial Sequence
  Description of Artificial Sequence: Synthetic oligonucleotide
  Target: ATXN1; (+) strand; PAM type: NRG; PAM sequence: AAG
agaattttcccaaactgaag

SEQ ID NO: 98746 - DNA, 20 bp, Artificial Sequence
  Description of Artificial Sequence: Synthetic oligonucleotide
  Target: ATXN1; (+) strand; PAM type: NRG; PAM sequence: AGG
gaattttcccaaactgaaga

SEQ ID NO: 98747 - DNA, 20 bp, Artificial Sequence
  Description of Artificial Sequence: Synthetic oligonucleotide
  Target: ATXN1; (+) strand; PAM type: NRG; PAM sequence: AAG
ccaaactgaagaaggataat

SEQ ID NO: 98748 - DNA, 20 bp, Artificial Sequence
  Description of Artificial Sequence: Synthetic oligonucleotide
  Target: ATXN1; (+) strand; PAM type: NRG; PAM sequence: CAG
actgaagaaggataataaga

SEQ ID NO: 98749 - DNA, 20 bp, Artificial Sequence
  Description of Artificial Sequence: Synthetic oligonucleotide
  Target: ATXN1; (+) strand; PAM type: NRG; PAM sequence: AAG
aaggataataagacagtttc

SEQ ID NO: 98750 - DNA, 20 bp, Artificial Sequence
  Description of Artificial Sequence: Synthetic oligonucleotide
  Target: ATXN1; (+) strand; PAM type: NRG; PAM sequence: AAG
gataataagacagtttcaag

SEQ ID NO: 98751 - DNA, 20 bp, Artificial Sequence
  Description of Artificial Sequence: Synthetic oligonucleotide
  Target: ATXN1; (+) strand; PAM type: NRG; PAM sequence: AGG
ataataagacagtttcaaga

SEQ ID NO: 98752 - DNA, 20 bp, Artificial Sequence
  Description of Artificial Sequence: Synthetic oligonucleotide
  Target: ATXN1; (+) strand; PAM type: NRG; PAM sequence: TAG
aagacagtttcaagaaggcc

SEQ ID NO: 98753 - DNA, 20 bp, Artificial Sequence
  Description of Artificial Sequence: Synthetic oligonucleotide
  Target: ATXN1; (+) strand; PAM type: NRG; PAM sequence: CAG
caagaaggcctagccccaaa

SEQ ID NO: 98754 - DNA, 20 bp, Artificial Sequence
  Description of Artificial Sequence: Synthetic oligonucleotide
  Target: ATXN1; (+) strand; PAM type: NRG; PAM sequence: AGG
aagaaggcctagccccaaac

SEQ ID NO: 98755 - DNA, 20 bp, Artificial Sequence
  Description of Artificial Sequence: Synthetic oligonucleotide
  Target: ATXN1; (+) strand; PAM type: NRG; PAM sequence: AAG
aaacaggaaaaataaacaaa

SEQ ID NO: 98756 - DNA, 20 bp, Artificial Sequence
  Description of Artificial Sequence: Synthetic oligonucleotide
  Target: ATXN1; (+) strand; PAM type: NRG; PAM sequence: GAG
aacaaaaagaaatcctcact

SEQ ID NO: 98757 - DNA, 20 bp, Artificial Sequence
  Description of Artificial Sequence: Synthetic oligonucleotide
  Target: ATXN1; (+) strand; PAM type: NRG; PAM sequence: AGG
acaaaaagaaatcctcactg

SEQ ID NO: 98758 - DNA, 20 bp, Artificial Sequence
  Description of Artificial Sequence: Synthetic oligonucleotide
  Target: ATXN1; (+) strand; PAM type: NRG; PAM sequence: CAG
aaaagaaatcctcactgagg

SEQ ID NO: 98759 - DNA, 20 bp, Artificial Sequence
  Description of Artificial Sequence: Synthetic oligonucleotide
  Target: ATXN1; (+) strand; PAM type: NRG; PAM sequence: GAG
aaatcctcactgaggcagat

SEQ ID NO: 98760 - DNA, 20 bp, Artificial Sequence
  Description of Artificial Sequence: Synthetic oligonucleotide
  Target: ATXN1; (+) strand; PAM type: NRG; PAM sequence: AAG
aattaaactgctataaatca

SEQ ID NO: 98761 - DNA, 20 bp, Artificial Sequence
  Description of Artificial Sequence: Synthetic oligonucleotide
  Target: ATXN1; (+) strand; PAM type: NRG; PAM sequence: CAG
aagacatcttgtaaactaaa

SEQ ID NO: 98762 - DNA, 20 bp, Artificial Sequence
  Description of Artificial Sequence: Synthetic oligonucleotide
  Target: ATXN1; (+) strand; PAM type: NRG; PAM sequence: AGG
agacatcttgtaaactaaac

SEQ ID NO: 98763 - DNA, 20 bp, Artificial Sequence
  Description of Artificial Sequence: Synthetic oligonucleotide
  Target: ATXN1; (+) strand; PAM type: NRG; PAM sequence: AAG
acaggaaaaaatatcgttaa

SEQ ID NO: 98764 - DNA, 20 bp, Artificial Sequence
  Description of Artificial Sequence: Synthetic oligonucleotide
  Target: ATXN1; (+) strand; PAM type: NRG; PAM sequence: TAG
aaaatatcgttaaaagcctc

SEQ ID NO: 98765 - DNA, 20 bp, Artificial Sequence
  Description of Artificial Sequence: Synthetic oligonucleotide
  Target: ATXN1; (+) strand; PAM type: NRG; PAM sequence: CAG
atcgttaaaagcctctagaa

SEQ ID NO: 98766 - DNA, 20 bp, Artificial Sequence
  Description of Artificial Sequence: Synthetic oligonucleotide
  Target: ATXN1; (+) strand; PAM type: NRG; PAM sequence: AGG
tcgttaaaagcctctagaac

SEQ ID NO: 98767 - DNA, 20 bp, Artificial Sequence
  Description of Artificial Sequence: Synthetic oligonucleotide
  Target: ATXN1; (+) strand; PAM type: NRG; PAM sequence: TGG
taaaagcctctagaacaggc

SEQ ID NO: 98768 - DNA, 20 bp, Artificial Sequence
  Description of Artificial Sequence: Synthetic oligonucleotide
  Target: ATXN1; (+) strand; PAM type: NRG; PAM sequence: GGG
aaaagcctctagaacaggct

SEQ ID NO: 98769 - DNA, 20 bp, Artificial Sequence
  Description of Artificial Sequence: Synthetic oligonucleotide
  Target: ATXN1; (+) strand; PAM type: NRG; PAM sequence: TGG
cctctagaacaggctgggtg

SEQ ID NO: 98770 - DNA, 20 bp, Artificial Sequence
  Description of Artificial Sequence: Synthetic oligonucleotide
  Target: ATXN1; (+) strand; PAM type: NRG; PAM sequence: TGG
ctagaacaggctgggtgtgg

SEQ ID NO: 98771 - DNA, 20 bp, Artificial Sequence
  Description of Artificial Sequence: Synthetic oligonucleotide
  Target: ATXN1; (+) strand; PAM type: NRG; PAM sequence: CAG
gtggctcctgcctgtaatcc

SEQ ID NO: 98772 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 98773 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 98774 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 98775 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 98776 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 98777 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 98778 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccgagg

SEQ ID NO: 98779 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggt

SEQ ID NO: 98780 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggtggg

SEQ ID NO: 98781 - DNA, 20 bp, Artificial Sequence
  Description of Artificial Sequence: Synthetic oligonucleotide
  Target: ATXN1; (+) strand; PAM type: NRG; PAM sequence: GAG
ccgaggtgggtggattacct

SEQ ID NO: 98782 - DNA, 20 bp, Artificial Sequence
  Description of Artificial Sequence: Synthetic oligonucleotide
  Target: ATXN1; (+) strand; PAM type: NRG; PAM sequence: AGG
cgaggtgggtggattacctg

SEQ ID NO: 98783 - DNA, 20 bp, Artificial Sequence
  Description of Artificial Sequence: Synthetic oligonucleotide
  Target: ATXN1; (+) strand; PAM type: NRG; PAM sequence: CAG
gtgggtggattacctgaggt

SEQ ID NO: 98784 - DNA, 20 bp, Artificial Sequence
  Description of Artificial Sequence: Synthetic oligonucleotide
  Target: ATXN1; (+) strand; PAM type: NRG; PAM sequence: AGG
tgggtggattacctgaggtc

SEQ ID NO: 98785 - DNA, 20 bp, Artificial Sequence
  Description of Artificial Sequence: Synthetic oligonucleotide
  Target: ATXN1; (+) strand; PAM type: NRG; PAM sequence: GAG
ggtggattacctgaggtcag

SEQ ID NO: 98786 - DNA, 20 bp, Artificial Sequence
  Description of Artificial Sequence: Synthetic oligonucleotide
  Target: ATXN1; (+) strand; PAM type: NRG; PAM sequence: GAG
ttacctgaggtcaggagttt

SEQ ID NO: 98787 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagtttgagac

SEQ ID NO: 98788 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccagtc

SEQ ID NO: 98789 - DNA, 20 bp, Artificial Sequence
  Description of Artificial Sequence: Synthetic oligonucleotide
  Target: ATXN1; (+) strand; PAM type: NRG; PAM sequence: TGG
tgagaccagtctggccaaca

SEQ ID NO: 98790 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatgcaaaaat

SEQ ID NO: 98791 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatgcaaaaattagc

SEQ ID NO: 98792 - DNA, 20 bp, Artificial Sequence
  Description of Artificial Sequence: Synthetic oligonucleotide
  Target: ATXN1; (+) strand; PAM type: NRG; PAM sequence: GGG
taaaaatgcaaaaattagct

SEQ ID NO: 98793 - DNA, 20 bp, Artificial Sequence
  Description of Artificial Sequence: Synthetic oligonucleotide
  Target: ATXN1; (+) strand; PAM type: NRG; PAM sequence: TGG
atgcaaaaattagctgggca

SEQ ID NO: 98794 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatgg

SEQ ID NO: 98795 - DNA, 20 bp, Artificial Sequence
  Description of Artificial Sequence: Synthetic oligonucleotide
  Target: ATXN1; (+) strand; PAM type: NRG; PAM sequence: CAG
aaattagctgggcatggtgg

SEQ ID NO: 98796 - DNA, 20 bp, Artificial Sequence
  Description of Artificial Sequence: Synthetic oligonucleotide
  Target: ATXN1; (+) strand; PAM type: NRG; PAM sequence: AGG
aattagctgggcatggtggc

SEQ ID NO: 98797 - DNA, 20 bp, Artificial Sequence
  Description of Artificial Sequence: Synthetic oligonucleotide
  Target: ATXN1; (+) strand; PAM type: NRG; PAM sequence: CAG
gtggcaggaacctgtaatcc

SEQ ID NO: 98798 - DNA, 20 bp, Artificial Sequence
  Description of Artificial Sequence: Synthetic oligonucleotide
  Target: ATXN1; (+) strand; PAM type: NRG; PAM sequence: CGG
aacctgtaatcccagctact

SEQ ID NO: 98799 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctactc

SEQ ID NO: 98800 - DNA, 20 bp, Artificial Sequence
  Description of Artificial Sequence: Synthetic oligonucleotide
  Target: ATXN1; (+) strand; PAM type: NRG; PAM sequence: GGG
cctgtaatcccagctactcg

SEQ ID NO: 98801 - DNA, 20 bp, Artificial Sequence
  Description of Artificial Sequence: Synthetic oligonucleotide
  Target: ATXN1; (+) strand; PAM type: NRG; PAM sequence: GGG
ctgtaatcccagctactcgg

SEQ ID NO: 98802 - DNA, 20 bp, Artificial Sequence
  Description of Artificial Sequence: Synthetic oligonucleotide
  Target: ATXN1; (+) strand; PAM type: NRG; PAM sequence: GGG
tgtaatcccagctactcggg

SEQ ID NO: 98803 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcggggggct

SEQ ID NO: 98804 - DNA, 20 bp, Artificial Sequence
  Description of Artificial Sequence: Synthetic oligonucleotide
  Target: ATXN1; (+) strand; PAM type: NRG; PAM sequence: AGG
cccagctactcggggggctg

SEQ ID NO: 98805 - DNA, 20 bp, Artificial Sequence
  Description of Artificial Sequence: Synthetic oligonucleotide
  Target: ATXN1; (+) strand; PAM type: NRG; PAM sequence: CAG
agctactcggggggctgagg

SEQ ID NO: 98806 - DNA, 20 bp, Artificial Sequence
  Description of Artificial Sequence: Synthetic oligonucleotide
  Target: ATXN1; (+) strand; PAM type: NRG; PAM sequence: AGG
gctactcggggggctgaggc

SEQ ID NO: 98807 - DNA, 20 bp, Artificial Sequence
  Description of Artificial Sequence: Synthetic oligonucleotide
  Target: ATXN1; (+) strand; PAM type: NRG; PAM sequence: GAG
tactcggggggctgaggcag

SEQ ID NO: 98808 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcacttgaacc

SEQ ID NO: 98809 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacttgaaccc

SEQ ID NO: 98810 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgaacccgg

SEQ ID NO: 98811 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacccggg

SEQ ID NO: 98812 - DNA, 20 bp, Artificial Sequence
  Description of Artificial Sequence: Synthetic oligonucleotide
  Target: ATXN1; (+) strand; PAM type: NRG; PAM sequence: CGG
aatcacttgaacccgggagg

SEQ ID NO: 98813 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgggaggcg

SEQ ID NO: 98814 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgggaggcgg

SEQ ID NO: 98815 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcggaggttg

SEQ ID NO: 98816 - DNA, 20 bp, Artificial Sequence
  Description of Artificial Sequence: Synthetic oligonucleotide
  Target: ATXN1; (+) strand; PAM type: NRG; PAM sequence: GAG
cgggaggcggaggttgcagt

SEQ ID NO: 98817 - DNA, 20 bp, Artificial Sequence
  Description of Artificial Sequence: Synthetic oligonucleotide
  Target: ATXN1; (+) strand; PAM type: NRG; PAM sequence: AAG
ggcggaggttgcagtgagcc

SEQ ID NO: 98818 - DNA, 20 bp, Artificial Sequence
  Description of Artificial Sequence: Synthetic oligonucleotide
  Target: ATXN1; (+) strand; PAM type: NRG; PAM sequence: CAG
gcagtgagccaagatcgttg

SEQ ID NO: 98819 - DNA, 20 bp, Artificial Sequence
  Description of Artificial Sequence: Synthetic oligonucleotide
  Target: ATXN1; (+) strand; PAM type: NRG; PAM sequence: GAG
tgagccaagatcgttgcagt

SEQ ID NO: 98820 - DNA, 20 bp, Artificial Sequence
  Description of Artificial Sequence: Synthetic oligonucleotide
  Target: ATXN1; (+) strand; PAM type: NRG; PAM sequence: AAG
caagatcgttgcagtgagcc

SEQ ID NO: 98821 - DNA, 20 bp, Artificial Sequence
  Description of Artificial Sequence: Synthetic oligonucleotide
  Target: ATXN1; (+) strand; PAM type: NRG; PAM sequence: CAG
gcagtgagccaagatcgttg

SEQ ID NO: 98822 - DNA, 20 bp, Artificial Sequence
  Description of Artificial Sequence: Synthetic oligonucleotide
  Target: ATXN1; (+) strand; PAM type: NRG; PAM sequence: GAG
tgagccaagatcgttgcagt

SEQ ID NO: 98823 - DNA, 20 bp, Artificial Sequence
  Description of Artificial Sequence: Synthetic oligonucleotide
  Target: ATXN1; (+) strand; PAM type: NRG; PAM sequence: AAG
caagatcgttgcagtgagcc

SEQ ID NO: 98824 - DNA, 20 bp, Artificial Sequence
  Description of Artificial Sequence: Synthetic oligonucleotide
  Target: ATXN1; (+) strand; PAM type: NRG; PAM sequence: TAG
aagatcattccatcacactc

SEQ ID NO: 98825 - DNA, 20 bp, Artificial Sequence
  Description of Artificial Sequence: Synthetic oligonucleotide
  Target: ATXN1; (+) strand; PAM type: NRG; PAM sequence: TGG
cattccatcacactctagac

SEQ ID NO: 98826 - DNA, 20 bp, Artificial Sequence
  Description of Artificial Sequence: Synthetic oligonucleotide
  Target: ATXN1; (+) strand; PAM type: NRG; PAM sequence: GGG
attccatcacactctagact

SEQ ID NO: 98827 - DNA, 20 bp, Artificial Sequence
  Description of Artificial Sequence: Synthetic oligonucleotide
  Target: ATXN1; (+) strand; PAM type: NRG; PAM sequence: TAG
cactctagactgggcgacaa

SEQ ID NO: 98828 - DNA, 20 bp, Artificial Sequence
  Description of Artificial Sequence: Synthetic oligonucleotide
  Target: ATXN1; (+) strand; PAM type: NRG; PAM sequence: GAG
ctctagactgggcgacaata

SEQ ID NO: 98829 - DNA, 20 bp, Artificial Sequence
  Description of Artificial Sequence: Synthetic oligonucleotide
  Target: ATXN1; (+) strand; PAM type: NRG; PAM sequence: AAG
gaaactccattaaaaaaaaa

SEQ ID NO: 98830 - DNA, 20 bp, Artificial Sequence
  Description of Artificial Sequence: Synthetic oligonucleotide
  Target: ATXN1; (+) strand; PAM type: NRG; PAM sequence: TAG
cattaaaaaaaaaaagcctc

SEQ ID NO: 98831 - DNA, 20 bp, Artificial Sequence
  Description of Artificial Sequence: Synthetic oligonucleotide
  Target: ATXN1; (+) strand; PAM type: NRG; PAM sequence: AAG
aatacatattatctccaaat

SEQ ID NO: 98832 - DNA, 20 bp, Artificial Sequence
  Description of Artificial Sequence: Synthetic oligonucleotide
  Target: ATXN1; (+) strand; PAM type: NRG; PAM sequence: TGG
tatctccaaataagcaacaa

SEQ ID NO: 98833 - DNA, 20 bp, Artificial Sequence
  Description of Artificial Sequence: Synthetic oligonucleotide
  Target: ATXN1; (+) strand; PAM type: NRG; PAM sequence: CAG
ataagcaacaatggaactca

SEQ ID NO: 98834 - DNA, 20 bp, Artificial Sequence
  Description of Artificial Sequence: Synthetic oligonucleotide
  Target: ATXN1; (+) strand; PAM type: NRG; PAM sequence: TGG
ttacatctcaacaaaaataa

SEQ ID NO: 98835 - DNA, 20 bp, Artificial Sequence
  Description of Artificial Sequence: Synthetic oligonucleotide
  Target: ATXN1; (+) strand; PAM type: NRG; PAM sequence: AAG
catctcaacaaaaataatgg

SEQ ID NO: 98836 - DNA, 20 bp, Artificial Sequence
  Description of Artificial Sequence: Synthetic oligonucleotide
  Target: ATXN1; (+) strand; PAM type: NRG; PAM sequence: CAG
tcaacaaaaataatggaagc

SEQ ID NO: 98837 - DNA, 20 bp, Artificial Sequence
  Description of Artificial Sequence: Synthetic oligonucleotide
  Target: ATXN1; (+) strand; PAM type: NRG; PAM sequence: TAG
acaaaaataatggaagccag

SEQ ID NO: 98838 - DNA, 20 bp, Artificial Sequence
  Description of Artificial Sequence: Synthetic oligonucleotide
  Target: ATXN1; (+) strand; PAM type: NRG; PAM sequence: TGG
taatggaagccagtagacaa

SEQ ID NO: 98839 - DNA, 20 bp, Artificial Sequence
  Description of Artificial Sequence: Synthetic oligonucleotide
  Target: ATXN1; (+) strand; PAM type: NRG; PAM sequence: GAG
atggaagccagtagacaatg

SEQ ID NO: 98840 - DNA, 20 bp, Artificial Sequence
  Description of Artificial Sequence: Synthetic oligonucleotide
  Target: ATXN1; (+) strand; PAM type: NRG; PAM sequence: TGG
ccagtagacaatggagacaa

SEQ ID NO: 98841 - DNA, 20 bp, Artificial Sequence
  Description of Artificial Sequence: Synthetic oligonucleotide
  Target: ATXN1; (+) strand; PAM type: NRG; PAM sequence: CAG
gagacaatggaatatcttta

SEQ ID NO: 98842 - DNA, 20 bp, Artificial Sequence
  Description of Artificial Sequence: Synthetic oligonucleotide
  Target: ATXN1; (+) strand; PAM type: NRG; PAM sequence: AAG
ggaatatctttacagtgcta

SEQ ID NO: 98843 - DNA, 20 bp, Artificial Sequence
  Description of Artificial Sequence: Synthetic oligonucleotide
  Target: ATXN1; (+) strand; PAM type: NRG; PAM sequence: AAG
tctttacagtgctaaagaaa

SEQ ID NO: 98844 - DNA, 20 bp, Artificial Sequence
  Description of Artificial Sequence: Synthetic oligonucleotide
  Target: ATXN1; (+) strand; PAM type: NRG; PAM sequence: TGG
taaagaaaaagaattgtcaa

SEQ ID NO: 98845 - DNA, 20 bp, Artificial Sequence
  Description of Artificial Sequence: Synthetic oligonucleotide
  Target: ATXN1; (+) strand; PAM type: NRG; PAM sequence: TGG
tgtcaatggcgaattctata

SEQ ID NO: 98846 - DNA, 20 bp, Artificial Sequence
  Description of Artificial Sequence: Synthetic oligonucleotide
  Target: ATXN1; (+) strand; PAM type: NRG; PAM sequence: GAG
tcaatggcgaattctatatg

SEQ ID NO: 98847 - DNA, 20 bp, Artificial Sequence
  Description of Artificial Sequence: Synthetic oligonucleotide
  Target: ATXN1; (+) strand; PAM type: NRG; PAM sequence: AAG
cgaattctatatggagcaaa

SEQ ID NO: 98848 - DNA, 20 bp, Artificial Sequence
  Description of Artificial Sequence: Synthetic oligonucleotide
  Target: ATXN1; (+) strand; PAM type: NRG; PAM sequence: CAG
atggagcaaaaagatccttc

SEQ ID NO: 98849 - DNA, 20 bp, Artificial Sequence
  Description of Artificial Sequence: Synthetic oligonucleotide
  Target: ATXN1; (+) strand; PAM type: NRG; PAM sequence: AAG
aaaaagatccttccagaatg

SEQ ID NO: 98850 - DNA, 20 bp, Artificial Sequence
  Description of Artificial Sequence: Synthetic oligonucleotide
  Target: ATXN1; (+) strand; PAM type: NRG; PAM sequence: AGG
aaaagatccttccagaatga

SEQ ID NO: 98851 - DNA, 20 bp, Artificial Sequence
  Description of Artificial Sequence: Synthetic oligonucleotide
  Target: ATXN1; (+) strand; PAM type: NRG; PAM sequence: TAG
cttccagaatgaaggcaaaa

SEQ ID NO: 98852 - DNA, 20 bp, Artificial Sequence
  Description of Artificial Sequence: Synthetic oligonucleotide
  Target: ATXN1; (+) strand; PAM type: NRG; PAM sequence: GAG
tccagaatgaaggcaaaata

SEQ ID NO: 98853 - DNA, 20 bp, Artificial Sequence
  Description of Artificial Sequence: Synthetic oligonucleotide
  Target: ATXN1; (+) strand; PAM type: NRG; PAM sequence: CAG
aggcaaaatagagacatgtt

SEQ ID NO: 98854 - DNA, 20 bp, Artificial Sequence
  Description of Artificial Sequence: Synthetic oligonucleotide
  Target: ATXN1; (+) strand; PAM type: NRG; PAM sequence: CAG
tagagacatgttcagacaaa

SEQ ID NO: 98855 - DNA, 20 bp, Artificial Sequence
  Description of Artificial Sequence: Synthetic oligonucleotide
  Target: ATXN1; (+) strand; PAM type: NRG; PAM sequence: AAG
ttcagacaaacagtaattaa

SEQ ID NO: 98856 - DNA, 20 bp, Artificial Sequence
  Description of Artificial Sequence: Synthetic oligonucleotide
  Target: ATXN1; (+) strand; PAM type: NRG; PAM sequence: CAG
ttaaaagaattcaccatcaa

SEQ ID NO: 98857 - DNA, 20 bp, Artificial Sequence
  Description of Artificial Sequence: Synthetic oligonucleotide
  Target: ATXN1; (+) strand; PAM type: NRG; PAM sequence: TAG
ccatcaacagatctgcatta

SEQ ID NO: 98858 - DNA, 20 bp, Artificial Sequence
  Description of Artificial Sequence: Synthetic oligonucleotide
  Target: ATXN1; (+) strand; PAM type: NRG; PAM sequence: AAG
tgcattatagaaaatactaa

SEQ ID NO: 98859 - DNA, 20 bp, Artificial Sequence
  Description of Artificial Sequence: Synthetic oligonucleotide
  Target: ATXN1; (+) strand; PAM type: NRG; PAM sequence: AGG
gcattatagaaaatactaaa

SEQ ID NO: 98860 - DNA, 20 bp, Artificial Sequence
  Description of Artificial Sequence: Synthetic oligonucleotide
  Target: ATXN1; (+) strand; PAM type: NRG; PAM sequence: TAG
aaatactaaaaggtattctt

SEQ ID NO: 98861 - DNA, 20 bp, Artificial Sequence
  Description of Artificial Sequence: Synthetic oligonucleotide
  Target: ATXN1; (+) strand; PAM type: NRG; PAM sequence: AGG
aatactaaaaggtattcttt

SEQ ID NO: 98862 - DNA, 20 bp, Artificial Sequence
  Description of Artificial Sequence: Synthetic oligonucleotide
  Target: ATXN1; (+) strand; PAM type: NRG; PAM sequence: TAG
actaaaaggtattctttagg

SEQ ID NO: 98863 - DNA, 20 bp, Artificial Sequence
  Description of Artificial Sequence: Synthetic oligonucleotide
  Target: ATXN1; (+) strand; PAM type: NRG; PAM sequence: GAG
taaaaggtattctttaggta

SEQ ID NO: 98864 - DNA, 20 bp, Artificial Sequence
  Description of Artificial Sequence: Synthetic oligonucleotide
  Target: ATXN1; (+) strand; PAM type: NRG; PAM sequence: TAG
aggtagagaaaaaacaaatc

SEQ ID NO: 98865 - DNA, 20 bp, Artificial Sequence
  Description of Artificial Sequence: Synthetic oligonucleotide
  Target: ATXN1; (+) strand; PAM type: NRG; PAM sequence: AAG
gaaaaaacaaatctagattg

SEQ ID NO: 98866 - DNA, 20 bp, Artificial Sequence
  Description of Artificial Sequence: Synthetic oligonucleotide
  Target: ATXN1; (+) strand; PAM type: NRG; PAM sequence: CAG
aatctagattgaagtttgta

SEQ ID NO: 98867 - DNA, 20 bp, Artificial Sequence
  Description of Artificial Sequence: Synthetic oligonucleotide
  Target: ATXN1; (+) strand; PAM type: NRG; PAM sequence: AGG
atctagattgaagtttgtac

SEQ ID NO: 98868 - DNA, 20 bp, Artificial Sequence
  Description of Artificial Sequence: Synthetic oligonucleotide
  Target: ATXN1; (+) strand; PAM type: NRG; PAM sequence: GGG
tctagattgaagtttgtaca

SEQ ID NO: 98869 - DNA, 20 bp, Artificial Sequence
  Description of Artificial Sequence: Synthetic oligonucleotide
  Target: ATXN1; (+) strand; PAM type: NRG; PAM sequence: GAG
tagattgaagtttgtacagg

SEQ ID NO: 98870 - DNA, 20 bp, Artificial Sequence
  Description of Artificial Sequence: Synthetic oligonucleotide
  Target: ATXN1; (+) strand; PAM type: NRG; PAM sequence: AGG
agattgaagtttgtacaggg

SEQ ID NO: 98871 - DNA, 20 bp, Artificial Sequence
  Description of Artificial Sequence: Synthetic oligonucleotide
  Target: ATXN1; (+) strand; PAM type: NRG; PAM sequence: AAG
agtttgtacagggaggaatg

SEQ ID NO: 98872 - DNA, 20 bp, Artificial Sequence
  Description of Artificial Sequence: Synthetic oligonucleotide
  Target: ATXN1; (+) strand; PAM type: NRG; PAM sequence: GAG
tttgtacagggaggaatgaa

SEQ ID NO: 98873 - DNA, 20 bp, Artificial Sequence
  Description of Artificial Sequence: Synthetic oligonucleotide
  Target: ATXN1; (+) strand; PAM type: NRG; PAM sequence: AGG
ttgtacagggaggaatgaag

SEQ ID NO: 98874 - DNA, 20 bp, Artificial Sequence
  Description of Artificial Sequence: Synthetic oligonucleotide
  Target: ATXN1; (+) strand; PAM type: NRG; PAM sequence: TGG
ggaatgaagaggaatgaaaa

SEQ ID NO: 98875 - DNA, 20 bp, Artificial Sequence
  Description of Artificial Sequence: Synthetic oligonucleotide
  Target: ATXN1; (+) strand; PAM type: NRG; PAM sequence: TAG
atgaagaggaatgaaaatgg

SEQ ID NO: 98876 - DNA, 20 bp, Artificial Sequence
  Description of Artificial Sequence: Synthetic oligonucleotide
  Target: ATXN1; (+) strand; PAM type: NRG; PAM sequence: TGG
gaatgaaaatggtagataca

SEQ ID NO: 98877 - DNA, 20 bp, Artificial Sequence
  Description of Artificial Sequence: Synthetic oligonucleotide
  Target: ATXN1; (+) strand; PAM type: NRG; PAM sequence: TGG
tggtgaatctgaatgaatat

SEQ ID NO: 98878 - DNA, 20 bp, Artificial Sequence
  Description of Artificial Sequence: Synthetic oligonucleotide
  Target: ATXN1; (+) strand; PAM type: NRG; PAM sequence: TGG
aacaatatttaaaatattgt

SEQ ID NO: 98879 - DNA, 20 bp, Artificial Sequence
  Description of Artificial Sequence: Synthetic oligonucleotide
  Target: ATXN1; (+) strand; PAM type: NRG; PAM sequence: GAG
gattctttttttctttttgt

SEQ ID NO: 98880 - DNA, 20 bp, Artificial Sequence
  Description of Artificial Sequence: Synthetic oligonucleotide
  Target: ATXN1; (+) strand; PAM type: NRG; PAM sequence: GAG
ttctttttttctttttgtga

SEQ ID NO: 98881 - DNA, 20 bp, Artificial Sequence
  Description of Artificial Sequence: Synthetic oligonucleotide
  Target: ATXN1; (+) strand; PAM type: NRG; PAM sequence: AGG
tctttttttctttttgtgag

SEQ ID NO: 98882 - DNA, 20 bp, Artificial Sequence
  Description of Artificial Sequence: Synthetic oligonucleotide
  Target: ATXN1; (+) strand; PAM type: NRG; PAM sequence: GGG
ctttttttctttttgtgaga

SEQ ID NO: 98883 - DNA, 20 bp, Artificial Sequence
  Description of Artificial Sequence: Synthetic oligonucleotide
  Target: ATXN1; (+) strand; PAM type: NRG; PAM sequence: GAG
ttttttctttttgtgagagg

SEQ ID NO: 98884 - DNA, 20 bp, Artificial Sequence
  Description of Artificial Sequence: Synthetic oligonucleotide
  Target: ATXN1; (+) strand; PAM type: NRG; PAM sequence: CAG
gggagtcttgctctgtcgcc

SEQ ID NO: 98885 - DNA, 20 bp, Artificial Sequence
  Description of Artificial Sequence: Synthetic oligonucleotide
  Target: ATXN1; (+) strand; PAM type: NRG; PAM sequence: AGG
ggagtcttgctctgtcgccc

SEQ ID NO: 98886 - DNA, 20 bp, Artificial Sequence
  Description of Artificial Sequence: Synthetic oligonucleotide
  Target: ATXN1; (+) strand; PAM type: NRG; PAM sequence: TGG
tcttgctctgtcgcccaggc

SEQ ID NO: 98887 - DNA, 20 bp, Artificial Sequence
  Description of Artificial Sequence: Synthetic oligonucleotide
  Target: ATXN1; (+) strand; PAM type: NRG; PAM sequence: GAG
ttgctctgtcgcccaggctg

SEQ ID NO: 98888 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 98889 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcag

SEQ ID NO: 98890 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggcgcgatct

SEQ ID NO: 98891 - DNA, 20 bp, Artificial Sequence
  Description of Artificial Sequence: Synthetic oligonucleotide
  Target: ATXN1; (+) strand; PAM type: NRG; PAM sequence: CGG
tcactgcaatctccgcctcc

SEQ ID NO: 98892 - DNA, 20 bp, Artificial Sequence
  Description of Artificial Sequence: Synthetic oligonucleotide
  Target: ATXN1; (+) strand; PAM type: NRG; PAM sequence: GGG
cactgcaatctccgcctccc

SEQ ID NO: 98893 - DNA, 20 bp, Artificial Sequence
  Description of Artificial Sequence: Synthetic oligonucleotide
  Target: ATXN1; (+) strand; PAM type: NRG; PAM sequence: AAG
aatctccgcctcccgggttc

SEQ ID NO: 98894 - DNA, 20 bp, Artificial Sequence
  Description of Artificial Sequence: Synthetic oligonucleotide
  Target: ATXN1; (+) strand; PAM type: NRG; PAM sequence: GAG
tccgcctcccgggttcaagc

SEQ ID NO: 98895 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgagtctcctgcct

SEQ ID NO: 98896 - DNA, 20 bp, Artificial Sequence
  Description of Artificial Sequence: Synthetic oligonucleotide
  Target: ATXN1; (+) strand; PAM type: NRG; PAM sequence: AAG
gtctcctgcctcagactccc

SEQ ID NO: 98897 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagactcccaag

SEQ ID NO: 98898 - DNA, 20 bp, Artificial Sequence
  Description of Artificial Sequence: Synthetic oligonucleotide
  Target: ATXN1; (+) strand; PAM type: NRG; PAM sequence: TGG
gcctcagactcccaagtagc

SEQ ID NO: 98899 - DNA, 20 bp, Artificial Sequence
  Description of Artificial Sequence: Synthetic oligonucleotide
  Target: ATXN1; (+) strand; PAM type: NRG; PAM sequence: GGG
cctcagactcccaagtagct

SEQ ID NO: 98900 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggacta

SEQ ID NO: 98901 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggactac

SEQ ID NO: 98902 - DNA, 20 bp, Artificial Sequence
  Description of Artificial Sequence: Synthetic oligonucleotide
  Target: ATXN1; (+) strand; PAM type: NRG; PAM sequence: CAG
tgcaccaccaccaccacgcc

SEQ ID NO: 98903 - DNA, 20 bp, Artificial Sequence
  Description of Artificial Sequence: Synthetic oligonucleotide
  Target: ATXN1; (+) strand; PAM type: NRG; PAM sequence: TAG
ccagctactttttgtatttt

SEQ ID NO: 98904 - DNA, 20 bp, Artificial Sequence
  Description of Artificial Sequence: Synthetic oligonucleotide
  Target: ATXN1; (+) strand; PAM type: NRG; PAM sequence: TAG
gctactttttgtatttttag

SEQ ID NO: 98905 - DNA, 20 bp, Artificial Sequence
  Description of Artificial Sequence: Synthetic oligonucleotide
  Target: ATXN1; (+) strand; PAM type: NRG; PAM sequence: GAG
tactttttgtatttttagta

SEQ ID NO: 98906 - DNA, 20 bp, Artificial Sequence
  Description of Artificial Sequence: Synthetic oligonucleotide
  Target: ATXN1; (+) strand; PAM type: NRG; PAM sequence: TGG
tttttgtatttttagtagag

SEQ ID NO: 98907 - DNA, 20 bp, Artificial Sequence
  Description of Artificial Sequence: Synthetic oligonucleotide
  Target: ATXN1; (+) strand; PAM type: NRG; PAM sequence: GGG
ttttgtatttttagtagagt

SEQ ID NO: 98908 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagtg

SEQ ID NO: 98909 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagtgg

SEQ ID NO: 98910 - DNA, 20 bp, Artificial Sequence
  Description of Artificial Sequence: Synthetic oligonucleotide
  Target: ATXN1; (+) strand; PAM type: NRG; PAM sequence: TGG
gagtgggggcttcaccatgt

SEQ ID NO: 98911 - DNA, 20 bp, Artificial Sequence
  Description of Artificial Sequence: Synthetic oligonucleotide
  Target: ATXN1; (+) strand; PAM type: NRG; PAM sequence: CAG
gggggcttcaccatgttggc

SEQ ID NO: 98912 - DNA, 20 bp, Artificial Sequence
  Description of Artificial Sequence: Synthetic oligonucleotide
  Target: ATXN1; (+) strand; PAM type: NRG; PAM sequence: AGG
ggggcttcaccatgttggcc

SEQ ID NO: 98913 - DNA, 20 bp, Artificial Sequence
  Description of Artificial Sequence: Synthetic oligonucleotide
  Target: ATXN1; (+) strand; PAM type: NRG; PAM sequence: TGG
cttcaccatgttggccagga

SEQ ID NO: 98914 - DNA, 20 bp, Artificial Sequence
  Description of Artificial Sequence: Synthetic oligonucleotide
  Target: ATXN1; (+) strand; PAM type: NRG; PAM sequence: CAG
acctcatgatccacccgcct

SEQ ID NO: 98915 - DNA, 20 bp, Artificial Sequence
  Description of Artificial Sequence: Synthetic oligonucleotide
  Target: ATXN1; (+) strand; PAM type: NRG; PAM sequence: AAG
ccacccgcctcagtctccca

SEQ ID NO: 98916 - DNA, 20 bp, Artificial Sequence
  Description of Artificial Sequence: Synthetic oligonucleotide
  Target: ATXN1; (+) strand; PAM type: NRG; PAM sequence: TGG
gcctcagtctcccaaagtgc

SEQ ID NO: 98917 - DNA, 20 bp, Artificial Sequence
  Description of Artificial Sequence: Synthetic oligonucleotide
  Target: ATXN1; (+) strand; PAM type: NRG; PAM sequence: GGG
cctcagtctcccaaagtgct

SEQ ID NO: 98918 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 98919 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 98920 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 98921 - DNA, 20 bp, Artificial Sequence
  Description of Artificial Sequence: Synthetic oligonucleotide
  Target: ATXN1; (+) strand; PAM type: NRG; PAM sequence: CAG
acaggcgtgagccaccgtgt

SEQ ID NO: 98922 - DNA, 20 bp, Artificial Sequence
  Description of Artificial Sequence: Synthetic oligonucleotide
  Target: ATXN1; (+) strand; PAM type: NRG; PAM sequence: AGG
caggcgtgagccaccgtgtc

SEQ ID NO: 98923 - DNA, 20 bp, Artificial Sequence
  Description of Artificial Sequence: Synthetic oligonucleotide
  Target: ATXN1; (+) strand; PAM type: NRG; PAM sequence: TGG
ccaccgtgtcaggcctccat

SEQ ID NO: 98924 - DNA, 20 bp, Artificial Sequence
  Description of Artificial Sequence: Synthetic oligonucleotide
  Target: ATXN1; (+) strand; PAM type: NRG; PAM sequence: CAG
cattggattttatacacatt

SEQ ID NO: 98925 - DNA, 20 bp, Artificial Sequence
  Description of Artificial Sequence: Synthetic oligonucleotide
  Target: ATXN1; (+) strand; PAM type: NRG; PAM sequence: AAG
aaaacacacatgcataattg

SEQ ID NO: 98926 - DNA, 20 bp, Artificial Sequence
  Description of Artificial Sequence: Synthetic oligonucleotide
  Target: ATXN1; (+) strand; PAM type: NRG; PAM sequence: AAG
aagtaccaaaaaaactttaa

SEQ ID NO: 98927 - DNA, 20 bp, Artificial Sequence
  Description of Artificial Sequence: Synthetic oligonucleotide
  Target: ATXN1; (+) strand; PAM type: NRG; PAM sequence: TAG
taccaaaaaaactttaaaag

SEQ ID NO: 98928 - DNA, 20 bp, Artificial Sequence
  Description of Artificial Sequence: Synthetic oligonucleotide
  Target: ATXN1; (+) strand; PAM type: NRG; PAM sequence: TAG
caaaaaaactttaaaagtag

SEQ ID NO: 98929 - DNA, 20 bp, Artificial Sequence
  Description of Artificial Sequence: Synthetic oligonucleotide
  Target: ATXN1; (+) strand; PAM type: NRG; PAM sequence: CAG
ttaaaagtagtagatttcca

SEQ ID NO: 98930 - DNA, 20 bp, Artificial Sequence
  Description of Artificial Sequence: Synthetic oligonucleotide
  Target: ATXN1; (+) strand; PAM type: NRG; PAM sequence: TAG
tttgttaactctgattgatc

SEQ ID NO: 98931 - DNA, 20 bp, Artificial Sequence
  Description of Artificial Sequence: Synthetic oligonucleotide
  Target: ATXN1; (+) strand; PAM type: NRG; PAM sequence: TAG
atctagttctgatacatttc

SEQ ID NO: 98932 - DNA, 20 bp, Artificial Sequence
  Description of Artificial Sequence: Synthetic oligonucleotide
  Target: ATXN1; (+) strand; PAM type: NRG; PAM sequence: CAG
ctgatacatttctagaatga

SEQ ID NO: 98933 - DNA, 20 bp, Artificial Sequence
  Description of Artificial Sequence: Synthetic oligonucleotide
  Target: ATXN1; (+) strand; PAM type: NRG; PAM sequence: TGG
tctagaatgacagactttac

SEQ ID NO: 98934 - DNA, 20 bp, Artificial Sequence
  Description of Artificial Sequence: Synthetic oligonucleotide
  Target: ATXN1; (+) strand; PAM type: NRG; PAM sequence: AAG
agactttactggatccatac

SEQ ID NO: 98935 - DNA, 20 bp, Artificial Sequence
  Description of Artificial Sequence: Synthetic oligonucleotide
  Target: ATXN1; (+) strand; PAM type: NRG; PAM sequence: AGG
gactttactggatccataca

SEQ ID NO: 98936 - DNA, 20 bp, Artificial Sequence
  Description of Artificial Sequence: Synthetic oligonucleotide
  Target: ATXN1; (+) strand; PAM type: NRG; PAM sequence: TAG
atccatacaaggcatatttt

SEQ ID NO: 98937 - DNA, 20 bp, Artificial Sequence
  Description of Artificial Sequence: Synthetic oligonucleotide
  Target: ATXN1; (+) strand; PAM type: NRG; PAM sequence: AAG
catacaaggcatatttttag

SEQ ID NO: 98938 - DNA, 20 bp, Artificial Sequence
  Description of Artificial Sequence: Synthetic oligonucleotide
  Target: ATXN1; (+) strand; PAM type: NRG; PAM sequence: GAG
tacaaggcatatttttagaa

SEQ ID NO: 98939 - DNA, 20 bp, Artificial Sequence
  Description of Artificial Sequence: Synthetic oligonucleotide
  Target: ATXN1; (+) strand; PAM type: NRG; PAM sequence: GAG
atttttagaagagacaactt

SEQ ID NO: 98940 - DNA, 20 bp, Artificial Sequence
  Description of Artificial Sequence: Synthetic oligonucleotide
  Target: ATXN1; (+) strand; PAM type: NRG; PAM sequence: TGG
acaacttgagtacattcata

SEQ ID NO: 98941 - DNA, 20 bp, Artificial Sequence
  Description of Artificial Sequence: Synthetic oligonucleotide
  Target: ATXN1; (+) strand; PAM type: NRG; PAM sequence: CAG
acttgagtacattcatatgg

SEQ ID NO: 98942 - DNA, 20 bp, Artificial Sequence
  Description of Artificial Sequence: Synthetic oligonucleotide
  Target: ATXN1; (+) strand; PAM type: NRG; PAM sequence: AAG
acattcatatggcagcttgt

SEQ ID NO: 98943 - DNA, 20 bp, Artificial Sequence
  Description of Artificial Sequence: Synthetic oligonucleotide
  Target: ATXN1; (+) strand; PAM type: NRG; PAM sequence: TGG
ccttctcctgtgtgtattac

SEQ ID NO: 98944 - DNA, 20 bp, Artificial Sequence
  Description of Artificial Sequence: Synthetic oligonucleotide
  Target: ATXN1; (+) strand; PAM type: NRG; PAM sequence: GGG
cttctcctgtgtgtattact

SEQ ID NO: 98945 - DNA, 20 bp, Artificial Sequence
  Description of Artificial Sequence: Synthetic oligonucleotide
  Target: ATXN1; (+) strand; PAM type: NRG; PAM sequence: GGG
ttctcctgtgtgtattactg

SEQ ID NO: 98946 - DNA, 20 bp, Artificial Sequence
  Description of Artificial Sequence: Synthetic oligonucleotide
  Target: ATXN1; (+) strand; PAM type: NRG; PAM sequence: GGG
tctcctgtgtgtattactgg

SEQ ID NO: 98947 - DNA, 20 bp, Artificial Sequence
  Description of Artificial Sequence: Synthetic oligonucleotide
  Target: ATXN1; (+) strand; PAM type: NRG; PAM sequence: AAG
ctgtgtgtattactggggga

SEQ ID NO: 98948 - DNA, 20 bp, Artificial Sequence
  Description of Artificial Sequence: Synthetic oligonucleotide
  Target: ATXN1; (+) strand; PAM type: NRG; PAM sequence: TGG
gggggaaagtttcattgttc

SEQ ID NO: 98949 - DNA, 20 bp, Artificial Sequence
  Description of Artificial Sequence: Synthetic oligonucleotide
  Target: ATXN1; (+) strand; PAM type: NRG; PAM sequence: GGG
ggggaaagtttcattgttct

SEQ ID NO: 98950 - DNA, 20 bp, Artificial Sequence
  Description of Artificial Sequence: Synthetic oligonucleotide
  Target: ATXN1; (+) strand; PAM type: NRG; PAM sequence: AAG
tgggctatttttataatgtg

SEQ ID NO: 98951 - DNA, 20 bp, Artificial Sequence
  Description of Artificial Sequence: Synthetic oligonucleotide
  Target: ATXN1; (+) strand; PAM type: NRG; PAM sequence: AAG
ctatttttataatgtgaagc

SEQ ID NO: 98952 - DNA, 20 bp, Artificial Sequence
  Description of Artificial Sequence: Synthetic oligonucleotide
  Target: ATXN1; (+) strand; PAM type: NRG; PAM sequence: AAG
tataatgtgaagcaagctaa

SEQ ID NO: 98953 - DNA, 20 bp, Artificial Sequence
  Description of Artificial Sequence: Synthetic oligonucleotide
  Target: ATXN1; (+) strand; PAM type: NRG; PAM sequence: GAG
gaagcaagctaaaagttttt

SEQ ID NO: 98954 - DNA, 20 bp, Artificial Sequence
  Description of Artificial Sequence: Synthetic oligonucleotide
  Target: ATXN1; (+) strand; PAM type: NRG; PAM sequence: AAG
ttgagtgcctactctctgtc

SEQ ID NO: 98955 - DNA, 20 bp, Artificial Sequence
  Description of Artificial Sequence: Synthetic oligonucleotide
  Target: ATXN1; (+) strand; PAM type: NRG; PAM sequence: CAG
cctactctctgtcaagctct

SEQ ID NO: 98956 - DNA, 20 bp, Artificial Sequence
  Description of Artificial Sequence: Synthetic oligonucleotide
  Target: ATXN1; (+) strand; PAM type: NRG; PAM sequence: AGG
ctactctctgtcaagctctc

SEQ ID NO: 98957 - DNA, 20 bp, Artificial Sequence
  Description of Artificial Sequence: Synthetic oligonucleotide
  Target: ATXN1; (+) strand; PAM type: NRG; PAM sequence: AAG
tcaggtacaaactttacaaa

SEQ ID NO: 98958 - DNA, 20 bp, Artificial Sequence
  Description of Artificial Sequence: Synthetic oligonucleotide
  Target: ATXN1; (+) strand; PAM type: NRG; PAM sequence: TAG
attttgtttaatgttcataa

SEQ ID NO: 98959 - DNA, 20 bp, Artificial Sequence
  Description of Artificial Sequence: Synthetic oligonucleotide
  Target: ATXN1; (+) strand; PAM type: NRG; PAM sequence: TAG
tttaatgttcataatagtat

SEQ ID NO: 98960 - DNA, 20 bp, Artificial Sequence
  Description of Artificial Sequence: Synthetic oligonucleotide
  Target: ATXN1; (+) strand; PAM type: NRG; PAM sequence: TGG
tgttcataatagtattagta

SEQ ID NO: 98961 - DNA, 20 bp, Artificial Sequence
  Description of Artificial Sequence: Synthetic oligonucleotide
  Target: ATXN1; (+) strand; PAM type: NRG; PAM sequence: TAG
ataatagtattagtatggaa

SEQ ID NO: 98962 - DNA, 20 bp, Artificial Sequence
  Description of Artificial Sequence: Synthetic oligonucleotide
  Target: ATXN1; (+) strand; PAM type: NRG; PAM sequence: TAG
aattttgtaaattttacgaa

SEQ ID NO: 98963 - DNA, 20 bp, Artificial Sequence
  Description of Artificial Sequence: Synthetic oligonucleotide
  Target: ATXN1; (+) strand; PAM type: NRG; PAM sequence: CAG
gtaaattttacgaatagtca

SEQ ID NO: 98964 - DNA, 20 bp, Artificial Sequence
  Description of Artificial Sequence: Synthetic oligonucleotide
  Target: ATXN1; (+) strand; PAM type: NRG; PAM sequence: GAG
aaattttacgaatagtcaca

SEQ ID NO: 98965 - DNA, 20 bp, Artificial Sequence
  Description of Artificial Sequence: Synthetic oligonucleotide
  Target: ATXN1; (+) strand; PAM type: NRG; PAM sequence: GAG
attttacgaatagtcacaga

SEQ ID NO: 98966 - DNA, 20 bp, Artificial Sequence
  Description of Artificial Sequence: Synthetic oligonucleotide
  Target: ATXN1; (+) strand; PAM type: NRG; PAM sequence: AAG
cgaatagtcacagagagatt

SEQ ID NO: 98967 - DNA, 20 bp, Artificial Sequence
  Description of Artificial Sequence: Synthetic oligonucleotide
  Target: ATXN1; (+) strand; PAM type: NRG; PAM sequence: TAG
aagtcacttgcctaatgtca

SEQ ID NO: 98968 - DNA, 20 bp, Artificial Sequence
  Description of Artificial Sequence: Synthetic oligonucleotide
  Target: ATXN1; (+) strand; PAM type: NRG; PAM sequence: TAG
ttgcctaatgtcatagctat

SEQ ID NO: 98969 - DNA, 20 bp, Artificial Sequence
  Description of Artificial Sequence: Synthetic oligonucleotide
  Target: ATXN1; (+) strand; PAM type: NRG; PAM sequence: TGG
atgtcatagctattagctaa

SEQ ID NO: 98970 - DNA, 20 bp, Artificial Sequence
  Description of Artificial Sequence: Synthetic oligonucleotide
  Target: ATXN1; (+) strand; PAM type: NRG; PAM sequence: GGG
tgtcatagctattagctaat

SEQ ID NO: 98971 - DNA, 20 bp, Artificial Sequence
  Description of Artificial Sequence: Synthetic oligonucleotide
  Target: ATXN1; (+) strand; PAM type: NRG; PAM sequence: TAG
tagctattagctaatgggtt

SEQ ID NO: 98972 - DNA, 20 bp, Artificial Sequence
  Description of Artificial Sequence: Synthetic oligonucleotide
  Target: ATXN1; (+) strand; PAM type: NRG; PAM sequence: AGG
agctattagctaatgggttt

SEQ ID NO: 98973 - DNA, 20 bp, Artificial Sequence
  Description of Artificial Sequence: Synthetic oligonucleotide
  Target: ATXN1; (+) strand; PAM type: NRG; PAM sequence: CAG
atgggtttaggattttatcc

SEQ ID NO: 98974 - DNA, 20 bp, Artificial Sequence
  Description of Artificial Sequence: Synthetic oligonucleotide
  Target: ATXN1; (+) strand; PAM type: NRG; PAM sequence: TGG
taggattttatcccagtcat

SEQ ID NO: 98975 - DNA, 20 bp, Artificial Sequence
  Description of Artificial Sequence: Synthetic oligonucleotide
  Target: ATXN1; (+) strand; PAM type: NRG; PAM sequence: GAG
ctcctgacctctacccttgt

SEQ ID NO: 98976 - DNA, 20 bp, Artificial Sequence
  Description of Artificial Sequence: Synthetic oligonucleotide
  Target: ATXN1; (+) strand; PAM type: NRG; PAM sequence: AAG
gacctctacccttgtgagca

SEQ ID NO: 98977 - DNA, 20 bp, Artificial Sequence
  Description of Artificial Sequence: Synthetic oligonucleotide
  Target: ATXN1; (+) strand; PAM type: NRG; PAM sequence: AAG
agacattacaatgccaccaa

SEQ ID NO: 98978 - DNA, 20 bp, Artificial Sequence
  Description of Artificial Sequence: Synthetic oligonucleotide
  Target: ATXN1; (+) strand; PAM type: NRG; PAM sequence: GAG
acattacaatgccaccaaaa

SEQ ID NO: 98979 - DNA, 20 bp, Artificial Sequence
  Description of Artificial Sequence: Synthetic oligonucleotide
  Target: ATXN1; (+) strand; PAM type: NRG; PAM sequence: AAG
gccaccaaaagagatgaact

SEQ ID NO: 98980 - DNA, 20 bp, Artificial Sequence
  Description of Artificial Sequence: Synthetic oligonucleotide
  Target: ATXN1; (+) strand; PAM type: NRG; PAM sequence: CAG
gcattcctgctaccccccaa

SEQ ID NO: 98981 - DNA, 20 bp, Artificial Sequence
  Description of Artificial Sequence: Synthetic oligonucleotide
  Target: ATXN1; (+) strand; PAM type: NRG; PAM sequence: TGG
ttcctgctaccccccaacag

SEQ ID NO: 98982 - DNA, 20 bp, Artificial Sequence
  Description of Artificial Sequence: Synthetic oligonucleotide
  Target: ATXN1; (+) strand; PAM type: NRG; PAM sequence: AAG
tggtgaatattgactgaaat

SEQ ID NO: 98983 - DNA, 20 bp, Artificial Sequence
  Description of Artificial Sequence: Synthetic oligonucleotide
  Target: ATXN1; (+) strand; PAM type: NRG; PAM sequence: TAG
tgaatattgactgaaataag

SEQ ID NO: 98984 - DNA, 20 bp, Artificial Sequence
  Description of Artificial Sequence: Synthetic oligonucleotide
  Target: ATXN1; (+) strand; PAM type: NRG; PAM sequence: AGG
gaatattgactgaaataagt

SEQ ID NO: 98985 - DNA, 20 bp, Artificial Sequence
  Description of Artificial Sequence: Synthetic oligonucleotide
  Target: ATXN1; (+) strand; PAM type: NRG; PAM sequence: AAG
actgaaataagtaggatcca

SEQ ID NO: 98986 - DNA, 20 bp, Artificial Sequence
  Description of Artificial Sequence: Synthetic oligonucleotide
  Target: ATXN1; (+) strand; PAM type: NRG; PAM sequence: AGG
ctgaaataagtaggatccaa

SEQ ID NO: 98987 - DNA, 20 bp, Artificial Sequence
  Description of Artificial Sequence: Synthetic oligonucleotide
  Target: ATXN1; (+) strand; PAM type: NRG; PAM sequence: GAG
taagtaggatccaaaggcat

SEQ ID NO: 98988 - DNA, 20 bp, Artificial Sequence
  Description of Artificial Sequence: Synthetic oligonucleotide
  Target: ATXN1; (+) strand; PAM type: NRG; PAM sequence: TGG
gatccaaaggcatgagctca

SEQ ID NO: 98989 - DNA, 20 bp, Artificial Sequence
  Description of Artificial Sequence: Synthetic oligonucleotide
  Target: ATXN1; (+) strand; PAM type: NRG; PAM sequence: GGG
atccaaaggcatgagctcat

SEQ ID NO: 98990 - DNA, 20 bp, Artificial Sequence
  Description of Artificial Sequence: Synthetic oligonucleotide
  Target: ATXN1; (+) strand; PAM type: NRG; PAM sequence: TGG
gagctcatgggcttgttcca

SEQ ID NO: 98991 - DNA, 20 bp, Artificial Sequence
  Description of Artificial Sequence: Synthetic oligonucleotide
  Target: ATXN1; (+) strand; PAM type: NRG; PAM sequence: CAG
catgggcttgttccatggta

SEQ ID NO: 98992 - DNA, 20 bp, Artificial Sequence
  Description of Artificial Sequence: Synthetic oligonucleotide
  Target: ATXN1; (+) strand; PAM type: NRG; PAM sequence: CAG
tggtacagataattgtgatg

SEQ ID NO: 98993 - DNA, 20 bp, Artificial Sequence
  Description of Artificial Sequence: Synthetic oligonucleotide
  Target: ATXN1; (+) strand; PAM type: NRG; PAM sequence: TAG
gtgatgcagtgtttgcctta

SEQ ID NO: 98994 - DNA, 20 bp, Artificial Sequence
  Description of Artificial Sequence: Synthetic oligonucleotide
  Target: ATXN1; (+) strand; PAM type: NRG; PAM sequence: TAG
tatagccactcatacaattc

SEQ ID NO: 98995 - DNA, 20 bp, Artificial Sequence
  Description of Artificial Sequence: Synthetic oligonucleotide
  Target: ATXN1; (+) strand; PAM type: NRG; PAM sequence: AAG
caattctagttaccctgtac

SEQ ID NO: 98996 - DNA, 20 bp, Artificial Sequence
  Description of Artificial Sequence: Synthetic oligonucleotide
  Target: ATXN1; (+) strand; PAM type: NRG; PAM sequence: TGG
tacaagtgtgtgacactatt

SEQ ID NO: 98997 - DNA, 20 bp, Artificial Sequence
  Description of Artificial Sequence: Synthetic oligonucleotide
  Target: ATXN1; (+) strand; PAM type: NRG; PAM sequence: CAG
aactacatttacatcacaca

SEQ ID NO: 98998 - DNA, 20 bp, Artificial Sequence
  Description of Artificial Sequence: Synthetic oligonucleotide
  Target: ATXN1; (+) strand; PAM type: NRG; PAM sequence: TAG
catatatgtgcatatataca

SEQ ID NO: 98999 - DNA, 20 bp, Artificial Sequence
  Description of Artificial Sequence: Synthetic oligonucleotide
  Target: ATXN1; (+) strand; PAM type: NRG; PAM sequence: AAG
acatagacaaatatacttac

SEQ ID NO: 99000 - DNA, 20 bp, Artificial Sequence
  Description of Artificial Sequence: Synthetic oligonucleotide
  Target: ATXN1; (+) strand; PAM type: NRG; PAM sequence: CAG
atacttacaagtgactgtat

SEQ ID NO: 99001 - DNA, 20 bp, Artificial Sequence
  Description of Artificial Sequence: Synthetic oligonucleotide
  Target: ATXN1; (+) strand; PAM type: NRG; PAM sequence: TGG
ttacaagtgactgtatcaga

SEQ ID NO: 99002 - DNA, 20 bp, Artificial Sequence
  Description of Artificial Sequence: Synthetic oligonucleotide
  Target: ATXN1; (+) strand; PAM type: NRG; PAM sequence: GGG
tacaagtgactgtatcagat

SEQ ID NO: 99003 - DNA, 20 bp, Artificial Sequence
  Description of Artificial Sequence: Synthetic oligonucleotide
  Target: ATXN1; (+) strand; PAM type: NRG; PAM sequence: GGG
acaagtgactgtatcagatg

SEQ ID NO: 99004 - DNA, 20 bp, Artificial Sequence
  Description of Artificial Sequence: Synthetic oligonucleotide
  Target: ATXN1; (+) strand; PAM type: NRG; PAM sequence: AAG
ggggatacccactgtattct

SEQ ID NO: 99005 - DNA, 20 bp, Artificial Sequence
  Description of Artificial Sequence: Synthetic oligonucleotide
  Target: ATXN1; (+) strand; PAM type: NRG; PAM sequence: TAG
gatacccactgtattctaag

SEQ ID NO: 99006 - DNA, 20 bp, Artificial Sequence
  Description of Artificial Sequence: Synthetic oligonucleotide
  Target: ATXN1; (+) strand; PAM type: NRG; PAM sequence: AGG
atacccactgtattctaagt

SEQ ID NO: 99007 - DNA, 20 bp, Artificial Sequence
  Description of Artificial Sequence: Synthetic oligonucleotide
  Target: ATXN1; (+) strand; PAM type: NRG; PAM sequence: GAG
acccactgtattctaagtag

SEQ ID NO: 99008 - DNA, 20 bp, Artificial Sequence
  Description of Artificial Sequence: Synthetic oligonucleotide
  Target: ATXN1; (+) strand; PAM type: NRG; PAM sequence: AGG
cccactgtattctaagtagg

SEQ ID NO: 99009 - DNA, 20 bp, Artificial Sequence
  Description of Artificial Sequence: Synthetic oligonucleotide
  Target: ATXN1; (+) strand; PAM type: NRG; PAM sequence: TGG
tctaagtaggaggaccaatc

SEQ ID NO: 99010 - DNA, 20 bp, Artificial Sequence
  Description of Artificial Sequence: Synthetic oligonucleotide
  Target: ATXN1; (+) strand; PAM type: NRG; PAM sequence: TGG
taggaggaccaatctggaac

SEQ ID NO: 99011 - DNA, 20 bp, Artificial Sequence
  Description of Artificial Sequence: Synthetic oligonucleotide
  Target: ATXN1; (+) strand; PAM type: NRG; PAM sequence: TAG
ccaatctggaactggctcca

SEQ ID NO: 99012 - DNA, 20 bp, Artificial Sequence
  Description of Artificial Sequence: Synthetic oligonucleotide
  Target: ATXN1; (+) strand; PAM type: NRG; PAM sequence: TAG
agatcctcttgcaaacctct

SEQ ID NO: 99013 - DNA, 20 bp, Artificial Sequence
  Description of Artificial Sequence: Synthetic oligonucleotide
  Target: ATXN1; (+) strand; PAM type: NRG; PAM sequence: GAG
atcctcttgcaaacctctta

SEQ ID NO: 99014 - DNA, 20 bp, Artificial Sequence
  Description of Artificial Sequence: Synthetic oligonucleotide
  Target: ATXN1; (+) strand; PAM type: NRG; PAM sequence: CAG
cattaacaacataaactgaa

SEQ ID NO: 99015 - DNA, 20 bp, Artificial Sequence
  Description of Artificial Sequence: Synthetic oligonucleotide
  Target: ATXN1; (+) strand; PAM type: NRG; PAM sequence: AAG
taacaacataaactgaacag

SEQ ID NO: 99016 - DNA, 20 bp, Artificial Sequence
  Description of Artificial Sequence: Synthetic oligonucleotide
  Target: ATXN1; (+) strand; PAM type: NRG; PAM sequence: AGG
aacaacataaactgaacaga

SEQ ID NO: 99017 - DNA, 20 bp, Artificial Sequence
  Description of Artificial Sequence: Synthetic oligonucleotide
  Target: ATXN1; (+) strand; PAM type: NRG; PAM sequence: AAG
aaggaaaccaatcccacatc

SEQ ID NO: 99018 - DNA, 20 bp, Artificial Sequence
  Description of Artificial Sequence: Synthetic oligonucleotide
  Target: ATXN1; (+) strand; PAM type: NRG; PAM sequence: TGG
gaaaccaatcccacatcaag

SEQ ID NO: 99019 - DNA, 20 bp, Artificial Sequence
  Description of Artificial Sequence: Synthetic oligonucleotide
  Target: ATXN1; (+) strand; PAM type: NRG; PAM sequence: GAG
aaccaatcccacatcaagtg

SEQ ID NO: 99020 - DNA, 20 bp, Artificial Sequence
  Description of Artificial Sequence: Synthetic oligonucleotide
  Target: ATXN1; (+) strand; PAM type: NRG; PAM sequence: AAG
gattgttttgctgcaaatcc

SEQ ID NO: 99021 - DNA, 20 bp, Artificial Sequence
  Description of Artificial Sequence: Synthetic oligonucleotide
  Target: ATXN1; (+) strand; PAM type: NRG; PAM sequence: CAG
agtcataaaaataaaactct

SEQ ID NO: 99022 - DNA, 20 bp, Artificial Sequence
  Description of Artificial Sequence: Synthetic oligonucleotide
  Target: ATXN1; (+) strand; PAM type: NRG; PAM sequence: AGG
gtcataaaaataaaactctc

SEQ ID NO: 99023 - DNA, 20 bp, Artificial Sequence
  Description of Artificial Sequence: Synthetic oligonucleotide
  Target: ATXN1; (+) strand; PAM type: NRG; PAM sequence: AAG
ggtgttaacatctgtctcgt

SEQ ID NO: 99024 - DNA, 20 bp, Artificial Sequence
  Description of Artificial Sequence: Synthetic oligonucleotide
  Target: ATXN1; (+) strand; PAM type: NRG; PAM sequence: CAG
tgtctcgtaagactctctac

SEQ ID NO: 99025 - DNA, 20 bp, Artificial Sequence
  Description of Artificial Sequence: Synthetic oligonucleotide
  Target: ATXN1; (+) strand; PAM type: NRG; PAM sequence: GAG
tctcgtaagactctctacca

SEQ ID NO: 99026 - DNA, 20 bp, Artificial Sequence
  Description of Artificial Sequence: Synthetic oligonucleotide
  Target: ATXN1; (+) strand; PAM type: NRG; PAM sequence: CGG
aagactctctaccagagttg

SEQ ID NO: 99027 - DNA, 20 bp, Artificial Sequence
  Description of Artificial Sequence: Synthetic oligonucleotide
  Target: ATXN1; (+) strand; PAM type: NRG; PAM sequence: CAG
tgcttattcttgcccaacac

SEQ ID NO: 99028 - DNA, 20 bp, Artificial Sequence
  Description of Artificial Sequence: Synthetic oligonucleotide
  Target: ATXN1; (+) strand; PAM type: NRG; PAM sequence: AGG
gcttattcttgcccaacacc

SEQ ID NO: 99029 - DNA, 20 bp, Artificial Sequence
  Description of Artificial Sequence: Synthetic oligonucleotide
  Target: ATXN1; (+) strand; PAM type: NRG; PAM sequence: CAG
tattcttgcccaacaccagg

SEQ ID NO: 99030 - DNA, 20 bp, Artificial Sequence
  Description of Artificial Sequence: Synthetic oligonucleotide
  Target: ATXN1; (+) strand; PAM type: NRG; PAM sequence: GAG
ttcttgcccaacaccaggca

SEQ ID NO: 99031 - DNA, 20 bp, Artificial Sequence
  Description of Artificial Sequence: Synthetic oligonucleotide
  Target: ATXN1; (+) strand; PAM type: NRG; PAM sequence: AGG
tcttgcccaacaccaggcag

SEQ ID NO: 99032 - DNA, 20 bp, Artificial Sequence
  Description of Artificial Sequence: Synthetic oligonucleotide
  Target: ATXN1; (+) strand; PAM type: NRG; PAM sequence: CAG
ggcagaggtaatgtgacatt

SEQ ID NO: 99033 - DNA, 20 bp, Artificial Sequence
  Description of Artificial Sequence: Synthetic oligonucleotide
  Target: ATXN1; (+) strand; PAM type: NRG; PAM sequence: AAG
agaggtaatgtgacattcag

SEQ ID NO: 99034 - DNA, 20 bp, Artificial Sequence
  Description of Artificial Sequence: Synthetic oligonucleotide
  Target: ATXN1; (+) strand; PAM type: NRG; PAM sequence: CAG
taatgtgacattcagaagac

SEQ ID NO: 99035 - DNA, 20 bp, Artificial Sequence
  Description of Artificial Sequence: Synthetic oligonucleotide
  Target: ATXN1; (+) strand; PAM type: NRG; PAM sequence: AAG
tgtgacattcagaagaccag

SEQ ID NO: 99036 - DNA, 20 bp, Artificial Sequence
  Description of Artificial Sequence: Synthetic oligonucleotide
  Target: ATXN1; (+) strand; PAM type: NRG; PAM sequence: TAG
attcagaagaccagaagcct

SEQ ID NO: 99037 - DNA, 20 bp, Artificial Sequence
  Description of Artificial Sequence: Synthetic oligonucleotide
  Target: ATXN1; (+) strand; PAM type: NRG; PAM sequence: CAG
agccttagttccaaacatgt

SEQ ID NO: 99038 - DNA, 20 bp, Artificial Sequence
  Description of Artificial Sequence: Synthetic oligonucleotide
  Target: ATXN1; (+) strand; PAM type: NRG; PAM sequence: TGG
aaacatgtcagcctcttttc

SEQ ID NO: 99039 - DNA, 20 bp, Artificial Sequence
  Description of Artificial Sequence: Synthetic oligonucleotide
  Target: ATXN1; (+) strand; PAM type: NRG; PAM sequence: CGG
tttctggttctgcgtgttcc

SEQ ID NO: 99040 - DNA, 20 bp, Artificial Sequence
  Description of Artificial Sequence: Synthetic oligonucleotide
  Target: ATXN1; (+) strand; PAM type: NRG; PAM sequence: TGG
ataactccctgtctccttgc

SEQ ID NO: 99041 - DNA, 20 bp, Artificial Sequence
  Description of Artificial Sequence: Synthetic oligonucleotide
  Target: ATXN1; (+) strand; PAM type: NRG; PAM sequence: CAG
actccctgtctccttgctgg

SEQ ID NO: 99042 - DNA, 20 bp, Artificial Sequence
  Description of Artificial Sequence: Synthetic oligonucleotide
  Target: ATXN1; (+) strand; PAM type: NRG; PAM sequence: TGG
cctgtctccttgctggcaga

SEQ ID NO: 99043 - DNA, 20 bp, Artificial Sequence
  Description of Artificial Sequence: Synthetic oligonucleotide
  Target: ATXN1; (+) strand; PAM type: NRG; PAM sequence: CGG
tctccttgctggcagatggc

SEQ ID NO: 99044 - DNA, 20 bp, Artificial Sequence
  Description of Artificial Sequence: Synthetic oligonucleotide
  Target: ATXN1; (+) strand; PAM type: NRG; PAM sequence: TGG
gatggccggacacctaccca

SEQ ID NO: 99045 - DNA, 20 bp, Artificial Sequence
  Description of Artificial Sequence: Synthetic oligonucleotide
  Target: ATXN1; (+) strand; PAM type: NRG; PAM sequence: GAG
tggccggacacctacccatg

SEQ ID NO: 99046 - DNA, 20 bp, Artificial Sequence
  Description of Artificial Sequence: Synthetic oligonucleotide
  Target: ATXN1; (+) strand; PAM type: NRG; PAM sequence: GAG
gccggacacctacccatgga

SEQ ID NO: 99047 - DNA, 20 bp, Artificial Sequence
  Description of Artificial Sequence: Synthetic oligonucleotide
  Target: ATXN1; (+) strand; PAM type: NRG; PAM sequence: AGG
ccggacacctacccatggag

SEQ ID NO: 99048 - DNA, 20 bp, Artificial Sequence
  Description of Artificial Sequence: Synthetic oligonucleotide
  Target: ATXN1; (+) strand; PAM type: NRG; PAM sequence: TGG
cctacccatggagaggccct

SEQ ID NO: 99049 - DNA, 20 bp, Artificial Sequence
  Description of Artificial Sequence: Synthetic oligonucleotide
  Target: ATXN1; (+) strand; PAM type: NRG; PAM sequence: GAG
tggagaggcccttggtgtgt

SEQ ID NO: 99050 - DNA, 20 bp, Artificial Sequence
  Description of Artificial Sequence: Synthetic oligonucleotide
  Target: ATXN1; (+) strand; PAM type: NRG; PAM sequence: CAG
gccacattatacacacttca

SEQ ID NO: 99051 - DNA, 20 bp, Artificial Sequence
  Description of Artificial Sequence: Synthetic oligonucleotide
  Target: ATXN1; (+) strand; PAM type: NRG; PAM sequence: AGG
ccacattatacacacttcac

SEQ ID NO: 99052 - DNA, 20 bp, Artificial Sequence
  Description of Artificial Sequence: Synthetic oligonucleotide
  Target: ATXN1; (+) strand; PAM type: NRG; PAM sequence: GGG
cacattatacacacttcaca

SEQ ID NO: 99053 - DNA, 20 bp, Artificial Sequence
  Description of Artificial Sequence: Synthetic oligonucleotide
  Target: ATXN1; (+) strand; PAM type: NRG; PAM sequence: CAG
attatacacacttcacaggg

SEQ ID NO: 99054 - DNA, 20 bp, Artificial Sequence
  Description of Artificial Sequence: Synthetic oligonucleotide
  Target: ATXN1; (+) strand; PAM type: NRG; PAM sequence: AGG
ttatacacacttcacagggc

SEQ ID NO: 99055 - DNA, 20 bp, Artificial Sequence
  Description of Artificial Sequence: Synthetic oligonucleotide
  Target: ATXN1; (+) strand; PAM type: NRG; PAM sequence: TAG
taacatctactgtgttctca

SEQ ID NO: 99056 - DNA, 20 bp, Artificial Sequence
  Description of Artificial Sequence: Synthetic oligonucleotide
  Target: ATXN1; (+) strand; PAM type: NRG; PAM sequence: AGG
aacatctactgtgttctcat

SEQ ID NO: 99057 - DNA, 20 bp, Artificial Sequence
  Description of Artificial Sequence: Synthetic oligonucleotide
  Target: ATXN1; (+) strand; PAM type: NRG; PAM sequence: GAG
tctcataggtaaacttatct

SEQ ID NO: 99058 - DNA, 20 bp, Artificial Sequence
  Description of Artificial Sequence: Synthetic oligonucleotide
  Target: ATXN1; (+) strand; PAM type: NRG; PAM sequence: AGG
ctcataggtaaacttatctg

SEQ ID NO: 99059 - DNA, 20 bp, Artificial Sequence
  Description of Artificial Sequence: Synthetic oligonucleotide
  Target: ATXN1; (+) strand; PAM type: NRG; PAM sequence: AAG
ctgaggatttccacgttacc

SEQ ID NO: 99060 - DNA, 20 bp, Artificial Sequence
  Description of Artificial Sequence: Synthetic oligonucleotide
  Target: ATXN1; (+) strand; PAM type: NRG; PAM sequence: TAG
tccacgttaccaagtatctg

SEQ ID NO: 99061 - DNA, 20 bp, Artificial Sequence
  Description of Artificial Sequence: Synthetic oligonucleotide
  Target: ATXN1; (+) strand; PAM type: NRG; PAM sequence: AAG
caagtatctgtagactcatt

SEQ ID NO: 99062 - DNA, 20 bp, Artificial Sequence
  Description of Artificial Sequence: Synthetic oligonucleotide
  Target: ATXN1; (+) strand; PAM type: NRG; PAM sequence: AAG
actcattaagaaatgtctac

SEQ ID NO: 99063 - DNA, 20 bp, Artificial Sequence
  Description of Artificial Sequence: Synthetic oligonucleotide
  Target: ATXN1; (+) strand; PAM type: NRG; PAM sequence: CAG
tgtctacaagccctttataa

SEQ ID NO: 99064 - DNA, 20 bp, Artificial Sequence
  Description of Artificial Sequence: Synthetic oligonucleotide
  Target: ATXN1; (+) strand; PAM type: NRG; PAM sequence: AGG
gtctacaagccctttataac

SEQ ID NO: 99065 - DNA, 20 bp, Artificial Sequence
  Description of Artificial Sequence: Synthetic oligonucleotide
  Target: ATXN1; (+) strand; PAM type: NRG; PAM sequence: TAG
taacaggtactataattgat

SEQ ID NO: 99066 - DNA, 20 bp, Artificial Sequence
  Description of Artificial Sequence: Synthetic oligonucleotide
  Target: ATXN1; (+) strand; PAM type: NRG; PAM sequence: AAG
actataattgattagtgcaa

SEQ ID NO: 99067 - DNA, 20 bp, Artificial Sequence
  Description of Artificial Sequence: Synthetic oligonucleotide
  Target: ATXN1; (+) strand; PAM type: NRG; PAM sequence: CAG
taattgattagtgcaaaagt

SEQ ID NO: 99068 - DNA, 20 bp, Artificial Sequence
  Description of Artificial Sequence: Synthetic oligonucleotide
  Target: ATXN1; (+) strand; PAM type: NRG; PAM sequence: AGG
aattgattagtgcaaaagtc

SEQ ID NO: 99069 - DNA, 20 bp, Artificial Sequence
  Description of Artificial Sequence: Synthetic oligonucleotide
  Target: ATXN1; (+) strand; PAM type: NRG; PAM sequence: CAG
ttagtgcaaaagtcaggata

SEQ ID NO: 99070 - DNA, 20 bp, Artificial Sequence
  Description of Artificial Sequence: Synthetic oligonucleotide
  Target: ATXN1; (+) strand; PAM type: NRG; PAM sequence: AAG
gatacacgtgtttccctcta

SEQ ID NO: 99071 - DNA, 20 bp, Artificial Sequence
  Description of Artificial Sequence: Synthetic oligonucleotide
  Target: ATXN1; (+) strand; PAM type: NRG; PAM sequence: TGG
taaagacttcataatgttat

SEQ ID NO: 99072 - DNA, 20 bp, Artificial Sequence
  Description of Artificial Sequence: Synthetic oligonucleotide
  Target: ATXN1; (+) strand; PAM type: NRG; PAM sequence: AAG
aatgttattggacattttga

SEQ ID NO: 99073 - DNA, 20 bp, Artificial Sequence
  Description of Artificial Sequence: Synthetic oligonucleotide
  Target: ATXN1; (+) strand; PAM type: NRG; PAM sequence: AAG
ttccgcatctcaaaactcca

SEQ ID NO: 99074 - DNA, 20 bp, Artificial Sequence
  Description of Artificial Sequence: Synthetic oligonucleotide
  Target: ATXN1; (+) strand; PAM type: NRG; PAM sequence: CAG
agacaccactcttgtaatcc

SEQ ID NO: 99075 - DNA, 20 bp, Artificial Sequence
  Description of Artificial Sequence: Synthetic oligonucleotide
  Target: ATXN1; (+) strand; PAM type: NRG; PAM sequence: TGG
ctcttgtaatcccagcactt

SEQ ID NO: 99076 - DNA, 20 bp, Artificial Sequence
  Description of Artificial Sequence: Synthetic oligonucleotide
  Target: ATXN1; (+) strand; PAM type: NRG; PAM sequence: GGG
tcttgtaatcccagcacttt

SEQ ID NO: 99077 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcccagcactttgg

SEQ ID NO: 99078 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 99079 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 99080 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 99081 - DNA, 20 bp, Artificial Sequence
  Description of Artificial Sequence: Synthetic oligonucleotide
  Target: ATXN1; (+) strand; PAM type: NRG; PAM sequence: TAG
gctgaggtacaattgtgaaa

SEQ ID NO: 99082 - DNA, 20 bp, Artificial Sequence
  Description of Artificial Sequence: Synthetic oligonucleotide
  Target: ATXN1; (+) strand; PAM type: NRG; PAM sequence: AAG
gtacaattgtgaaatagcaa

SEQ ID NO: 99083 - DNA, 20 bp, Artificial Sequence
  Description of Artificial Sequence: Synthetic oligonucleotide
  Target: ATXN1; (+) strand; PAM type: NRG; PAM sequence: AAG
actaactccatttttgttta

SEQ ID NO: 99084 - DNA, 20 bp, Artificial Sequence
  Description of Artificial Sequence: Synthetic oligonucleotide
  Target: ATXN1; (+) strand; PAM type: NRG; PAM sequence: AGG
ctaactccatttttgtttaa

SEQ ID NO: 99085 - DNA, 20 bp, Artificial Sequence
  Description of Artificial Sequence: Synthetic oligonucleotide
  Target: ATXN1; (+) strand; PAM type: NRG; PAM sequence: GGG
taactccatttttgtttaaa

SEQ ID NO: 99086 - DNA, 20 bp, Artificial Sequence
  Description of Artificial Sequence: Synthetic oligonucleotide
  Target: ATXN1; (+) strand; PAM type: NRG; PAM sequence: TAG
gttttaccctttcctgcacg

SEQ ID NO: 99087 - DNA, 20 bp, Artificial Sequence
  Description of Artificial Sequence: Synthetic oligonucleotide
  Target: ATXN1; (+) strand; PAM type: NRG; PAM sequence: AGG
ttttaccctttcctgcacgt

SEQ ID NO: 99088 - DNA, 20 bp, Artificial Sequence
  Description of Artificial Sequence: Synthetic oligonucleotide
  Target: ATXN1; (+) strand; PAM type: NRG; PAM sequence: TAG
accctttcctgcacgtaggc

SEQ ID NO: 99089 - DNA, 20 bp, Artificial Sequence
  Description of Artificial Sequence: Synthetic oligonucleotide
  Target: ATXN1; (+) strand; PAM type: NRG; PAM sequence: AGG
ccctttcctgcacgtaggct

SEQ ID NO: 99090 - DNA, 20 bp, Artificial Sequence
  Description of Artificial Sequence: Synthetic oligonucleotide
  Target: ATXN1; (+) strand; PAM type: NRG; PAM sequence: TGG
cgtaggctaggataatttta

SEQ ID NO: 99091 - DNA, 20 bp, Artificial Sequence
  Description of Artificial Sequence: Synthetic oligonucleotide
  Target: ATXN1; (+) strand; PAM type: NRG; PAM sequence: GAG
taggataattttatggcacc

SEQ ID NO: 99092 - DNA, 20 bp, Artificial Sequence
  Description of Artificial Sequence: Synthetic oligonucleotide
  Target: ATXN1; (+) strand; PAM type: NRG; PAM sequence: TAG
aaacaacaatcatgtacttt

SEQ ID NO: 99093 - DNA, 20 bp, Artificial Sequence
  Description of Artificial Sequence: Synthetic oligonucleotide
  Target: ATXN1; (+) strand; PAM type: NRG; PAM sequence: TGG
gtacttttagaaactaactc

SEQ ID NO: 99094 - DNA, 20 bp, Artificial Sequence
  Description of Artificial Sequence: Synthetic oligonucleotide
  Target: ATXN1; (+) strand; PAM type: NRG; PAM sequence: GGG
tacttttagaaactaactct

SEQ ID NO: 99095 - DNA, 20 bp, Artificial Sequence
  Description of Artificial Sequence: Synthetic oligonucleotide
  Target: ATXN1; (+) strand; PAM type: NRG; PAM sequence: AAG
agaaactaactctgggatta

SEQ ID NO: 99096 - DNA, 20 bp, Artificial Sequence
  Description of Artificial Sequence: Synthetic oligonucleotide
  Target: ATXN1; (+) strand; PAM type: NRG; PAM sequence: AGG
gaaactaactctgggattaa

SEQ ID NO: 99097 - DNA, 20 bp, Artificial Sequence
  Description of Artificial Sequence: Synthetic oligonucleotide
  Target: ATXN1; (+) strand; PAM type: NRG; PAM sequence: GGG
aaactaactctgggattaaa

SEQ ID NO: 99098 - DNA, 20 bp, Artificial Sequence
  Description of Artificial Sequence: Synthetic oligonucleotide
  Target: ATXN1; (+) strand; PAM type: NRG; PAM sequence: GGG
aactaactctgggattaaag

SEQ ID NO: 99099 - DNA, 20 bp, Artificial Sequence
  Description of Artificial Sequence: Synthetic oligonucleotide
  Target: ATXN1; (+) strand; PAM type: NRG; PAM sequence: AAG
taactctgggattaaagggg

SEQ ID NO: 99100 - DNA, 20 bp, Artificial Sequence
  Description of Artificial Sequence: Synthetic oligonucleotide
  Target: ATXN1; (+) strand; PAM type: NRG; PAM sequence: AAG
caactaactatatattgtta

SEQ ID NO: 99101 - DNA, 20 bp, Artificial Sequence
  Description of Artificial Sequence: Synthetic oligonucleotide
  Target: ATXN1; (+) strand; PAM type: NRG; PAM sequence: TAG
tatatattgttaaagactga

SEQ ID NO: 99102 - DNA, 20 bp, Artificial Sequence
  Description of Artificial Sequence: Synthetic oligonucleotide
  Target: ATXN1; (+) strand; PAM type: NRG; PAM sequence: AGG
atatattgttaaagactgat

SEQ ID NO: 99103 - DNA, 20 bp, Artificial Sequence
  Description of Artificial Sequence: Synthetic oligonucleotide
  Target: ATXN1; (+) strand; PAM type: NRG; PAM sequence: GAG
atattgttaaagactgatag

SEQ ID NO: 99104 - DNA, 20 bp, Artificial Sequence
  Description of Artificial Sequence: Synthetic oligonucleotide
  Target: ATXN1; (+) strand; PAM type: NRG; PAM sequence: TGG
ttgttaaagactgataggag

SEQ ID NO: 99105 - DNA, 20 bp, Artificial Sequence
  Description of Artificial Sequence: Synthetic oligonucleotide
  Target: ATXN1; (+) strand; PAM type: NRG; PAM sequence: TGG
taaagactgataggagtggc

SEQ ID NO: 99106 - DNA, 20 bp, Artificial Sequence
  Description of Artificial Sequence: Synthetic oligonucleotide
  Target: ATXN1; (+) strand; PAM type: NRG; PAM sequence: GGG
aaagactgataggagtggct

SEQ ID NO: 99107 - DNA, 20 bp, Artificial Sequence
  Description of Artificial Sequence: Synthetic oligonucleotide
  Target: ATXN1; (+) strand; PAM type: NRG; PAM sequence: CGG
ctgataggagtggctgggca

SEQ ID NO: 99108 - DNA, 20 bp, Artificial Sequence
  Description of Artificial Sequence: Synthetic oligonucleotide
  Target: ATXN1; (+) strand; PAM type: NRG; PAM sequence: TGG
ataggagtggctgggcacgg

SEQ ID NO: 99109 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 99110 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 99111 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 99112 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 99113 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 99114 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 99115 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 99116 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 99117 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 99118 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccgaggcggg

SEQ ID NO: 99119 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggcggatcacct

SEQ ID NO: 99120 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggcggatcacctg

SEQ ID NO: 99121 - DNA, 20 bp, Artificial Sequence
  Description of Artificial Sequence: Synthetic oligonucleotide
  Target: ATXN1; (+) strand; PAM type: NRG; PAM sequence: CAG
gcgggcggatcacctgaggt

SEQ ID NO: 99122 - DNA, 20 bp, Artificial Sequence
  Description of Artificial Sequence: Synthetic oligonucleotide
  Target: ATXN1; (+) strand; PAM type: NRG; PAM sequence: AGG
cgggcggatcacctgaggtc

SEQ ID NO: 99123 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacctgaggtcag

SEQ ID NO: 99124 - DNA, 20 bp, Artificial Sequence
  Description of Artificial Sequence: Synthetic oligonucleotide
  Target: ATXN1; (+) strand; PAM type: NRG; PAM sequence: TAG
gatcacctgaggtcaggagt

SEQ ID NO: 99125 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagtta

SEQ ID NO: 99126 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttagagac

SEQ ID NO: 99127 - DNA, 20 bp, Artificial Sequence
  Description of Artificial Sequence: Synthetic oligonucleotide
  Target: ATXN1; (+) strand; PAM type: NRG; PAM sequence: TGG
tcaggagttagagaccagtc

SEQ ID NO: 99128 - DNA, 20 bp, Artificial Sequence
  Description of Artificial Sequence: Synthetic oligonucleotide
  Target: ATXN1; (+) strand; PAM type: NRG; PAM sequence: TGG
agagaccagtctggccaata

SEQ ID NO: 99129 - DNA, 20 bp, Artificial Sequence
  Description of Artificial Sequence: Synthetic oligonucleotide
  Target: ATXN1; (+) strand; PAM type: NRG; PAM sequence: AAG
accctctattaaaaatacta

SEQ ID NO: 99130 - DNA, 20 bp, Artificial Sequence
  Description of Artificial Sequence: Synthetic oligonucleotide
  Target: ATXN1; (+) strand; PAM type: NRG; PAM sequence: AAG
attaaaaatactaaagactg

SEQ ID NO: 99131 - DNA, 20 bp, Artificial Sequence
  Description of Artificial Sequence: Synthetic oligonucleotide
  Target: ATXN1; (+) strand; PAM type: NRG; PAM sequence: AGG
ttaaaaatactaaagactga

SEQ ID NO: 99132 - DNA, 20 bp, Artificial Sequence
  Description of Artificial Sequence: Synthetic oligonucleotide
  Target: ATXN1; (+) strand; PAM type: NRG; PAM sequence: GAG
aaaaatactaaagactgaag

SEQ ID NO: 99133 - DNA, 20 bp, Artificial Sequence
  Description of Artificial Sequence: Synthetic oligonucleotide
  Target: ATXN1; (+) strand; PAM type: NRG; PAM sequence: AAG
aggagcattatgacctgacc

SEQ ID NO: 99134 - DNA, 20 bp, Artificial Sequence
  Description of Artificial Sequence: Synthetic oligonucleotide
  Target: ATXN1; (+) strand; PAM type: NRG; PAM sequence: AGG
ggagcattatgacctgacca

SEQ ID NO: 99135 - DNA, 20 bp, Artificial Sequence
  Description of Artificial Sequence: Synthetic oligonucleotide
  Target: ATXN1; (+) strand; PAM type: NRG; PAM sequence: AAG
ttatgacctgaccaaggaca

SEQ ID NO: 99136 - DNA, 20 bp, Artificial Sequence
  Description of Artificial Sequence: Synthetic oligonucleotide
  Target: ATXN1; (+) strand; PAM type: NRG; PAM sequence: AAG
tgacctgaccaaggacaaag

SEQ ID NO: 99137 - DNA, 20 bp, Artificial Sequence
  Description of Artificial Sequence: Synthetic oligonucleotide
  Target: ATXN1; (+) strand; PAM type: NRG; PAM sequence: TGG
caaccttcttgaaccctcac

SEQ ID NO: 99138 - DNA, 20 bp, Artificial Sequence
  Description of Artificial Sequence: Synthetic oligonucleotide
  Target: ATXN1; (+) strand; PAM type: NRG; PAM sequence: TGG
cactggtgcccaaatgtcta

SEQ ID NO: 99139 - DNA, 20 bp, Artificial Sequence
  Description of Artificial Sequence: Synthetic oligonucleotide
  Target: ATXN1; (+) strand; PAM type: NRG; PAM sequence: CAG
gcccaaatgtctatggtcct

SEQ ID NO: 99140 - DNA, 20 bp, Artificial Sequence
  Description of Artificial Sequence: Synthetic oligonucleotide
  Target: ATXN1; (+) strand; PAM type: NRG; PAM sequence: CAG
tcccataaaaaccctccaac

SEQ ID NO: 99141 - DNA, 20 bp, Artificial Sequence
  Description of Artificial Sequence: Synthetic oligonucleotide
  Target: ATXN1; (+) strand; PAM type: NRG; PAM sequence: TGG
ctccaaccagcctaaaaaat

SEQ ID NO: 99142 - DNA, 20 bp, Artificial Sequence
  Description of Artificial Sequence: Synthetic oligonucleotide
  Target: ATXN1; (+) strand; PAM type: NRG; PAM sequence: GAG
ccaaccagcctaaaaaattg

SEQ ID NO: 99143 - DNA, 20 bp, Artificial Sequence
  Description of Artificial Sequence: Synthetic oligonucleotide
  Target: ATXN1; (+) strand; PAM type: NRG; PAM sequence: GAG
ttacaaaattattatttctt

SEQ ID NO: 99144 - DNA, 20 bp, Artificial Sequence
  Description of Artificial Sequence: Synthetic oligonucleotide
  Target: ATXN1; (+) strand; PAM type: NRG; PAM sequence: TGG
aaaattattatttcttgaga

SEQ ID NO: 99145 - DNA, 20 bp, Artificial Sequence
  Description of Artificial Sequence: Synthetic oligonucleotide
  Target: ATXN1; (+) strand; PAM type: NRG; PAM sequence: CAG
gagatggattctctgttgcc

SEQ ID NO: 99146 - DNA, 20 bp, Artificial Sequence
  Description of Artificial Sequence: Synthetic oligonucleotide
  Target: ATXN1; (+) strand; PAM type: NRG; PAM sequence: AGG
agatggattctctgttgccc

SEQ ID NO: 99147 - DNA, 20 bp, Artificial Sequence
  Description of Artificial Sequence: Synthetic oligonucleotide
  Target: ATXN1; (+) strand; PAM type: NRG; PAM sequence: TGG
ggattctctgttgcccaggc

SEQ ID NO: 99148 - DNA, 20 bp, Artificial Sequence
  Description of Artificial Sequence: Synthetic oligonucleotide
  Target: ATXN1; (+) strand; PAM type: NRG; PAM sequence: GAG
attctctgttgcccaggctg

SEQ ID NO: 99149 - DNA, 20 bp, Artificial Sequence
  Description of Artificial Sequence: Synthetic oligonucleotide
  Target: ATXN1; (+) strand; PAM type: NRG; PAM sequence: CAG
ctgttgcccaggctggagtg

SEQ ID NO: 99150 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtgcag

SEQ ID NO: 99151 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggtacaatct

SEQ ID NO: 99152 - DNA, 20 bp, Artificial Sequence
  Description of Artificial Sequence: Synthetic oligonucleotide
  Target: ATXN1; (+) strand; PAM type: NRG; PAM sequence: TAG
tcactgcaacctctgcttcc

SEQ ID NO: 99153 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctctgcttcct

SEQ ID NO: 99154 - DNA, 20 bp, Artificial Sequence
  Description of Artificial Sequence: Synthetic oligonucleotide
  Target: ATXN1; (+) strand; PAM type: NRG; PAM sequence: AAG
aacctctgcttcctaggttc

SEQ ID NO: 99155 - DNA, 20 bp, Artificial Sequence
  Description of Artificial Sequence: Synthetic oligonucleotide
  Target: ATXN1; (+) strand; PAM type: NRG; PAM sequence: CAG
ttcaagctattctcctgtct

SEQ ID NO: 99156 - DNA, 20 bp, Artificial Sequence
  Description of Artificial Sequence: Synthetic oligonucleotide
  Target: ATXN1; (+) strand; PAM type: NRG; PAM sequence: GAG
ttctcctgtctcagcctcct

SEQ ID NO: 99157 - DNA, 20 bp, Artificial Sequence
  Description of Artificial Sequence: Synthetic oligonucleotide
  Target: ATXN1; (+) strand; PAM type: NRG; PAM sequence: TAG
tcctgtctcagcctcctgag

SEQ ID NO: 99158 - DNA, 20 bp, Artificial Sequence
  Description of Artificial Sequence: Synthetic oligonucleotide
  Target: ATXN1; (+) strand; PAM type: NRG; PAM sequence: TGG
gtctcagcctcctgagtagc

SEQ ID NO: 99159 - DNA, 20 bp, Artificial Sequence
  Description of Artificial Sequence: Synthetic oligonucleotide
  Target: ATXN1; (+) strand; PAM type: NRG; PAM sequence: GGG
tctcagcctcctgagtagct

SEQ ID NO: 99160 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggacta

SEQ ID NO: 99161 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactac

SEQ ID NO: 99162 - DNA, 20 bp, Artificial Sequence
  Description of Artificial Sequence: Synthetic oligonucleotide
  Target: ATXN1; (+) strand; PAM type: NRG; PAM sequence: TGG
caggcatgtgccaccacacc

SEQ ID NO: 99163 - DNA, 20 bp, Artificial Sequence
  Description of Artificial Sequence: Synthetic oligonucleotide
  Target: ATXN1; (+) strand; PAM type: NRG; PAM sequence: TAG
tggctaatttttgtattttt

SEQ ID NO: 99164 - DNA, 20 bp, Artificial Sequence
  Description of Artificial Sequence: Synthetic oligonucleotide
  Target: ATXN1; (+) strand; PAM type: NRG; PAM sequence: TAG
ctaatttttgtattttttag

SEQ ID NO: 99165 - DNA, 20 bp, Artificial Sequence
  Description of Artificial Sequence: Synthetic oligonucleotide
  Target: ATXN1; (+) strand; PAM type: NRG; PAM sequence: GAG
aatttttgtattttttagta

SEQ ID NO: 99166 - DNA, 20 bp, Artificial Sequence
  Description of Artificial Sequence: Synthetic oligonucleotide
  Target: ATXN1; (+) strand; PAM type: NRG; PAM sequence: TGG
tttgtattttttagtagaga

SEQ ID NO: 99167 - DNA, 20 bp, Artificial Sequence
  Description of Artificial Sequence: Synthetic oligonucleotide
  Target: ATXN1; (+) strand; PAM type: NRG; PAM sequence: TGG
tttttagtagagatggtgtt

SEQ ID NO: 99168 - DNA, 20 bp, Artificial Sequence
  Description of Artificial Sequence: Synthetic oligonucleotide
  Target: ATXN1; (+) strand; PAM type: NRG; PAM sequence: TGG
gagatggtgtttggccattg

SEQ ID NO: 99169 - DNA, 20 bp, Artificial Sequence
  Description of Artificial Sequence: Synthetic oligonucleotide
  Target: ATXN1; (+) strand; PAM type: NRG; PAM sequence: GGG
agatggtgtttggccattgt

SEQ ID NO: 99170 - DNA, 20 bp, Artificial Sequence
  Description of Artificial Sequence: Synthetic oligonucleotide
  Target: ATXN1; (+) strand; PAM type: NRG; PAM sequence: CAG
ggtgtttggccattgtgggt

SEQ ID NO: 99171 - DNA, 20 bp, Artificial Sequence
  Description of Artificial Sequence: Synthetic oligonucleotide
  Target: ATXN1; (+) strand; PAM type: NRG; PAM sequence: AGG
gtgtttggccattgtgggtc

SEQ ID NO: 99172 - DNA, 20 bp, Artificial Sequence
  Description of Artificial Sequence: Synthetic oligonucleotide
  Target: ATXN1; (+) strand; PAM type: NRG; PAM sequence: TGG
ttggccattgtgggtcaggc

SEQ ID NO: 99173 - DNA, 20 bp, Artificial Sequence
  Description of Artificial Sequence: Synthetic oligonucleotide
  Target: ATXN1; (+) strand; PAM type: NRG; PAM sequence: TAG
tggtctcaaactcctgacct

SEQ ID NO: 99174 - DNA, 20 bp, Artificial Sequence
  Description of Artificial Sequence: Synthetic oligonucleotide
  Target: ATXN1; (+) strand; PAM type: NRG; PAM sequence: AGG
ggtctcaaactcctgacctt

SEQ ID NO: 99175 - DNA, 20 bp, Artificial Sequence
  Description of Artificial Sequence: Synthetic oligonucleotide
  Target: ATXN1; (+) strand; PAM type: NRG; PAM sequence: TGG
cttaggtgatccgcctgcct

SEQ ID NO: 99176 - DNA, 20 bp, Artificial Sequence
  Description of Artificial Sequence: Synthetic oligonucleotide
  Target: ATXN1; (+) strand; PAM type: NRG; PAM sequence: AAG
ccgcctgccttggcatccca

SEQ ID NO: 99177 - DNA, 20 bp, Artificial Sequence
  Description of Artificial Sequence: Synthetic oligonucleotide
  Target: ATXN1; (+) strand; PAM type: NRG; PAM sequence: TGG
gccttggcatcccaaagtgc

SEQ ID NO: 99178 - DNA, 20 bp, Artificial Sequence
  Description of Artificial Sequence: Synthetic oligonucleotide
  Target: ATXN1; (+) strand; PAM type: NRG; PAM sequence: GGG
ccttggcatcccaaagtgct

SEQ ID NO: 99179 - DNA, 20 bp, Artificial Sequence
  Description of Artificial Sequence: Synthetic oligonucleotide
  Target: ATXN1; (+) strand; PAM type: NRG; PAM sequence: CAG
atcccaaagtgctgggatta

SEQ ID NO: 99180 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacagatgt

SEQ ID NO: 99181 - DNA, 20 bp, Artificial Sequence
  Description of Artificial Sequence: Synthetic oligonucleotide
  Target: ATXN1; (+) strand; PAM type: NRG; PAM sequence: TGG
cagatgtgagctaccatgcc

SEQ ID NO: 99182 - DNA, 20 bp, Artificial Sequence
  Description of Artificial Sequence: Synthetic oligonucleotide
  Target: ATXN1; (+) strand; PAM type: NRG; PAM sequence: TGG
gtgagctaccatgcctggcc

SEQ ID NO: 99183 - DNA, 20 bp, Artificial Sequence
  Description of Artificial Sequence: Synthetic oligonucleotide
  Target: ATXN1; (+) strand; PAM type: NRG; PAM sequence: GAG
gagctaccatgcctggcctg

SEQ ID NO: 99184 - DNA, 20 bp, Artificial Sequence
  Description of Artificial Sequence: Synthetic oligonucleotide
  Target: ATXN1; (+) strand; PAM type: NRG; PAM sequence: TGG
taccatgcctggcctggaga

SEQ ID NO: 99185 - DNA, 20 bp, Artificial Sequence
  Description of Artificial Sequence: Synthetic oligonucleotide
  Target: ATXN1; (+) strand; PAM type: NRG; PAM sequence: TAG
ctggcctggagatggtactt

SEQ ID NO: 99186 - DNA, 20 bp, Artificial Sequence
  Description of Artificial Sequence: Synthetic oligonucleotide
  Target: ATXN1; (+) strand; PAM type: NRG; PAM sequence: AAG
gcctggagatggtactttag

SEQ ID NO: 99187 - DNA, 20 bp, Artificial Sequence
  Description of Artificial Sequence: Synthetic oligonucleotide
  Target: ATXN1; (+) strand; PAM type: NRG; PAM sequence: AGG
cctggagatggtactttaga

SEQ ID NO: 99188 - DNA, 20 bp, Artificial Sequence
  Description of Artificial Sequence: Synthetic oligonucleotide
  Target: ATXN1; (+) strand; PAM type: NRG; PAM sequence: TAG
gagatggtactttagaaggc

SEQ ID NO: 99189 - DNA, 20 bp, Artificial Sequence
  Description of Artificial Sequence: Synthetic oligonucleotide
  Target: ATXN1; (+) strand; PAM type: NRG; PAM sequence: TGG
catcatcttctcaatttctc

SEQ ID NO: 99190 - DNA, 20 bp, Artificial Sequence
  Description of Artificial Sequence: Synthetic oligonucleotide
  Target: ATXN1; (+) strand; PAM type: NRG; PAM sequence: TGG
ccaacctcatctctcgtatt

SEQ ID NO: 99191 - DNA, 20 bp, Artificial Sequence
  Description of Artificial Sequence: Synthetic oligonucleotide
  Target: ATXN1; (+) strand; PAM type: NRG; PAM sequence: GAG
atctctcgtatttggctttt

SEQ ID NO: 99192 - DNA, 20 bp, Artificial Sequence
  Description of Artificial Sequence: Synthetic oligonucleotide
  Target: ATXN1; (+) strand; PAM type: NRG; PAM sequence: TGG
tctcgtatttggcttttgag

SEQ ID NO: 99193 - DNA, 20 bp, Artificial Sequence
  Description of Artificial Sequence: Synthetic oligonucleotide
  Target: ATXN1; (+) strand; PAM type: NRG; PAM sequence: GAG
gtatttggcttttgagtggt

SEQ ID NO: 99194 - DNA, 20 bp, Artificial Sequence
  Description of Artificial Sequence: Synthetic oligonucleotide
  Target: ATXN1; (+) strand; PAM type: NRG; PAM sequence: CAG
tttggcttttgagtggtgag

SEQ ID NO: 99195 - DNA, 20 bp, Artificial Sequence
  Description of Artificial Sequence: Synthetic oligonucleotide
  Target: ATXN1; (+) strand; PAM type: NRG; PAM sequence: AAG
agtggtgagcagccaaacct

SEQ ID NO: 99196 - DNA, 20 bp, Artificial Sequence
  Description of Artificial Sequence: Synthetic oligonucleotide
  Target: ATXN1; (+) strand; PAM type: NRG; PAM sequence: CAG
tgagcagccaaacctaagtt

SEQ ID NO: 99197 - DNA, 20 bp, Artificial Sequence
  Description of Artificial Sequence: Synthetic oligonucleotide
  Target: ATXN1; (+) strand; PAM type: NRG; PAM sequence: CAG
gccaaacctaagttcagtta

SEQ ID NO: 99198 - DNA, 20 bp, Artificial Sequence
  Description of Artificial Sequence: Synthetic oligonucleotide
  Target: ATXN1; (+) strand; PAM type: NRG; PAM sequence: GAG
caaacctaagttcagttaca

SEQ ID NO: 99199 - DNA, 20 bp, Artificial Sequence
  Description of Artificial Sequence: Synthetic oligonucleotide
  Target: ATXN1; (+) strand; PAM type: NRG; PAM sequence: AGG
aaacctaagttcagttacag

SEQ ID NO: 99200 - DNA, 20 bp, Artificial Sequence
  Description of Artificial Sequence: Synthetic oligonucleotide
  Target: ATXN1; (+) strand; PAM type: NRG; PAM sequence: GAG
aagttcagttacagaggtgc

SEQ ID NO: 99201 - DNA, 20 bp, Artificial Sequence
  Description of Artificial Sequence: Synthetic oligonucleotide
  Target: ATXN1; (+) strand; PAM type: NRG; PAM sequence: AGG
agttcagttacagaggtgcg

SEQ ID NO: 99202 - DNA, 20 bp, Artificial Sequence
  Description of Artificial Sequence: Synthetic oligonucleotide
  Target: ATXN1; (+) strand; PAM type: NRG; PAM sequence: GGG
gttcagttacagaggtgcga

SEQ ID NO: 99203 - DNA, 20 bp, Artificial Sequence
  Description of Artificial Sequence: Synthetic oligonucleotide
  Target: ATXN1; (+) strand; PAM type: NRG; PAM sequence: GAG
cagaggtgcgagggtcactc

SEQ ID NO: 99204 - DNA, 20 bp, Artificial Sequence
  Description of Artificial Sequence: Synthetic oligonucleotide
  Target: ATXN1; (+) strand; PAM type: NRG; PAM sequence: CAG
ctcgagctactgcaccactc

SEQ ID NO: 99205 - DNA, 20 bp, Artificial Sequence
  Description of Artificial Sequence: Synthetic oligonucleotide
  Target: ATXN1; (+) strand; PAM type: NRG; PAM sequence: CAG
caccactccagcctgtgtgc

SEQ ID NO: 99206 - DNA, 20 bp, Artificial Sequence
  Description of Artificial Sequence: Synthetic oligonucleotide
  Target: ATXN1; (+) strand; PAM type: NRG; PAM sequence: GAG
ccactccagcctgtgtgcca

SEQ ID NO: 99207 - DNA, 20 bp, Artificial Sequence
  Description of Artificial Sequence: Synthetic oligonucleotide
  Target: ATXN1; (+) strand; PAM type: NRG; PAM sequence: AAG
tccagcctgtgtgccagagc

SEQ ID NO: 99208 - DNA, 20 bp, Artificial Sequence
  Description of Artificial Sequence: Synthetic oligonucleotide
  Target: ATXN1; (+) strand; PAM type: NRG; PAM sequence: AAG
aaccaaactccaaatctcca

SEQ ID NO: 99209 - DNA, 20 bp, Artificial Sequence
  Description of Artificial Sequence: Synthetic oligonucleotide
  Target: ATXN1; (+) strand; PAM type: NRG; PAM sequence: CAG
aaactccaaatctccaaaga

SEQ ID NO: 99210 - DNA, 20 bp, Artificial Sequence
  Description of Artificial Sequence: Synthetic oligonucleotide
  Target: ATXN1; (+) strand; PAM type: NRG; PAM sequence: AGG
aactccaaatctccaaagac

SEQ ID NO: 99211 - DNA, 20 bp, Artificial Sequence
  Description of Artificial Sequence: Synthetic oligonucleotide
  Target: ATXN1; (+) strand; PAM type: NRG; PAM sequence: TAG
aaatctccaaagacaggcct

SEQ ID NO: 99212 - DNA, 20 bp, Artificial Sequence
  Description of Artificial Sequence: Synthetic oligonucleotide
  Target: ATXN1; (+) strand; PAM type: NRG; PAM sequence: TGG
ggccttagaattaaatgctg

SEQ ID NO: 99213 - DNA, 20 bp, Artificial Sequence
  Description of Artificial Sequence: Synthetic oligonucleotide
  Target: ATXN1; (+) strand; PAM type: NRG; PAM sequence: TAG
aaatgctgtggtgtgaacca

SEQ ID NO: 99214 - DNA, 20 bp, Artificial Sequence
  Description of Artificial Sequence: Synthetic oligonucleotide
  Target: ATXN1; (+) strand; PAM type: NRG; PAM sequence: TAG
gctgtggtgtgaaccatagc

SEQ ID NO: 99215 - DNA, 20 bp, Artificial Sequence
  Description of Artificial Sequence: Synthetic oligonucleotide
  Target: ATXN1; (+) strand; PAM type: NRG; PAM sequence: CAG
ggtgtgaaccatagctagaa

SEQ ID NO: 99216 - DNA, 20 bp, Artificial Sequence
  Description of Artificial Sequence: Synthetic oligonucleotide
  Target: ATXN1; (+) strand; PAM type: NRG; PAM sequence: GAG
cagcctgccgaaaaattcac

SEQ ID NO: 99217 - DNA, 20 bp, Artificial Sequence
  Description of Artificial Sequence: Synthetic oligonucleotide
  Target: ATXN1; (+) strand; PAM type: NRG; PAM sequence: GAG
gcctgccgaaaaattcacga

SEQ ID NO: 99218 - DNA, 20 bp, Artificial Sequence
  Description of Artificial Sequence: Synthetic oligonucleotide
  Target: ATXN1; (+) strand; PAM type: NRG; PAM sequence: AAG
ccgaaaaattcacgagagaa

SEQ ID NO: 99219 - DNA, 20 bp, Artificial Sequence
  Description of Artificial Sequence: Synthetic oligonucleotide
  Target: ATXN1; (+) strand; PAM type: NRG; PAM sequence: TGG
aattcacgagagaaaagtga

SEQ ID NO: 99220 - DNA, 20 bp, Artificial Sequence
  Description of Artificial Sequence: Synthetic oligonucleotide
  Target: ATXN1; (+) strand; PAM type: NRG; PAM sequence: GAG
ttcacgagagaaaagtgatg

SEQ ID NO: 99221 - DNA, 20 bp, Artificial Sequence
  Description of Artificial Sequence: Synthetic oligonucleotide
  Target: ATXN1; (+) strand; PAM type: NRG; PAM sequence: GAG
cacgagagaaaagtgatgga

SEQ ID NO: 99222 - DNA, 20 bp, Artificial Sequence
  Description of Artificial Sequence: Synthetic oligonucleotide
  Target: ATXN1; (+) strand; PAM type: NRG; PAM sequence: GAG
cgagagaaaagtgatggaga

SEQ ID NO: 99223 - DNA, 20 bp, Artificial Sequence
  Description of Artificial Sequence: Synthetic oligonucleotide
  Target: ATXN1; (+) strand; PAM type: NRG; PAM sequence: GAG
agagaaaagtgatggagaga

SEQ ID NO: 99224 - DNA, 20 bp, Artificial Sequence
  Description of Artificial Sequence: Synthetic oligonucleotide
  Target: ATXN1; (+) strand; PAM type: NRG; PAM sequence: GAG
gatggagagagagaatattt

SEQ ID NO: 99225 - DNA, 20 bp, Artificial Sequence
  Description of Artificial Sequence: Synthetic oligonucleotide
  Target: ATXN1; (+) strand; PAM type: NRG; PAM sequence: AAG
tttgagatgcgtactaaaac

SEQ ID NO: 99226 - DNA, 20 bp, Artificial Sequence
  Description of Artificial Sequence: Synthetic oligonucleotide
  Target: ATXN1; (+) strand; PAM type: NRG; PAM sequence: TGG
ctaaaacaagatgacgttaa

SEQ ID NO: 99227 - DNA, 20 bp, Artificial Sequence
  Description of Artificial Sequence: Synthetic oligonucleotide
  Target: ATXN1; (+) strand; PAM type: NRG; PAM sequence: GAG
ggaatttttttttttttttt

SEQ ID NO: 99228 - DNA, 20 bp, Artificial Sequence
  Description of Artificial Sequence: Synthetic oligonucleotide
  Target: ATXN1; (+) strand; PAM type: NRG; PAM sequence: CAG
ttttttttttttttttgaga

SEQ ID NO: 99229 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagaca

SEQ ID NO: 99230 - DNA, 20 bp, Artificial Sequence
  Description of Artificial Sequence: Synthetic oligonucleotide
  Target: ATXN1; (+) strand; PAM type: NRG; PAM sequence: CAG
cagagtctcgctctgtcacc

SEQ ID NO: 99231 - DNA, 20 bp, Artificial Sequence
  Description of Artificial Sequence: Synthetic oligonucleotide
  Target: ATXN1; (+) strand; PAM type: NRG; PAM sequence: AGG
agagtctcgctctgtcaccc

SEQ ID NO: 99232 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcacccaggt

SEQ ID NO: 99233 - DNA, 20 bp, Artificial Sequence
  Description of Artificial Sequence: Synthetic oligonucleotide
  Target: ATXN1; (+) strand; PAM type: NRG; PAM sequence: GAG
tcgctctgtcacccaggttg

SEQ ID NO: 99234 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggttggagtg

SEQ ID NO: 99235 - DNA, 20 bp, Artificial Sequence
  Description of Artificial Sequence: Synthetic oligonucleotide
  Target: ATXN1; (+) strand; PAM type: NRG; PAM sequence: TGG
tcacccaggttggagtgcag

SEQ ID NO: 99236 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggcaccatct

SEQ ID NO: 99237 - DNA, 20 bp, Artificial Sequence
  Description of Artificial Sequence: Synthetic oligonucleotide
  Target: ATXN1; (+) strand; PAM type: NRG; PAM sequence: TGG
tcactgcaatctctgcctcc

SEQ ID NO: 99238 - DNA, 20 bp, Artificial Sequence
  Description of Artificial Sequence: Synthetic oligonucleotide
  Target: ATXN1; (+) strand; PAM type: NRG; PAM sequence: GAG
aatctctgcctcctggattc

SEQ ID NO: 99239 - DNA, 20 bp, Artificial Sequence
  Description of Artificial Sequence: Synthetic oligonucleotide
  Target: ATXN1; (+) strand; PAM type: NRG; PAM sequence: CAG
ttcgagcgattctcctgcct

SEQ ID NO: 99240 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 99241 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 99242 - DNA, 20 bp, Artificial Sequence
  Description of Artificial Sequence: Synthetic oligonucleotide
  Target: ATXN1; (+) strand; PAM type: NRG; PAM sequence: CAG
tgcctcagcctcccaagtag

SEQ ID NO: 99243 - DNA, 20 bp, Artificial Sequence
  Description of Artificial Sequence: Synthetic oligonucleotide
  Target: ATXN1; (+) strand; PAM type: NRG; PAM sequence: AGG
gcctcagcctcccaagtagc

SEQ ID NO: 99244 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagca

SEQ ID NO: 99245 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagcagggatta

SEQ ID NO: 99246 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagcagggattac

SEQ ID NO: 99247 - DNA, 20 bp, Artificial Sequence
  Description of Artificial Sequence: Synthetic oligonucleotide
  Target: ATXN1; (+) strand; PAM type: NRG; PAM sequence: TGG
caggtgcccaccaccacccc

SEQ ID NO: 99248 - DNA, 20 bp, Artificial Sequence
  Description of Artificial Sequence: Synthetic oligonucleotide
  Target: ATXN1; (+) strand; PAM type: NRG; PAM sequence: TAG
tggctaattttttatatttt

SEQ ID NO: 99249 - DNA, 20 bp, Artificial Sequence
  Description of Artificial Sequence: Synthetic oligonucleotide
  Target: ATXN1; (+) strand; PAM type: NRG; PAM sequence: TAG
ctaattttttatatttttag

SEQ ID NO: 99250 - DNA, 20 bp, Artificial Sequence
  Description of Artificial Sequence: Synthetic oligonucleotide
  Target: ATXN1; (+) strand; PAM type: NRG; PAM sequence: CGG
ttttatatttttagtagaca

SEQ ID NO: 99251 - DNA, 20 bp, Artificial Sequence
  Description of Artificial Sequence: Synthetic oligonucleotide
  Target: ATXN1; (+) strand; PAM type: NRG; PAM sequence: GGG
tttatatttttagtagacac

SEQ ID NO: 99252 - DNA, 20 bp, Artificial Sequence
  Description of Artificial Sequence: Synthetic oligonucleotide
  Target: ATXN1; (+) strand; PAM type: NRG; PAM sequence: GGG
ttatatttttagtagacacg

SEQ ID NO: 99253 - DNA, 20 bp, Artificial Sequence
  Description of Artificial Sequence: Synthetic oligonucleotide
  Target: ATXN1; (+) strand; PAM type: NRG; PAM sequence: TGG
cggggtttcattcaccatgt

SEQ ID NO: 99254 - DNA, 20 bp, Artificial Sequence
  Description of Artificial Sequence: Synthetic oligonucleotide
  Target: ATXN1; (+) strand; PAM type: NRG; PAM sequence: AAG
tttcattcaccatgttggcc

SEQ ID NO: 99255 - DNA, 20 bp, Artificial Sequence
  Description of Artificial Sequence: Synthetic oligonucleotide
  Target: ATXN1; (+) strand; PAM type: NRG; PAM sequence: TAG
attcaccatgttggccaagc

SEQ ID NO: 99256 - DNA, 20 bp, Artificial Sequence
  Description of Artificial Sequence: Synthetic oligonucleotide
  Target: ATXN1; (+) strand; PAM type: NRG; PAM sequence: CAG
tagtcttgaactcctgatct

SEQ ID NO: 99257 - DNA, 20 bp, Artificial Sequence
  Description of Artificial Sequence: Synthetic oligonucleotide
  Target: ATXN1; (+) strand; PAM type: NRG; PAM sequence: AGG
agtcttgaactcctgatctc

SEQ ID NO: 99258 - DNA, 20 bp, Artificial Sequence
  Description of Artificial Sequence: Synthetic oligonucleotide
  Target: ATXN1; (+) strand; PAM type: NRG; PAM sequence: CAG
ctcaggcgatctgcccgcca

SEQ ID NO: 99259 - DNA, 20 bp, Artificial Sequence
  Description of Artificial Sequence: Synthetic oligonucleotide
  Target: ATXN1; (+) strand; PAM type: NRG; PAM sequence: TAG
gccacagcctcccaaaatgc

SEQ ID NO: 99260 - DNA, 20 bp, Artificial Sequence
  Description of Artificial Sequence: Synthetic oligonucleotide
  Target: ATXN1; (+) strand; PAM type: NRG; PAM sequence: AGG
ccacagcctcccaaaatgct

SEQ ID NO: 99261 - DNA, 20 bp, Artificial Sequence
  Description of Artificial Sequence: Synthetic oligonucleotide
  Target: ATXN1; (+) strand; PAM type: NRG; PAM sequence: CAG
ctcccaaaatgctaggatta

SEQ ID NO: 99262 - DNA, 20 bp, Artificial Sequence
  Description of Artificial Sequence: Synthetic oligonucleotide
  Target: ATXN1; (+) strand; PAM type: NRG; PAM sequence: AAG
ccaaaatgctaggattacag

SEQ ID NO: 99263 - DNA, 20 bp, Artificial Sequence
  Description of Artificial Sequence: Synthetic oligonucleotide
  Target: ATXN1; (+) strand; PAM type: NRG; PAM sequence: GAG
aatgctaggattacagaagt

SEQ ID NO: 99264 - DNA, 20 bp, Artificial Sequence
  Description of Artificial Sequence: Synthetic oligonucleotide
  Target: ATXN1; (+) strand; PAM type: NRG; PAM sequence: TGG
agtgagtcaccgcgcccacc

SEQ ID NO: 99265 - DNA, 20 bp, Artificial Sequence
  Description of Artificial Sequence: Synthetic oligonucleotide
  Target: ATXN1; (+) strand; PAM type: NRG; PAM sequence: TAG
taatgaaatttatgttaacc

SEQ ID NO: 99266 - DNA, 20 bp, Artificial Sequence
  Description of Artificial Sequence: Synthetic oligonucleotide
  Target: ATXN1; (+) strand; PAM type: NRG; PAM sequence: TAG
gaaatttatgttaacctaga

SEQ ID NO: 99267 - DNA, 20 bp, Artificial Sequence
  Description of Artificial Sequence: Synthetic oligonucleotide
  Target: ATXN1; (+) strand; PAM type: NRG; PAM sequence: AGG
aaatttatgttaacctagat

SEQ ID NO: 99268 - DNA, 20 bp, Artificial Sequence
  Description of Artificial Sequence: Synthetic oligonucleotide
  Target: ATXN1; (+) strand; PAM type: NRG; PAM sequence: TGG
tatgttaacctagataggct

SEQ ID NO: 99269 - DNA, 20 bp, Artificial Sequence
  Description of Artificial Sequence: Synthetic oligonucleotide
  Target: ATXN1; (+) strand; PAM type: NRG; PAM sequence: GGG
atgttaacctagataggctt

SEQ ID NO: 99270 - DNA, 20 bp, Artificial Sequence
  Description of Artificial Sequence: Synthetic oligonucleotide
  Target: ATXN1; (+) strand; PAM type: NRG; PAM sequence: GAG
gttaacctagataggcttgg

SEQ ID NO: 99271 - DNA, 20 bp, Artificial Sequence
  Description of Artificial Sequence: Synthetic oligonucleotide
  Target: ATXN1; (+) strand; PAM type: NRG; PAM sequence: AAG
attcttctttaatcacttca

SEQ ID NO: 99272 - DNA, 20 bp, Artificial Sequence
  Description of Artificial Sequence: Synthetic oligonucleotide
  Target: ATXN1; (+) strand; PAM type: NRG; PAM sequence: AGG
ttcttctttaatcacttcaa

SEQ ID NO: 99273 - DNA, 20 bp, Artificial Sequence
  Description of Artificial Sequence: Synthetic oligonucleotide
  Target: ATXN1; (+) strand; PAM type: NRG; PAM sequence: AAG
tctgcctttgcttcctacca

SEQ ID NO: 99274 - DNA, 20 bp, Artificial Sequence
  Description of Artificial Sequence: Synthetic oligonucleotide
  Target: ATXN1; (+) strand; PAM type: NRG; PAM sequence: AGG
ctgcctttgcttcctaccaa

SEQ ID NO: 99275 - DNA, 20 bp, Artificial Sequence
  Description of Artificial Sequence: Synthetic oligonucleotide
  Target: ATXN1; (+) strand; PAM type: NRG; PAM sequence: GAG
gcctttgcttcctaccaaag

SEQ ID NO: 99276 - DNA, 20 bp, Artificial Sequence
  Description of Artificial Sequence: Synthetic oligonucleotide
  Target: ATXN1; (+) strand; PAM type: NRG; PAM sequence: AAG
gagctgtgtcaccctgcgaa

SEQ ID NO: 99277 - DNA, 20 bp, Artificial Sequence
  Description of Artificial Sequence: Synthetic oligonucleotide
  Target: ATXN1; (+) strand; PAM type: NRG; PAM sequence: CAG
ctgcgaaaagatgccacgac

SEQ ID NO: 99278 - DNA, 20 bp, Artificial Sequence
  Description of Artificial Sequence: Synthetic oligonucleotide
  Target: ATXN1; (+) strand; PAM type: NRG; PAM sequence: CAG
aagatgccacgaccagatat

SEQ ID NO: 99279 - DNA, 20 bp, Artificial Sequence
  Description of Artificial Sequence: Synthetic oligonucleotide
  Target: ATXN1; (+) strand; PAM type: NRG; PAM sequence: TGG
tgccacgaccagatatcagc

SEQ ID NO: 99280 - DNA, 20 bp, Artificial Sequence
  Description of Artificial Sequence: Synthetic oligonucleotide
  Target: ATXN1; (+) strand; PAM type: NRG; PAM sequence: GGG
gccacgaccagatatcagct

SEQ ID NO: 99281 - DNA, 20 bp, Artificial Sequence
  Description of Artificial Sequence: Synthetic oligonucleotide
  Target: ATXN1; (+) strand; PAM type: NRG; PAM sequence: AAG
gatatcagctgggtccatga

SEQ ID NO: 99282 - DNA, 20 bp, Artificial Sequence
  Description of Artificial Sequence: Synthetic oligonucleotide
  Target: ATXN1; (+) strand; PAM type: NRG; PAM sequence: GAG
cagctgggtccatgaaagct

SEQ ID NO: 99283 - DNA, 20 bp, Artificial Sequence
  Description of Artificial Sequence: Synthetic oligonucleotide
  Target: ATXN1; (+) strand; PAM type: NRG; PAM sequence: AGG
agctgggtccatgaaagctg

SEQ ID NO: 99284 - DNA, 20 bp, Artificial Sequence
  Description of Artificial Sequence: Synthetic oligonucleotide
  Target: ATXN1; (+) strand; PAM type: NRG; PAM sequence: TGG
tgggtccatgaaagctgagg

SEQ ID NO: 99285 - DNA, 20 bp, Artificial Sequence
  Description of Artificial Sequence: Synthetic oligonucleotide
  Target: ATXN1; (+) strand; PAM type: NRG; PAM sequence: GGG
gggtccatgaaagctgaggt

SEQ ID NO: 99286 - DNA, 20 bp, Artificial Sequence
  Description of Artificial Sequence: Synthetic oligonucleotide
  Target: ATXN1; (+) strand; PAM type: NRG; PAM sequence: GAG
gtccatgaaagctgaggtgg

SEQ ID NO: 99287 - DNA, 20 bp, Artificial Sequence
  Description of Artificial Sequence: Synthetic oligonucleotide
  Target: ATXN1; (+) strand; PAM type: NRG; PAM sequence: CGG
catgaaagctgaggtgggag

SEQ ID NO: 99288 - DNA, 20 bp, Artificial Sequence
  Description of Artificial Sequence: Synthetic oligonucleotide
  Target: ATXN1; (+) strand; PAM type: NRG; PAM sequence: AAG
gaaagctgaggtgggagcgg

SEQ ID NO: 99289 - DNA, 20 bp, Artificial Sequence
  Description of Artificial Sequence: Synthetic oligonucleotide
  Target: ATXN1; (+) strand; PAM type: NRG; PAM sequence: CAG
ggtgggagcggaagattatt

SEQ ID NO: 99290 - DNA, 20 bp, Artificial Sequence
  Description of Artificial Sequence: Synthetic oligonucleotide
  Target: ATXN1; (+) strand; PAM type: NRG; PAM sequence: TAG
ttcagataatctgatcattg

SEQ ID NO: 99291 - DNA, 20 bp, Artificial Sequence
  Description of Artificial Sequence: Synthetic oligonucleotide
  Target: ATXN1; (+) strand; PAM type: NRG; PAM sequence: AGG
tcagataatctgatcattgt

SEQ ID NO: 99292 - DNA, 20 bp, Artificial Sequence
  Description of Artificial Sequence: Synthetic oligonucleotide
  Target: ATXN1; (+) strand; PAM type: NRG; PAM sequence: CAG
taatctgatcattgtaggca

SEQ ID NO: 99293 - DNA, 20 bp, Artificial Sequence
  Description of Artificial Sequence: Synthetic oligonucleotide
  Target: ATXN1; (+) strand; PAM type: NRG; PAM sequence: CGG
tgatcattgtaggcacagat

SEQ ID NO: 99294 - DNA, 20 bp, Artificial Sequence
  Description of Artificial Sequence: Synthetic oligonucleotide
  Target: ATXN1; (+) strand; PAM type: NRG; PAM sequence: TAG
cattgtaggcacagatcgga

SEQ ID NO: 99295 - DNA, 20 bp, Artificial Sequence
  Description of Artificial Sequence: Synthetic oligonucleotide
  Target: ATXN1; (+) strand; PAM type: NRG; PAM sequence: CAG
gcacagatcggatagcttgc

SEQ ID NO: 99296 - DNA, 20 bp, Artificial Sequence
  Description of Artificial Sequence: Synthetic oligonucleotide
  Target: ATXN1; (+) strand; PAM type: NRG; PAM sequence: TAG
atagcttgccagcccaatgc

SEQ ID NO: 99297 - DNA, 20 bp, Artificial Sequence
  Description of Artificial Sequence: Synthetic oligonucleotide
  Target: ATXN1; (+) strand; PAM type: NRG; PAM sequence: TAG
ctagttttctcctcactaat

SEQ ID NO: 99298 - DNA, 20 bp, Artificial Sequence
  Description of Artificial Sequence: Synthetic oligonucleotide
  Target: ATXN1; (+) strand; PAM type: NRG; PAM sequence: TAG
actaattagtgtgaactacc

SEQ ID NO: 99299 - DNA, 20 bp, Artificial Sequence
  Description of Artificial Sequence: Synthetic oligonucleotide
  Target: ATXN1; (+) strand; PAM type: NRG; PAM sequence: TGG
acaatgtactttttccccct

SEQ ID NO: 99300 - DNA, 20 bp, Artificial Sequence
  Description of Artificial Sequence: Synthetic oligonucleotide
  Target: ATXN1; (+) strand; PAM type: NRG; PAM sequence: GGG
caatgtactttttccccctt

SEQ ID NO: 99301 - DNA, 20 bp, Artificial Sequence
  Description of Artificial Sequence: Synthetic oligonucleotide
  Target: ATXN1; (+) strand; PAM type: NRG; PAM sequence: GGG
aatgtactttttcccccttg

SEQ ID NO: 99302 - DNA, 20 bp, Artificial Sequence
  Description of Artificial Sequence: Synthetic oligonucleotide
  Target: ATXN1; (+) strand; PAM type: NRG; PAM sequence: GAG
cccttggggtctgaatgtat

SEQ ID NO: 99303 - DNA, 20 bp, Artificial Sequence
  Description of Artificial Sequence: Synthetic oligonucleotide
  Target: ATXN1; (+) strand; PAM type: NRG; PAM sequence: AAG
ttggggtctgaatgtatgag

SEQ ID NO: 99304 - DNA, 20 bp, Artificial Sequence
  Description of Artificial Sequence: Synthetic oligonucleotide
  Target: ATXN1; (+) strand; PAM type: NRG; PAM sequence: AAG
gaatgtatgagaagtaaaat

SEQ ID NO: 99305 - DNA, 20 bp, Artificial Sequence
  Description of Artificial Sequence: Synthetic oligonucleotide
  Target: ATXN1; (+) strand; PAM type: NRG; PAM sequence: AGG
aatgtatgagaagtaaaata

SEQ ID NO: 99306 - DNA, 20 bp, Artificial Sequence
  Description of Artificial Sequence: Synthetic oligonucleotide
  Target: ATXN1; (+) strand; PAM type: NRG; PAM sequence: TGG
taaggtttttttcccttctt

SEQ ID NO: 99307 - DNA, 20 bp, Artificial Sequence
  Description of Artificial Sequence: Synthetic oligonucleotide
  Target: ATXN1; (+) strand; PAM type: NRG; PAM sequence: AAG
ttttttcccttctttggtga

SEQ ID NO: 99308 - DNA, 20 bp, Artificial Sequence
  Description of Artificial Sequence: Synthetic oligonucleotide
  Target: ATXN1; (+) strand; PAM type: NRG; PAM sequence: TAG
cttgttgcacacatctcaaa

SEQ ID NO: 99309 - DNA, 20 bp, Artificial Sequence
  Description of Artificial Sequence: Synthetic oligonucleotide
  Target: ATXN1; (+) strand; PAM type: NRG; PAM sequence: AGG
ttgttgcacacatctcaaat

SEQ ID NO: 99310 - DNA, 20 bp, Artificial Sequence
  Description of Artificial Sequence: Synthetic oligonucleotide
  Target: ATXN1; (+) strand; PAM type: NRG; PAM sequence: AAG
catctcaaataggtacactc

SEQ ID NO: 99311 - DNA, 20 bp, Artificial Sequence
  Description of Artificial Sequence: Synthetic oligonucleotide
  Target: ATXN1; (+) strand; PAM type: NRG; PAM sequence: TAG
taggtacactcaagcattca

SEQ ID NO: 99312 - DNA, 20 bp, Artificial Sequence
  Description of Artificial Sequence: Synthetic oligonucleotide
  Target: ATXN1; (+) strand; PAM type: NRG; PAM sequence: TAG
atctatctttattttataat

SEQ ID NO: 99313 - DNA, 20 bp, Artificial Sequence
  Description of Artificial Sequence: Synthetic oligonucleotide
  Target: ATXN1; (+) strand; PAM type: NRG; PAM sequence: AGG
tctatctttattttataatt

SEQ ID NO: 99314 - DNA, 20 bp, Artificial Sequence
  Description of Artificial Sequence: Synthetic oligonucleotide
  Target: ATXN1; (+) strand; PAM type: NRG; PAM sequence: AAG
tttataattaggtttgtcat

SEQ ID NO: 99315 - DNA, 20 bp, Artificial Sequence
  Description of Artificial Sequence: Synthetic oligonucleotide
  Target: ATXN1; (+) strand; PAM type: NRG; PAM sequence: AGG
ttataattaggtttgtcata

SEQ ID NO: 99316 - DNA, 20 bp, Artificial Sequence
  Description of Artificial Sequence: Synthetic oligonucleotide
  Target: ATXN1; (+) strand; PAM type: NRG; PAM sequence: AAG
taaggatataaacattctta

SEQ ID NO: 99317 - DNA, 20 bp, Artificial Sequence
  Description of Artificial Sequence: Synthetic oligonucleotide
  Target: ATXN1; (+) strand; PAM type: NRG; PAM sequence: AGG
aaggatataaacattcttaa

SEQ ID NO: 99318 - DNA, 20 bp, Artificial Sequence
  Description of Artificial Sequence: Synthetic oligonucleotide
  Target: ATXN1; (+) strand; PAM type: NRG; PAM sequence: AAG
ctgatcattaaccgttaatg

SEQ ID NO: 99319 - DNA, 20 bp, Artificial Sequence
  Description of Artificial Sequence: Synthetic oligonucleotide
  Target: ATXN1; (+) strand; PAM type: NRG; PAM sequence: GAG
gttaatgaagaaatctcact

SEQ ID NO: 99320 - DNA, 20 bp, Artificial Sequence
  Description of Artificial Sequence: Synthetic oligonucleotide
  Target: ATXN1; (+) strand; PAM type: NRG; PAM sequence: AGG
ttaatgaagaaatctcactg

SEQ ID NO: 99321 - DNA, 20 bp, Artificial Sequence
  Description of Artificial Sequence: Synthetic oligonucleotide
  Target: ATXN1; (+) strand; PAM type: NRG; PAM sequence: GGG
taatgaagaaatctcactga

SEQ ID NO: 99322 - DNA, 20 bp, Artificial Sequence
  Description of Artificial Sequence: Synthetic oligonucleotide
  Target: ATXN1; (+) strand; PAM type: NRG; PAM sequence: GGG
aatgaagaaatctcactgag

SEQ ID NO: 99323 - DNA, 20 bp, Artificial Sequence
  Description of Artificial Sequence: Synthetic oligonucleotide
  Target: ATXN1; (+) strand; PAM type: NRG; PAM sequence: CAG
aatctcactgaggggtttct

SEQ ID NO: 99324 - DNA, 20 bp, Artificial Sequence
  Description of Artificial Sequence: Synthetic oligonucleotide
  Target: ATXN1; (+) strand; PAM type: NRG; PAM sequence: GAG
tcactgaggggtttctcagt

SEQ ID NO: 99325 - DNA, 20 bp, Artificial Sequence
  Description of Artificial Sequence: Synthetic oligonucleotide
  Target: ATXN1; (+) strand; PAM type: NRG; PAM sequence: TGG
tctgttgcttgaaattccct

SEQ ID NO: 99326 - DNA, 20 bp, Artificial Sequence
  Description of Artificial Sequence: Synthetic oligonucleotide
  Target: ATXN1; (+) strand; PAM type: NRG; PAM sequence: GAG
tgttgcttgaaattcccttg

SEQ ID NO: 99327 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaaattcccttgga

SEQ ID NO: 99328 - DNA, 20 bp, Artificial Sequence
  Description of Artificial Sequence: Synthetic oligonucleotide
  Target: ATXN1; (+) strand; PAM type: NRG; PAM sequence: AGG
tgcttgaaattcccttggag

SEQ ID NO: 99329 - DNA, 20 bp, Artificial Sequence
  Description of Artificial Sequence: Synthetic oligonucleotide
  Target: ATXN1; (+) strand; PAM type: NRG; PAM sequence: GAG
cttgaaattcccttggagag

SEQ ID NO: 99330 - DNA, 20 bp, Artificial Sequence
  Description of Artificial Sequence: Synthetic oligonucleotide
  Target: ATXN1; (+) strand; PAM type: NRG; PAM sequence: CAG
tcaaaacatgctgtcaatgc

SEQ ID NO: 99331 - DNA, 20 bp, Artificial Sequence
  Description of Artificial Sequence: Synthetic oligonucleotide
  Target: ATXN1; (+) strand; PAM type: NRG; PAM sequence: CGG
aaacatgctgtcaatgccag

SEQ ID NO: 99332 - DNA, 20 bp, Artificial Sequence
  Description of Artificial Sequence: Synthetic oligonucleotide
  Target: ATXN1; (+) strand; PAM type: NRG; PAM sequence: GGG
aacatgctgtcaatgccagc

SEQ ID NO: 99333 - DNA, 20 bp, Artificial Sequence
  Description of Artificial Sequence: Synthetic oligonucleotide
  Target: ATXN1; (+) strand; PAM type: NRG; PAM sequence: GGG
acatgctgtcaatgccagcg

SEQ ID NO: 99334 - DNA, 20 bp, Artificial Sequence
  Description of Artificial Sequence: Synthetic oligonucleotide
  Target: ATXN1; (+) strand; PAM type: NRG; PAM sequence: TGG
ctgtcaatgccagcggggac

SEQ ID NO: 99335 - DNA, 20 bp, Artificial Sequence
  Description of Artificial Sequence: Synthetic oligonucleotide
  Target: ATXN1; (+) strand; PAM type: NRG; PAM sequence: TGG
aatgccagcggggactggtt

SEQ ID NO: 99336 - DNA, 20 bp, Artificial Sequence
  Description of Artificial Sequence: Synthetic oligonucleotide
  Target: ATXN1; (+) strand; PAM type: NRG; PAM sequence: CAG
ggactggtttggatgtgaaa

SEQ ID NO: 99337 - DNA, 20 bp, Artificial Sequence
  Description of Artificial Sequence: Synthetic oligonucleotide
  Target: ATXN1; (+) strand; PAM type: NRG; PAM sequence: GAG
actggtttggatgtgaaaca

SEQ ID NO: 99338 - DNA, 20 bp, Artificial Sequence
  Description of Artificial Sequence: Synthetic oligonucleotide
  Target: ATXN1; (+) strand; PAM type: NRG; PAM sequence: CGG
gtttggatgtgaaacagaga

SEQ ID NO: 99339 - DNA, 20 bp, Artificial Sequence
  Description of Artificial Sequence: Synthetic oligonucleotide
  Target: ATXN1; (+) strand; PAM type: NRG; PAM sequence: TAG
acagagacggtgtgattttg

SEQ ID NO: 99340 - DNA, 20 bp, Artificial Sequence
  Description of Artificial Sequence: Synthetic oligonucleotide
  Target: ATXN1; (+) strand; PAM type: NRG; PAM sequence: AGG
cagagacggtgtgattttgt

SEQ ID NO: 99341 - DNA, 20 bp, Artificial Sequence
  Description of Artificial Sequence: Synthetic oligonucleotide
  Target: ATXN1; (+) strand; PAM type: NRG; PAM sequence: TGG
aggatgatgtcatcttcaac

SEQ ID NO: 99342 - DNA, 20 bp, Artificial Sequence
  Description of Artificial Sequence: Synthetic oligonucleotide
  Target: ATXN1; (+) strand; PAM type: NRG; PAM sequence: AAG
tcatcttcaactggaacaat

SEQ ID NO: 99343 - DNA, 20 bp, Artificial Sequence
  Description of Artificial Sequence: Synthetic oligonucleotide
  Target: ATXN1; (+) strand; PAM type: NRG; PAM sequence: TGG
ccttgaatttaaaacccata

SEQ ID NO: 99344 - DNA, 20 bp, Artificial Sequence
  Description of Artificial Sequence: Synthetic oligonucleotide
  Target: ATXN1; (+) strand; PAM type: NRG; PAM sequence: GGG
cttgaatttaaaacccatat

SEQ ID NO: 99345 - DNA, 20 bp, Artificial Sequence
  Description of Artificial Sequence: Synthetic oligonucleotide
  Target: ATXN1; (+) strand; PAM type: NRG; PAM sequence: TAG
ggtattctctatgatgctga

SEQ ID NO: 99346 - DNA, 20 bp, Artificial Sequence
  Description of Artificial Sequence: Synthetic oligonucleotide
  Target: ATXN1; (+) strand; PAM type: NRG; PAM sequence: GAG
ttattattattttttttttt

SEQ ID NO: 99347 - DNA, 20 bp, Artificial Sequence
  Description of Artificial Sequence: Synthetic oligonucleotide
  Target: ATXN1; (+) strand; PAM type: NRG; PAM sequence: TGG
tattatttttttttttgaga

SEQ ID NO: 99348 - DNA, 20 bp, Artificial Sequence
  Description of Artificial Sequence: Synthetic oligonucleotide
  Target: ATXN1; (+) strand; PAM type: NRG; PAM sequence: GAG
ttatttttttttttgagatg

SEQ ID NO: 99349 - DNA, 20 bp, Artificial Sequence
  Description of Artificial Sequence: Synthetic oligonucleotide
  Target: ATXN1; (+) strand; PAM type: NRG; PAM sequence: CAG
tggagtcttgctctgttgcc

SEQ ID NO: 99350 - DNA, 20 bp, Artificial Sequence
  Description of Artificial Sequence: Synthetic oligonucleotide
  Target: ATXN1; (+) strand; PAM type: NRG; PAM sequence: AGG
ggagtcttgctctgttgccc

SEQ ID NO: 99351 - DNA, 20 bp, Artificial Sequence
  Description of Artificial Sequence: Synthetic oligonucleotide
  Target: ATXN1; (+) strand; PAM type: NRG; PAM sequence: TGG
tcttgctctgttgcccaggc

SEQ ID NO: 99352 - DNA, 20 bp, Artificial Sequence
  Description of Artificial Sequence: Synthetic oligonucleotide
  Target: ATXN1; (+) strand; PAM type: NRG; PAM sequence: TAG
ctgttgcccaggctggaatg

SEQ ID NO: 99353 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggaatgtag

SEQ ID NO: 99354 - DNA, 20 bp, Artificial Sequence
  Description of Artificial Sequence: Synthetic oligonucleotide
  Target: ATXN1; (+) strand; PAM type: NRG; PAM sequence: CGG
ggaatgtagtggcactatct

SEQ ID NO: 99355 - DNA, 20 bp, Artificial Sequence
  Description of Artificial Sequence: Synthetic oligonucleotide
  Target: ATXN1; (+) strand; PAM type: NRG; PAM sequence: TGG
tcactgcaaactccacctcc

SEQ ID NO: 99356 - DNA, 20 bp, Artificial Sequence
  Description of Artificial Sequence: Synthetic oligonucleotide
  Target: ATXN1; (+) strand; PAM type: NRG; PAM sequence: GGG
cactgcaaactccacctcct

SEQ ID NO: 99357 - DNA, 20 bp, Artificial Sequence
  Description of Artificial Sequence: Synthetic oligonucleotide
  Target: ATXN1; (+) strand; PAM type: NRG; PAM sequence: AAG
aaactccacctcctgggttc

SEQ ID NO: 99358 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 99359 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 99360 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccgag

SEQ ID NO: 99361 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtagc

SEQ ID NO: 99362 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgagtagct

SEQ ID NO: 99363 - DNA, 20 bp, Artificial Sequence
  Description of Artificial Sequence: Synthetic oligonucleotide
  Target: ATXN1; (+) strand; PAM type: NRG; PAM sequence: GAG
tcagcctcccgagtagctgg

SEQ ID NO: 99364 - DNA, 20 bp, Artificial Sequence
  Description of Artificial Sequence: Synthetic oligonucleotide
  Target: ATXN1; (+) strand; PAM type: NRG; PAM sequence: AGG
cagcctcccgagtagctggg

SEQ ID NO: 99365 - DNA, 20 bp, Artificial Sequence
  Description of Artificial Sequence: Synthetic oligonucleotide
  Target: ATXN1; (+) strand; PAM type: NRG; PAM sequence: AAG
cccgagtagctgggaggcat

SEQ ID NO: 99366 - DNA, 20 bp, Artificial Sequence
  Description of Artificial Sequence: Synthetic oligonucleotide
  Target: ATXN1; (+) strand; PAM type: NRG; PAM sequence: TGG
gaggcataagccaccacacc

SEQ ID NO: 99367 - DNA, 20 bp, Artificial Sequence
  Description of Artificial Sequence: Synthetic oligonucleotide
  Target: ATXN1; (+) strand; PAM type: NRG; PAM sequence: TAG
ctggctaatttttgtatgtt

SEQ ID NO: 99368 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatgtttag

SEQ ID NO: 99369 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatgtttagta

SEQ ID NO: 99370 - DNA, 20 bp, Artificial Sequence
  Description of Artificial Sequence: Synthetic oligonucleotide
  Target: ATXN1; (+) strand; PAM type: NRG; PAM sequence: CGG
ttttgtatgtttagtagaga

SEQ ID NO: 99371 - DNA, 20 bp, Artificial Sequence
  Description of Artificial Sequence: Synthetic oligonucleotide
  Target: ATXN1; (+) strand; PAM type: NRG; PAM sequence: GGG
tttgtatgtttagtagagac

SEQ ID NO: 99372 - DNA, 20 bp, Artificial Sequence
  Description of Artificial Sequence: Synthetic oligonucleotide
  Target: ATXN1; (+) strand; PAM type: NRG; PAM sequence: GGG
ttgtatgtttagtagagacg

SEQ ID NO: 99373 - DNA, 20 bp, Artificial Sequence
  Description of Artificial Sequence: Synthetic oligonucleotide
  Target: ATXN1; (+) strand; PAM type: NRG; PAM sequence: TGG
gagacggggttttaccatgt

SEQ ID NO: 99374 - DNA, 20 bp, Artificial Sequence
  Description of Artificial Sequence: Synthetic oligonucleotide
  Target: ATXN1; (+) strand; PAM type: NRG; PAM sequence: CAG
cggggttttaccatgttggc

SEQ ID NO: 99375 - DNA, 20 bp, Artificial Sequence
  Description of Artificial Sequence: Synthetic oligonucleotide
  Target: ATXN1; (+) strand; PAM type: NRG; PAM sequence: AGG
ggggttttaccatgttggcc

SEQ ID NO: 99376 - DNA, 20 bp, Artificial Sequence
  Description of Artificial Sequence: Synthetic oligonucleotide
  Target: ATXN1; (+) strand; PAM type: NRG; PAM sequence: TGG
ttttaccatgttggccaggc

SEQ ID NO: 99377 - DNA, 20 bp, Artificial Sequence
  Description of Artificial Sequence: Synthetic oligonucleotide
  Target: ATXN1; (+) strand; PAM type: NRG; PAM sequence: AAG
ggtcttgaactcctgacctc

SEQ ID NO: 99378 - DNA, 20 bp, Artificial Sequence
  Description of Artificial Sequence: Synthetic oligonucleotide
  Target: ATXN1; (+) strand; PAM type: NRG; PAM sequence: TGG
ctcaagtgatctgcctgcct

SEQ ID NO: 99379 - DNA, 20 bp, Artificial Sequence
  Description of Artificial Sequence: Synthetic oligonucleotide
  Target: ATXN1; (+) strand; PAM type: NRG; PAM sequence: AAG
ctgcctgccttggcctccta

SEQ ID NO: 99380 - DNA, 20 bp, Artificial Sequence
  Description of Artificial Sequence: Synthetic oligonucleotide
  Target: ATXN1; (+) strand; PAM type: NRG; PAM sequence: TGG
gccttggcctcctaaagtgc

SEQ ID NO: 99381 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcctaaagtgct

SEQ ID NO: 99382 - DNA, 20 bp, Artificial Sequence
  Description of Artificial Sequence: Synthetic oligonucleotide
  Target: ATXN1; (+) strand; PAM type: NRG; PAM sequence: CAG
ctcctaaagtgctgggatta

SEQ ID NO: 99383 - DNA, 20 bp, Artificial Sequence
  Description of Artificial Sequence: Synthetic oligonucleotide
  Target: ATXN1; (+) strand; PAM type: NRG; PAM sequence: AGG
tcctaaagtgctgggattac

SEQ ID NO: 99384 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 99385 - DNA, 20 bp, Artificial Sequence
  Description of Artificial Sequence: Synthetic oligonucleotide
  Target: ATXN1; (+) strand; PAM type: NRG; PAM sequence: CGG
caggtgtgagccaccgtgcc

SEQ ID NO: 99386 - DNA, 20 bp, Artificial Sequence
  Description of Artificial Sequence: Synthetic oligonucleotide
  Target: ATXN1; (+) strand; PAM type: NRG; PAM sequence: GAG
cccggcctcaaaatattatt

SEQ ID NO: 99387 - DNA, 20 bp, Artificial Sequence
  Description of Artificial Sequence: Synthetic oligonucleotide
  Target: ATXN1; (+) strand; PAM type: NRG; PAM sequence: AGG
ccggcctcaaaatattattg

SEQ ID NO: 99388 - DNA, 20 bp, Artificial Sequence
  Description of Artificial Sequence: Synthetic oligonucleotide
  Target: ATXN1; (+) strand; PAM type: NRG; PAM sequence: GGG
cggcctcaaaatattattga

SEQ ID NO: 99389 - DNA, 20 bp, Artificial Sequence
  Description of Artificial Sequence: Synthetic oligonucleotide
  Target: ATXN1; (+) strand; PAM type: NRG; PAM sequence: CAG
gggttcctaatgatacattt

SEQ ID NO: 99390 - DNA, 20 bp, Artificial Sequence
  Description of Artificial Sequence: Synthetic oligonucleotide
  Target: ATXN1; (+) strand; PAM type: NRG; PAM sequence: AGG
ggttcctaatgatacatttc

SEQ ID NO: 99391 - DNA, 20 bp, Artificial Sequence
  Description of Artificial Sequence: Synthetic oligonucleotide
  Target: ATXN1; (+) strand; PAM type: NRG; PAM sequence: CAG
atgatacatttcaggctttc

SEQ ID NO: 99392 - DNA, 20 bp, Artificial Sequence
  Description of Artificial Sequence: Synthetic oligonucleotide
  Target: ATXN1; (+) strand; PAM type: NRG; PAM sequence: AAG
aggctttccagttttaataa

SEQ ID NO: 99393 - DNA, 20 bp, Artificial Sequence
  Description of Artificial Sequence: Synthetic oligonucleotide
  Target: ATXN1; (+) strand; PAM type: NRG; PAM sequence: AAG
agttttaataaaagttcaac

SEQ ID NO: 99394 - DNA, 20 bp, Artificial Sequence
  Description of Artificial Sequence: Synthetic oligonucleotide
  Target: ATXN1; (+) strand; PAM type: NRG; PAM sequence: GAG
aagttcaacaagtatacacc

SEQ ID NO: 99395 - DNA, 20 bp, Artificial Sequence
  Description of Artificial Sequence: Synthetic oligonucleotide
  Target: ATXN1; (+) strand; PAM type: NRG; PAM sequence: AAG
gtatacaccgagcacctgct

SEQ ID NO: 99396 - DNA, 20 bp, Artificial Sequence
  Description of Artificial Sequence: Synthetic oligonucleotide
  Target: ATXN1; (+) strand; PAM type: NRG; PAM sequence: TAG
accgagcacctgctaagtgt

SEQ ID NO: 99397 - DNA, 20 bp, Artificial Sequence
  Description of Artificial Sequence: Synthetic oligonucleotide
  Target: ATXN1; (+) strand; PAM type: NRG; PAM sequence: AGG
ccgagcacctgctaagtgtt

SEQ ID NO: 99398 - DNA, 20 bp, Artificial Sequence
  Description of Artificial Sequence: Synthetic oligonucleotide
  Target: ATXN1; (+) strand; PAM type: NRG; PAM sequence: TAG
ctgctaagtgttaggaacct

SEQ ID NO: 99399 - DNA, 20 bp, Artificial Sequence
  Description of Artificial Sequence: Synthetic oligonucleotide
  Target: ATXN1; (+) strand; PAM type: NRG; PAM sequence: AAG
ctaagtgttaggaaccttag

SEQ ID NO: 99400 - DNA, 20 bp, Artificial Sequence
  Description of Artificial Sequence: Synthetic oligonucleotide
  Target: ATXN1; (+) strand; PAM type: NRG; PAM sequence: GAG
aagtgttaggaaccttagaa

SEQ ID NO: 99401 - DNA, 20 bp, Artificial Sequence
  Description of Artificial Sequence: Synthetic oligonucleotide
  Target: ATXN1; (+) strand; PAM type: NRG; PAM sequence: TGG
aaccttagaagagtatctat

SEQ ID NO: 99402 - DNA, 20 bp, Artificial Sequence
  Description of Artificial Sequence: Synthetic oligonucleotide
  Target: ATXN1; (+) strand; PAM type: NRG; PAM sequence: AAG
tagaagagtatctattggtt

SEQ ID NO: 99403 - DNA, 20 bp, Artificial Sequence
  Description of Artificial Sequence: Synthetic oligonucleotide
  Target: ATXN1; (+) strand; PAM type: NRG; PAM sequence: TAG
agtatctattggttaagacc

SEQ ID NO: 99404 - DNA, 20 bp, Artificial Sequence
  Description of Artificial Sequence: Synthetic oligonucleotide
  Target: ATXN1; (+) strand; PAM type: NRG; PAM sequence: CAG
cctagtttcttgcctcccac

SEQ ID NO: 99405 - DNA, 20 bp, Artificial Sequence
  Description of Artificial Sequence: Synthetic oligonucleotide
  Target: ATXN1; (+) strand; PAM type: NRG; PAM sequence: AGG
ctagtttcttgcctcccacc

SEQ ID NO: 99406 - DNA, 20 bp, Artificial Sequence
  Description of Artificial Sequence: Synthetic oligonucleotide
  Target: ATXN1; (+) strand; PAM type: NRG; PAM sequence: GAG
agtttcttgcctcccaccag

SEQ ID NO: 99407 - DNA, 20 bp, Artificial Sequence
  Description of Artificial Sequence: Synthetic oligonucleotide
  Target: ATXN1; (+) strand; PAM type: NRG; PAM sequence: CAG
tcttgcctcccaccaggaga

SEQ ID NO: 99408 - DNA, 20 bp, Artificial Sequence
  Description of Artificial Sequence: Synthetic oligonucleotide
  Target: ATXN1; (+) strand; PAM type: NRG; PAM sequence: CGG
gacagaacatacacgcaaaa

SEQ ID NO: 99409 - DNA, 20 bp, Artificial Sequence
  Description of Artificial Sequence: Synthetic oligonucleotide
  Target: ATXN1; (+) strand; PAM type: NRG; PAM sequence: GGG
acagaacatacacgcaaaac

SEQ ID NO: 99410 - DNA, 20 bp, Artificial Sequence
  Description of Artificial Sequence: Synthetic oligonucleotide
  Target: ATXN1; (+) strand; PAM type: NRG; PAM sequence: TGG
acacgcaaaacgggtacatt

SEQ ID NO: 99411 - DNA, 20 bp, Artificial Sequence
  Description of Artificial Sequence: Synthetic oligonucleotide
  Target: ATXN1; (+) strand; PAM type: NRG; PAM sequence: CAG
aaacgggtacatttggacac

SEQ ID NO: 99412 - DNA, 20 bp, Artificial Sequence
  Description of Artificial Sequence: Synthetic oligonucleotide
  Target: ATXN1; (+) strand; PAM type: NRG; PAM sequence: CAG
actatccgatgacgtccact

SEQ ID NO: 99413 - DNA, 20 bp, Artificial Sequence
  Description of Artificial Sequence: Synthetic oligonucleotide
  Target: ATXN1; (+) strand; PAM type: NRG; PAM sequence: TGG
acgtccactcagatgtcgaa

SEQ ID NO: 99414 - DNA, 20 bp, Artificial Sequence
  Description of Artificial Sequence: Synthetic oligonucleotide
  Target: ATXN1; (+) strand; PAM type: NRG; PAM sequence: GGG
cgtccactcagatgtcgaat

SEQ ID NO: 99415 - DNA, 20 bp, Artificial Sequence
  Description of Artificial Sequence: Synthetic oligonucleotide
  Target: ATXN1; (+) strand; PAM type: NRG; PAM sequence: AAG
gaatgggcaactcaaactta

SEQ ID NO: 99416 - DNA, 20 bp, Artificial Sequence
  Description of Artificial Sequence: Synthetic oligonucleotide
  Target: ATXN1; (+) strand; PAM type: NRG; PAM sequence: CAG
taaagtgacctaaaacacac

SEQ ID NO: 99417 - DNA, 20 bp, Artificial Sequence
  Description of Artificial Sequence: Synthetic oligonucleotide
  Target: ATXN1; (+) strand; PAM type: NRG; PAM sequence: CGG
cctcccgatgtgcccctgcc

SEQ ID NO: 99418 - DNA, 20 bp, Artificial Sequence
  Description of Artificial Sequence: Synthetic oligonucleotide
  Target: ATXN1; (+) strand; PAM type: NRG; PAM sequence: TGG
cccgatgtgcccctgcccgg

SEQ ID NO: 99419 - DNA, 20 bp, Artificial Sequence
  Description of Artificial Sequence: Synthetic oligonucleotide
  Target: ATXN1; (+) strand; PAM type: NRG; PAM sequence: TGG
ttcttccccatctccataaa

SEQ ID NO: 99420 - DNA, 20 bp, Artificial Sequence
  Description of Artificial Sequence: Synthetic oligonucleotide
  Target: ATXN1; (+) strand; PAM type: NRG; PAM sequence: CGG
taaatggtatcccattcttc

SEQ ID NO: 99421 - DNA, 20 bp, Artificial Sequence
  Description of Artificial Sequence: Synthetic oligonucleotide
  Target: ATXN1; (+) strand; PAM type: NRG; PAM sequence: AAG
attcttccggctgttcaatc

SEQ ID NO: 99422 - DNA, 20 bp, Artificial Sequence
  Description of Artificial Sequence: Synthetic oligonucleotide
  Target: ATXN1; (+) strand; PAM type: NRG; PAM sequence: TGG
ggctgttcaatcaagcacct

SEQ ID NO: 99423 - DNA, 20 bp, Artificial Sequence
  Description of Artificial Sequence: Synthetic oligonucleotide
  Target: ATXN1; (+) strand; PAM type: NRG; PAM sequence: AAG
atcacaaacatcccaattat

SEQ ID NO: 99424 - DNA, 20 bp, Artificial Sequence
  Description of Artificial Sequence: Synthetic oligonucleotide
  Target: ATXN1; (+) strand; PAM type: NRG; PAM sequence: TGG
ccaattataagcaaactgta

SEQ ID NO: 99425 - DNA, 20 bp, Artificial Sequence
  Description of Artificial Sequence: Synthetic oligonucleotide
  Target: ATXN1; (+) strand; PAM type: NRG; PAM sequence: GGG
caattataagcaaactgtat

SEQ ID NO: 99426 - DNA, 20 bp, Artificial Sequence
  Description of Artificial Sequence: Synthetic oligonucleotide
  Target: ATXN1; (+) strand; PAM type: NRG; PAM sequence: TAG
gttccttttccaaatacacc

SEQ ID NO: 99427 - DNA, 20 bp, Artificial Sequence
  Description of Artificial Sequence: Synthetic oligonucleotide
  Target: ATXN1; (+) strand; PAM type: NRG; PAM sequence: TGG
tacctccaccacctttgtcc

SEQ ID NO: 99428 - DNA, 20 bp, Artificial Sequence
  Description of Artificial Sequence: Synthetic oligonucleotide
  Target: ATXN1; (+) strand; PAM type: NRG; PAM sequence: AAG
ccaccacctttgtcctggcc

SEQ ID NO: 99429 - DNA, 20 bp, Artificial Sequence
  Description of Artificial Sequence: Synthetic oligonucleotide
  Target: ATXN1; (+) strand; PAM type: NRG; PAM sequence: CGG
caagctgcatctcactcgct

SEQ ID NO: 99430 - DNA, 20 bp, Artificial Sequence
  Description of Artificial Sequence: Synthetic oligonucleotide
  Target: ATXN1; (+) strand; PAM type: NRG; PAM sequence: AAG
ctcgctcggtcaccacatgc

SEQ ID NO: 99431 - DNA, 20 bp, Artificial Sequence
  Description of Artificial Sequence: Synthetic oligonucleotide
  Target: ATXN1; (+) strand; PAM type: NRG; PAM sequence: TGG
caccacatgcaagcctgatg

SEQ ID NO: 99432 - DNA, 20 bp, Artificial Sequence
  Description of Artificial Sequence: Synthetic oligonucleotide
  Target: ATXN1; (+) strand; PAM type: NRG; PAM sequence: TAG
gccccttactccctacactg

SEQ ID NO: 99433 - DNA, 20 bp, Artificial Sequence
  Description of Artificial Sequence: Synthetic oligonucleotide
  Target: ATXN1; (+) strand; PAM type: NRG; PAM sequence: CAG
tactccctacactgtagcaa

SEQ ID NO: 99434 - DNA, 20 bp, Artificial Sequence
  Description of Artificial Sequence: Synthetic oligonucleotide
  Target: ATXN1; (+) strand; PAM type: NRG; PAM sequence: TGG
tccctacactgtagcaacag

SEQ ID NO: 99435 - DNA, 20 bp, Artificial Sequence
  Description of Artificial Sequence: Synthetic oligonucleotide
  Target: ATXN1; (+) strand; PAM type: NRG; PAM sequence: TGG
agcaacagtggtctccttgc

SEQ ID NO: 99436 - DNA, 20 bp, Artificial Sequence
  Description of Artificial Sequence: Synthetic oligonucleotide
  Target: ATXN1; (+) strand; PAM type: NRG; PAM sequence: TGG
cccctcttgcgccttccgtc

SEQ ID NO: 99437 - DNA, 20 bp, Artificial Sequence
  Description of Artificial Sequence: Synthetic oligonucleotide
  Target: ATXN1; (+) strand; PAM type: NRG; PAM sequence: GGG
ccctcttgcgccttccgtct

SEQ ID NO: 99438 - DNA, 20 bp, Artificial Sequence
  Description of Artificial Sequence: Synthetic oligonucleotide
  Target: ATXN1; (+) strand; PAM type: NRG; PAM sequence: TGG
tgctactctctccattcatt

SEQ ID NO: 99439 - DNA, 20 bp, Artificial Sequence
  Description of Artificial Sequence: Synthetic oligonucleotide
  Target: ATXN1; (+) strand; PAM type: NRG; PAM sequence: CAG
ttgccacccactgtcctttt

SEQ ID NO: 99440 - DNA, 20 bp, Artificial Sequence
  Description of Artificial Sequence: Synthetic oligonucleotide
  Target: ATXN1; (+) strand; PAM type: NRG; PAM sequence: GAG
gccacccactgtccttttca

SEQ ID NO: 99441 - DNA, 20 bp, Artificial Sequence
  Description of Artificial Sequence: Synthetic oligonucleotide
  Target: ATXN1; (+) strand; PAM type: NRG; PAM sequence: GAG
cacccactgtccttttcaga

SEQ ID NO: 99442 - DNA, 20 bp, Artificial Sequence
  Description of Artificial Sequence: Synthetic oligonucleotide
  Target: ATXN1; (+) strand; PAM type: NRG; PAM sequence: CAG
ttcagagagaactcccctga

SEQ ID NO: 99443 - DNA, 20 bp, Artificial Sequence
  Description of Artificial Sequence: Synthetic oligonucleotide
  Target: ATXN1; (+) strand; PAM type: NRG; PAM sequence: TAG
tatttaaaataacaaccctc

SEQ ID NO: 99444 - DNA, 20 bp, Artificial Sequence
  Description of Artificial Sequence: Synthetic oligonucleotide
  Target: ATXN1; (+) strand; PAM type: NRG; PAM sequence: TAG
taacaaccctctagtttcca

SEQ ID NO: 99445 - DNA, 20 bp, Artificial Sequence
  Description of Artificial Sequence: Synthetic oligonucleotide
  Target: ATXN1; (+) strand; PAM type: NRG; PAM sequence: GAG
tagcttcctttttttatttt

SEQ ID NO: 99446 - DNA, 20 bp, Artificial Sequence
  Description of Artificial Sequence: Synthetic oligonucleotide
  Target: ATXN1; (+) strand; PAM type: NRG; PAM sequence: TAG
ttcctttttttattttgaga

SEQ ID NO: 99447 - DNA, 20 bp, Artificial Sequence
  Description of Artificial Sequence: Synthetic oligonucleotide
  Target: ATXN1; (+) strand; PAM type: NRG; PAM sequence: AGG
tcctttttttattttgagat

SEQ ID NO: 99448 - DNA, 20 bp, Artificial Sequence
  Description of Artificial Sequence: Synthetic oligonucleotide
  Target: ATXN1; (+) strand; PAM type: NRG; PAM sequence: GGG
cctttttttattttgagata

SEQ ID NO: 99449 - DNA, 20 bp, Artificial Sequence
  Description of Artificial Sequence: Synthetic oligonucleotide
  Target: ATXN1; (+) strand; PAM type: NRG; PAM sequence: CAG
tagggtcttgttctgttgcc

SEQ ID NO: 99450 - DNA, 20 bp, Artificial Sequence
  Description of Artificial Sequence: Synthetic oligonucleotide
  Target: ATXN1; (+) strand; PAM type: NRG; PAM sequence: AGG
agggtcttgttctgttgccc

SEQ ID NO: 99451 - DNA, 20 bp, Artificial Sequence
  Description of Artificial Sequence: Synthetic oligonucleotide
  Target: ATXN1; (+) strand; PAM type: NRG; PAM sequence: TGG
tcttgttctgttgcccaggc

SEQ ID NO: 99452 - DNA, 20 bp, Artificial Sequence
  Description of Artificial Sequence: Synthetic oligonucleotide
  Target: ATXN1; (+) strand; PAM type: NRG; PAM sequence: GAG
ttgttctgttgcccaggctg

SEQ ID NO: 99453 - DNA, 20 bp, Artificial Sequence
  Description of Artificial Sequence: Synthetic oligonucleotide
  Target: ATXN1; (+) strand; PAM type: NRG; PAM sequence: CAG
ctgttgcccaggctggagta

SEQ ID NO: 99454 - DNA, 20 bp, Artificial Sequence
  Description of Artificial Sequence: Synthetic oligonucleotide
  Target: ATXN1; (+) strand; PAM type: NRG; PAM sequence: TAG
ttgcccaggctggagtacag

SEQ ID NO: 99455 - DNA, 20 bp, Artificial Sequence
  Description of Artificial Sequence: Synthetic oligonucleotide
  Target: ATXN1; (+) strand; PAM type: NRG; PAM sequence: TGG
ggagtacagtagcatgatca

SEQ ID NO: 99456 - DNA, 20 bp, Artificial Sequence
  Description of Artificial Sequence: Synthetic oligonucleotide
  Target: ATXN1; (+) strand; PAM type: NRG; PAM sequence: CAG
agcatgatcatggctcactg

SEQ ID NO: 99457 - DNA, 20 bp, Artificial Sequence
  Description of Artificial Sequence: Synthetic oligonucleotide
  Target: ATXN1; (+) strand; PAM type: NRG; PAM sequence: TGG
tcactgcagccttgacctcg

SEQ ID NO: 99458 - DNA, 20 bp, Artificial Sequence
  Description of Artificial Sequence: Synthetic oligonucleotide
  Target: ATXN1; (+) strand; PAM type: NRG; PAM sequence: GGG
cactgcagccttgacctcgt

SEQ ID NO: 99459 - DNA, 20 bp, Artificial Sequence
  Description of Artificial Sequence: Synthetic oligonucleotide
  Target: ATXN1; (+) strand; PAM type: NRG; PAM sequence: AAG
agccttgacctcgtgggctc

SEQ ID NO: 99460 - DNA, 20 bp, Artificial Sequence
  Description of Artificial Sequence: Synthetic oligonucleotide
  Target: ATXN1; (+) strand; PAM type: NRG; PAM sequence: CAG
ctcaagatatcttcctgcct

SEQ ID NO: 99461 - DNA, 20 bp, Artificial Sequence
  Description of Artificial Sequence: Synthetic oligonucleotide
  Target: ATXN1; (+) strand; PAM type: NRG; PAM sequence: GAG
tcttcctgcctcagccgcct

SEQ ID NO: 99462 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagccgcctgag

SEQ ID NO: 99463 - DNA, 20 bp, Artificial Sequence
  Description of Artificial Sequence: Synthetic oligonucleotide
  Target: ATXN1; (+) strand; PAM type: NRG; PAM sequence: TGG
gcctcagccgcctgagtagt

SEQ ID NO: 99464 - DNA, 20 bp, Artificial Sequence
  Description of Artificial Sequence: Synthetic oligonucleotide
  Target: ATXN1; (+) strand; PAM type: NRG; PAM sequence: GGG
cctcagccgcctgagtagtt

SEQ ID NO: 99465 - DNA, 20 bp, Artificial Sequence
  Description of Artificial Sequence: Synthetic oligonucleotide
  Target: ATXN1; (+) strand; PAM type: NRG; PAM sequence: CAG
catgcatgcaccaccatgtc

SEQ ID NO: 99466 - DNA, 20 bp, Artificial Sequence
  Description of Artificial Sequence: Synthetic oligonucleotide
  Target: ATXN1; (+) strand; PAM type: NRG; PAM sequence: TGG
atgtccagctaatgttttgt

SEQ ID NO: 99467 - DNA, 20 bp, Artificial Sequence
  Description of Artificial Sequence: Synthetic oligonucleotide
  Target: ATXN1; (+) strand; PAM type: NRG; PAM sequence: AAG
cagctaatgttttgttggtg

SEQ ID NO: 99468 - DNA, 20 bp, Artificial Sequence
  Description of Artificial Sequence: Synthetic oligonucleotide
  Target: ATXN1; (+) strand; PAM type: NRG; PAM sequence: TAG
agataatgatgatcattatg

SEQ ID NO: 99469 - DNA, 20 bp, Artificial Sequence
  Description of Artificial Sequence: Synthetic oligonucleotide
  Target: ATXN1; (+) strand; PAM type: NRG; PAM sequence: GAG
ataatgatgatcattatgta

SEQ ID NO: 99470 - DNA, 20 bp, Artificial Sequence
  Description of Artificial Sequence: Synthetic oligonucleotide
  Target: ATXN1; (+) strand; PAM type: NRG; PAM sequence: TGG
tgatgatcattatgtagaga

SEQ ID NO: 99471 - DNA, 20 bp, Artificial Sequence
  Description of Artificial Sequence: Synthetic oligonucleotide
  Target: ATXN1; (+) strand; PAM type: NRG; PAM sequence: GAG
atgatcattatgtagagatg

SEQ ID NO: 99472 - DNA, 20 bp, Artificial Sequence
  Description of Artificial Sequence: Synthetic oligonucleotide
  Target: ATXN1; (+) strand; PAM type: NRG; PAM sequence: TGG
gagatggagccttgctatgt

SEQ ID NO: 99473 - DNA, 20 bp, Artificial Sequence
  Description of Artificial Sequence: Synthetic oligonucleotide
  Target: ATXN1; (+) strand; PAM type: NRG; PAM sequence: TGG
ggagccttgctatgttggcc

SEQ ID NO: 99474 - DNA, 20 bp, Artificial Sequence
  Description of Artificial Sequence: Synthetic oligonucleotide
  Target: ATXN1; (+) strand; PAM type: NRG; PAM sequence: TGG
ccttgctatgttggcctggc

SEQ ID NO: 99475 - DNA, 20 bp, Artificial Sequence
  Description of Artificial Sequence: Synthetic oligonucleotide
  Target: ATXN1; (+) strand; PAM type: NRG; PAM sequence: TGG
ctggctggtttcaaaactcc

SEQ ID NO: 99476 - DNA, 20 bp, Artificial Sequence
  Description of Artificial Sequence: Synthetic oligonucleotide
  Target: ATXN1; (+) strand; PAM type: NRG; PAM sequence: AAG
gtttcaaaactcctggcctc

SEQ ID NO: 99477 - DNA, 20 bp, Artificial Sequence
  Description of Artificial Sequence: Synthetic oligonucleotide
  Target: ATXN1; (+) strand; PAM type: NRG; PAM sequence: CAG
cctcaagtgccctcttgcct

SEQ ID NO: 99478 - DNA, 20 bp, Artificial Sequence
  Description of Artificial Sequence: Synthetic oligonucleotide
  Target: ATXN1; (+) strand; PAM type: NRG; PAM sequence: AAG
cctcttgcctcagcctccca

SEQ ID NO: 99479 - DNA, 20 bp, Artificial Sequence
  Description of Artificial Sequence: Synthetic oligonucleotide
  Target: ATXN1; (+) strand; PAM type: NRG; PAM sequence: GAG
cctcagcctcccaaagtgct

SEQ ID NO: 99480 - DNA, 20 bp, Artificial Sequence
  Description of Artificial Sequence: Synthetic oligonucleotide
  Target: ATXN1; (+) strand; PAM type: NRG; PAM sequence: AAG
tcccaaagtgctgagattac

SEQ ID NO: 99481 - DNA, 20 bp, Artificial Sequence
  Description of Artificial Sequence: Synthetic oligonucleotide
  Target: ATXN1; (+) strand; PAM type: NRG; PAM sequence: GAG
agtgctgagattacaagcat

SEQ ID NO: 99482 - DNA, 20 bp, Artificial Sequence
  Description of Artificial Sequence: Synthetic oligonucleotide
  Target: ATXN1; (+) strand; PAM type: NRG; PAM sequence: TAG
gattacaagcatgagccacc

SEQ ID NO: 99483 - DNA, 20 bp, Artificial Sequence
  Description of Artificial Sequence: Synthetic oligonucleotide
  Target: ATXN1; (+) strand; PAM type: NRG; PAM sequence: TGG
caagcatgagccacctagcc

SEQ ID NO: 99484 - DNA, 20 bp, Artificial Sequence
  Description of Artificial Sequence: Synthetic oligonucleotide
  Target: ATXN1; (+) strand; PAM type: NRG; PAM sequence: CAG
gccccttctcctctttatac

SEQ ID NO: 99485 - DNA, 20 bp, Artificial Sequence
  Description of Artificial Sequence: Synthetic oligonucleotide
  Target: ATXN1; (+) strand; PAM type: NRG; PAM sequence: AGG
ccccttctcctctttatacc

SEQ ID NO: 99486 - DNA, 20 bp, Artificial Sequence
  Description of Artificial Sequence: Synthetic oligonucleotide
  Target: ATXN1; (+) strand; PAM type: NRG; PAM sequence: GGG
cccttctcctctttatacca

SEQ ID NO: 99487 - DNA, 20 bp, Artificial Sequence
  Description of Artificial Sequence: Synthetic oligonucleotide
  Target: ATXN1; (+) strand; PAM type: NRG; PAM sequence: CAG
taccagggatccccaacccc

SEQ ID NO: 99488 - DNA, 20 bp, Artificial Sequence
  Description of Artificial Sequence: Synthetic oligonucleotide
  Target: ATXN1; (+) strand; PAM type: NRG; PAM sequence: AGG
accagggatccccaaccccc

SEQ ID NO: 99489 - DNA, 20 bp, Artificial Sequence
  Description of Artificial Sequence: Synthetic oligonucleotide
  Target: ATXN1; (+) strand; PAM type: NRG; PAM sequence: CAG
gatccccaacccccaggcaa

SEQ ID NO: 99490 - DNA, 20 bp, Artificial Sequence
  Description of Artificial Sequence: Synthetic oligonucleotide
  Target: ATXN1; (+) strand; PAM type: NRG; PAM sequence: CAG
ccaacccccaggcaacagac

SEQ ID NO: 99491 - DNA, 20 bp, Artificial Sequence
  Description of Artificial Sequence: Synthetic oligonucleotide
  Target: ATXN1; (+) strand; PAM type: NRG; PAM sequence: TAG
acccccaggcaacagaccag

SEQ ID NO: 99492 - DNA, 20 bp, Artificial Sequence
  Description of Artificial Sequence: Synthetic oligonucleotide
  Target: ATXN1; (+) strand; PAM type: NRG; PAM sequence: CAG
cccaggcaacagaccagtag

SEQ ID NO: 99493 - DNA, 20 bp, Artificial Sequence
  Description of Artificial Sequence: Synthetic oligonucleotide
  Target: ATXN1; (+) strand; PAM type: NRG; PAM sequence: TGG
aacagaccagtagcagtcca

SEQ ID NO: 99494 - DNA, 20 bp, Artificial Sequence
  Description of Artificial Sequence: Synthetic oligonucleotide
  Target: ATXN1; (+) strand; PAM type: NRG; PAM sequence: TAG
agtagcagtccatggcctgt

SEQ ID NO: 99495 - DNA, 20 bp, Artificial Sequence
  Description of Artificial Sequence: Synthetic oligonucleotide
  Target: ATXN1; (+) strand; PAM type: NRG; PAM sequence: AGG
gtagcagtccatggcctgtt

SEQ ID NO: 99496 - DNA, 20 bp, Artificial Sequence
  Description of Artificial Sequence: Synthetic oligonucleotide
  Target: ATXN1; (+) strand; PAM type: NRG; PAM sequence: TGG
gtccatggcctgttaggtac

SEQ ID NO: 99497 - DNA, 20 bp, Artificial Sequence
  Description of Artificial Sequence: Synthetic oligonucleotide
  Target: ATXN1; (+) strand; PAM type: NRG; PAM sequence: GGG
tccatggcctgttaggtact

SEQ ID NO: 99498 - DNA, 20 bp, Artificial Sequence
  Description of Artificial Sequence: Synthetic oligonucleotide
  Target: ATXN1; (+) strand; PAM type: NRG; PAM sequence: CAG
ctgttaggtactgggctgca

SEQ ID NO: 99499 - DNA, 20 bp, Artificial Sequence
  Description of Artificial Sequence: Synthetic oligonucleotide
  Target: ATXN1; (+) strand; PAM type: NRG; PAM sequence: TGG
taggtactgggctgcacagc

SEQ ID NO: 99500 - DNA, 20 bp, Artificial Sequence
  Description of Artificial Sequence: Synthetic oligonucleotide
  Target: ATXN1; (+) strand; PAM type: NRG; PAM sequence: GAG
ggtactgggctgcacagctg

SEQ ID NO: 99501 - DNA, 20 bp, Artificial Sequence
  Description of Artificial Sequence: Synthetic oligonucleotide
  Target: ATXN1; (+) strand; PAM type: NRG; PAM sequence: AGG
gtactgggctgcacagctgg

SEQ ID NO: 99502 - DNA, 20 bp, Artificial Sequence
  Description of Artificial Sequence: Synthetic oligonucleotide
  Target: ATXN1; (+) strand; PAM type: NRG; PAM sequence: GAG
tgggctgcacagctggaggt

SEQ ID NO: 99503 - DNA, 20 bp, Artificial Sequence
  Description of Artificial Sequence: Synthetic oligonucleotide
  Target: ATXN1; (+) strand; PAM type: NRG; PAM sequence: CAG
ctggaggtgagcaaccattc

SEQ ID NO: 99504 - DNA, 20 bp, Artificial Sequence
  Description of Artificial Sequence: Synthetic oligonucleotide
  Target: ATXN1; (+) strand; PAM type: NRG; PAM sequence: GAG
gtgagcaaccattccagact

SEQ ID NO: 99505 - DNA, 20 bp, Artificial Sequence
  Description of Artificial Sequence: Synthetic oligonucleotide
  Target: ATXN1; (+) strand; PAM type: NRG; PAM sequence: CAG
gactgagctccgcctcctgt

SEQ ID NO: 99506 - DNA, 20 bp, Artificial Sequence
  Description of Artificial Sequence: Synthetic oligonucleotide
  Target: ATXN1; (+) strand; PAM type: NRG; PAM sequence: CAG
agctccgcctcctgtcagat

SEQ ID NO: 99507 - DNA, 20 bp, Artificial Sequence
  Description of Artificial Sequence: Synthetic oligonucleotide
  Target: ATXN1; (+) strand; PAM type: NRG; PAM sequence: AAG
cctcctgtcagatcagtcgc

SEQ ID NO: 99508 - DNA, 20 bp, Artificial Sequence
  Description of Artificial Sequence: Synthetic oligonucleotide
  Target: ATXN1; (+) strand; PAM type: NRG; PAM sequence: TAG
gtcagatcagtcgcaagcat

SEQ ID NO: 99509 - DNA, 20 bp, Artificial Sequence
  Description of Artificial Sequence: Synthetic oligonucleotide
  Target: ATXN1; (+) strand; PAM type: NRG; PAM sequence: TAG
tcgcaagcattagattctca

SEQ ID NO: 99510 - DNA, 20 bp, Artificial Sequence
  Description of Artificial Sequence: Synthetic oligonucleotide
  Target: ATXN1; (+) strand; PAM type: NRG; PAM sequence: AGG
cgcaagcattagattctcat

SEQ ID NO: 99511 - DNA, 20 bp, Artificial Sequence
  Description of Artificial Sequence: Synthetic oligonucleotide
  Target: ATXN1; (+) strand; PAM type: NRG; PAM sequence: GAG
caagcattagattctcatag

SEQ ID NO: 99512 - DNA, 20 bp, Artificial Sequence
  Description of Artificial Sequence: Synthetic oligonucleotide
  Target: ATXN1; (+) strand; PAM type: NRG; PAM sequence: AAG
ctattgtaaactgcgcatgc

SEQ ID NO: 99513 - DNA, 20 bp, Artificial Sequence
  Description of Artificial Sequence: Synthetic oligonucleotide
  Target: ATXN1; (+) strand; PAM type: NRG; PAM sequence: AGG
tattgtaaactgcgcatgca

SEQ ID NO: 99514 - DNA, 20 bp, Artificial Sequence
  Description of Artificial Sequence: Synthetic oligonucleotide
  Target: ATXN1; (+) strand; PAM type: NRG; PAM sequence: CAG
aactgcgcatgcaaggaatc

SEQ ID NO: 99515 - DNA, 20 bp, Artificial Sequence
  Description of Artificial Sequence: Synthetic oligonucleotide
  Target: ATXN1; (+) strand; PAM type: NRG; PAM sequence: AGG
actgcgcatgcaaggaatcc

SEQ ID NO: 99516 - DNA, 20 bp, Artificial Sequence
  Description of Artificial Sequence: Synthetic oligonucleotide
  Target: ATXN1; (+) strand; PAM type: NRG; PAM sequence: GAG
ccaggttgtgcactccttat

SEQ ID NO: 99517 - DNA, 20 bp, Artificial Sequence
  Description of Artificial Sequence: Synthetic oligonucleotide
  Target: ATXN1; (+) strand; PAM type: NRG; PAM sequence: GAG
taactaatgcctgatgatct

SEQ ID NO: 99518 - DNA, 20 bp, Artificial Sequence
  Description of Artificial Sequence: Synthetic oligonucleotide
  Target: ATXN1; (+) strand; PAM type: NRG; PAM sequence: AGG
aactaatgcctgatgatctg

SEQ ID NO: 99519 - DNA, 20 bp, Artificial Sequence
  Description of Artificial Sequence: Synthetic oligonucleotide
  Target: ATXN1; (+) strand; PAM type: NRG; PAM sequence: TGG
taatgcctgatgatctgagg

SEQ ID NO: 99520 - DNA, 20 bp, Artificial Sequence
  Description of Artificial Sequence: Synthetic oligonucleotide
  Target: ATXN1; (+) strand; PAM type: NRG; PAM sequence: CAG
cctgatgatctgaggtggaa

SEQ ID NO: 99521 - DNA, 20 bp, Artificial Sequence
  Description of Artificial Sequence: Synthetic oligonucleotide
  Target: ATXN1; (+) strand; PAM type: NRG; PAM sequence: CAG
aaaatcttcttccatgaaac

SEQ ID NO: 99522 - DNA, 20 bp, Artificial Sequence
  Description of Artificial Sequence: Synthetic oligonucleotide
  Target: ATXN1; (+) strand; PAM type: NRG; PAM sequence: TGG
tcttccatgaaaccagtccc

SEQ ID NO: 99523 - DNA, 20 bp, Artificial Sequence
  Description of Artificial Sequence: Synthetic oligonucleotide
  Target: ATXN1; (+) strand; PAM type: NRG; PAM sequence: AAG
aaaccagtccctggtgccaa

SEQ ID NO: 99524 - DNA, 20 bp, Artificial Sequence
  Description of Artificial Sequence: Synthetic oligonucleotide
  Target: ATXN1; (+) strand; PAM type: NRG; PAM sequence: AGG
aaccagtccctggtgccaaa

SEQ ID NO: 99525 - DNA, 20 bp, Artificial Sequence
  Description of Artificial Sequence: Synthetic oligonucleotide
  Target: ATXN1; (+) strand; PAM type: NRG; PAM sequence: GGG
accagtccctggtgccaaaa

SEQ ID NO: 99526 - DNA, 20 bp, Artificial Sequence
  Description of Artificial Sequence: Synthetic oligonucleotide
  Target: ATXN1; (+) strand; PAM type: NRG; PAM sequence: TGG
tccctggtgccaaaagggac

SEQ ID NO: 99527 - DNA, 20 bp, Artificial Sequence
  Description of Artificial Sequence: Synthetic oligonucleotide
  Target: ATXN1; (+) strand; PAM type: NRG; PAM sequence: CAG
tttgcctctttccccaaact

SEQ ID NO: 99528 - DNA, 20 bp, Artificial Sequence
  Description of Artificial Sequence: Synthetic oligonucleotide
  Target: ATXN1; (+) strand; PAM type: NRG; PAM sequence: CAG
caaactcagtgttctatctc

SEQ ID NO: 99529 - DNA, 20 bp, Artificial Sequence
  Description of Artificial Sequence: Synthetic oligonucleotide
  Target: ATXN1; (+) strand; PAM type: NRG; PAM sequence: GAG
aactcagtgttctatctcca

SEQ ID NO: 99530 - DNA, 20 bp, Artificial Sequence
  Description of Artificial Sequence: Synthetic oligonucleotide
  Target: ATXN1; (+) strand; PAM type: NRG; PAM sequence: AAG
gttctatctccagagtctaa

SEQ ID NO: 99531 - DNA, 20 bp, Artificial Sequence
  Description of Artificial Sequence: Synthetic oligonucleotide
  Target: ATXN1; (+) strand; PAM type: NRG; PAM sequence: TAG
ccagagtctaaaagacttcc

SEQ ID NO: 99532 - DNA, 20 bp, Artificial Sequence
  Description of Artificial Sequence: Synthetic oligonucleotide
  Target: ATXN1; (+) strand; PAM type: NRG; PAM sequence: AAG
agtctaaaagacttcctagc

SEQ ID NO: 99533 - DNA, 20 bp, Artificial Sequence
  Description of Artificial Sequence: Synthetic oligonucleotide
  Target: ATXN1; (+) strand; PAM type: NRG; PAM sequence: TAG
aaagacttcctagcaagtaa

SEQ ID NO: 99534 - DNA, 20 bp, Artificial Sequence
  Description of Artificial Sequence: Synthetic oligonucleotide
  Target: ATXN1; (+) strand; PAM type: NRG; PAM sequence: AGG
aagacttcctagcaagtaat

SEQ ID NO: 99535 - DNA, 20 bp, Artificial Sequence
  Description of Artificial Sequence: Synthetic oligonucleotide
  Target: ATXN1; (+) strand; PAM type: NRG; PAM sequence: CAG
cctagcaagtaataggtgct

SEQ ID NO: 99536 - DNA, 20 bp, Artificial Sequence
  Description of Artificial Sequence: Synthetic oligonucleotide
  Target: ATXN1; (+) strand; PAM type: NRG; PAM sequence: AAG
ggtgctcagttaaaatctga

SEQ ID NO: 99537 - DNA, 20 bp, Artificial Sequence
  Description of Artificial Sequence: Synthetic oligonucleotide
  Target: ATXN1; (+) strand; PAM type: NRG; PAM sequence: AAG
gctcagttaaaatctgaaag

SEQ ID NO: 99538 - DNA, 20 bp, Artificial Sequence
  Description of Artificial Sequence: Synthetic oligonucleotide
  Target: ATXN1; (+) strand; PAM type: NRG; PAM sequence: GAG
tcagttaaaatctgaaagaa

SEQ ID NO: 99539 - DNA, 20 bp, Artificial Sequence
  Description of Artificial Sequence: Synthetic oligonucleotide
  Target: ATXN1; (+) strand; PAM type: NRG; PAM sequence: AGG
cagttaaaatctgaaagaag

SEQ ID NO: 99540 - DNA, 20 bp, Artificial Sequence
  Description of Artificial Sequence: Synthetic oligonucleotide
  Target: ATXN1; (+) strand; PAM type: NRG; PAM sequence: CGG
taaaatctgaaagaagaggc

SEQ ID NO: 99541 - DNA, 20 bp, Artificial Sequence
  Description of Artificial Sequence: Synthetic oligonucleotide
  Target: ATXN1; (+) strand; PAM type: NRG; PAM sequence: GGG
aaaatctgaaagaagaggcc

SEQ ID NO: 99542 - DNA, 20 bp, Artificial Sequence
  Description of Artificial Sequence: Synthetic oligonucleotide
  Target: ATXN1; (+) strand; PAM type: NRG; PAM sequence: TGG
ctgaaagaagaggccgggca

SEQ ID NO: 99543 - DNA, 20 bp, Artificial Sequence
  Description of Artificial Sequence: Synthetic oligonucleotide
  Target: ATXN1; (+) strand; PAM type: NRG; PAM sequence: TGG
aaagaagaggccgggcatgg

SEQ ID NO: 99544 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccaccactt

SEQ ID NO: 99545 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccaccacttt

SEQ ID NO: 99546 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaccactttgg

SEQ ID NO: 99547 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaccactttggg

SEQ ID NO: 99548 - DNA, 20 bp, Artificial Sequence
  Description of Artificial Sequence: Synthetic oligonucleotide
  Target: ATXN1; (+) strand; PAM type: NRG; PAM sequence: CAG
aatcccaccactttgggagg

SEQ ID NO: 99549 - DNA, 20 bp, Artificial Sequence
  Description of Artificial Sequence: Synthetic oligonucleotide
  Target: ATXN1; (+) strand; PAM type: NRG; PAM sequence: GAG
tcccaccactttgggaggca

SEQ ID NO: 99550 - DNA, 20 bp, Artificial Sequence
  Description of Artificial Sequence: Synthetic oligonucleotide
  Target: ATXN1; (+) strand; PAM type: NRG; PAM sequence: AGG
cccaccactttgggaggcag

SEQ ID NO: 99551 - DNA, 20 bp, Artificial Sequence
  Description of Artificial Sequence: Synthetic oligonucleotide
  Target: ATXN1; (+) strand; PAM type: NRG; PAM sequence: CGG
accactttgggaggcagagg

SEQ ID NO: 99552 - DNA, 20 bp, Artificial Sequence
  Description of Artificial Sequence: Synthetic oligonucleotide
  Target: ATXN1; (+) strand; PAM type: NRG; PAM sequence: GGG
ccactttgggaggcagaggc

SEQ ID NO: 99553 - DNA, 20 bp, Artificial Sequence
  Description of Artificial Sequence: Synthetic oligonucleotide
  Target: ATXN1; (+) strand; PAM type: NRG; PAM sequence: GAG
ggcagaggcgggctgatcat

SEQ ID NO: 99554 - DNA, 20 bp, Artificial Sequence
  Description of Artificial Sequence: Synthetic oligonucleotide
  Target: ATXN1; (+) strand; PAM type: NRG; PAM sequence: AGG
gcagaggcgggctgatcatg

SEQ ID NO: 99555 - DNA, 20 bp, Artificial Sequence
  Description of Artificial Sequence: Synthetic oligonucleotide
  Target: ATXN1; (+) strand; PAM type: NRG; PAM sequence: CAG
aggcgggctgatcatgaggt

SEQ ID NO: 99556 - DNA, 20 bp, Artificial Sequence
  Description of Artificial Sequence: Synthetic oligonucleotide
  Target: ATXN1; (+) strand; PAM type: NRG; PAM sequence: AGG
ggcgggctgatcatgaggtc

SEQ ID NO: 99557 - DNA, 20 bp, Artificial Sequence
  Description of Artificial Sequence: Synthetic oligonucleotide
  Target: ATXN1; (+) strand; PAM type: NRG; PAM sequence: GAG
cgggctgatcatgaggtcag

SEQ ID NO: 99558 - DNA, 20 bp, Artificial Sequence
  Description of Artificial Sequence: Synthetic oligonucleotide
  Target: ATXN1; (+) strand; PAM type: NRG; PAM sequence: AAG
gatcatgaggtcaggagttc

SEQ ID NO: 99559 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 99560 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctgaccaaca

SEQ ID NO: 99561 - DNA, 20 bp, Artificial Sequence
  Description of Artificial Sequence: Synthetic oligonucleotide
  Target: ATXN1; (+) strand; PAM type: NRG; PAM sequence: TAG
tactaaaaatacaaaaaaat

SEQ ID NO: 99562 - DNA, 20 bp, Artificial Sequence
  Description of Artificial Sequence: Synthetic oligonucleotide
  Target: ATXN1; (+) strand; PAM type: NRG; PAM sequence: CAG
aaaaatacaaaaaaattagc

SEQ ID NO: 99563 - DNA, 20 bp, Artificial Sequence
  Description of Artificial Sequence: Synthetic oligonucleotide
  Target: ATXN1; (+) strand; PAM type: NRG; PAM sequence: AGG
aaaatacaaaaaaattagcc

SEQ ID NO: 99564 - DNA, 20 bp, Artificial Sequence
  Description of Artificial Sequence: Synthetic oligonucleotide
  Target: ATXN1; (+) strand; PAM type: NRG; PAM sequence: TGG
acaaaaaaattagccaggcg

SEQ ID NO: 99565 - DNA, 20 bp, Artificial Sequence
  Description of Artificial Sequence: Synthetic oligonucleotide
  Target: ATXN1; (+) strand; PAM type: NRG; PAM sequence: GGG
caaaaaaattagccaggcgt

SEQ ID NO: 99566 - DNA, 20 bp, Artificial Sequence
  Description of Artificial Sequence: Synthetic oligonucleotide
  Target: ATXN1; (+) strand; PAM type: NRG; PAM sequence: GAG
aaaaaattagccaggcgtgg

SEQ ID NO: 99567 - DNA, 20 bp, Artificial Sequence
  Description of Artificial Sequence: Synthetic oligonucleotide
  Target: ATXN1; (+) strand; PAM type: NRG; PAM sequence: CAG
aaattagccaggcgtgggag

SEQ ID NO: 99568 - DNA, 20 bp, Artificial Sequence
  Description of Artificial Sequence: Synthetic oligonucleotide
  Target: ATXN1; (+) strand; PAM type: NRG; PAM sequence: AGG
aattagccaggcgtgggagc

SEQ ID NO: 99569 - DNA, 20 bp, Artificial Sequence
  Description of Artificial Sequence: Synthetic oligonucleotide
  Target: ATXN1; (+) strand; PAM type: NRG; PAM sequence: CAG
ggagcaggtgcctgtaatct

SEQ ID NO: 99570 - DNA, 20 bp, Artificial Sequence
  Description of Artificial Sequence: Synthetic oligonucleotide
  Target: ATXN1; (+) strand; PAM type: NRG; PAM sequence: AAG
ctgtaatctcagctactctg

SEQ ID NO: 99571 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagctactctga

SEQ ID NO: 99572 - DNA, 20 bp, Artificial Sequence
  Description of Artificial Sequence: Synthetic oligonucleotide
  Target: ATXN1; (+) strand; PAM type: NRG; PAM sequence: AAG
ctcagctactctgaaggctg

SEQ ID NO: 99573 - DNA, 20 bp, Artificial Sequence
  Description of Artificial Sequence: Synthetic oligonucleotide
  Target: ATXN1; (+) strand; PAM type: NRG; PAM sequence: CAG
agctactctgaaggctgaag

SEQ ID NO: 99574 - DNA, 20 bp, Artificial Sequence
  Description of Artificial Sequence: Synthetic oligonucleotide
  Target: ATXN1; (+) strand; PAM type: NRG; PAM sequence: AGG
gctactctgaaggctgaagc

SEQ ID NO: 99575 - DNA, 20 bp, Artificial Sequence
  Description of Artificial Sequence: Synthetic oligonucleotide
  Target: ATXN1; (+) strand; PAM type: NRG; PAM sequence: GAG
tactctgaaggctgaagcag

SEQ ID NO: 99576 - DNA, 20 bp, Artificial Sequence
  Description of Artificial Sequence: Synthetic oligonucleotide
  Target: ATXN1; (+) strand; PAM type: NRG; PAM sequence: TGG
gcaggagaattgcttgaacc

SEQ ID NO: 99577 - DNA, 20 bp, Artificial Sequence
  Description of Artificial Sequence: Synthetic oligonucleotide
  Target: ATXN1; (+) strand; PAM type: NRG; PAM sequence: GGG
caggagaattgcttgaacct

SEQ ID NO: 99578 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaacctgg

SEQ ID NO: 99579 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttgaacctggg

SEQ ID NO: 99580 - DNA, 20 bp, Artificial Sequence
  Description of Artificial Sequence: Synthetic oligonucleotide
  Target: ATXN1; (+) strand; PAM type: NRG; PAM sequence: CGG
aattgcttgaacctgggagg

SEQ ID NO: 99581 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctgggaggcg

SEQ ID NO: 99582 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggaggcgg

SEQ ID NO: 99583 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcggaggttg

SEQ ID NO: 99584 - DNA, 20 bp, Artificial Sequence
  Description of Artificial Sequence: Synthetic oligonucleotide
  Target: ATXN1; (+) strand; PAM type: NRG; PAM sequence: GAG
tgggaggcggaggttgcagt

SEQ ID NO: 99585 - DNA, 20 bp, Artificial Sequence
  Description of Artificial Sequence: Synthetic oligonucleotide
  Target: ATXN1; (+) strand; PAM type: NRG; PAM sequence: AAG
ggcggaggttgcagtgagcc

SEQ ID NO: 99586 - DNA, 20 bp, Artificial Sequence
  Description of Artificial Sequence: Synthetic oligonucleotide
  Target: ATXN1; (+) strand; PAM type: NRG; PAM sequence: CAG
aagatcacgccattgcaccc

SEQ ID NO: 99587 - DNA, 20 bp, Artificial Sequence
  Description of Artificial Sequence: Synthetic oligonucleotide
  Target: ATXN1; (+) strand; PAM type: NRG; PAM sequence: CAG
cacgccattgcaccccagcc

SEQ ID NO: 99588 - DNA, 20 bp, Artificial Sequence
  Description of Artificial Sequence: Synthetic oligonucleotide
  Target: ATXN1; (+) strand; PAM type: NRG; PAM sequence: AGG
acgccattgcaccccagccc

SEQ ID NO: 99589 - DNA, 20 bp, Artificial Sequence
  Description of Artificial Sequence: Synthetic oligonucleotide
  Target: ATXN1; (+) strand; PAM type: NRG; PAM sequence: CAG
ttgcaccccagcccaggtga

SEQ ID NO: 99590 - DNA, 20 bp, Artificial Sequence
  Description of Artificial Sequence: Synthetic oligonucleotide
  Target: ATXN1; (+) strand; PAM type: NRG; PAM sequence: AAG
cccagcccaggtgacagtgc

SEQ ID NO: 99591 - DNA, 20 bp, Artificial Sequence
  Description of Artificial Sequence: Synthetic oligonucleotide
  Target: ATXN1; (+) strand; PAM type: NRG; PAM sequence: AAG
caaaacaaaaaaaaaactga

SEQ ID NO: 99592 - DNA, 20 bp, Artificial Sequence
  Description of Artificial Sequence: Synthetic oligonucleotide
  Target: ATXN1; (+) strand; PAM type: NRG; PAM sequence: TAG
caaaaaaaaaactgaaagaa

SEQ ID NO: 99593 - DNA, 20 bp, Artificial Sequence
  Description of Artificial Sequence: Synthetic oligonucleotide
  Target: ATXN1; (+) strand; PAM type: NRG; PAM sequence: TGG
agttctgtttgccttctgta

SEQ ID NO: 99594 - DNA, 20 bp, Artificial Sequence
  Description of Artificial Sequence: Synthetic oligonucleotide
  Target: ATXN1; (+) strand; PAM type: NRG; PAM sequence: TGG
tgtatggaaaaacattgcaa

SEQ ID NO: 99595 - DNA, 20 bp, Artificial Sequence
  Description of Artificial Sequence: Synthetic oligonucleotide
  Target: ATXN1; (+) strand; PAM type: NRG; PAM sequence: AAG
gaaaaacattgcaatggtac

SEQ ID NO: 99596 - DNA, 20 bp, Artificial Sequence
  Description of Artificial Sequence: Synthetic oligonucleotide
  Target: ATXN1; (+) strand; PAM type: NRG; PAM sequence: TGG
aaacattgcaatggtacaag

SEQ ID NO: 99597 - DNA, 20 bp, Artificial Sequence
  Description of Artificial Sequence: Synthetic oligonucleotide
  Target: ATXN1; (+) strand; PAM type: NRG; PAM sequence: CAG
gcaatggtacaagtggacaa

SEQ ID NO: 99598 - DNA, 20 bp, Artificial Sequence
  Description of Artificial Sequence: Synthetic oligonucleotide
  Target: ATXN1; (+) strand; PAM type: NRG; PAM sequence: AGG
caatggtacaagtggacaac

SEQ ID NO: 99599 - DNA, 20 bp, Artificial Sequence
  Description of Artificial Sequence: Synthetic oligonucleotide
  Target: ATXN1; (+) strand; PAM type: NRG; PAM sequence: GGG
aatggtacaagtggacaaca

SEQ ID NO: 99600 - DNA, 20 bp, Artificial Sequence
  Description of Artificial Sequence: Synthetic oligonucleotide
  Target: ATXN1; (+) strand; PAM type: NRG; PAM sequence: GGG
atggtacaagtggacaacag

SEQ ID NO: 99601 - DNA, 20 bp, Artificial Sequence
  Description of Artificial Sequence: Synthetic oligonucleotide
  Target: ATXN1; (+) strand; PAM type: NRG; PAM sequence: GGG
tggtacaagtggacaacagg

SEQ ID NO: 99602 - DNA, 20 bp, Artificial Sequence
  Description of Artificial Sequence: Synthetic oligonucleotide
  Target: ATXN1; (+) strand; PAM type: NRG; PAM sequence: TAG
aagtggacaacagggggcaa

SEQ ID NO: 99603 - DNA, 20 bp, Artificial Sequence
  Description of Artificial Sequence: Synthetic oligonucleotide
  Target: ATXN1; (+) strand; PAM type: NRG; PAM sequence: GAG
gtggacaacagggggcaata

SEQ ID NO: 99604 - DNA, 20 bp, Artificial Sequence
  Description of Artificial Sequence: Synthetic oligonucleotide
  Target: ATXN1; (+) strand; PAM type: NRG; PAM sequence: GAG
ggacaacagggggcaataga

SEQ ID NO: 99605 - DNA, 20 bp, Artificial Sequence
  Description of Artificial Sequence: Synthetic oligonucleotide
  Target: ATXN1; (+) strand; PAM type: NRG; PAM sequence: CAG
tttttttttttttttttaac

SEQ ID NO: 99606 - DNA, 20 bp, Artificial Sequence
  Description of Artificial Sequence: Synthetic oligonucleotide
  Target: ATXN1; (+) strand; PAM type: NRG; PAM sequence: CAG
tttttttttttttaaccagc

SEQ ID NO: 99607 - DNA, 20 bp, Artificial Sequence
  Description of Artificial Sequence: Synthetic oligonucleotide
  Target: ATXN1; (+) strand; PAM type: NRG; PAM sequence: AAG
tttttaaccagccagaacta

SEQ ID NO: 99608 - DNA, 20 bp, Artificial Sequence
  Description of Artificial Sequence: Synthetic oligonucleotide
  Target: ATXN1; (+) strand; PAM type: NRG; PAM sequence: TGG
ttaaccagccagaactaaag

SEQ ID NO: 99609 - DNA, 20 bp, Artificial Sequence
  Description of Artificial Sequence: Synthetic oligonucleotide
  Target: ATXN1; (+) strand; PAM type: NRG; PAM sequence: GGG
taaccagccagaactaaagt

SEQ ID NO: 99610 - DNA, 20 bp, Artificial Sequence
  Description of Artificial Sequence: Synthetic oligonucleotide
  Target: ATXN1; (+) strand; PAM type: NRG; PAM sequence: CAG
aagtgggctgtgacctcccc

SEQ ID NO: 99611 - DNA, 20 bp, Artificial Sequence
  Description of Artificial Sequence: Synthetic oligonucleotide
  Target: ATXN1; (+) strand; PAM type: NRG; PAM sequence: AGG
agtgggctgtgacctccccc

SEQ ID NO: 99612 - DNA, 20 bp, Artificial Sequence
  Description of Artificial Sequence: Synthetic oligonucleotide
  Target: ATXN1; (+) strand; PAM type: NRG; PAM sequence: GGG
gtgggctgtgacctccccca

SEQ ID NO: 99613 - DNA, 20 bp, Artificial Sequence
  Description of Artificial Sequence: Synthetic oligonucleotide
  Target: ATXN1; (+) strand; PAM type: NRG; PAM sequence: GAG
gggctgtgacctcccccagg

SEQ ID NO: 99614 - DNA, 20 bp, Artificial Sequence
  Description of Artificial Sequence: Synthetic oligonucleotide
  Target: ATXN1; (+) strand; PAM type: NRG; PAM sequence: GAG
gctgtgacctcccccaggga

SEQ ID NO: 99615 - DNA, 20 bp, Artificial Sequence
  Description of Artificial Sequence: Synthetic oligonucleotide
  Target: ATXN1; (+) strand; PAM type: NRG; PAM sequence: AGG
ctgtgacctcccccagggag

SEQ ID NO: 99616 - DNA, 20 bp, Artificial Sequence
  Description of Artificial Sequence: Synthetic oligonucleotide
  Target: ATXN1; (+) strand; PAM type: NRG; PAM sequence: GAG
gtgacctcccccagggagag

SEQ ID NO: 99617 - DNA, 20 bp, Artificial Sequence
  Description of Artificial Sequence: Synthetic oligonucleotide
  Target: ATXN1; (+) strand; PAM type: NRG; PAM sequence: CAG
acctcccccagggagaggag

SEQ ID NO: 99618 - DNA, 20 bp, Artificial Sequence
  Description of Artificial Sequence: Synthetic oligonucleotide
  Target: ATXN1; (+) strand; PAM type: NRG; PAM sequence: CAG
gagaggagcagtgctttctc

SEQ ID NO: 99619 - DNA, 20 bp, Artificial Sequence
  Description of Artificial Sequence: Synthetic oligonucleotide
  Target: ATXN1; (+) strand; PAM type: NRG; PAM sequence: AGG
agaggagcagtgctttctcc

SEQ ID NO: 99620 - DNA, 20 bp, Artificial Sequence
  Description of Artificial Sequence: Synthetic oligonucleotide
  Target: ATXN1; (+) strand; PAM type: NRG; PAM sequence: GGG
gaggagcagtgctttctcca

SEQ ID NO: 99621 - DNA, 20 bp, Artificial Sequence
  Description of Artificial Sequence: Synthetic oligonucleotide
  Target: ATXN1; (+) strand; PAM type: NRG; PAM sequence: TGG
gcagtgctttctccagggtg

SEQ ID NO: 99622 - DNA, 20 bp, Artificial Sequence
  Description of Artificial Sequence: Synthetic oligonucleotide
  Target: ATXN1; (+) strand; PAM type: NRG; PAM sequence: CAG
ggtgtggctttaccgcctaa

SEQ ID NO: 99623 - DNA, 20 bp, Artificial Sequence
  Description of Artificial Sequence: Synthetic oligonucleotide
  Target: ATXN1; (+) strand; PAM type: NRG; PAM sequence: AGG
gtgtggctttaccgcctaac

SEQ ID NO: 99624 - DNA, 20 bp, Artificial Sequence
  Description of Artificial Sequence: Synthetic oligonucleotide
  Target: ATXN1; (+) strand; PAM type: NRG; PAM sequence: CAG
tggctttaccgcctaacagg

SEQ ID NO: 99625 - DNA, 20 bp, Artificial Sequence
  Description of Artificial Sequence: Synthetic oligonucleotide
  Target: ATXN1; (+) strand; PAM type: NRG; PAM sequence: CAG
cgcctaacaggcagctttct

SEQ ID NO: 99626 - DNA, 20 bp, Artificial Sequence
  Description of Artificial Sequence: Synthetic oligonucleotide
  Target: ATXN1; (+) strand; PAM type: NRG; PAM sequence: CGG
ctaacaggcagctttctcag

SEQ ID NO: 99627 - DNA, 20 bp, Artificial Sequence
  Description of Artificial Sequence: Synthetic oligonucleotide
  Target: ATXN1; (+) strand; PAM type: NRG; PAM sequence: GAG
aacaggcagctttctcagcg

SEQ ID NO: 99628 - DNA, 20 bp, Artificial Sequence
  Description of Artificial Sequence: Synthetic oligonucleotide
  Target: ATXN1; (+) strand; PAM type: NRG; PAM sequence: TAG
cagctttctcagcggagcca

SEQ ID NO: 99629 - DNA, 20 bp, Artificial Sequence
  Description of Artificial Sequence: Synthetic oligonucleotide
  Target: ATXN1; (+) strand; PAM type: NRG; PAM sequence: CAG
ccatagccacctcaccttgt

SEQ ID NO: 99630 - DNA, 20 bp, Artificial Sequence
  Description of Artificial Sequence: Synthetic oligonucleotide
  Target: ATXN1; (+) strand; PAM type: NRG; PAM sequence: GAG
acctcaccttgtcagatgct

SEQ ID NO: 99631 - DNA, 20 bp, Artificial Sequence
  Description of Artificial Sequence: Synthetic oligonucleotide
  Target: ATXN1; (+) strand; PAM type: NRG; PAM sequence: AGG
cctcaccttgtcagatgctg

SEQ ID NO: 99632 - DNA, 20 bp, Artificial Sequence
  Description of Artificial Sequence: Synthetic oligonucleotide
  Target: ATXN1; (+) strand; PAM type: NRG; PAM sequence: CAG
gattttattgaatcacactt

SEQ ID NO: 99633 - DNA, 20 bp, Artificial Sequence
  Description of Artificial Sequence: Synthetic oligonucleotide
  Target: ATXN1; (+) strand; PAM type: NRG; PAM sequence: CAG
tctctccactctcgttcttg

SEQ ID NO: 99634 - DNA, 20 bp, Artificial Sequence
  Description of Artificial Sequence: Synthetic oligonucleotide
  Target: ATXN1; (+) strand; PAM type: NRG; PAM sequence: TAG
tctcgttcttgcagctgtgt

SEQ ID NO: 99635 - DNA, 20 bp, Artificial Sequence
  Description of Artificial Sequence: Synthetic oligonucleotide
  Target: ATXN1; (+) strand; PAM type: NRG; PAM sequence: AAG
cagctgtgttagtaatcatt

SEQ ID NO: 99636 - DNA, 20 bp, Artificial Sequence
  Description of Artificial Sequence: Synthetic oligonucleotide
  Target: ATXN1; (+) strand; PAM type: NRG; PAM sequence: TGG
aagtcattttatgatcttgc

SEQ ID NO: 99637 - DNA, 20 bp, Artificial Sequence
  Description of Artificial Sequence: Synthetic oligonucleotide
  Target: ATXN1; (+) strand; PAM type: NRG; PAM sequence: GGG
agtcattttatgatcttgct

SEQ ID NO: 99638 - DNA, 20 bp, Artificial Sequence
  Description of Artificial Sequence: Synthetic oligonucleotide
  Target: ATXN1; (+) strand; PAM type: NRG; PAM sequence: GGG
gtcattttatgatcttgctg

SEQ ID NO: 99639 - DNA, 20 bp, Artificial Sequence
  Description of Artificial Sequence: Synthetic oligonucleotide
  Target: ATXN1; (+) strand; PAM type: NRG; PAM sequence: CAG
ctggggttccacacattttc

SEQ ID NO: 99640 - DNA, 20 bp, Artificial Sequence
  Description of Artificial Sequence: Synthetic oligonucleotide
  Target: ATXN1; (+) strand; PAM type: NRG; PAM sequence: TGG
gttccacacattttccagaa

SEQ ID NO: 99641 - DNA, 20 bp, Artificial Sequence
  Description of Artificial Sequence: Synthetic oligonucleotide
  Target: ATXN1; (+) strand; PAM type: NRG; PAM sequence: TGG
tcccaatgaaaataaactca

SEQ ID NO: 99642 - DNA, 20 bp, Artificial Sequence
  Description of Artificial Sequence: Synthetic oligonucleotide
  Target: ATXN1; (+) strand; PAM type: NRG; PAM sequence: GGG
cccaatgaaaataaactcat

SEQ ID NO: 99643 - DNA, 20 bp, Artificial Sequence
  Description of Artificial Sequence: Synthetic oligonucleotide
  Target: ATXN1; (+) strand; PAM type: NRG; PAM sequence: GAG
caatgaaaataaactcatgg

SEQ ID NO: 99644 - DNA, 20 bp, Artificial Sequence
  Description of Artificial Sequence: Synthetic oligonucleotide
  Target: ATXN1; (+) strand; PAM type: NRG; PAM sequence: CAG
tgaaaataaactcatgggag

SEQ ID NO: 99645 - DNA, 20 bp, Artificial Sequence
  Description of Artificial Sequence: Synthetic oligonucleotide
  Target: ATXN1; (+) strand; PAM type: NRG; PAM sequence: CAG
aactcatgggagcagtacca

SEQ ID NO: 99646 - DNA, 20 bp, Artificial Sequence
  Description of Artificial Sequence: Synthetic oligonucleotide
  Target: ATXN1; (+) strand; PAM type: NRG; PAM sequence: AAG
agcagtaccacagataacca

SEQ ID NO: 99647 - DNA, 20 bp, Artificial Sequence
  Description of Artificial Sequence: Synthetic oligonucleotide
  Target: ATXN1; (+) strand; PAM type: NRG; PAM sequence: CAG
caaagcacgttacataacgc

SEQ ID NO: 99648 - DNA, 20 bp, Artificial Sequence
  Description of Artificial Sequence: Synthetic oligonucleotide
  Target: ATXN1; (+) strand; PAM type: NRG; PAM sequence: CAG
gcacgttacataacgccaga

SEQ ID NO: 99649 - DNA, 20 bp, Artificial Sequence
  Description of Artificial Sequence: Synthetic oligonucleotide
  Target: ATXN1; (+) strand; PAM type: NRG; PAM sequence: TAG
taacgccagacagctcaata

SEQ ID NO: 99650 - DNA, 20 bp, Artificial Sequence
  Description of Artificial Sequence: Synthetic oligonucleotide
  Target: ATXN1; (+) strand; PAM type: NRG; PAM sequence: CAG
atatagcccattttttcatc

SEQ ID NO: 99651 - DNA, 20 bp, Artificial Sequence
  Description of Artificial Sequence: Synthetic oligonucleotide
  Target: ATXN1; (+) strand; PAM type: NRG; PAM sequence: AAG
tatcctgtttcaaacaccct

SEQ ID NO: 99652 - DNA, 20 bp, Artificial Sequence
  Description of Artificial Sequence: Synthetic oligonucleotide
  Target: ATXN1; (+) strand; PAM type: NRG; PAM sequence: CAG
cctgtttcaaacaccctaag

SEQ ID NO: 99653 - DNA, 20 bp, Artificial Sequence
  Description of Artificial Sequence: Synthetic oligonucleotide
  Target: ATXN1; (+) strand; PAM type: NRG; PAM sequence: AAG
tttcaaacaccctaagcagt

SEQ ID NO: 99654 - DNA, 20 bp, Artificial Sequence
  Description of Artificial Sequence: Synthetic oligonucleotide
  Target: ATXN1; (+) strand; PAM type: NRG; PAM sequence: TAG
caaacaccctaagcagtaag

SEQ ID NO: 99655 - DNA, 20 bp, Artificial Sequence
  Description of Artificial Sequence: Synthetic oligonucleotide
  Target: ATXN1; (+) strand; PAM type: NRG; PAM sequence: TAG
accctaagcagtaagtagaa

SEQ ID NO: 99656 - DNA, 20 bp, Artificial Sequence
  Description of Artificial Sequence: Synthetic oligonucleotide
  Target: ATXN1; (+) strand; PAM type: NRG; PAM sequence: GAG
ttctttctttcttttttttt

SEQ ID NO: 99657 - DNA, 20 bp, Artificial Sequence
  Description of Artificial Sequence: Synthetic oligonucleotide
  Target: ATXN1; (+) strand; PAM type: NRG; PAM sequence: CAG
ttctttctttttttttgaga

SEQ ID NO: 99658 - DNA, 20 bp, Artificial Sequence
  Description of Artificial Sequence: Synthetic oligonucleotide
  Target: ATXN1; (+) strand; PAM type: NRG; PAM sequence: GAG
ctttctttttttttgagaca

SEQ ID NO: 99659 - DNA, 20 bp, Artificial Sequence
  Description of Artificial Sequence: Synthetic oligonucleotide
  Target: ATXN1; (+) strand; PAM type: NRG; PAM sequence: AAG
cagagtctcactctgtcgcc

SEQ ID NO: 99660 - DNA, 20 bp, Artificial Sequence
  Description of Artificial Sequence: Synthetic oligonucleotide
  Target: ATXN1; (+) strand; PAM type: NRG; PAM sequence: AGG
agagtctcactctgtcgcca

SEQ ID NO: 99661 - DNA, 20 bp, Artificial Sequence
  Description of Artificial Sequence: Synthetic oligonucleotide
  Target: ATXN1; (+) strand; PAM type: NRG; PAM sequence: TAG
tctcactctgtcgccaaggc

SEQ ID NO: 99662 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgccaaggcta

SEQ ID NO: 99663 - DNA, 20 bp, Artificial Sequence
  Description of Artificial Sequence: Synthetic oligonucleotide
  Target: ATXN1; (+) strand; PAM type: NRG; PAM sequence: TAG
ctgtcgccaaggctagagtg

SEQ ID NO: 99664 - DNA, 20 bp, Artificial Sequence
  Description of Artificial Sequence: Synthetic oligonucleotide
  Target: ATXN1; (+) strand; PAM type: NRG; PAM sequence: TGG
tcgccaaggctagagtgtag

SEQ ID NO: 99665 - DNA, 20 bp, Artificial Sequence
  Description of Artificial Sequence: Synthetic oligonucleotide
  Target: ATXN1; (+) strand; PAM type: NRG; PAM sequence: CGG
agtggtgccatcttgattca

SEQ ID NO: 99666 - DNA, 20 bp, Artificial Sequence
  Description of Artificial Sequence: Synthetic oligonucleotide
  Target: ATXN1; (+) strand; PAM type: NRG; PAM sequence: CAG
tcacggtaacctctgcctcc

SEQ ID NO: 99667 - DNA, 20 bp, Artificial Sequence
  Description of Artificial Sequence: Synthetic oligonucleotide
  Target: ATXN1; (+) strand; PAM type: NRG; PAM sequence: AGG
cacggtaacctctgcctccc

SEQ ID NO: 99668 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcccaggttc

SEQ ID NO: 99669 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgcct

SEQ ID NO: 99670 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 99671 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 99672 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 99673 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 99674 - DNA, 20 bp, Artificial Sequence
  Description of Artificial Sequence: Synthetic oligonucleotide
  Target: ATXN1; (+) strand; PAM type: NRG; PAM sequence: TAG
ctcccaagtagctgggatta

SEQ ID NO: 99675 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattat

SEQ ID NO: 99676 - DNA, 20 bp, Artificial Sequence
  Description of Artificial Sequence: Synthetic oligonucleotide
  Target: ATXN1; (+) strand; PAM type: NRG; PAM sequence: CAG
ataggcgcctgccaccacac

SEQ ID NO: 99677 - DNA, 20 bp, Artificial Sequence
  Description of Artificial Sequence: Synthetic oligonucleotide
  Target: ATXN1; (+) strand; PAM type: NRG; PAM sequence: AGG
taggcgcctgccaccacacc

SEQ ID NO: 99678 - DNA, 20 bp, Artificial Sequence
  Description of Artificial Sequence: Synthetic oligonucleotide
  Target: ATXN1; (+) strand; PAM type: NRG; PAM sequence: TAG
caggctaatttttttgtatt

SEQ ID NO: 99679 - DNA, 20 bp, Artificial Sequence
  Description of Artificial Sequence: Synthetic oligonucleotide
  Target: ATXN1; (+) strand; PAM type: NRG; PAM sequence: TAG
gctaatttttttgtatttag

SEQ ID NO: 99680 - DNA, 20 bp, Artificial Sequence
  Description of Artificial Sequence: Synthetic oligonucleotide
  Target: ATXN1; (+) strand; PAM type: NRG; PAM sequence: GAG
taatttttttgtatttagta

SEQ ID NO: 99681 - DNA, 20 bp, Artificial Sequence
  Description of Artificial Sequence: Synthetic oligonucleotide
  Target: ATXN1; (+) strand; PAM type: NRG; PAM sequence: CGG
ttttttgtatttagtagaga

SEQ ID NO: 99682 - DNA, 20 bp, Artificial Sequence
  Description of Artificial Sequence: Synthetic oligonucleotide
  Target: ATXN1; (+) strand; PAM type: NRG; PAM sequence: GGG
tttttgtatttagtagagac

SEQ ID NO: 99683 - DNA, 20 bp, Artificial Sequence
  Description of Artificial Sequence: Synthetic oligonucleotide
  Target: ATXN1; (+) strand; PAM type: NRG; PAM sequence: TAG
gagacgggttttcaccatgt

SEQ ID NO: 99684 - DNA, 20 bp, Artificial Sequence
  Description of Artificial Sequence: Synthetic oligonucleotide
  Target: ATXN1; (+) strand; PAM type: NRG; PAM sequence: CAG
cgggttttcaccatgttagt

SEQ ID NO: 99685 - DNA, 20 bp, Artificial Sequence
  Description of Artificial Sequence: Synthetic oligonucleotide
  Target: ATXN1; (+) strand; PAM type: NRG; PAM sequence: AGG
gggttttcaccatgttagtc

SEQ ID NO: 99686 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttagtcaggc

SEQ ID NO: 99687 - DNA, 20 bp, Artificial Sequence
  Description of Artificial Sequence: Synthetic oligonucleotide
  Target: ATXN1; (+) strand; PAM type: NRG; PAM sequence: CAG
tggtcttgaactcttgacct

SEQ ID NO: 99688 - DNA, 20 bp, Artificial Sequence
  Description of Artificial Sequence: Synthetic oligonucleotide
  Target: ATXN1; (+) strand; PAM type: NRG; PAM sequence: CGG
ctcagatgatccacccacct

SEQ ID NO: 99689 - DNA, 20 bp, Artificial Sequence
  Description of Artificial Sequence: Synthetic oligonucleotide
  Target: ATXN1; (+) strand; PAM type: NRG; PAM sequence: AAG
ccacccacctcggcctccca

SEQ ID NO: 99690 - DNA, 20 bp, Artificial Sequence
  Description of Artificial Sequence: Synthetic oligonucleotide
  Target: ATXN1; (+) strand; PAM type: NRG; PAM sequence: TGG
acctcggcctcccaaagtgc

SEQ ID NO: 99691 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 99692 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 99693 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 99694 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 99695 - DNA, 20 bp, Artificial Sequence
  Description of Artificial Sequence: Synthetic oligonucleotide
  Target: ATXN1; (+) strand; PAM type: NRG; PAM sequence: CAG
caggtgtgagccaccgcgcc

SEQ ID NO: 99696 - DNA, 20 bp, Artificial Sequence
  Description of Artificial Sequence: Synthetic oligonucleotide
  Target: ATXN1; (+) strand; PAM type: NRG; PAM sequence: AGG
aggtgtgagccaccgcgccc

SEQ ID NO: 99697 - DNA, 20 bp, Artificial Sequence
  Description of Artificial Sequence: Synthetic oligonucleotide
  Target: ATXN1; (+) strand; PAM type: NRG; PAM sequence: GGG
ggtgtgagccaccgcgccca

SEQ ID NO: 99698 - DNA, 20 bp, Artificial Sequence
  Description of Artificial Sequence: Synthetic oligonucleotide
  Target: ATXN1; (+) strand; PAM type: NRG; PAM sequence: TGG
tgagccaccgcgcccaggga

SEQ ID NO: 99699 - DNA, 20 bp, Artificial Sequence
  Description of Artificial Sequence: Synthetic oligonucleotide
  Target: ATXN1; (+) strand; PAM type: NRG; PAM sequence: AAG
gatggcctttatacttttgt

SEQ ID NO: 99700 - DNA, 20 bp, Artificial Sequence
  Description of Artificial Sequence: Synthetic oligonucleotide
  Target: ATXN1; (+) strand; PAM type: NRG; PAM sequence: GAG
ctttatacttttgtaagctt

SEQ ID NO: 99701 - DNA, 20 bp, Artificial Sequence
  Description of Artificial Sequence: Synthetic oligonucleotide
  Target: ATXN1; (+) strand; PAM type: NRG; PAM sequence: AGG
tttatacttttgtaagcttg

SEQ ID NO: 99702 - DNA, 20 bp, Artificial Sequence
  Description of Artificial Sequence: Synthetic oligonucleotide
  Target: ATXN1; (+) strand; PAM type: NRG; PAM sequence: GGG
ttatacttttgtaagcttga

SEQ ID NO: 99703 - DNA, 20 bp, Artificial Sequence
  Description of Artificial Sequence: Synthetic oligonucleotide
  Target: ATXN1; (+) strand; PAM type: NRG; PAM sequence: TGG
ggccctctgtctttcatctc

SEQ ID NO: 99704 - DNA, 20 bp, Artificial Sequence
  Description of Artificial Sequence: Synthetic oligonucleotide
  Target: ATXN1; (+) strand; PAM type: NRG; PAM sequence: CAG
atctctggatgccctgtcgc

SEQ ID NO: 99705 - DNA, 20 bp, Artificial Sequence
  Description of Artificial Sequence: Synthetic oligonucleotide
  Target: ATXN1; (+) strand; PAM type: NRG; PAM sequence: TGG
tcgccagcacctcttgcttt

SEQ ID NO: 99706 - DNA, 20 bp, Artificial Sequence
  Description of Artificial Sequence: Synthetic oligonucleotide
  Target: ATXN1; (+) strand; PAM type: NRG; PAM sequence: GGG
cgccagcacctcttgctttt

SEQ ID NO: 99707 - DNA, 20 bp, Artificial Sequence
  Description of Artificial Sequence: Synthetic oligonucleotide
  Target: ATXN1; (+) strand; PAM type: NRG; PAM sequence: GGG
gccagcacctcttgcttttg

SEQ ID NO: 99708 - DNA, 20 bp, Artificial Sequence
  Description of Artificial Sequence: Synthetic oligonucleotide
  Target: ATXN1; (+) strand; PAM type: NRG; PAM sequence: GGG
ccagcacctcttgcttttgg

SEQ ID NO: 99709 - DNA, 20 bp, Artificial Sequence
  Description of Artificial Sequence: Synthetic oligonucleotide
  Target: ATXN1; (+) strand; PAM type: NRG; PAM sequence: TGG
gcacctcttgcttttggggg

SEQ ID NO: 99710 - DNA, 20 bp, Artificial Sequence
  Description of Artificial Sequence: Synthetic oligonucleotide
  Target: ATXN1; (+) strand; PAM type: NRG; PAM sequence: CAG
ctccctcctcccactgctgc

SEQ ID NO: 99711 - DNA, 20 bp, Artificial Sequence
  Description of Artificial Sequence: Synthetic oligonucleotide
  Target: ATXN1; (+) strand; PAM type: NRG; PAM sequence: AAG
ctcctcccactgctgccagc

SEQ ID NO: 99712 - DNA, 20 bp, Artificial Sequence
  Description of Artificial Sequence: Synthetic oligonucleotide
  Target: ATXN1; (+) strand; PAM type: NRG; PAM sequence: CAG
cagcaagcccatgtgctcat

SEQ ID NO: 99713 - DNA, 20 bp, Artificial Sequence
  Description of Artificial Sequence: Synthetic oligonucleotide
  Target: ATXN1; (+) strand; PAM type: NRG; PAM sequence: TGG
agcccatgtgctcatcagtg

SEQ ID NO: 99714 - DNA, 20 bp, Artificial Sequence
  Description of Artificial Sequence: Synthetic oligonucleotide
  Target: ATXN1; (+) strand; PAM type: NRG; PAM sequence: AAG
gtgctcatcagtgtggttat

SEQ ID NO: 99715 - DNA, 20 bp, Artificial Sequence
  Description of Artificial Sequence: Synthetic oligonucleotide
  Target: ATXN1; (+) strand; PAM type: NRG; PAM sequence: GAG
gctcatcagtgtggttataa

SEQ ID NO: 99716 - DNA, 20 bp, Artificial Sequence
  Description of Artificial Sequence: Synthetic oligonucleotide
  Target: ATXN1; (+) strand; PAM type: NRG; PAM sequence: TAG
tccccctaaatcgactcctc

SEQ ID NO: 99717 - DNA, 20 bp, Artificial Sequence
  Description of Artificial Sequence: Synthetic oligonucleotide
  Target: ATXN1; (+) strand; PAM type: NRG; PAM sequence: TGG
gtcacctccaactcccattt

SEQ ID NO: 99718 - DNA, 20 bp, Artificial Sequence
  Description of Artificial Sequence: Synthetic oligonucleotide
  Target: ATXN1; (+) strand; PAM type: NRG; PAM sequence: TGG
cctccaactcccattttgga

SEQ ID NO: 99719 - DNA, 20 bp, Artificial Sequence
  Description of Artificial Sequence: Synthetic oligonucleotide
  Target: ATXN1; (+) strand; PAM type: NRG; PAM sequence: TAG
ccattttggatggacgaacc

SEQ ID NO: 99720 - DNA, 20 bp, Artificial Sequence
  Description of Artificial Sequence: Synthetic oligonucleotide
  Target: ATXN1; (+) strand; PAM type: NRG; PAM sequence: CAG
tttggatggacgaacctaga

SEQ ID NO: 99721 - DNA, 20 bp, Artificial Sequence
  Description of Artificial Sequence: Synthetic oligonucleotide
  Target: ATXN1; (+) strand; PAM type: NRG; PAM sequence: AGG
ttggatggacgaacctagac

SEQ ID NO: 99722 - DNA, 20 bp, Artificial Sequence
  Description of Artificial Sequence: Synthetic oligonucleotide
  Target: ATXN1; (+) strand; PAM type: NRG; PAM sequence: GGG
tggatggacgaacctagaca

SEQ ID NO: 99723 - DNA, 20 bp, Artificial Sequence
  Description of Artificial Sequence: Synthetic oligonucleotide
  Target: ATXN1; (+) strand; PAM type: NRG; PAM sequence: GAG
gatggacgaacctagacagg

SEQ ID NO: 99724 - DNA, 20 bp, Artificial Sequence
  Description of Artificial Sequence: Synthetic oligonucleotide
  Target: ATXN1; (+) strand; PAM type: NRG; PAM sequence: TGG
agacaacaccgactcacttc

SEQ ID NO: 99725 - DNA, 20 bp, Artificial Sequence
  Description of Artificial Sequence: Synthetic oligonucleotide
  Target: ATXN1; (+) strand; PAM type: NRG; PAM sequence: GGG
gacaacaccgactcacttct

SEQ ID NO: 99726 - DNA, 20 bp, Artificial Sequence
  Description of Artificial Sequence: Synthetic oligonucleotide
  Target: ATXN1; (+) strand; PAM type: NRG; PAM sequence: TGG
ttcctaatctgactaatgac

SEQ ID NO: 99727 - DNA, 20 bp, Artificial Sequence
  Description of Artificial Sequence: Synthetic oligonucleotide
  Target: ATXN1; (+) strand; PAM type: NRG; PAM sequence: AAG
ctgactaatgactggctttt

SEQ ID NO: 99728 - DNA, 20 bp, Artificial Sequence
  Description of Artificial Sequence: Synthetic oligonucleotide
  Target: ATXN1; (+) strand; PAM type: NRG; PAM sequence: TAG
ctggcttttaagaaaaattt

SEQ ID NO: 99729 - DNA, 20 bp, Artificial Sequence
  Description of Artificial Sequence: Synthetic oligonucleotide
  Target: ATXN1; (+) strand; PAM type: NRG; PAM sequence: TAG
ataaaattcctttcaccact

SEQ ID NO: 99730 - DNA, 20 bp, Artificial Sequence
  Description of Artificial Sequence: Synthetic oligonucleotide
  Target: ATXN1; (+) strand; PAM type: NRG; PAM sequence: TAG
ttgattgtatatttcaatct

SEQ ID NO: 99731 - DNA, 20 bp, Artificial Sequence
  Description of Artificial Sequence: Synthetic oligonucleotide
  Target: ATXN1; (+) strand; PAM type: NRG; PAM sequence: TGG
tgtatatttcaatcttagat

SEQ ID NO: 99732 - DNA, 20 bp, Artificial Sequence
  Description of Artificial Sequence: Synthetic oligonucleotide
  Target: ATXN1; (+) strand; PAM type: NRG; PAM sequence: AAG
atgtacatatcaccaaaaac

SEQ ID NO: 99733 - DNA, 20 bp, Artificial Sequence
  Description of Artificial Sequence: Synthetic oligonucleotide
  Target: ATXN1; (+) strand; PAM type: NRG; PAM sequence: TAG
acatatcaccaaaaacaaga

SEQ ID NO: 99734 - DNA, 20 bp, Artificial Sequence
  Description of Artificial Sequence: Synthetic oligonucleotide
  Target: ATXN1; (+) strand; PAM type: NRG; PAM sequence: AAG
atcaccaaaaacaagataga

SEQ ID NO: 99735 - DNA, 20 bp, Artificial Sequence
  Description of Artificial Sequence: Synthetic oligonucleotide
  Target: ATXN1; (+) strand; PAM type: NRG; PAM sequence: AAG
atgtctcccatttccttcac

SEQ ID NO: 99736 - DNA, 20 bp, Artificial Sequence
  Description of Artificial Sequence: Synthetic oligonucleotide
  Target: ATXN1; (+) strand; PAM type: NRG; PAM sequence: GAG
gtctcccatttccttcacaa

SEQ ID NO: 99737 - DNA, 20 bp, Artificial Sequence
  Description of Artificial Sequence: Synthetic oligonucleotide
  Target: ATXN1; (+) strand; PAM type: NRG; PAM sequence: AAG
ccctgttttcacaaattgcg

SEQ ID NO: 99738 - DNA, 20 bp, Artificial Sequence
  Description of Artificial Sequence: Synthetic oligonucleotide
  Target: ATXN1; (+) strand; PAM type: NRG; PAM sequence: AGG
cctgttttcacaaattgcga

SEQ ID NO: 99739 - DNA, 20 bp, Artificial Sequence
  Description of Artificial Sequence: Synthetic oligonucleotide
  Target: ATXN1; (+) strand; PAM type: NRG; PAM sequence: GGG
ctgttttcacaaattgcgaa

SEQ ID NO: 99740 - DNA, 20 bp, Artificial Sequence
  Description of Artificial Sequence: Synthetic oligonucleotide
  Target: ATXN1; (+) strand; PAM type: NRG; PAM sequence: CAG
attttttcatgacactatcc

SEQ ID NO: 99741 - DNA, 20 bp, Artificial Sequence
  Description of Artificial Sequence: Synthetic oligonucleotide
  Target: ATXN1; (+) strand; PAM type: NRG; PAM sequence: TGG
atacaaatttcgcctgttgc

SEQ ID NO: 99742 - DNA, 20 bp, Artificial Sequence
  Description of Artificial Sequence: Synthetic oligonucleotide
  Target: ATXN1; (+) strand; PAM type: NRG; PAM sequence: GGG
tacaaatttcgcctgttgct

SEQ ID NO: 99743 - DNA, 20 bp, Artificial Sequence
  Description of Artificial Sequence: Synthetic oligonucleotide
  Target: ATXN1; (+) strand; PAM type: NRG; PAM sequence: GAG
caaatttcgcctgttgctgg

SEQ ID NO: 99744 - DNA, 20 bp, Artificial Sequence
  Description of Artificial Sequence: Synthetic oligonucleotide
  Target: ATXN1; (+) strand; PAM type: NRG; PAM sequence: AAG
ggagcaatgaattctctcat

SEQ ID NO: 99745 - DNA, 20 bp, Artificial Sequence
  Description of Artificial Sequence: Synthetic oligonucleotide
  Target: ATXN1; (+) strand; PAM type: NRG; PAM sequence: TAG
caatgaattctctcataagc

SEQ ID NO: 99746 - DNA, 20 bp, Artificial Sequence
  Description of Artificial Sequence: Synthetic oligonucleotide
  Target: ATXN1; (+) strand; PAM type: NRG; PAM sequence: AGG
aatgaattctctcataagct

SEQ ID NO: 99747 - DNA, 20 bp, Artificial Sequence
  Description of Artificial Sequence: Synthetic oligonucleotide
  Target: ATXN1; (+) strand; PAM type: NRG; PAM sequence: CAG
ttctctcataagctaggttt

SEQ ID NO: 99748 - DNA, 20 bp, Artificial Sequence
  Description of Artificial Sequence: Synthetic oligonucleotide
  Target: ATXN1; (+) strand; PAM type: NRG; PAM sequence: AAG
ctcataagctaggtttcagt

SEQ ID NO: 99749 - DNA, 20 bp, Artificial Sequence
  Description of Artificial Sequence: Synthetic oligonucleotide
  Target: ATXN1; (+) strand; PAM type: NRG; PAM sequence: TGG
agtaagtatgtcttgttttt

SEQ ID NO: 99750 - DNA, 20 bp, Artificial Sequence
  Description of Artificial Sequence: Synthetic oligonucleotide
  Target: ATXN1; (+) strand; PAM type: NRG; PAM sequence: TGG
ttttggcgaaattattaaat

SEQ ID NO: 99751 - DNA, 20 bp, Artificial Sequence
  Description of Artificial Sequence: Synthetic oligonucleotide
  Target: ATXN1; (+) strand; PAM type: NRG; PAM sequence: GGG
tttggcgaaattattaaatt

SEQ ID NO: 99752 - DNA, 20 bp, Artificial Sequence
  Description of Artificial Sequence: Synthetic oligonucleotide
  Target: ATXN1; (+) strand; PAM type: NRG; PAM sequence: AAG
gcattcttaactttgtctgc

SEQ ID NO: 99753 - DNA, 20 bp, Artificial Sequence
  Description of Artificial Sequence: Synthetic oligonucleotide
  Target: ATXN1; (+) strand; PAM type: NRG; PAM sequence: CAG
ttgtctgcaagtgaaattct

SEQ ID NO: 99754 - DNA, 20 bp, Artificial Sequence
  Description of Artificial Sequence: Synthetic oligonucleotide
  Target: ATXN1; (+) strand; PAM type: NRG; PAM sequence: TAG
tctcagtcttgttttacctg

SEQ ID NO: 99755 - DNA, 20 bp, Artificial Sequence
  Description of Artificial Sequence: Synthetic oligonucleotide
  Target: ATXN1; (+) strand; PAM type: NRG; PAM sequence: GAG
tcagtcttgttttacctgta

SEQ ID NO: 99756 - DNA, 20 bp, Artificial Sequence
  Description of Artificial Sequence: Synthetic oligonucleotide
  Target: ATXN1; (+) strand; PAM type: NRG; PAM sequence: AAG
tcttgttttacctgtagaga

SEQ ID NO: 99757 - DNA, 20 bp, Artificial Sequence
  Description of Artificial Sequence: Synthetic oligonucleotide
  Target: ATXN1; (+) strand; PAM type: NRG; PAM sequence: AGG
cttgttttacctgtagagaa

SEQ ID NO: 99758 - DNA, 20 bp, Artificial Sequence
  Description of Artificial Sequence: Synthetic oligonucleotide
  Target: ATXN1; (+) strand; PAM type: NRG; PAM sequence: CGG
ttttacctgtagagaaaggc

SEQ ID NO: 99759 - DNA, 20 bp, Artificial Sequence
  Description of Artificial Sequence: Synthetic oligonucleotide
  Target: ATXN1; (+) strand; PAM type: NRG; PAM sequence: TGG
gaaaggccggtctgctttcc

SEQ ID NO: 99760 - DNA, 20 bp, Artificial Sequence
  Description of Artificial Sequence: Synthetic oligonucleotide
  Target: ATXN1; (+) strand; PAM type: NRG; PAM sequence: AAG
aggccggtctgctttcctgg

SEQ ID NO: 99761 - DNA, 20 bp, Artificial Sequence
  Description of Artificial Sequence: Synthetic oligonucleotide
  Target: ATXN1; (+) strand; PAM type: NRG; PAM sequence: AGG
ggccggtctgctttcctgga

SEQ ID NO: 99762 - DNA, 20 bp, Artificial Sequence
  Description of Artificial Sequence: Synthetic oligonucleotide
  Target: ATXN1; (+) strand; PAM type: NRG; PAM sequence: AAG
gtctgctttcctggaaggct

SEQ ID NO: 99763 - DNA, 20 bp, Artificial Sequence
  Description of Artificial Sequence: Synthetic oligonucleotide
  Target: ATXN1; (+) strand; PAM type: NRG; PAM sequence: TGG
cctggaaggctaagtctgca

SEQ ID NO: 99764 - DNA, 20 bp, Artificial Sequence
  Description of Artificial Sequence: Synthetic oligonucleotide
  Target: ATXN1; (+) strand; PAM type: NRG; PAM sequence: CAG
agtctgcatggttacgttct

SEQ ID NO: 99765 - DNA, 20 bp, Artificial Sequence
  Description of Artificial Sequence: Synthetic oligonucleotide
  Target: ATXN1; (+) strand; PAM type: NRG; PAM sequence: CAG
gttctcagcatgaaaaaaat

SEQ ID NO: 99766 - DNA, 20 bp, Artificial Sequence
  Description of Artificial Sequence: Synthetic oligonucleotide
  Target: ATXN1; (+) strand; PAM type: NRG; PAM sequence: AAG
aatcagaaaaccccgtctca

SEQ ID NO: 99767 - DNA, 20 bp, Artificial Sequence
  Description of Artificial Sequence: Synthetic oligonucleotide
  Target: ATXN1; (+) strand; PAM type: NRG; PAM sequence: AAG
aaaaccccgtctcaaagatg

SEQ ID NO: 99768 - DNA, 20 bp, Artificial Sequence
  Description of Artificial Sequence: Synthetic oligonucleotide
  Target: ATXN1; (+) strand; PAM type: NRG; PAM sequence: AGG
aaaccccgtctcaaagatga

SEQ ID NO: 99769 - DNA, 20 bp, Artificial Sequence
  Description of Artificial Sequence: Synthetic oligonucleotide
  Target: ATXN1; (+) strand; PAM type: NRG; PAM sequence: GGG
aaccccgtctcaaagatgaa

SEQ ID NO: 99770 - DNA, 20 bp, Artificial Sequence
  Description of Artificial Sequence: Synthetic oligonucleotide
  Target: ATXN1; (+) strand; PAM type: NRG; PAM sequence: GGG
accccgtctcaaagatgaag

SEQ ID NO: 99771 - DNA, 20 bp, Artificial Sequence
  Description of Artificial Sequence: Synthetic oligonucleotide
  Target: ATXN1; (+) strand; PAM type: NRG; PAM sequence: GGG
ccccgtctcaaagatgaagg

SEQ ID NO: 99772 - DNA, 20 bp, Artificial Sequence
  Description of Artificial Sequence: Synthetic oligonucleotide
  Target: ATXN1; (+) strand; PAM type: NRG; PAM sequence: AAG
gtctcaaagatgaagggggt

SEQ ID NO: 99773 - DNA, 20 bp, Artificial Sequence
  Description of Artificial Sequence: Synthetic oligonucleotide
  Target: ATXN1; (+) strand; PAM type: NRG; PAM sequence: GAG
caaagatgaagggggtaagc

SEQ ID NO: 99774 - DNA, 20 bp, Artificial Sequence
  Description of Artificial Sequence: Synthetic oligonucleotide
  Target: ATXN1; (+) strand; PAM type: NRG; PAM sequence: GAG
aagatgaagggggtaagcga

SEQ ID NO: 99775 - DNA, 20 bp, Artificial Sequence
  Description of Artificial Sequence: Synthetic oligonucleotide
  Target: ATXN1; (+) strand; PAM type: NRG; PAM sequence: CAG
ttaaaaatcattaataaaaa

SEQ ID NO: 99776 - DNA, 20 bp, Artificial Sequence
  Description of Artificial Sequence: Synthetic oligonucleotide
  Target: ATXN1; (+) strand; PAM type: NRG; PAM sequence: TGG
taaaaacagtcaaaacgctt

SEQ ID NO: 99777 - DNA, 20 bp, Artificial Sequence
  Description of Artificial Sequence: Synthetic oligonucleotide
  Target: ATXN1; (+) strand; PAM type: NRG; PAM sequence: GAG
acagtcaaaacgctttggct

SEQ ID NO: 99778 - DNA, 20 bp, Artificial Sequence
  Description of Artificial Sequence: Synthetic oligonucleotide
  Target: ATXN1; (+) strand; PAM type: NRG; PAM sequence: AAG
aaaacgctttggctgagtgt

SEQ ID NO: 99779 - DNA, 20 bp, Artificial Sequence
  Description of Artificial Sequence: Synthetic oligonucleotide
  Target: ATXN1; (+) strand; PAM type: NRG; PAM sequence: GAG
ctgagtgtaagaatctctgt

SEQ ID NO: 99780 - DNA, 20 bp, Artificial Sequence
  Description of Artificial Sequence: Synthetic oligonucleotide
  Target: ATXN1; (+) strand; PAM type: NRG; PAM sequence: AAG
cactgaatcatgttcacgca

SEQ ID NO: 99781 - DNA, 20 bp, Artificial Sequence
  Description of Artificial Sequence: Synthetic oligonucleotide
  Target: ATXN1; (+) strand; PAM type: NRG; PAM sequence: CAG
tgttcacgcaaagcctgact

SEQ ID NO: 99782 - DNA, 20 bp, Artificial Sequence
  Description of Artificial Sequence: Synthetic oligonucleotide
  Target: ATXN1; (+) strand; PAM type: NRG; PAM sequence: TGG
gcaaagcctgactcagtcct

SEQ ID NO: 99783 - DNA, 20 bp, Artificial Sequence
  Description of Artificial Sequence: Synthetic oligonucleotide
  Target: ATXN1; (+) strand; PAM type: NRG; PAM sequence: TGG
aagcctgactcagtccttgg

SEQ ID NO: 99784 - DNA, 20 bp, Artificial Sequence
  Description of Artificial Sequence: Synthetic oligonucleotide
  Target: ATXN1; (+) strand; PAM type: NRG; PAM sequence: AAG
cctgactcagtccttggtgg

SEQ ID NO: 99785 - DNA, 20 bp, Artificial Sequence
  Description of Artificial Sequence: Synthetic oligonucleotide
  Target: ATXN1; (+) strand; PAM type: NRG; PAM sequence: CAG
agtccttggtggaagtgttt

SEQ ID NO: 99786 - DNA, 20 bp, Artificial Sequence
  Description of Artificial Sequence: Synthetic oligonucleotide
  Target: ATXN1; (+) strand; PAM type: NRG; PAM sequence: AGG
gtccttggtggaagtgtttc

SEQ ID NO: 99787 - DNA, 20 bp, Artificial Sequence
  Description of Artificial Sequence: Synthetic oligonucleotide
  Target: ATXN1; (+) strand; PAM type: NRG; PAM sequence: GGG
tccttggtggaagtgtttca

SEQ ID NO: 99788 - DNA, 20 bp, Artificial Sequence
  Description of Artificial Sequence: Synthetic oligonucleotide
  Target: ATXN1; (+) strand; PAM type: NRG; PAM sequence: CAG
ggaagtgtttcagggttgtt

SEQ ID NO: 99789 - DNA, 20 bp, Artificial Sequence
  Description of Artificial Sequence: Synthetic oligonucleotide
  Target: ATXN1; (+) strand; PAM type: NRG; PAM sequence: TAG
tgttcagtaaacccacaccc

SEQ ID NO: 99790 - DNA, 20 bp, Artificial Sequence
  Description of Artificial Sequence: Synthetic oligonucleotide
  Target: ATXN1; (+) strand; PAM type: NRG; PAM sequence: CGG
gtaaacccacaccctagcac

SEQ ID NO: 99791 - DNA, 20 bp, Artificial Sequence
  Description of Artificial Sequence: Synthetic oligonucleotide
  Target: ATXN1; (+) strand; PAM type: NRG; PAM sequence: GGG
taaacccacaccctagcacc

SEQ ID NO: 99792 - DNA, 20 bp, Artificial Sequence
  Description of Artificial Sequence: Synthetic oligonucleotide
  Target: ATXN1; (+) strand; PAM type: NRG; PAM sequence: AAG
taacacaaatcccacattaa

SEQ ID NO: 99793 - DNA, 20 bp, Artificial Sequence
  Description of Artificial Sequence: Synthetic oligonucleotide
  Target: ATXN1; (+) strand; PAM type: NRG; PAM sequence: TGG
acaaatcccacattaaaagc

SEQ ID NO: 99794 - DNA, 20 bp, Artificial Sequence
  Description of Artificial Sequence: Synthetic oligonucleotide
  Target: ATXN1; (+) strand; PAM type: NRG; PAM sequence: GGG
caaatcccacattaaaagct

SEQ ID NO: 99795 - DNA, 20 bp, Artificial Sequence
  Description of Artificial Sequence: Synthetic oligonucleotide
  Target: ATXN1; (+) strand; PAM type: NRG; PAM sequence: TGG
agctgggtttttcttacaca

SEQ ID NO: 99796 - DNA, 20 bp, Artificial Sequence
  Description of Artificial Sequence: Synthetic oligonucleotide
  Target: ATXN1; (+) strand; PAM type: NRG; PAM sequence: TAG
tgggtttttcttacacatgg

SEQ ID NO: 99797 - DNA, 20 bp, Artificial Sequence
  Description of Artificial Sequence: Synthetic oligonucleotide
  Target: ATXN1; (+) strand; PAM type: NRG; PAM sequence: TGG
ttttcttacacatggtagcg

SEQ ID NO: 99798 - DNA, 20 bp, Artificial Sequence
  Description of Artificial Sequence: Synthetic oligonucleotide
  Target: ATXN1; (+) strand; PAM type: NRG; PAM sequence: CAG
acacatggtagcgtggctca

SEQ ID NO: 99799 - DNA, 20 bp, Artificial Sequence
  Description of Artificial Sequence: Synthetic oligonucleotide
  Target: ATXN1; (+) strand; PAM type: NRG; PAM sequence: GAG
acatggtagcgtggctcaca

SEQ ID NO: 99800 - DNA, 20 bp, Artificial Sequence
  Description of Artificial Sequence: Synthetic oligonucleotide
  Target: ATXN1; (+) strand; PAM type: NRG; PAM sequence: TGG
tggctcacagagctcccttg

SEQ ID NO: 99801 - DNA, 20 bp, Artificial Sequence
  Description of Artificial Sequence: Synthetic oligonucleotide
  Target: ATXN1; (+) strand; PAM type: NRG; PAM sequence: GGG
ggctcacagagctcccttgt

SEQ ID NO: 99802 - DNA, 20 bp, Artificial Sequence
  Description of Artificial Sequence: Synthetic oligonucleotide
  Target: ATXN1; (+) strand; PAM type: NRG; PAM sequence: AAG
tcacagagctcccttgtggg

SEQ ID NO: 99803 - DNA, 20 bp, Artificial Sequence
  Description of Artificial Sequence: Synthetic oligonucleotide
  Target: ATXN1; (+) strand; PAM type: NRG; PAM sequence: AGG
cacagagctcccttgtggga

SEQ ID NO: 99804 - DNA, 20 bp, Artificial Sequence
  Description of Artificial Sequence: Synthetic oligonucleotide
  Target: ATXN1; (+) strand; PAM type: NRG; PAM sequence: TGG
tcccttgtgggaaggccctg

SEQ ID NO: 99805 - DNA, 20 bp, Artificial Sequence
  Description of Artificial Sequence: Synthetic oligonucleotide
  Target: ATXN1; (+) strand; PAM type: NRG; PAM sequence: GGG
cccttgtgggaaggccctgt

SEQ ID NO: 99806 - DNA, 20 bp, Artificial Sequence
  Description of Artificial Sequence: Synthetic oligonucleotide
  Target: ATXN1; (+) strand; PAM type: NRG; PAM sequence: GGG
ccttgtgggaaggccctgtg

SEQ ID NO: 99807 - DNA, 20 bp, Artificial Sequence
  Description of Artificial Sequence: Synthetic oligonucleotide
  Target: ATXN1; (+) strand; PAM type: NRG; PAM sequence: GAG
ttgtgggaaggccctgtggg

SEQ ID NO: 99808 - DNA, 20 bp, Artificial Sequence
  Description of Artificial Sequence: Synthetic oligonucleotide
  Target: ATXN1; (+) strand; PAM type: NRG; PAM sequence: AGG
tgtgggaaggccctgtgggg

SEQ ID NO: 99809 - DNA, 20 bp, Artificial Sequence
  Description of Artificial Sequence: Synthetic oligonucleotide
  Target: ATXN1; (+) strand; PAM type: NRG; PAM sequence: CAG
gaaggccctgtggggaggct

SEQ ID NO: 99810 - DNA, 20 bp, Artificial Sequence
  Description of Artificial Sequence: Synthetic oligonucleotide
  Target: ATXN1; (+) strand; PAM type: NRG; PAM sequence: AGG
aaggccctgtggggaggctc

SEQ ID NO: 99811 - DNA, 20 bp, Artificial Sequence
  Description of Artificial Sequence: Synthetic oligonucleotide
  Target: ATXN1; (+) strand; PAM type: NRG; PAM sequence: GGG
aggccctgtggggaggctca

SEQ ID NO: 99812 - DNA, 20 bp, Artificial Sequence
  Description of Artificial Sequence: Synthetic oligonucleotide
  Target: ATXN1; (+) strand; PAM type: NRG; PAM sequence: TGG
cctgtggggaggctcaggga

SEQ ID NO: 99813 - DNA, 20 bp, Artificial Sequence
  Description of Artificial Sequence: Synthetic oligonucleotide
  Target: ATXN1; (+) strand; PAM type: NRG; PAM sequence: CAG
tggggaggctcagggatggc

SEQ ID NO: 99814 - DNA, 20 bp, Artificial Sequence
  Description of Artificial Sequence: Synthetic oligonucleotide
  Target: ATXN1; (+) strand; PAM type: NRG; PAM sequence: AGG
ggggaggctcagggatggcc

SEQ ID NO: 99815 - DNA, 20 bp, Artificial Sequence
  Description of Artificial Sequence: Synthetic oligonucleotide
  Target: ATXN1; (+) strand; PAM type: NRG; PAM sequence: AAG
gaggctcagggatggccagg

SEQ ID NO: 99816 - DNA, 20 bp, Artificial Sequence
  Description of Artificial Sequence: Synthetic oligonucleotide
  Target: ATXN1; (+) strand; PAM type: NRG; PAM sequence: AGG
aggctcagggatggccagga

SEQ ID NO: 99817 - DNA, 20 bp, Artificial Sequence
  Description of Artificial Sequence: Synthetic oligonucleotide
  Target: ATXN1; (+) strand; PAM type: NRG; PAM sequence: CAG
tggccaggaaggacactgcc

SEQ ID NO: 99818 - DNA, 20 bp, Artificial Sequence
  Description of Artificial Sequence: Synthetic oligonucleotide
  Target: ATXN1; (+) strand; PAM type: NRG; PAM sequence: GAG
caggaaggacactgcccagt

SEQ ID NO: 99819 - DNA, 20 bp, Artificial Sequence
  Description of Artificial Sequence: Synthetic oligonucleotide
  Target: ATXN1; (+) strand; PAM type: NRG; PAM sequence: CAG
cactgcccagtgagtgacca

SEQ ID NO: 99820 - DNA, 20 bp, Artificial Sequence
  Description of Artificial Sequence: Synthetic oligonucleotide
  Target: ATXN1; (+) strand; PAM type: NRG; PAM sequence: CAG
tgcccagtgagtgaccacag

SEQ ID NO: 99821 - DNA, 20 bp, Artificial Sequence
  Description of Artificial Sequence: Synthetic oligonucleotide
  Target: ATXN1; (+) strand; PAM type: NRG; PAM sequence: CGG
tgaccacagcagctgtgaca

SEQ ID NO: 99822 - DNA, 20 bp, Artificial Sequence
  Description of Artificial Sequence: Synthetic oligonucleotide
  Target: ATXN1; (+) strand; PAM type: NRG; PAM sequence: AAG
ccacagcagctgtgacacgg

SEQ ID NO: 99823 - DNA, 20 bp, Artificial Sequence
  Description of Artificial Sequence: Synthetic oligonucleotide
  Target: ATXN1; (+) strand; PAM type: NRG; PAM sequence: TAG
agctgtgacacggaagccct

SEQ ID NO: 99824 - DNA, 20 bp, Artificial Sequence
  Description of Artificial Sequence: Synthetic oligonucleotide
  Target: ATXN1; (+) strand; PAM type: NRG; PAM sequence: AGG
gctgtgacacggaagccctt

SEQ ID NO: 99825 - DNA, 20 bp, Artificial Sequence
  Description of Artificial Sequence: Synthetic oligonucleotide
  Target: ATXN1; (+) strand; PAM type: NRG; PAM sequence: CAG
cacggaagcccttaggcaca

SEQ ID NO: 99826 - DNA, 20 bp, Artificial Sequence
  Description of Artificial Sequence: Synthetic oligonucleotide
  Target: ATXN1; (+) strand; PAM type: NRG; PAM sequence: AGG
acggaagcccttaggcacac

SEQ ID NO: 99827 - DNA, 20 bp, Artificial Sequence
  Description of Artificial Sequence: Synthetic oligonucleotide
  Target: ATXN1; (+) strand; PAM type: NRG; PAM sequence: TAG
gcccttaggcacacaggttc

SEQ ID NO: 99828 - DNA, 20 bp, Artificial Sequence
  Description of Artificial Sequence: Synthetic oligonucleotide
  Target: ATXN1; (+) strand; PAM type: NRG; PAM sequence: TGG
gctcacttgccttccttttc

SEQ ID NO: 99829 - DNA, 20 bp, Artificial Sequence
  Description of Artificial Sequence: Synthetic oligonucleotide
  Target: ATXN1; (+) strand; PAM type: NRG; PAM sequence: GGG
ctcacttgccttccttttct

SEQ ID NO: 99830 - DNA, 20 bp, Artificial Sequence
  Description of Artificial Sequence: Synthetic oligonucleotide
  Target: ATXN1; (+) strand; PAM type: NRG; PAM sequence: GGG
tcacttgccttccttttctg

SEQ ID NO: 99831 - DNA, 20 bp, Artificial Sequence
  Description of Artificial Sequence: Synthetic oligonucleotide
  Target: ATXN1; (+) strand; PAM type: NRG; PAM sequence: TAG
gggccttaaaatgtgtgcct

SEQ ID NO: 99832 - DNA, 20 bp, Artificial Sequence
  Description of Artificial Sequence: Synthetic oligonucleotide
  Target: ATXN1; (+) strand; PAM type: NRG; PAM sequence: AGG
ggccttaaaatgtgtgcctt

SEQ ID NO: 99833 - DNA, 20 bp, Artificial Sequence
  Description of Artificial Sequence: Synthetic oligonucleotide
  Target: ATXN1; (+) strand; PAM type: NRG; PAM sequence: CAG
cttaaaatgtgtgccttagg

SEQ ID NO: 99834 - DNA, 20 bp, Artificial Sequence
  Description of Artificial Sequence: Synthetic oligonucleotide
  Target: ATXN1; (+) strand; PAM type: NRG; PAM sequence: AGG
ttaaaatgtgtgccttaggc

SEQ ID NO: 99835 - DNA, 20 bp, Artificial Sequence
  Description of Artificial Sequence: Synthetic oligonucleotide
  Target: ATXN1; (+) strand; PAM type: NRG; PAM sequence: GGG
taaaatgtgtgccttaggca

SEQ ID NO: 99836 - DNA, 20 bp, Artificial Sequence
  Description of Artificial Sequence: Synthetic oligonucleotide
  Target: ATXN1; (+) strand; PAM type: NRG; PAM sequence: AAG
aatgtgtgccttaggcaggg

SEQ ID NO: 99837 - DNA, 20 bp, Artificial Sequence
  Description of Artificial Sequence: Synthetic oligonucleotide
  Target: ATXN1; (+) strand; PAM type: NRG; PAM sequence: AGG
atgtgtgccttaggcaggga

SEQ ID NO: 99838 - DNA, 20 bp, Artificial Sequence
  Description of Artificial Sequence: Synthetic oligonucleotide
  Target: ATXN1; (+) strand; PAM type: NRG; PAM sequence: GGG
tgtgtgccttaggcagggaa

SEQ ID NO: 99839 - DNA, 20 bp, Artificial Sequence
  Description of Artificial Sequence: Synthetic oligonucleotide
  Target: ATXN1; (+) strand; PAM type: NRG; PAM sequence: TGG
gtgccttaggcagggaaggg

SEQ ID NO: 99840 - DNA, 20 bp, Artificial Sequence
  Description of Artificial Sequence: Synthetic oligonucleotide
  Target: ATXN1; (+) strand; PAM type: NRG; PAM sequence: CAG
gtggctcatccctgtaatcc

SEQ ID NO: 99841 - DNA, 20 bp, Artificial Sequence
  Description of Artificial Sequence: Synthetic oligonucleotide
  Target: ATXN1; (+) strand; PAM type: NRG; PAM sequence: TGG
tccctgtaatcccagcactt

SEQ ID NO: 99842 - DNA, 20 bp, Artificial Sequence
  Description of Artificial Sequence: Synthetic oligonucleotide
  Target: ATXN1; (+) strand; PAM type: NRG; PAM sequence: GGG
ccctgtaatcccagcacttt

SEQ ID NO: 99843 - DNA, 20 bp, Artificial Sequence
  Description of Artificial Sequence: Synthetic oligonucleotide
  Target: ATXN1; (+) strand; PAM type: NRG; PAM sequence: GGG
cctgtaatcccagcactttg

SEQ ID NO: 99844 - DNA, 20 bp, Artificial Sequence
  Description of Artificial Sequence: Synthetic oligonucleotide
  Target: ATXN1; (+) strand; PAM type: NRG; PAM sequence: GGG
ctgtaatcccagcactttgg

SEQ ID NO: 99845 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggggcct

SEQ ID NO: 99846 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggggcctg

SEQ ID NO: 99847 - DNA, 20 bp, Artificial Sequence
  Description of Artificial Sequence: Synthetic oligonucleotide
  Target: ATXN1; (+) strand; PAM type: NRG; PAM sequence: CGG
agcactttgggggcctgagg

SEQ ID NO: 99848 - DNA, 20 bp, Artificial Sequence
  Description of Artificial Sequence: Synthetic oligonucleotide
  Target: ATXN1; (+) strand; PAM type: NRG; PAM sequence: GGG
gcactttgggggcctgaggc

SEQ ID NO: 99849 - DNA, 20 bp, Artificial Sequence
  Description of Artificial Sequence: Synthetic oligonucleotide
  Target: ATXN1; (+) strand; PAM type: NRG; PAM sequence: GAG
actttgggggcctgaggcgg

SEQ ID NO: 99850 - DNA, 20 bp, Artificial Sequence
  Description of Artificial Sequence: Synthetic oligonucleotide
  Target: ATXN1; (+) strand; PAM type: NRG; PAM sequence: AGG
ctttgggggcctgaggcggg

SEQ ID NO: 99851 - DNA, 20 bp, Artificial Sequence
  Description of Artificial Sequence: Synthetic oligonucleotide
  Target: ATXN1; (+) strand; PAM type: NRG; PAM sequence: GAG
ctgaggcgggaggatcacat

SEQ ID NO: 99852 - DNA, 20 bp, Artificial Sequence
  Description of Artificial Sequence: Synthetic oligonucleotide
  Target: ATXN1; (+) strand; PAM type: NRG; PAM sequence: CAG
gcgggaggatcacatgagct

SEQ ID NO: 99853 - DNA, 20 bp, Artificial Sequence
  Description of Artificial Sequence: Synthetic oligonucleotide
  Target: ATXN1; (+) strand; PAM type: NRG; PAM sequence: AGG
cgggaggatcacatgagctc

SEQ ID NO: 99854 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacatgagctcag

SEQ ID NO: 99855 - DNA, 20 bp, Artificial Sequence
  Description of Artificial Sequence: Synthetic oligonucleotide
  Target: ATXN1; (+) strand; PAM type: NRG; PAM sequence: AAG
tcacatgagctcaggagttc

SEQ ID NO: 99856 - DNA, 20 bp, Artificial Sequence
  Description of Artificial Sequence: Synthetic oligonucleotide
  Target: ATXN1; (+) strand; PAM type: NRG; PAM sequence: GAG
acatgagctcaggagttcaa

SEQ ID NO: 99857 - DNA, 20 bp, Artificial Sequence
  Description of Artificial Sequence: Synthetic oligonucleotide
  Target: ATXN1; (+) strand; PAM type: NRG; PAM sequence: CAG
tgagctcaggagttcaagag

SEQ ID NO: 99858 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagagcagcc

SEQ ID NO: 99859 - DNA, 20 bp, Artificial Sequence
  Description of Artificial Sequence: Synthetic oligonucleotide
  Target: ATXN1; (+) strand; PAM type: NRG; PAM sequence: GGG
caggagttcaagagcagcct

SEQ ID NO: 99860 - DNA, 20 bp, Artificial Sequence
  Description of Artificial Sequence: Synthetic oligonucleotide
  Target: ATXN1; (+) strand; PAM type: NRG; PAM sequence: TGG
caagagcagcctgggcaaca

SEQ ID NO: 99861 - DNA, 20 bp, Artificial Sequence
  Description of Artificial Sequence: Synthetic oligonucleotide
  Target: ATXN1; (+) strand; PAM type: NRG; PAM sequence: AAG
agcagcctgggcaacatggc

SEQ ID NO: 99862 - DNA, 20 bp, Artificial Sequence
  Description of Artificial Sequence: Synthetic oligonucleotide
  Target: ATXN1; (+) strand; PAM type: NRG; PAM sequence: TAG
accccgtctctacaaaaaaa

SEQ ID NO: 99863 - DNA, 20 bp, Artificial Sequence
  Description of Artificial Sequence: Synthetic oligonucleotide
  Target: ATXN1; (+) strand; PAM type: NRG; PAM sequence: TAG
ctacaaaaaaatagaaaaat

SEQ ID NO: 99864 - DNA, 20 bp, Artificial Sequence
  Description of Artificial Sequence: Synthetic oligonucleotide
  Target: ATXN1; (+) strand; PAM type: NRG; PAM sequence: TGG
aaaaaaatagaaaaattagc

SEQ ID NO: 99865 - DNA, 20 bp, Artificial Sequence
  Description of Artificial Sequence: Synthetic oligonucleotide
  Target: ATXN1; (+) strand; PAM type: NRG; PAM sequence: GGG
aaaaaatagaaaaattagct

SEQ ID NO: 99866 - DNA, 20 bp, Artificial Sequence
  Description of Artificial Sequence: Synthetic oligonucleotide
  Target: ATXN1; (+) strand; PAM type: NRG; PAM sequence: TGG
atagaaaaattagctgggcg

SEQ ID NO: 99867 - DNA, 20 bp, Artificial Sequence
  Description of Artificial Sequence: Synthetic oligonucleotide
  Target: ATXN1; (+) strand; PAM type: NRG; PAM sequence: TGG
gaaaaattagctgggcgtgg

SEQ ID NO: 99868 - DNA, 20 bp, Artificial Sequence
  Description of Artificial Sequence: Synthetic oligonucleotide
  Target: ATXN1; (+) strand; PAM type: NRG; PAM sequence: TGG
ggcgtggtggtgtgtacttg

SEQ ID NO: 99869 - DNA, 20 bp, Artificial Sequence
  Description of Artificial Sequence: Synthetic oligonucleotide
  Target: ATXN1; (+) strand; PAM type: NRG; PAM sequence: TAG
gtacttgtggtccctgttcc

SEQ ID NO: 99870 - DNA, 20 bp, Artificial Sequence
  Description of Artificial Sequence: Synthetic oligonucleotide
  Target: ATXN1; (+) strand; PAM type: NRG; PAM sequence: AGG
tacttgtggtccctgttcct

SEQ ID NO: 99871 - DNA, 20 bp, Artificial Sequence
  Description of Artificial Sequence: Synthetic oligonucleotide
  Target: ATXN1; (+) strand; PAM type: NRG; PAM sequence: GGG
acttgtggtccctgttccta

SEQ ID NO: 99872 - DNA, 20 bp, Artificial Sequence
  Description of Artificial Sequence: Synthetic oligonucleotide
  Target: ATXN1; (+) strand; PAM type: NRG; PAM sequence: GAG
ttgtggtccctgttcctagg

SEQ ID NO: 99873 - DNA, 20 bp, Artificial Sequence
  Description of Artificial Sequence: Synthetic oligonucleotide
  Target: ATXN1; (+) strand; PAM type: NRG; PAM sequence: AGG
tgtggtccctgttcctaggg

SEQ ID NO: 99874 - DNA, 20 bp, Artificial Sequence
  Description of Artificial Sequence: Synthetic oligonucleotide
  Target: ATXN1; (+) strand; PAM type: NRG; PAM sequence: AAG
ccctgttcctagggaggctg

SEQ ID NO: 99875 - DNA, 20 bp, Artificial Sequence
  Description of Artificial Sequence: Synthetic oligonucleotide
  Target: ATXN1; (+) strand; PAM type: NRG; PAM sequence: TGG
tgttcctagggaggctgaag

SEQ ID NO: 99876 - DNA, 20 bp, Artificial Sequence
  Description of Artificial Sequence: Synthetic oligonucleotide
  Target: ATXN1; (+) strand; PAM type: NRG; PAM sequence: GGG
gttcctagggaggctgaagt

SEQ ID NO: 99877 - DNA, 20 bp, Artificial Sequence
  Description of Artificial Sequence: Synthetic oligonucleotide
  Target: ATXN1; (+) strand; PAM type: NRG; PAM sequence: GAG
tcctagggaggctgaagtgg

SEQ ID NO: 99878 - DNA, 20 bp, Artificial Sequence
  Description of Artificial Sequence: Synthetic oligonucleotide
  Target: ATXN1; (+) strand; PAM type: NRG; PAM sequence: AGG
cctagggaggctgaagtggg

SEQ ID NO: 99879 - DNA, 20 bp, Artificial Sequence
  Description of Artificial Sequence: Synthetic oligonucleotide
  Target: ATXN1; (+) strand; PAM type: NRG; PAM sequence: GAG
ctgaagtgggaggattgctt

SEQ ID NO: 99880 - DNA, 20 bp, Artificial Sequence
  Description of Artificial Sequence: Synthetic oligonucleotide
  Target: ATXN1; (+) strand; PAM type: NRG; PAM sequence: TAG
gtgggaggattgcttgagcc

SEQ ID NO: 99881 - DNA, 20 bp, Artificial Sequence
  Description of Artificial Sequence: Synthetic oligonucleotide
  Target: ATXN1; (+) strand; PAM type: NRG; PAM sequence: AGG
tgggaggattgcttgagcct

SEQ ID NO: 99882 - DNA, 20 bp, Artificial Sequence
  Description of Artificial Sequence: Synthetic oligonucleotide
  Target: ATXN1; (+) strand; PAM type: NRG; PAM sequence: GAG
ggaggattgcttgagcctag

SEQ ID NO: 99883 - DNA, 20 bp, Artificial Sequence
  Description of Artificial Sequence: Synthetic oligonucleotide
  Target: ATXN1; (+) strand; PAM type: NRG; PAM sequence: AGG
gaggattgcttgagcctagg

SEQ ID NO: 99884 - DNA, 20 bp, Artificial Sequence
  Description of Artificial Sequence: Synthetic oligonucleotide
  Target: ATXN1; (+) strand; PAM type: NRG; PAM sequence: AAG
tgcttgagcctaggaggtca

SEQ ID NO: 99885 - DNA, 20 bp, Artificial Sequence
  Description of Artificial Sequence: Synthetic oligonucleotide
  Target: ATXN1; (+) strand; PAM type: NRG; PAM sequence: CAG
agcctaggaggtcaaagctg

SEQ ID NO: 99886 - DNA, 20 bp, Artificial Sequence
  Description of Artificial Sequence: Synthetic oligonucleotide
  Target: ATXN1; (+) strand; PAM type: NRG; PAM sequence: GAG
taggaggtcaaagctgcagt

SEQ ID NO: 99887 - DNA, 20 bp, Artificial Sequence
  Description of Artificial Sequence: Synthetic oligonucleotide
  Target: ATXN1; (+) strand; PAM type: NRG; PAM sequence: TGG
aaagctgcagtgagctatta

SEQ ID NO: 99888 - DNA, 20 bp, Artificial Sequence
  Description of Artificial Sequence: Synthetic oligonucleotide
  Target: ATXN1; (+) strand; PAM type: NRG; PAM sequence: CAG
attatggtgtcactgcactc

SEQ ID NO: 99889 - DNA, 20 bp, Artificial Sequence
  Description of Artificial Sequence: Synthetic oligonucleotide
  Target: ATXN1; (+) strand; PAM type: NRG; PAM sequence: TGG
ggtgtcactgcactccagcc

SEQ ID NO: 99890 - DNA, 20 bp, Artificial Sequence
  Description of Artificial Sequence: Synthetic oligonucleotide
  Target: ATXN1; (+) strand; PAM type: NRG; PAM sequence: GGG
gtgtcactgcactccagcct

SEQ ID NO: 99891 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcaa

SEQ ID NO: 99892 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcaaca

SEQ ID NO: 99893 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcaacagagc

SEQ ID NO: 99894 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaatgtgcctta

SEQ ID NO: 99895 - DNA, 20 bp, Artificial Sequence
  Description of Artificial Sequence: Synthetic oligonucleotide
  Target: ATXN1; (+) strand; PAM type: NRG; PAM sequence: CAG
ttaaagaacaacataatatt

SEQ ID NO: 99896 - DNA, 20 bp, Artificial Sequence
  Description of Artificial Sequence: Synthetic oligonucleotide
  Target: ATXN1; (+) strand; PAM type: NRG; PAM sequence: AAG
acataatattcagtgctaaa

SEQ ID NO: 99897 - DNA, 20 bp, Artificial Sequence
  Description of Artificial Sequence: Synthetic oligonucleotide
  Target: ATXN1; (+) strand; PAM type: NRG; PAM sequence: GAG
attcagtgctaaaaagaaat

SEQ ID NO: 99898 - DNA, 20 bp, Artificial Sequence
  Description of Artificial Sequence: Synthetic oligonucleotide
  Target: ATXN1; (+) strand; PAM type: NRG; PAM sequence: CAG
gctaaaaagaaatgagctat

SEQ ID NO: 99899 - DNA, 20 bp, Artificial Sequence
  Description of Artificial Sequence: Synthetic oligonucleotide
  Target: ATXN1; (+) strand; PAM type: NRG; PAM sequence: GAG
taaaaagaaatgagctatca

SEQ ID NO: 99900 - DNA, 20 bp, Artificial Sequence
  Description of Artificial Sequence: Synthetic oligonucleotide
  Target: ATXN1; (+) strand; PAM type: NRG; PAM sequence: AAG
aaatgagctatcagagcaac

SEQ ID NO: 99901 - DNA, 20 bp, Artificial Sequence
  Description of Artificial Sequence: Synthetic oligonucleotide
  Target: ATXN1; (+) strand; PAM type: NRG; PAM sequence: AAG
tgagctatcagagcaacaag

SEQ ID NO: 99902 - DNA, 20 bp, Artificial Sequence
  Description of Artificial Sequence: Synthetic oligonucleotide
  Target: ATXN1; (+) strand; PAM type: NRG; PAM sequence: TGG
atcagagcaacaagaagaca

SEQ ID NO: 99903 - DNA, 20 bp, Artificial Sequence
  Description of Artificial Sequence: Synthetic oligonucleotide
  Target: ATXN1; (+) strand; PAM type: NRG; PAM sequence: AAG
agagcaacaagaagacatgg

SEQ ID NO: 99904 - DNA, 20 bp, Artificial Sequence
  Description of Artificial Sequence: Synthetic oligonucleotide
  Target: ATXN1; (+) strand; PAM type: NRG; PAM sequence: AAG
aacctgaaatgcatatcgct

SEQ ID NO: 99905 - DNA, 20 bp, Artificial Sequence
  Description of Artificial Sequence: Synthetic oligonucleotide
  Target: ATXN1; (+) strand; PAM type: NRG; PAM sequence: GAG
tgaaatgcatatcgctaagt

SEQ ID NO: 99906 - DNA, 20 bp, Artificial Sequence
  Description of Artificial Sequence: Synthetic oligonucleotide
  Target: ATXN1; (+) strand; PAM type: NRG; PAM sequence: GAG
aaatgcatatcgctaagtga

SEQ ID NO: 99907 - DNA, 20 bp, Artificial Sequence
  Description of Artificial Sequence: Synthetic oligonucleotide
  Target: ATXN1; (+) strand; PAM type: NRG; PAM sequence: AAG
gtgagagacgccaatgtgaa

SEQ ID NO: 99908 - DNA, 20 bp, Artificial Sequence
  Description of Artificial Sequence: Synthetic oligonucleotide
  Target: ATXN1; (+) strand; PAM type: NRG; PAM sequence: AGG
tgagagacgccaatgtgaaa

SEQ ID NO: 99909 - DNA, 20 bp, Artificial Sequence
  Description of Artificial Sequence: Synthetic oligonucleotide
  Target: ATXN1; (+) strand; PAM type: NRG; PAM sequence: CGG
aatgtgaaaaggcgacatac

SEQ ID NO: 99910 - DNA, 20 bp, Artificial Sequence
  Description of Artificial Sequence: Synthetic oligonucleotide
  Target: ATXN1; (+) strand; PAM type: NRG; PAM sequence: TGG
accggatgattccaactgca

SEQ ID NO: 99911 - DNA, 20 bp, Artificial Sequence
  Description of Artificial Sequence: Synthetic oligonucleotide
  Target: ATXN1; (+) strand; PAM type: NRG; PAM sequence: TGG
attccaactgcatggcattc

SEQ ID NO: 99912 - DNA, 20 bp, Artificial Sequence
  Description of Artificial Sequence: Synthetic oligonucleotide
  Target: ATXN1; (+) strand; PAM type: NRG; PAM sequence: CAG
aactgcatggcattctggaa

SEQ ID NO: 99913 - DNA, 20 bp, Artificial Sequence
  Description of Artificial Sequence: Synthetic oligonucleotide
  Target: ATXN1; (+) strand; PAM type: NRG; PAM sequence: AGG
actgcatggcattctggaac

SEQ ID NO: 99914 - DNA, 20 bp, Artificial Sequence
  Description of Artificial Sequence: Synthetic oligonucleotide
  Target: ATXN1; (+) strand; PAM type: NRG; PAM sequence: TGG
ttctggaacaggcaaaacta

SEQ ID NO: 99915 - DNA, 20 bp, Artificial Sequence
  Description of Artificial Sequence: Synthetic oligonucleotide
  Target: ATXN1; (+) strand; PAM type: NRG; PAM sequence: GAG
ctggaacaggcaaaactatg

SEQ ID NO: 99916 - DNA, 20 bp, Artificial Sequence
  Description of Artificial Sequence: Synthetic oligonucleotide
  Target: ATXN1; (+) strand; PAM type: NRG; PAM sequence: GAG
ggaacaggcaaaactatgga

SEQ ID NO: 99917 - DNA, 20 bp, Artificial Sequence
  Description of Artificial Sequence: Synthetic oligonucleotide
  Target: ATXN1; (+) strand; PAM type: NRG; PAM sequence: GAG
aacaggcaaaactatggaga

SEQ ID NO: 99918 - DNA, 20 bp, Artificial Sequence
  Description of Artificial Sequence: Synthetic oligonucleotide
  Target: ATXN1; (+) strand; PAM type: NRG; PAM sequence: CAG
tatggagagagtaaaatgat

SEQ ID NO: 99919 - DNA, 20 bp, Artificial Sequence
  Description of Artificial Sequence: Synthetic oligonucleotide
  Target: ATXN1; (+) strand; PAM type: NRG; PAM sequence: TGG
ggagagagtaaaatgatcag

SEQ ID NO: 99920 - DNA, 20 bp, Artificial Sequence
  Description of Artificial Sequence: Synthetic oligonucleotide
  Target: ATXN1; (+) strand; PAM type: NRG; PAM sequence: GGG
gagagagtaaaatgatcagt

SEQ ID NO: 99921 - DNA, 20 bp, Artificial Sequence
  Description of Artificial Sequence: Synthetic oligonucleotide
  Target: ATXN1; (+) strand; PAM type: NRG; PAM sequence: CAG
gtaaaatgatcagtgggtgc

SEQ ID NO: 99922 - DNA, 20 bp, Artificial Sequence
  Description of Artificial Sequence: Synthetic oligonucleotide
  Target: ATXN1; (+) strand; PAM type: NRG; PAM sequence: AGG
taaaatgatcagtgggtgcc

SEQ ID NO: 99923 - DNA, 20 bp, Artificial Sequence
  Description of Artificial Sequence: Synthetic oligonucleotide
  Target: ATXN1; (+) strand; PAM type: NRG; PAM sequence: GAG
aaatgatcagtgggtgccag

SEQ ID NO: 99924 - DNA, 20 bp, Artificial Sequence
  Description of Artificial Sequence: Synthetic oligonucleotide
  Target: ATXN1; (+) strand; PAM type: NRG; PAM sequence: CAG
tcagtgggtgccaggagttt

SEQ ID NO: 99925 - DNA, 20 bp, Artificial Sequence
  Description of Artificial Sequence: Synthetic oligonucleotide
  Target: ATXN1; (+) strand; PAM type: NRG; PAM sequence: AGG
cagtgggtgccaggagtttc

SEQ ID NO: 99926 - DNA, 20 bp, Artificial Sequence
  Description of Artificial Sequence: Synthetic oligonucleotide
  Target: ATXN1; (+) strand; PAM type: NRG; PAM sequence: TGG
tgggtgccaggagtttcagg

SEQ ID NO: 99927 - DNA, 20 bp, Artificial Sequence
  Description of Artificial Sequence: Synthetic oligonucleotide
  Target: ATXN1; (+) strand; PAM type: NRG; PAM sequence: GGG
gggtgccaggagtttcaggt

SEQ ID NO: 99928 - DNA, 20 bp, Artificial Sequence
  Description of Artificial Sequence: Synthetic oligonucleotide
  Target: ATXN1; (+) strand; PAM type: NRG; PAM sequence: GGG
ggtgccaggagtttcaggtg

SEQ ID NO: 99929 - DNA, 20 bp, Artificial Sequence
  Description of Artificial Sequence: Synthetic oligonucleotide
  Target: ATXN1; (+) strand; PAM type: NRG; PAM sequence: TGG
caggagtttcaggtggggtg

SEQ ID NO: 99930 - DNA, 20 bp, Artificial Sequence
  Description of Artificial Sequence: Synthetic oligonucleotide
  Target: ATXN1; (+) strand; PAM type: NRG; PAM sequence: GGG
aggagtttcaggtggggtgt

SEQ ID NO: 99931 - DNA, 20 bp, Artificial Sequence
  Description of Artificial Sequence: Synthetic oligonucleotide
  Target: ATXN1; (+) strand; PAM type: NRG; PAM sequence: GGG
ggagtttcaggtggggtgtg

SEQ ID NO: 99932 - DNA, 20 bp, Artificial Sequence
  Description of Artificial Sequence: Synthetic oligonucleotide
  Target: ATXN1; (+) strand; PAM type: NRG; PAM sequence: GGG
gagtttcaggtggggtgtgg

SEQ ID NO: 99933 - DNA, 20 bp, Artificial Sequence
  Description of Artificial Sequence: Synthetic oligonucleotide
  Target: ATXN1; (+) strand; PAM type: NRG; PAM sequence: TAG
ggtggggtgtgggggacaaa

SEQ ID NO: 99934 - DNA, 20 bp, Artificial Sequence
  Description of Artificial Sequence: Synthetic oligonucleotide
  Target: ATXN1; (+) strand; PAM type: NRG; PAM sequence: AAG
gggacaaatagttgatgcat

SEQ ID NO: 99935 - DNA, 20 bp, Artificial Sequence
  Description of Artificial Sequence: Synthetic oligonucleotide
  Target: ATXN1; (+) strand; PAM type: NRG; PAM sequence: AGG
ggacaaatagttgatgcata

SEQ ID NO: 99936 - DNA, 20 bp, Artificial Sequence
  Description of Artificial Sequence: Synthetic oligonucleotide
  Target: ATXN1; (+) strand; PAM type: NRG; PAM sequence: GGG
gacaaatagttgatgcataa

SEQ ID NO: 99937 - DNA, 20 bp, Artificial Sequence
  Description of Artificial Sequence: Synthetic oligonucleotide
  Target: ATXN1; (+) strand; PAM type: NRG; PAM sequence: TAG
gttgatgcataagggatttt

SEQ ID NO: 99938 - DNA, 20 bp, Artificial Sequence
  Description of Artificial Sequence: Synthetic oligonucleotide
  Target: ATXN1; (+) strand; PAM type: NRG; PAM sequence: AGG
ttgatgcataagggattttt

SEQ ID NO: 99939 - DNA, 20 bp, Artificial Sequence
  Description of Artificial Sequence: Synthetic oligonucleotide
  Target: ATXN1; (+) strand; PAM type: NRG; PAM sequence: GGG
tgatgcataagggattttta

SEQ ID NO: 99940 - DNA, 20 bp, Artificial Sequence
  Description of Artificial Sequence: Synthetic oligonucleotide
  Target: ATXN1; (+) strand; PAM type: NRG; PAM sequence: TGG
tgcataagggatttttaggg

SEQ ID NO: 99941 - DNA, 20 bp, Artificial Sequence
  Description of Artificial Sequence: Synthetic oligonucleotide
  Target: ATXN1; (+) strand; PAM type: NRG; PAM sequence: CAG
aagggatttttagggtggta

SEQ ID NO: 99942 - DNA, 20 bp, Artificial Sequence
  Description of Artificial Sequence: Synthetic oligonucleotide
  Target: ATXN1; (+) strand; PAM type: NRG; PAM sequence: TGG
tctgtataataatgtaatgc

SEQ ID NO: 99943 - DNA, 20 bp, Artificial Sequence
  Description of Artificial Sequence: Synthetic oligonucleotide
  Target: ATXN1; (+) strand; PAM type: NRG; PAM sequence: CAG
catcataaattcatcaaaaa

SEQ ID NO: 99944 - DNA, 20 bp, Artificial Sequence
  Description of Artificial Sequence: Synthetic oligonucleotide
  Target: ATXN1; (+) strand; PAM type: NRG; PAM sequence: CAG
caaaaacagcatgtacaaca

SEQ ID NO: 99945 - DNA, 20 bp, Artificial Sequence
  Description of Artificial Sequence: Synthetic oligonucleotide
  Target: ATXN1; (+) strand; PAM type: NRG; PAM sequence: GAG
aaaacagcatgtacaacaca

SEQ ID NO: 99946 - DNA, 20 bp, Artificial Sequence
  Description of Artificial Sequence: Synthetic oligonucleotide
  Target: ATXN1; (+) strand; PAM type: NRG; PAM sequence: TAG
gtacaacacagagtgaactg

SEQ ID NO: 99947 - DNA, 20 bp, Artificial Sequence
  Description of Artificial Sequence: Synthetic oligonucleotide
  Target: ATXN1; (+) strand; PAM type: NRG; PAM sequence: TGG
gtgaactgtagtataaacta

SEQ ID NO: 99948 - DNA, 20 bp, Artificial Sequence
  Description of Artificial Sequence: Synthetic oligonucleotide
  Target: ATXN1; (+) strand; PAM type: NRG; PAM sequence: TAG
gtagtataaactatggactt

SEQ ID NO: 99949 - DNA, 20 bp, Artificial Sequence
  Description of Artificial Sequence: Synthetic oligonucleotide
  Target: ATXN1; (+) strand; PAM type: NRG; PAM sequence: AAG
tatggactttagttaaaaat

SEQ ID NO: 99950 - DNA, 20 bp, Artificial Sequence
  Description of Artificial Sequence: Synthetic oligonucleotide
  Target: ATXN1; (+) strand; PAM type: NRG; PAM sequence: AGG
atggactttagttaaaaata

SEQ ID NO: 99951 - DNA, 20 bp, Artificial Sequence
  Description of Artificial Sequence: Synthetic oligonucleotide
  Target: ATXN1; (+) strand; PAM type: NRG; PAM sequence: CGG
tttagttaaaaataaggtat

SEQ ID NO: 99952 - DNA, 20 bp, Artificial Sequence
  Description of Artificial Sequence: Synthetic oligonucleotide
  Target: ATXN1; (+) strand; PAM type: NRG; PAM sequence: TGG
taaaaataaggtatcggtac

SEQ ID NO: 99953 - DNA, 20 bp, Artificial Sequence
  Description of Artificial Sequence: Synthetic oligonucleotide
  Target: ATXN1; (+) strand; PAM type: NRG; PAM sequence: CAG
aggtatcggtactggctcat

SEQ ID NO: 99954 - DNA, 20 bp, Artificial Sequence
  Description of Artificial Sequence: Synthetic oligonucleotide
  Target: ATXN1; (+) strand; PAM type: NRG; PAM sequence: AAG
ccaatctatcacaccaatgc

SEQ ID NO: 99955 - DNA, 20 bp, Artificial Sequence
  Description of Artificial Sequence: Synthetic oligonucleotide
  Target: ATXN1; (+) strand; PAM type: NRG; PAM sequence: CAG
ccaatgcaagattttaataa

SEQ ID NO: 99956 - DNA, 20 bp, Artificial Sequence
  Description of Artificial Sequence: Synthetic oligonucleotide
  Target: ATXN1; (+) strand; PAM type: NRG; PAM sequence: AGG
caatgcaagattttaataac

SEQ ID NO: 99957 - DNA, 20 bp, Artificial Sequence
  Description of Artificial Sequence: Synthetic oligonucleotide
  Target: ATXN1; (+) strand; PAM type: NRG; PAM sequence: GGG
aatgcaagattttaataaca

SEQ ID NO: 99958 - DNA, 20 bp, Artificial Sequence
  Description of Artificial Sequence: Synthetic oligonucleotide
  Target: ATXN1; (+) strand; PAM type: NRG; PAM sequence: TAG
ttaataacagggaaaactgt

SEQ ID NO: 99959 - DNA, 20 bp, Artificial Sequence
  Description of Artificial Sequence: Synthetic oligonucleotide
  Target: ATXN1; (+) strand; PAM type: NRG; PAM sequence: AGG
taataacagggaaaactgtt

SEQ ID NO: 99960 - DNA, 20 bp, Artificial Sequence
  Description of Artificial Sequence: Synthetic oligonucleotide
  Target: ATXN1; (+) strand; PAM type: NRG; PAM sequence: GAG
gggaaaactgttaggtgtgt

SEQ ID NO: 99961 - DNA, 20 bp, Artificial Sequence
  Description of Artificial Sequence: Synthetic oligonucleotide
  Target: ATXN1; (+) strand; PAM type: NRG; PAM sequence: TAG
cctaaaactgctttaaacaa

SEQ ID NO: 99962 - DNA, 20 bp, Artificial Sequence
  Description of Artificial Sequence: Synthetic oligonucleotide
  Target: ATXN1; (+) strand; PAM type: NRG; PAM sequence: CAG
ctaaatgctataaacaacaa

SEQ ID NO: 99963 - DNA, 20 bp, Artificial Sequence
  Description of Artificial Sequence: Synthetic oligonucleotide
  Target: ATXN1; (+) strand; PAM type: NRG; PAM sequence: GAG
gctataaacaacaacagtct

SEQ ID NO: 99964 - DNA, 20 bp, Artificial Sequence
  Description of Artificial Sequence: Synthetic oligonucleotide
  Target: ATXN1; (+) strand; PAM type: NRG; PAM sequence: GAG
tataaacaacaacagtctga

SEQ ID NO: 99965 - DNA, 20 bp, Artificial Sequence
  Description of Artificial Sequence: Synthetic oligonucleotide
  Target: ATXN1; (+) strand; PAM type: NRG; PAM sequence: AAG
ctgagagaatcaaaacatat

SEQ ID NO: 99966 - DNA, 20 bp, Artificial Sequence
  Description of Artificial Sequence: Synthetic oligonucleotide
  Target: ATXN1; (+) strand; PAM type: NRG; PAM sequence: CAG
tcaaaacatataagatgacc

SEQ ID NO: 99967 - DNA, 20 bp, Artificial Sequence
  Description of Artificial Sequence: Synthetic oligonucleotide
  Target: ATXN1; (+) strand; PAM type: NRG; PAM sequence: TGG
aacatataagatgacccagt

SEQ ID NO: 99968 - DNA, 20 bp, Artificial Sequence
  Description of Artificial Sequence: Synthetic oligonucleotide
  Target: ATXN1; (+) strand; PAM type: NRG; PAM sequence: GGG
acatataagatgacccagtt

SEQ ID NO: 99969 - DNA, 20 bp, Artificial Sequence
  Description of Artificial Sequence: Synthetic oligonucleotide
  Target: ATXN1; (+) strand; PAM type: NRG; PAM sequence: GGG
catataagatgacccagttg

SEQ ID NO: 99970 - DNA, 20 bp, Artificial Sequence
  Description of Artificial Sequence: Synthetic oligonucleotide
  Target: ATXN1; (+) strand; PAM type: NRG; PAM sequence: GGG
atataagatgacccagttgg

SEQ ID NO: 99971 - DNA, 20 bp, Artificial Sequence
  Description of Artificial Sequence: Synthetic oligonucleotide
  Target: ATXN1; (+) strand; PAM type: NRG; PAM sequence: TAG
gacccagttgggggcacata

SEQ ID NO: 99972 - DNA, 20 bp, Artificial Sequence
  Description of Artificial Sequence: Synthetic oligonucleotide
  Target: ATXN1; (+) strand; PAM type: NRG; PAM sequence: CAG
gggggcacatatagcacata

SEQ ID NO: 99973 - DNA, 20 bp, Artificial Sequence
  Description of Artificial Sequence: Synthetic oligonucleotide
  Target: ATXN1; (+) strand; PAM type: NRG; PAM sequence: AAG
catatagcacatacagttta

SEQ ID NO: 99974 - DNA, 20 bp, Artificial Sequence
  Description of Artificial Sequence: Synthetic oligonucleotide
  Target: ATXN1; (+) strand; PAM type: NRG; PAM sequence: AGG
atatagcacatacagtttaa

SEQ ID NO: 99975 - DNA, 20 bp, Artificial Sequence
  Description of Artificial Sequence: Synthetic oligonucleotide
  Target: ATXN1; (+) strand; PAM type: NRG; PAM sequence: GAG
atagcacatacagtttaaag

SEQ ID NO: 99976 - DNA, 20 bp, Artificial Sequence
  Description of Artificial Sequence: Synthetic oligonucleotide
  Target: ATXN1; (+) strand; PAM type: NRG; PAM sequence: GAG
agcacatacagtttaaagga

SEQ ID NO: 99977 - DNA, 20 bp, Artificial Sequence
  Description of Artificial Sequence: Synthetic oligonucleotide
  Target: ATXN1; (+) strand; PAM type: NRG; PAM sequence: TAG
ttctcctttttttttttttt

SEQ ID NO: 99978 - DNA, 20 bp, Artificial Sequence
  Description of Artificial Sequence: Synthetic oligonucleotide
  Target: ATXN1; (+) strand; PAM type: NRG; PAM sequence: GAG
ctccttttttttttttttta

SEQ ID NO: 99979 - DNA, 20 bp, Artificial Sequence
  Description of Artificial Sequence: Synthetic oligonucleotide
  Target: ATXN1; (+) strand; PAM type: NRG; PAM sequence: GAG
cctttttttttttttttaga

SEQ ID NO: 99980 - DNA, 20 bp, Artificial Sequence
  Description of Artificial Sequence: Synthetic oligonucleotide
  Target: ATXN1; (+) strand; PAM type: NRG; PAM sequence: AGG
ctttttttttttttttagag

SEQ ID NO: 99981 - DNA, 20 bp, Artificial Sequence
  Description of Artificial Sequence: Synthetic oligonucleotide
  Target: ATXN1; (+) strand; PAM type: NRG; PAM sequence: AAG
tttttttttagagaggtaca

SEQ ID NO: 99982 - DNA, 20 bp, Artificial Sequence
  Description of Artificial Sequence: Synthetic oligonucleotide
  Target: ATXN1; (+) strand; PAM type: NRG; PAM sequence: TGG
aagacccacaaacaaaaatg

SEQ ID NO: 99983 - DNA, 20 bp, Artificial Sequence
  Description of Artificial Sequence: Synthetic oligonucleotide
  Target: ATXN1; (+) strand; PAM type: NRG; PAM sequence: TAG
aacaaaaatgtggtttgaca

SEQ ID NO: 99984 - DNA, 20 bp, Artificial Sequence
  Description of Artificial Sequence: Synthetic oligonucleotide
  Target: ATXN1; (+) strand; PAM type: NRG; PAM sequence: TGG
gtttgacatagtttctctgt

SEQ ID NO: 99985 - DNA, 20 bp, Artificial Sequence
  Description of Artificial Sequence: Synthetic oligonucleotide
  Target: ATXN1; (+) strand; PAM type: NRG; PAM sequence: GAG
ttgacatagtttctctgttg

SEQ ID NO: 99986 - DNA, 20 bp, Artificial Sequence
  Description of Artificial Sequence: Synthetic oligonucleotide
  Target: ATXN1; (+) strand; PAM type: NRG; PAM sequence: CAG
tttctctgttggagcctttc

SEQ ID NO: 99987 - DNA, 20 bp, Artificial Sequence
  Description of Artificial Sequence: Synthetic oligonucleotide
  Target: ATXN1; (+) strand; PAM type: NRG; PAM sequence: CAG
tgttggagcctttccagcac

SEQ ID NO: 99988 - DNA, 20 bp, Artificial Sequence
  Description of Artificial Sequence: Synthetic oligonucleotide
  Target: ATXN1; (+) strand; PAM type: NRG; PAM sequence: CAG
gagcctttccagcaccagaa

SEQ ID NO: 99989 - DNA, 20 bp, Artificial Sequence
  Description of Artificial Sequence: Synthetic oligonucleotide
  Target: ATXN1; (+) strand; PAM type: NRG; PAM sequence: CAG
ctttccagcaccagaacaga

SEQ ID NO: 99990 - DNA, 20 bp, Artificial Sequence
  Description of Artificial Sequence: Synthetic oligonucleotide
  Target: ATXN1; (+) strand; PAM type: NRG; PAM sequence: AGG
tttccagcaccagaacagac

SEQ ID NO: 99991 - DNA, 20 bp, Artificial Sequence
  Description of Artificial Sequence: Synthetic oligonucleotide
  Target: ATXN1; (+) strand; PAM type: NRG; PAM sequence: AAG
ccagcaccagaacagacagg

SEQ ID NO: 99992 - DNA, 20 bp, Artificial Sequence
  Description of Artificial Sequence: Synthetic oligonucleotide
  Target: ATXN1; (+) strand; PAM type: NRG; PAM sequence: CGG
gtgtgtattaccaacaactg

SEQ ID NO: 99993 - DNA, 20 bp, Artificial Sequence
  Description of Artificial Sequence: Synthetic oligonucleotide
  Target: ATXN1; (+) strand; PAM type: NRG; PAM sequence: CAG
caacaactgcggcacaaatc

SEQ ID NO: 99994 - DNA, 20 bp, Artificial Sequence
  Description of Artificial Sequence: Synthetic oligonucleotide
  Target: ATXN1; (+) strand; PAM type: NRG; PAM sequence: AGG
aacaactgcggcacaaatcc

SEQ ID NO: 99995 - DNA, 20 bp, Artificial Sequence
  Description of Artificial Sequence: Synthetic oligonucleotide
  Target: ATXN1; (+) strand; PAM type: NRG; PAM sequence: GGG
acaactgcggcacaaatcca

SEQ ID NO: 99996 - DNA, 20 bp, Artificial Sequence
  Description of Artificial Sequence: Synthetic oligonucleotide
  Target: ATXN1; (+) strand; PAM type: NRG; PAM sequence: TGG
ctgcggcacaaatccagggc

SEQ ID NO: 99997 - DNA, 20 bp, Artificial Sequence
  Description of Artificial Sequence: Synthetic oligonucleotide
  Target: ATXN1; (+) strand; PAM type: NRG; PAM sequence: GGG
tgcggcacaaatccagggct

SEQ ID NO: 99998 - DNA, 20 bp, Artificial Sequence
  Description of Artificial Sequence: Synthetic oligonucleotide
  Target: ATXN1; (+) strand; PAM type: NRG; PAM sequence: CAG
ccagggctgggctctgcaca

SEQ ID NO: 99999 - DNA, 20 bp, Artificial Sequence
  Description of Artificial Sequence: Synthetic oligonucleotide
  Target: ATXN1; (+) strand; PAM type: NRG; PAM sequence: AGG
cagggctgggctctgcacac

SEQ ID NO: 100000 - DNA, 20 bp, Artificial Sequence
  Description of Artificial Sequence: Synthetic oligonucleotide
  Target: ATXN1; (+) strand; PAM type: NRG; PAM sequence: GGG
agggctgggctctgcacaca

SEQ ID NO: 100001 - DNA, 20 bp, Artificial Sequence
  Description of Artificial Sequence: Synthetic oligonucleotide
  Target: ATXN1; (+) strand; PAM type: NRG; PAM sequence: CAG
gctgggctctgcacacaggg

SEQ ID NO: 100002 - DNA, 20 bp, Artificial Sequence
  Description of Artificial Sequence: Synthetic oligonucleotide
  Target: ATXN1; (+) strand; PAM type: NRG; PAM sequence: TAG
ctatctattttttgatacat

SEQ ID NO: 100003 - DNA, 20 bp, Artificial Sequence
  Description of Artificial Sequence: Synthetic oligonucleotide
  Target: ATXN1; (+) strand; PAM type: NRG; PAM sequence: AGG
tatctattttttgatacatt

SEQ ID NO: 100004 - DNA, 20 bp, Artificial Sequence
  Description of Artificial Sequence: Synthetic oligonucleotide
  Target: ATXN1; (+) strand; PAM type: NRG; PAM sequence: AAG
cattaggattcatcgccacc

SEQ ID NO: 100005 - DNA, 20 bp, Artificial Sequence
  Description of Artificial Sequence: Synthetic oligonucleotide
  Target: ATXN1; (+) strand; PAM type: NRG; PAM sequence: CGG
ggattcatcgccaccaagct

SEQ ID NO: 100006 - DNA, 20 bp, Artificial Sequence
  Description of Artificial Sequence: Synthetic oligonucleotide
  Target: ATXN1; (+) strand; PAM type: NRG; PAM sequence: TGG
aagctcggcatgttcaatgt

SEQ ID NO: 100007 - DNA, 20 bp, Artificial Sequence
  Description of Artificial Sequence: Synthetic oligonucleotide
  Target: ATXN1; (+) strand; PAM type: NRG; PAM sequence: AAG
tcggcatgttcaatgttggc

SEQ ID NO: 100008 - DNA, 20 bp, Artificial Sequence
  Description of Artificial Sequence: Synthetic oligonucleotide
  Target: ATXN1; (+) strand; PAM type: NRG; PAM sequence: TGG
gcatgttcaatgttggcaag

SEQ ID NO: 100009 - DNA, 20 bp, Artificial Sequence
  Description of Artificial Sequence: Synthetic oligonucleotide
  Target: ATXN1; (+) strand; PAM type: NRG; PAM sequence: GGG
catgttcaatgttggcaagt

SEQ ID NO: 100010 - DNA, 20 bp, Artificial Sequence
  Description of Artificial Sequence: Synthetic oligonucleotide
  Target: ATXN1; (+) strand; PAM type: NRG; PAM sequence: TGG
gttggcaagtgggtctgcct

SEQ ID NO: 100011 - DNA, 20 bp, Artificial Sequence
  Description of Artificial Sequence: Synthetic oligonucleotide
  Target: ATXN1; (+) strand; PAM type: NRG; PAM sequence: AAG
gtgggtctgccttggctgca

SEQ ID NO: 100012 - DNA, 20 bp, Artificial Sequence
  Description of Artificial Sequence: Synthetic oligonucleotide
  Target: ATXN1; (+) strand; PAM type: NRG; PAM sequence: AGG
tgggtctgccttggctgcaa

SEQ ID NO: 100013 - DNA, 20 bp, Artificial Sequence
  Description of Artificial Sequence: Synthetic oligonucleotide
  Target: ATXN1; (+) strand; PAM type: NRG; PAM sequence: GGG
gggtctgccttggctgcaaa

SEQ ID NO: 100014 - DNA, 20 bp, Artificial Sequence
  Description of Artificial Sequence: Synthetic oligonucleotide
  Target: ATXN1; (+) strand; PAM type: NRG; PAM sequence: CAG
ctgcaaagggactgactcta

SEQ ID NO: 100015 - DNA, 20 bp, Artificial Sequence
  Description of Artificial Sequence: Synthetic oligonucleotide
  Target: ATXN1; (+) strand; PAM type: NRG; PAM sequence: AGG
tgcaaagggactgactctac

SEQ ID NO: 100016 - DNA, 20 bp, Artificial Sequence
  Description of Artificial Sequence: Synthetic oligonucleotide
  Target: ATXN1; (+) strand; PAM type: NRG; PAM sequence: GAG
ggctcatgtgccgcctgcat

SEQ ID NO: 100017 - DNA, 20 bp, Artificial Sequence
  Description of Artificial Sequence: Synthetic oligonucleotide
  Target: ATXN1; (+) strand; PAM type: NRG; PAM sequence: AGG
gctcatgtgccgcctgcatg

SEQ ID NO: 100018 - DNA, 20 bp, Artificial Sequence
  Description of Artificial Sequence: Synthetic oligonucleotide
  Target: ATXN1; (+) strand; PAM type: NRG; PAM sequence: GGG
ctcatgtgccgcctgcatga

SEQ ID NO: 100019 - DNA, 20 bp, Artificial Sequence
  Description of Artificial Sequence: Synthetic oligonucleotide
  Target: ATXN1; (+) strand; PAM type: NRG; PAM sequence: CGG
tgccgcctgcatgagggcct

SEQ ID NO: 100020 - DNA, 20 bp, Artificial Sequence
  Description of Artificial Sequence: Synthetic oligonucleotide
  Target: ATXN1; (+) strand; PAM type: NRG; PAM sequence: TAG
atgagggcctcggctatttt

SEQ ID NO: 100021 - DNA, 20 bp, Artificial Sequence
  Description of Artificial Sequence: Synthetic oligonucleotide
  Target: ATXN1; (+) strand; PAM type: NRG; PAM sequence: AGG
tgagggcctcggctattttt

SEQ ID NO: 100022 - DNA, 20 bp, Artificial Sequence
  Description of Artificial Sequence: Synthetic oligonucleotide
  Target: ATXN1; (+) strand; PAM type: NRG; PAM sequence: CAG
cctcggctatttttaggtac

SEQ ID NO: 100023 - DNA, 20 bp, Artificial Sequence
  Description of Artificial Sequence: Synthetic oligonucleotide
  Target: ATXN1; (+) strand; PAM type: NRG; PAM sequence: CAG
atgttaccaccgatgactca

SEQ ID NO: 100024 - DNA, 20 bp, Artificial Sequence
  Description of Artificial Sequence: Synthetic oligonucleotide
  Target: ATXN1; (+) strand; PAM type: NRG; PAM sequence: CAG
caccgatgactcacagctca

SEQ ID NO: 100025 - DNA, 20 bp, Artificial Sequence
  Description of Artificial Sequence: Synthetic oligonucleotide
  Target: ATXN1; (+) strand; PAM type: NRG; PAM sequence: AAG
cgatgactcacagctcacag

SEQ ID NO: 100026 - DNA, 20 bp, Artificial Sequence
  Description of Artificial Sequence: Synthetic oligonucleotide
  Target: ATXN1; (+) strand; PAM type: NRG; PAM sequence: TAG
cacagaagtcaaccaaaaaa

SEQ ID NO: 100027 - DNA, 20 bp, Artificial Sequence
  Description of Artificial Sequence: Synthetic oligonucleotide
  Target: ATXN1; (+) strand; PAM type: NRG; PAM sequence: TAG
agaagtcaaccaaaaaatag

SEQ ID NO: 100028 - DNA, 20 bp, Artificial Sequence
  Description of Artificial Sequence: Synthetic oligonucleotide
  Target: ATXN1; (+) strand; PAM type: NRG; PAM sequence: AAG
accaaaaaatagtagaatga

SEQ ID NO: 100029 - DNA, 20 bp, Artificial Sequence
  Description of Artificial Sequence: Synthetic oligonucleotide
  Target: ATXN1; (+) strand; PAM type: NRG; PAM sequence: AGG
ccaaaaaatagtagaatgaa

SEQ ID NO: 100030 - DNA, 20 bp, Artificial Sequence
  Description of Artificial Sequence: Synthetic oligonucleotide
  Target: ATXN1; (+) strand; PAM type: NRG; PAM sequence: AAG
aaaatagtagaatgaaagga

SEQ ID NO: 100031 - DNA, 20 bp, Artificial Sequence
  Description of Artificial Sequence: Synthetic oligonucleotide
  Target: ATXN1; (+) strand; PAM type: NRG; PAM sequence: CGG
tagaatgaaaggaaagccat

SEQ ID NO: 100032 - DNA, 20 bp, Artificial Sequence
  Description of Artificial Sequence: Synthetic oligonucleotide
  Target: ATXN1; (+) strand; PAM type: NRG; PAM sequence: TAG
aatgaaaggaaagccatcgg

SEQ ID NO: 100033 - DNA, 20 bp, Artificial Sequence
  Description of Artificial Sequence: Synthetic oligonucleotide
  Target: ATXN1; (+) strand; PAM type: NRG; PAM sequence: CAG
aaaggaaagccatcggtaga

SEQ ID NO: 100034 - DNA, 20 bp, Artificial Sequence
  Description of Artificial Sequence: Synthetic oligonucleotide
  Target: ATXN1; (+) strand; PAM type: NRG; PAM sequence: CAG
gaaagccatcggtagacagc

SEQ ID NO: 100035 - DNA, 20 bp, Artificial Sequence
  Description of Artificial Sequence: Synthetic oligonucleotide
  Target: ATXN1; (+) strand; PAM type: NRG; PAM sequence: AAG
gccatcggtagacagccagt

SEQ ID NO: 100036 - DNA, 20 bp, Artificial Sequence
  Description of Artificial Sequence: Synthetic oligonucleotide
  Target: ATXN1; (+) strand; PAM type: NRG; PAM sequence: GAG
catgataacaactgctgtac

SEQ ID NO: 100037 - DNA, 20 bp, Artificial Sequence
  Description of Artificial Sequence: Synthetic oligonucleotide
  Target: ATXN1; (+) strand; PAM type: NRG; PAM sequence: CAG
ctgctgtacgagcacacaca

SEQ ID NO: 100038 - DNA, 20 bp, Artificial Sequence
  Description of Artificial Sequence: Synthetic oligonucleotide
  Target: ATXN1; (+) strand; PAM type: NRG; PAM sequence: AGG
tgctgtacgagcacacacac

SEQ ID NO: 100039 - DNA, 20 bp, Artificial Sequence
  Description of Artificial Sequence: Synthetic oligonucleotide
  Target: ATXN1; (+) strand; PAM type: NRG; PAM sequence: CAG
aggcacactcacacccacgc

SEQ ID NO: 100040 - DNA, 20 bp, Artificial Sequence
  Description of Artificial Sequence: Synthetic oligonucleotide
  Target: ATXN1; (+) strand; PAM type: NRG; PAM sequence: AGG
ggcacactcacacccacgcc

SEQ ID NO: 100041 - DNA, 20 bp, Artificial Sequence
  Description of Artificial Sequence: Synthetic oligonucleotide
  Target: ATXN1; (+) strand; PAM type: NRG; PAM sequence: CAG
cactcacacccacgccagga

SEQ ID NO: 100042 - DNA, 20 bp, Artificial Sequence
  Description of Artificial Sequence: Synthetic oligonucleotide
  Target: ATXN1; (+) strand; PAM type: NRG; PAM sequence: CGG
cacacccacgccaggacagt

SEQ ID NO: 100043 - DNA, 20 bp, Artificial Sequence
  Description of Artificial Sequence: Synthetic oligonucleotide
  Target: ATXN1; (+) strand; PAM type: NRG; PAM sequence: GGG
acacccacgccaggacagtc

SEQ ID NO: 100044 - DNA, 20 bp, Artificial Sequence
  Description of Artificial Sequence: Synthetic oligonucleotide
  Target: ATXN1; (+) strand; PAM type: NRG; PAM sequence: GAG
acccacgccaggacagtcgg

SEQ ID NO: 100045 - DNA, 20 bp, Artificial Sequence
  Description of Artificial Sequence: Synthetic oligonucleotide
  Target: ATXN1; (+) strand; PAM type: NRG; PAM sequence: AGG
cccacgccaggacagtcggg

SEQ ID NO: 100046 - DNA, 20 bp, Artificial Sequence
  Description of Artificial Sequence: Synthetic oligonucleotide
  Target: ATXN1; (+) strand; PAM type: NRG; PAM sequence: GAG
cacgccaggacagtcgggag

SEQ ID NO: 100047 - DNA, 20 bp, Artificial Sequence
  Description of Artificial Sequence: Synthetic oligonucleotide
  Target: ATXN1; (+) strand; PAM type: NRG; PAM sequence: AGG
acgccaggacagtcgggagg

SEQ ID NO: 100048 - DNA, 20 bp, Artificial Sequence
  Description of Artificial Sequence: Synthetic oligonucleotide
  Target: ATXN1; (+) strand; PAM type: NRG; PAM sequence: TGG
ggacagtcgggaggaggaaa

SEQ ID NO: 100049 - DNA, 20 bp, Artificial Sequence
  Description of Artificial Sequence: Synthetic oligonucleotide
  Target: ATXN1; (+) strand; PAM type: NRG; PAM sequence: AAG
aggaaatggcactgaatatt

SEQ ID NO: 100050 - DNA, 20 bp, Artificial Sequence
  Description of Artificial Sequence: Synthetic oligonucleotide
  Target: ATXN1; (+) strand; PAM type: NRG; PAM sequence: CAG
aaatggcactgaatattaag

SEQ ID NO: 100051 - DNA, 20 bp, Artificial Sequence
  Description of Artificial Sequence: Synthetic oligonucleotide
  Target: ATXN1; (+) strand; PAM type: NRG; PAM sequence: GAG
ctgaatattaagcagccacc

SEQ ID NO: 100052 - DNA, 20 bp, Artificial Sequence
  Description of Artificial Sequence: Synthetic oligonucleotide
  Target: ATXN1; (+) strand; PAM type: NRG; PAM sequence: CAG
atattaagcagccaccgagt

SEQ ID NO: 100053 - DNA, 20 bp, Artificial Sequence
  Description of Artificial Sequence: Synthetic oligonucleotide
  Target: ATXN1; (+) strand; PAM type: NRG; PAM sequence: AGG
tattaagcagccaccgagtc

SEQ ID NO: 100054 - DNA, 20 bp, Artificial Sequence
  Description of Artificial Sequence: Synthetic oligonucleotide
  Target: ATXN1; (+) strand; PAM type: NRG; PAM sequence: GGG
attaagcagccaccgagtca

SEQ ID NO: 100055 - DNA, 20 bp, Artificial Sequence
  Description of Artificial Sequence: Synthetic oligonucleotide
  Target: ATXN1; (+) strand; PAM type: NRG; PAM sequence: AAG
aagcagccaccgagtcaggg

SEQ ID NO: 100056 - DNA, 20 bp, Artificial Sequence
  Description of Artificial Sequence: Synthetic oligonucleotide
  Target: ATXN1; (+) strand; PAM type: NRG; PAM sequence: CAG
cagccaccgagtcagggaag

SEQ ID NO: 100057 - DNA, 20 bp, Artificial Sequence
  Description of Artificial Sequence: Synthetic oligonucleotide
  Target: ATXN1; (+) strand; PAM type: NRG; PAM sequence: CGG
agtcagggaagcagtcacct

SEQ ID NO: 100058 - DNA, 20 bp, Artificial Sequence
  Description of Artificial Sequence: Synthetic oligonucleotide
  Target: ATXN1; (+) strand; PAM type: NRG; PAM sequence: GGG
gtcagggaagcagtcacctc

SEQ ID NO: 100059 - DNA, 20 bp, Artificial Sequence
  Description of Artificial Sequence: Synthetic oligonucleotide
  Target: ATXN1; (+) strand; PAM type: NRG; PAM sequence: GAG
cagggaagcagtcacctcgg

SEQ ID NO: 100060 - DNA, 20 bp, Artificial Sequence
  Description of Artificial Sequence: Synthetic oligonucleotide
  Target: ATXN1; (+) strand; PAM type: NRG; PAM sequence: AGG
agggaagcagtcacctcggg

SEQ ID NO: 100061 - DNA, 20 bp, Artificial Sequence
  Description of Artificial Sequence: Synthetic oligonucleotide
  Target: ATXN1; (+) strand; PAM type: NRG; PAM sequence: TGG
gcagtcacctcgggaggcgc

SEQ ID NO: 100062 - DNA, 20 bp, Artificial Sequence
  Description of Artificial Sequence: Synthetic oligonucleotide
  Target: ATXN1; (+) strand; PAM type: NRG; PAM sequence: GGG
cagtcacctcgggaggcgct

SEQ ID NO: 100063 - DNA, 20 bp, Artificial Sequence
  Description of Artificial Sequence: Synthetic oligonucleotide
  Target: ATXN1; (+) strand; PAM type: NRG; PAM sequence: AAG
tcacctcgggaggcgctggg

SEQ ID NO: 100064 - DNA, 20 bp, Artificial Sequence
  Description of Artificial Sequence: Synthetic oligonucleotide
  Target: ATXN1; (+) strand; PAM type: NRG; PAM sequence: CAG
cgggaggcgctgggaagcga

SEQ ID NO: 100065 - DNA, 20 bp, Artificial Sequence
  Description of Artificial Sequence: Synthetic oligonucleotide
  Target: ATXN1; (+) strand; PAM type: NRG; PAM sequence: CGG
aggcgctgggaagcgacaga

SEQ ID NO: 100066 - DNA, 20 bp, Artificial Sequence
  Description of Artificial Sequence: Synthetic oligonucleotide
  Target: ATXN1; (+) strand; PAM type: NRG; PAM sequence: CAG
gacagacggccctaataaca

SEQ ID NO: 100067 - DNA, 20 bp, Artificial Sequence
  Description of Artificial Sequence: Synthetic oligonucleotide
  Target: ATXN1; (+) strand; PAM type: NRG; PAM sequence: GAG
cagacggccctaataacaca

SEQ ID NO: 100068 - DNA, 20 bp, Artificial Sequence
  Description of Artificial Sequence: Synthetic oligonucleotide
  Target: ATXN1; (+) strand; PAM type: NRG; PAM sequence: TGG
ggccctaataacacagagcc

SEQ ID NO: 100069 - DNA, 20 bp, Artificial Sequence
  Description of Artificial Sequence: Synthetic oligonucleotide
  Target: ATXN1; (+) strand; PAM type: NRG; PAM sequence: TAG
ataacacagagcctggcatt

SEQ ID NO: 100070 - DNA, 20 bp, Artificial Sequence
  Description of Artificial Sequence: Synthetic oligonucleotide
  Target: ATXN1; (+) strand; PAM type: NRG; PAM sequence: AGG
taacacagagcctggcattt

SEQ ID NO: 100071 - DNA, 20 bp, Artificial Sequence
  Description of Artificial Sequence: Synthetic oligonucleotide
  Target: ATXN1; (+) strand; PAM type: NRG; PAM sequence: AAG
acagagcctggcatttagga

SEQ ID NO: 100072 - DNA, 20 bp, Artificial Sequence
  Description of Artificial Sequence: Synthetic oligonucleotide
  Target: ATXN1; (+) strand; PAM type: NRG; PAM sequence: AAG
gagcctggcatttaggaaag

SEQ ID NO: 100073 - DNA, 20 bp, Artificial Sequence
  Description of Artificial Sequence: Synthetic oligonucleotide
  Target: ATXN1; (+) strand; PAM type: NRG; PAM sequence: AAG
tggcatttaggaaagaagca

SEQ ID NO: 100074 - DNA, 20 bp, Artificial Sequence
  Description of Artificial Sequence: Synthetic oligonucleotide
  Target: ATXN1; (+) strand; PAM type: NRG; PAM sequence: AGG
ggcatttaggaaagaagcaa

SEQ ID NO: 100075 - DNA, 20 bp, Artificial Sequence
  Description of Artificial Sequence: Synthetic oligonucleotide
  Target: ATXN1; (+) strand; PAM type: NRG; PAM sequence: CAG
agcaaaggaacgtgtcaacc

SEQ ID NO: 100076 - DNA, 20 bp, Artificial Sequence
  Description of Artificial Sequence: Synthetic oligonucleotide
  Target: ATXN1; (+) strand; PAM type: NRG; PAM sequence: GAG
caaaggaacgtgtcaaccca

SEQ ID NO: 100077 - DNA, 20 bp, Artificial Sequence
  Description of Artificial Sequence: Synthetic oligonucleotide
  Target: ATXN1; (+) strand; PAM type: NRG; PAM sequence: GAG
atacattttacaactccact

SEQ ID NO: 100078 - DNA, 20 bp, Artificial Sequence
  Description of Artificial Sequence: Synthetic oligonucleotide
  Target: ATXN1; (+) strand; PAM type: NRG; PAM sequence: CAG
agcaaatgctgtgtactctt

SEQ ID NO: 100079 - DNA, 20 bp, Artificial Sequence
  Description of Artificial Sequence: Synthetic oligonucleotide
  Target: ATXN1; (+) strand; PAM type: NRG; PAM sequence: GAG
caaatgctgtgtactcttca

SEQ ID NO: 100080 - DNA, 20 bp, Artificial Sequence
  Description of Artificial Sequence: Synthetic oligonucleotide
  Target: ATXN1; (+) strand; PAM type: NRG; PAM sequence: AAG
atgctgtgtactcttcagag

SEQ ID NO: 100081 - DNA, 20 bp, Artificial Sequence
  Description of Artificial Sequence: Synthetic oligonucleotide
  Target: ATXN1; (+) strand; PAM type: NRG; PAM sequence: TAG
ctcttcagagaagctgaacc

SEQ ID NO: 100082 - DNA, 20 bp, Artificial Sequence
  Description of Artificial Sequence: Synthetic oligonucleotide
  Target: ATXN1; (+) strand; PAM type: NRG; PAM sequence: AGG
tcttcagagaagctgaacct

SEQ ID NO: 100083 - DNA, 20 bp, Artificial Sequence
  Description of Artificial Sequence: Synthetic oligonucleotide
  Target: ATXN1; (+) strand; PAM type: NRG; PAM sequence: AAG
tcagagaagctgaacctagg

SEQ ID NO: 100084 - DNA, 20 bp, Artificial Sequence
  Description of Artificial Sequence: Synthetic oligonucleotide
  Target: ATXN1; (+) strand; PAM type: NRG; PAM sequence: AGG
cagagaagctgaacctagga

SEQ ID NO: 100085 - DNA, 20 bp, Artificial Sequence
  Description of Artificial Sequence: Synthetic oligonucleotide
  Target: ATXN1; (+) strand; PAM type: NRG; PAM sequence: GGG
agagaagctgaacctaggaa

SEQ ID NO: 100086 - DNA, 20 bp, Artificial Sequence
  Description of Artificial Sequence: Synthetic oligonucleotide
  Target: ATXN1; (+) strand; PAM type: NRG; PAM sequence: GAG
aagctgaacctaggaagggt

SEQ ID NO: 100087 - DNA, 20 bp, Artificial Sequence
  Description of Artificial Sequence: Synthetic oligonucleotide
  Target: ATXN1; (+) strand; PAM type: NRG; PAM sequence: CAG
tgaacctaggaagggtgaga

SEQ ID NO: 100088 - DNA, 20 bp, Artificial Sequence
  Description of Artificial Sequence: Synthetic oligonucleotide
  Target: ATXN1; (+) strand; PAM type: NRG; PAM sequence: AAG
acctaggaagggtgagacag

SEQ ID NO: 100089 - DNA, 20 bp, Artificial Sequence
  Description of Artificial Sequence: Synthetic oligonucleotide
  Target: ATXN1; (+) strand; PAM type: NRG; PAM sequence: AGG
cctaggaagggtgagacaga

SEQ ID NO: 100090 - DNA, 20 bp, Artificial Sequence
  Description of Artificial Sequence: Synthetic oligonucleotide
  Target: ATXN1; (+) strand; PAM type: NRG; PAM sequence: TGG
ggaagggtgagacagaagga

SEQ ID NO: 100091 - DNA, 20 bp, Artificial Sequence
  Description of Artificial Sequence: Synthetic oligonucleotide
  Target: ATXN1; (+) strand; PAM type: NRG; PAM sequence: GGG
gaagggtgagacagaaggat

SEQ ID NO: 100092 - DNA, 20 bp, Artificial Sequence
  Description of Artificial Sequence: Synthetic oligonucleotide
  Target: ATXN1; (+) strand; PAM type: NRG; PAM sequence: TAG
gacagaaggatgggataata

SEQ ID NO: 100093 - DNA, 20 bp, Artificial Sequence
  Description of Artificial Sequence: Synthetic oligonucleotide
  Target: ATXN1; (+) strand; PAM type: NRG; PAM sequence: CAG
gggataatatagaacgccgc

SEQ ID NO: 100094 - DNA, 20 bp, Artificial Sequence
  Description of Artificial Sequence: Synthetic oligonucleotide
  Target: ATXN1; (+) strand; PAM type: NRG; PAM sequence: TGG
taatatagaacgccgccaga

SEQ ID NO: 100095 - DNA, 20 bp, Artificial Sequence
  Description of Artificial Sequence: Synthetic oligonucleotide
  Target: ATXN1; (+) strand; PAM type: NRG; PAM sequence: AAG
tatagaacgccgccagatgg

SEQ ID NO: 100096 - DNA, 20 bp, Artificial Sequence
  Description of Artificial Sequence: Synthetic oligonucleotide
  Target: ATXN1; (+) strand; PAM type: NRG; PAM sequence: AAG
acgccgccagatggaagcca

SEQ ID NO: 100097 - DNA, 20 bp, Artificial Sequence
  Description of Artificial Sequence: Synthetic oligonucleotide
  Target: ATXN1; (+) strand; PAM type: NRG; PAM sequence: AGG
cgccgccagatggaagccaa

SEQ ID NO: 100098 - DNA, 20 bp, Artificial Sequence
  Description of Artificial Sequence: Synthetic oligonucleotide
  Target: ATXN1; (+) strand; PAM type: NRG; PAM sequence: CAG
gatggaagccaaaggctccc

SEQ ID NO: 100099 - DNA, 20 bp, Artificial Sequence
  Description of Artificial Sequence: Synthetic oligonucleotide
  Target: ATXN1; (+) strand; PAM type: NRG; PAM sequence: TGG
gaagccaaaggctccccagc

SEQ ID NO: 100100 - DNA, 20 bp, Artificial Sequence
  Description of Artificial Sequence: Synthetic oligonucleotide
  Target: ATXN1; (+) strand; PAM type: NRG; PAM sequence: GGG
aagccaaaggctccccagct

SEQ ID NO: 100101 - DNA, 20 bp, Artificial Sequence
  Description of Artificial Sequence: Synthetic oligonucleotide
  Target: ATXN1; (+) strand; PAM type: NRG; PAM sequence: GGG
agccaaaggctccccagctg

SEQ ID NO: 100102 - DNA, 20 bp, Artificial Sequence
  Description of Artificial Sequence: Synthetic oligonucleotide
  Target: ATXN1; (+) strand; PAM type: NRG; PAM sequence: TGG
ctccccagctggggccatcc

SEQ ID NO: 100103 - DNA, 20 bp, Artificial Sequence
  Description of Artificial Sequence: Synthetic oligonucleotide
  Target: ATXN1; (+) strand; PAM type: NRG; PAM sequence: GGG
tccccagctggggccatcct

SEQ ID NO: 100104 - DNA, 20 bp, Artificial Sequence
  Description of Artificial Sequence: Synthetic oligonucleotide
  Target: ATXN1; (+) strand; PAM type: NRG; PAM sequence: CAG
ccagctggggccatcctggg

SEQ ID NO: 100105 - DNA, 20 bp, Artificial Sequence
  Description of Artificial Sequence: Synthetic oligonucleotide
  Target: ATXN1; (+) strand; PAM type: NRG; PAM sequence: AGG
cagctggggccatcctgggc

SEQ ID NO: 100106 - DNA, 20 bp, Artificial Sequence
  Description of Artificial Sequence: Synthetic oligonucleotide
  Target: ATXN1; (+) strand; PAM type: NRG; PAM sequence: GGG
agctggggccatcctgggca

SEQ ID NO: 100107 - DNA, 20 bp, Artificial Sequence
  Description of Artificial Sequence: Synthetic oligonucleotide
  Target: ATXN1; (+) strand; PAM type: NRG; PAM sequence: CAG
catcctgggcagggctgtcc

SEQ ID NO: 100108 - DNA, 20 bp, Artificial Sequence
  Description of Artificial Sequence: Synthetic oligonucleotide
  Target: ATXN1; (+) strand; PAM type: NRG; PAM sequence: CGG
cctgggcagggctgtcccag

SEQ ID NO: 100109 - DNA, 20 bp, Artificial Sequence
  Description of Artificial Sequence: Synthetic oligonucleotide
  Target: ATXN1; (+) strand; PAM type: NRG; PAM sequence: GGG
ctgggcagggctgtcccagc

SEQ ID NO: 100110 - DNA, 20 bp, Artificial Sequence
  Description of Artificial Sequence: Synthetic oligonucleotide
  Target: ATXN1; (+) strand; PAM type: NRG; PAM sequence: CAG
cccagcgggcacgtcactaa

SEQ ID NO: 100111 - DNA, 20 bp, Artificial Sequence
  Description of Artificial Sequence: Synthetic oligonucleotide
  Target: ATXN1; (+) strand; PAM type: NRG; PAM sequence: CAG
acgtcactaacagcctcttg

SEQ ID NO: 100112 - DNA, 20 bp, Artificial Sequence
  Description of Artificial Sequence: Synthetic oligonucleotide
  Target: ATXN1; (+) strand; PAM type: NRG; PAM sequence: AAG
tcactaacagcctcttgcag

SEQ ID NO: 100113 - DNA, 20 bp, Artificial Sequence
  Description of Artificial Sequence: Synthetic oligonucleotide
  Target: ATXN1; (+) strand; PAM type: NRG; PAM sequence: GAG
actaacagcctcttgcagaa

SEQ ID NO: 100114 - DNA, 20 bp, Artificial Sequence
  Description of Artificial Sequence: Synthetic oligonucleotide
  Target: ATXN1; (+) strand; PAM type: NRG; PAM sequence: AGG
ctaacagcctcttgcagaag

SEQ ID NO: 100115 - DNA, 20 bp, Artificial Sequence
  Description of Artificial Sequence: Synthetic oligonucleotide
  Target: ATXN1; (+) strand; PAM type: NRG; PAM sequence: GAG
aacagcctcttgcagaagag

SEQ ID NO: 100116 - DNA, 20 bp, Artificial Sequence
  Description of Artificial Sequence: Synthetic oligonucleotide
  Target: ATXN1; (+) strand; PAM type: NRG; PAM sequence: TGG
cctcttgcagaagaggagcc

SEQ ID NO: 100117 - DNA, 20 bp, Artificial Sequence
  Description of Artificial Sequence: Synthetic oligonucleotide
  Target: ATXN1; (+) strand; PAM type: NRG; PAM sequence: GGG
ctcttgcagaagaggagcct

SEQ ID NO: 100118 - DNA, 20 bp, Artificial Sequence
  Description of Artificial Sequence: Synthetic oligonucleotide
  Target: ATXN1; (+) strand; PAM type: NRG; PAM sequence: GAG
cttgcagaagaggagcctgg

SEQ ID NO: 100119 - DNA, 20 bp, Artificial Sequence
  Description of Artificial Sequence: Synthetic oligonucleotide
  Target: ATXN1; (+) strand; PAM type: NRG; PAM sequence: TGG
gggagcccttgtttctgcat

SEQ ID NO: 100120 - DNA, 20 bp, Artificial Sequence
  Description of Artificial Sequence: Synthetic oligonucleotide
  Target: ATXN1; (+) strand; PAM type: NRG; PAM sequence: TGG
cattggttgtcttactgatc

SEQ ID NO: 100121 - DNA, 20 bp, Artificial Sequence
  Description of Artificial Sequence: Synthetic oligonucleotide
  Target: ATXN1; (+) strand; PAM type: NRG; PAM sequence: GAG
ttggttgtcttactgatctg

SEQ ID NO: 100122 - DNA, 20 bp, Artificial Sequence
  Description of Artificial Sequence: Synthetic oligonucleotide
  Target: ATXN1; (+) strand; PAM type: NRG; PAM sequence: AGG
tggttgtcttactgatctgg

SEQ ID NO: 100123 - DNA, 20 bp, Artificial Sequence
  Description of Artificial Sequence: Synthetic oligonucleotide
  Target: ATXN1; (+) strand; PAM type: NRG; PAM sequence: GGG
ggttgtcttactgatctgga

SEQ ID NO: 100124 - DNA, 20 bp, Artificial Sequence
  Description of Artificial Sequence: Synthetic oligonucleotide
  Target: ATXN1; (+) strand; PAM type: NRG; PAM sequence: TGG
gtcttactgatctggagggc

SEQ ID NO: 100125 - DNA, 20 bp, Artificial Sequence
  Description of Artificial Sequence: Synthetic oligonucleotide
  Target: ATXN1; (+) strand; PAM type: NRG; PAM sequence: GAG
cttactgatctggagggctg

SEQ ID NO: 100126 - DNA, 20 bp, Artificial Sequence
  Description of Artificial Sequence: Synthetic oligonucleotide
  Target: ATXN1; (+) strand; PAM type: NRG; PAM sequence: CAG
accaatgcacccctcaaatc

SEQ ID NO: 100127 - DNA, 20 bp, Artificial Sequence
  Description of Artificial Sequence: Synthetic oligonucleotide
  Target: ATXN1; (+) strand; PAM type: NRG; PAM sequence: CAG
cctcaaatccagttcatact

SEQ ID NO: 100128 - DNA, 20 bp, Artificial Sequence
  Description of Artificial Sequence: Synthetic oligonucleotide
  Target: ATXN1; (+) strand; PAM type: NRG; PAM sequence: CAG
ccagttcatactcagaaata

SEQ ID NO: 100129 - DNA, 20 bp, Artificial Sequence
  Description of Artificial Sequence: Synthetic oligonucleotide
  Target: ATXN1; (+) strand; PAM type: NRG; PAM sequence: CAG
tacagattgatatgctcacg

SEQ ID NO: 100130 - DNA, 20 bp, Artificial Sequence
  Description of Artificial Sequence: Synthetic oligonucleotide
  Target: ATXN1; (+) strand; PAM type: NRG; PAM sequence: AGG
acagattgatatgctcacgc

SEQ ID NO: 100131 - DNA, 20 bp, Artificial Sequence
  Description of Artificial Sequence: Synthetic oligonucleotide
  Target: ATXN1; (+) strand; PAM type: NRG; PAM sequence: TGG
attgatatgctcacgcaggc

SEQ ID NO: 100132 - DNA, 20 bp, Artificial Sequence
  Description of Artificial Sequence: Synthetic oligonucleotide
  Target: ATXN1; (+) strand; PAM type: NRG; PAM sequence: TAG
caggctggcatgacatcatt

SEQ ID NO: 100133 - DNA, 20 bp, Artificial Sequence
  Description of Artificial Sequence: Synthetic oligonucleotide
  Target: ATXN1; (+) strand; PAM type: NRG; PAM sequence: TAG
ggcatgacatcatttagcct

SEQ ID NO: 100134 - DNA, 20 bp, Artificial Sequence
  Description of Artificial Sequence: Synthetic oligonucleotide
  Target: ATXN1; (+) strand; PAM type: NRG; PAM sequence: CAG
acatcatttagccttagaaa

SEQ ID NO: 100135 - DNA, 20 bp, Artificial Sequence
  Description of Artificial Sequence: Synthetic oligonucleotide
  Target: ATXN1; (+) strand; PAM type: NRG; PAM sequence: AGG
catcatttagccttagaaac

SEQ ID NO: 100136 - DNA, 20 bp, Artificial Sequence
  Description of Artificial Sequence: Synthetic oligonucleotide
  Target: ATXN1; (+) strand; PAM type: NRG; PAM sequence: CGG
tttagccttagaaacaggaa

SEQ ID NO: 100137 - DNA, 20 bp, Artificial Sequence
  Description of Artificial Sequence: Synthetic oligonucleotide
  Target: ATXN1; (+) strand; PAM type: NRG; PAM sequence: CGG
agccttagaaacaggaacgg

SEQ ID NO: 100138 - DNA, 20 bp, Artificial Sequence
  Description of Artificial Sequence: Synthetic oligonucleotide
  Target: ATXN1; (+) strand; PAM type: NRG; PAM sequence: GGG
gccttagaaacaggaacggc

SEQ ID NO: 100139 - DNA, 20 bp, Artificial Sequence
  Description of Artificial Sequence: Synthetic oligonucleotide
  Target: ATXN1; (+) strand; PAM type: NRG; PAM sequence: AAG
ttagaaacaggaacggcggg

SEQ ID NO: 100140 - DNA, 20 bp, Artificial Sequence
  Description of Artificial Sequence: Synthetic oligonucleotide
  Target: ATXN1; (+) strand; PAM type: NRG; PAM sequence: AGG
tagaaacaggaacggcggga

SEQ ID NO: 100141 - DNA, 20 bp, Artificial Sequence
  Description of Artificial Sequence: Synthetic oligonucleotide
  Target: ATXN1; (+) strand; PAM type: NRG; PAM sequence: GGG
agaaacaggaacggcgggaa

SEQ ID NO: 100142 - DNA, 20 bp, Artificial Sequence
  Description of Artificial Sequence: Synthetic oligonucleotide
  Target: ATXN1; (+) strand; PAM type: NRG; PAM sequence: CGG
ggcgggaagggtgctcgcct

SEQ ID NO: 100143 - DNA, 20 bp, Artificial Sequence
  Description of Artificial Sequence: Synthetic oligonucleotide
  Target: ATXN1; (+) strand; PAM type: NRG; PAM sequence: CGG
gtgctcgcctcggccactcg

SEQ ID NO: 100144 - DNA, 20 bp, Artificial Sequence
  Description of Artificial Sequence: Synthetic oligonucleotide
  Target: ATXN1; (+) strand; PAM type: NRG; PAM sequence: GGG
tgctcgcctcggccactcgc

SEQ ID NO: 100145 - DNA, 20 bp, Artificial Sequence
  Description of Artificial Sequence: Synthetic oligonucleotide
  Target: ATXN1; (+) strand; PAM type: NRG; PAM sequence: GAG
cactcgcgggattccacccc

SEQ ID NO: 100146 - DNA, 20 bp, Artificial Sequence
  Description of Artificial Sequence: Synthetic oligonucleotide
  Target: ATXN1; (+) strand; PAM type: NRG; PAM sequence: AGG
actcgcgggattccaccccg

SEQ ID NO: 100147 - DNA, 20 bp, Artificial Sequence
  Description of Artificial Sequence: Synthetic oligonucleotide
  Target: ATXN1; (+) strand; PAM type: NRG; PAM sequence: CAG
ggattccaccccgaggatta

SEQ ID NO: 100148 - DNA, 20 bp, Artificial Sequence
  Description of Artificial Sequence: Synthetic oligonucleotide
  Target: ATXN1; (+) strand; PAM type: NRG; PAM sequence: AGG
gattccaccccgaggattac

SEQ ID NO: 100149 - DNA, 20 bp, Artificial Sequence
  Description of Artificial Sequence: Synthetic oligonucleotide
  Target: ATXN1; (+) strand; PAM type: NRG; PAM sequence: CAG
tccaccccgaggattacagg

SEQ ID NO: 100150 - DNA, 20 bp, Artificial Sequence
  Description of Artificial Sequence: Synthetic oligonucleotide
  Target: ATXN1; (+) strand; PAM type: NRG; PAM sequence: AGG
ccaccccgaggattacaggc

SEQ ID NO: 100151 - DNA, 20 bp, Artificial Sequence
  Description of Artificial Sequence: Synthetic oligonucleotide
  Target: ATXN1; (+) strand; PAM type: NRG; PAM sequence: GGG
caccccgaggattacaggca

SEQ ID NO: 100152 - DNA, 20 bp, Artificial Sequence
  Description of Artificial Sequence: Synthetic oligonucleotide
  Target: ATXN1; (+) strand; PAM type: NRG; PAM sequence: TGG
gattacaggcagggtaaaaa

SEQ ID NO: 100153 - DNA, 20 bp, Artificial Sequence
  Description of Artificial Sequence: Synthetic oligonucleotide
  Target: ATXN1; (+) strand; PAM type: NRG; PAM sequence: TGG
aaatggcttattgtgctcat

SEQ ID NO: 100154 - DNA, 20 bp, Artificial Sequence
  Description of Artificial Sequence: Synthetic oligonucleotide
  Target: ATXN1; (+) strand; PAM type: NRG; PAM sequence: AAG
gcttattgtgctcattggaa

SEQ ID NO: 100155 - DNA, 20 bp, Artificial Sequence
  Description of Artificial Sequence: Synthetic oligonucleotide
  Target: ATXN1; (+) strand; PAM type: NRG; PAM sequence: CAG
ttgtgctcattggaaaagtt

SEQ ID NO: 100156 - DNA, 20 bp, Artificial Sequence
  Description of Artificial Sequence: Synthetic oligonucleotide
  Target: ATXN1; (+) strand; PAM type: NRG; PAM sequence: TAG
gaaaagttcagccttctttc

SEQ ID NO: 100157 - DNA, 20 bp, Artificial Sequence
  Description of Artificial Sequence: Synthetic oligonucleotide
  Target: ATXN1; (+) strand; PAM type: NRG; PAM sequence: CAG
ccttctttctagactttcat

SEQ ID NO: 100158 - DNA, 20 bp, Artificial Sequence
  Description of Artificial Sequence: Synthetic oligonucleotide
  Target: ATXN1; (+) strand; PAM type: NRG; PAM sequence: TAG
ctccttccataaactctttt

SEQ ID NO: 100159 - DNA, 20 bp, Artificial Sequence
  Description of Artificial Sequence: Synthetic oligonucleotide
  Target: ATXN1; (+) strand; PAM type: NRG; PAM sequence: GAG
ataaactctttttagaacac

SEQ ID NO: 100160 - DNA, 20 bp, Artificial Sequence
  Description of Artificial Sequence: Synthetic oligonucleotide
  Target: ATXN1; (+) strand; PAM type: NRG; PAM sequence: AGG
taaactctttttagaacacg

SEQ ID NO: 100161 - DNA, 20 bp, Artificial Sequence
  Description of Artificial Sequence: Synthetic oligonucleotide
  Target: ATXN1; (+) strand; PAM type: NRG; PAM sequence: CAG
gaggcctttgatttattttt

SEQ ID NO: 100162 - DNA, 20 bp, Artificial Sequence
  Description of Artificial Sequence: Synthetic oligonucleotide
  Target: ATXN1; (+) strand; PAM type: NRG; PAM sequence: CAG
tcagctgtgaatcactttct

SEQ ID NO: 100163 - DNA, 20 bp, Artificial Sequence
  Description of Artificial Sequence: Synthetic oligonucleotide
  Target: ATXN1; (+) strand; PAM type: NRG; PAM sequence: AGG
cagctgtgaatcactttctc

SEQ ID NO: 100164 - DNA, 20 bp, Artificial Sequence
  Description of Artificial Sequence: Synthetic oligonucleotide
  Target: ATXN1; (+) strand; PAM type: NRG; PAM sequence: GGG
agctgtgaatcactttctca

SEQ ID NO: 100165 - DNA, 20 bp, Artificial Sequence
  Description of Artificial Sequence: Synthetic oligonucleotide
  Target: ATXN1; (+) strand; PAM type: NRG; PAM sequence: GAG
gaatcactttctcagggccc

SEQ ID NO: 100166 - DNA, 20 bp, Artificial Sequence
  Description of Artificial Sequence: Synthetic oligonucleotide
  Target: ATXN1; (+) strand; PAM type: NRG; PAM sequence: AAG
tctcagggcccgagccatct

SEQ ID NO: 100167 - DNA, 20 bp, Artificial Sequence
  Description of Artificial Sequence: Synthetic oligonucleotide
  Target: ATXN1; (+) strand; PAM type: NRG; PAM sequence: AAG
ggcccgagccatctaagttg

SEQ ID NO: 100168 - DNA, 20 bp, Artificial Sequence
  Description of Artificial Sequence: Synthetic oligonucleotide
  Target: ATXN1; (+) strand; PAM type: NRG; PAM sequence: CAG
ccgagccatctaagttgaag

SEQ ID NO: 100169 - DNA, 20 bp, Artificial Sequence
  Description of Artificial Sequence: Synthetic oligonucleotide
  Target: ATXN1; (+) strand; PAM type: NRG; PAM sequence: AGG
cgagccatctaagttgaagc

SEQ ID NO: 100170 - DNA, 20 bp, Artificial Sequence
  Description of Artificial Sequence: Synthetic oligonucleotide
  Target: ATXN1; (+) strand; PAM type: NRG; PAM sequence: GGG
gagccatctaagttgaagca

SEQ ID NO: 100171 - DNA, 20 bp, Artificial Sequence
  Description of Artificial Sequence: Synthetic oligonucleotide
  Target: ATXN1; (+) strand; PAM type: NRG; PAM sequence: AAG
ccatctaagttgaagcaggg

SEQ ID NO: 100172 - DNA, 20 bp, Artificial Sequence
  Description of Artificial Sequence: Synthetic oligonucleotide
  Target: ATXN1; (+) strand; PAM type: NRG; PAM sequence: AGG
catctaagttgaagcaggga

SEQ ID NO: 100173 - DNA, 20 bp, Artificial Sequence
  Description of Artificial Sequence: Synthetic oligonucleotide
  Target: ATXN1; (+) strand; PAM type: NRG; PAM sequence: GGG
atctaagttgaagcagggaa

SEQ ID NO: 100174 - DNA, 20 bp, Artificial Sequence
  Description of Artificial Sequence: Synthetic oligonucleotide
  Target: ATXN1; (+) strand; PAM type: NRG; PAM sequence: AAG
agggaaaactaacattgcac

SEQ ID NO: 100175 - DNA, 20 bp, Artificial Sequence
  Description of Artificial Sequence: Synthetic oligonucleotide
  Target: ATXN1; (+) strand; PAM type: NRG; PAM sequence: AGG
gggaaaactaacattgcaca

SEQ ID NO: 100176 - DNA, 20 bp, Artificial Sequence
  Description of Artificial Sequence: Synthetic oligonucleotide
  Target: ATXN1; (+) strand; PAM type: NRG; PAM sequence: CAG
actaacattgcacaaggtcc

SEQ ID NO: 100177 - DNA, 20 bp, Artificial Sequence
  Description of Artificial Sequence: Synthetic oligonucleotide
  Target: ATXN1; (+) strand; PAM type: NRG; PAM sequence: CGG
caaggtcccagtgctactga

SEQ ID NO: 100178 - DNA, 20 bp, Artificial Sequence
  Description of Artificial Sequence: Synthetic oligonucleotide
  Target: ATXN1; (+) strand; PAM type: NRG; PAM sequence: GGG
aaggtcccagtgctactgac

SEQ ID NO: 100179 - DNA, 20 bp, Artificial Sequence
  Description of Artificial Sequence: Synthetic oligonucleotide
  Target: ATXN1; (+) strand; PAM type: NRG; PAM sequence: GAG
tcccagtgctactgacgggt

SEQ ID NO: 100180 - DNA, 20 bp, Artificial Sequence
  Description of Artificial Sequence: Synthetic oligonucleotide
  Target: ATXN1; (+) strand; PAM type: NRG; PAM sequence: AGG
cccagtgctactgacgggtg

SEQ ID NO: 100181 - DNA, 20 bp, Artificial Sequence
  Description of Artificial Sequence: Synthetic oligonucleotide
  Target: ATXN1; (+) strand; PAM type: NRG; PAM sequence: GGG
ccagtgctactgacgggtga

SEQ ID NO: 100182 - DNA, 20 bp, Artificial Sequence
  Description of Artificial Sequence: Synthetic oligonucleotide
  Target: ATXN1; (+) strand; PAM type: NRG; PAM sequence: CAG
tgacgggtgagggatatgtt

SEQ ID NO: 100183 - DNA, 20 bp, Artificial Sequence
  Description of Artificial Sequence: Synthetic oligonucleotide
  Target: ATXN1; (+) strand; PAM type: NRG; PAM sequence: CAG
gtgagggatatgttcagact

SEQ ID NO: 100184 - DNA, 20 bp, Artificial Sequence
  Description of Artificial Sequence: Synthetic oligonucleotide
  Target: ATXN1; (+) strand; PAM type: NRG; PAM sequence: CAG
tgttcagactcagatctctt

SEQ ID NO: 100185 - DNA, 20 bp, Artificial Sequence
  Description of Artificial Sequence: Synthetic oligonucleotide
  Target: ATXN1; (+) strand; PAM type: NRG; PAM sequence: CAG
gactcagatctcttcagtgc

SEQ ID NO: 100186 - DNA, 20 bp, Artificial Sequence
  Description of Artificial Sequence: Synthetic oligonucleotide
  Target: ATXN1; (+) strand; PAM type: NRG; PAM sequence: AAG
tgccagttcctgcattttcc

SEQ ID NO: 100187 - DNA, 20 bp, Artificial Sequence
  Description of Artificial Sequence: Synthetic oligonucleotide
  Target: ATXN1; (+) strand; PAM type: NRG; PAM sequence: CAG
cagttcctgcattttccaag

SEQ ID NO: 100188 - DNA, 20 bp, Artificial Sequence
  Description of Artificial Sequence: Synthetic oligonucleotide
  Target: ATXN1; (+) strand; PAM type: NRG; PAM sequence: AAG
agctaacctacttcctaccc

SEQ ID NO: 100189 - DNA, 20 bp, Artificial Sequence
  Description of Artificial Sequence: Synthetic oligonucleotide
  Target: ATXN1; (+) strand; PAM type: NRG; PAM sequence: AGG
gctaacctacttcctaccca

SEQ ID NO: 100190 - DNA, 20 bp, Artificial Sequence
  Description of Artificial Sequence: Synthetic oligonucleotide
  Target: ATXN1; (+) strand; PAM type: NRG; PAM sequence: GAG
taacctacttcctacccaag

SEQ ID NO: 100191 - DNA, 20 bp, Artificial Sequence
  Description of Artificial Sequence: Synthetic oligonucleotide
  Target: ATXN1; (+) strand; PAM type: NRG; PAM sequence: AGG
aacctacttcctacccaagg

SEQ ID NO: 100192 - DNA, 20 bp, Artificial Sequence
  Description of Artificial Sequence: Synthetic oligonucleotide
  Target: ATXN1; (+) strand; PAM type: NRG; PAM sequence: GAG
cctacttcctacccaaggag

SEQ ID NO: 100193 - DNA, 20 bp, Artificial Sequence
  Description of Artificial Sequence: Synthetic oligonucleotide
  Target: ATXN1; (+) strand; PAM type: NRG; PAM sequence: AGG
ctacttcctacccaaggagg

SEQ ID NO: 100194 - DNA, 20 bp, Artificial Sequence
  Description of Artificial Sequence: Synthetic oligonucleotide
  Target: ATXN1; (+) strand; PAM type: NRG; PAM sequence: AAG
ctacccaaggaggaggtgcg

SEQ ID NO: 100195 - DNA, 20 bp, Artificial Sequence
  Description of Artificial Sequence: Synthetic oligonucleotide
  Target: ATXN1; (+) strand; PAM type: NRG; PAM sequence: GAG
cgaagccccatccttctttt

SEQ ID NO: 100196 - DNA, 20 bp, Artificial Sequence
  Description of Artificial Sequence: Synthetic oligonucleotide
  Target: ATXN1; (+) strand; PAM type: NRG; PAM sequence: TGG
atccttcttttgagttgcat

SEQ ID NO: 100197 - DNA, 20 bp, Artificial Sequence
  Description of Artificial Sequence: Synthetic oligonucleotide
  Target: ATXN1; (+) strand; PAM type: NRG; PAM sequence: CGG
ccacgttgatgctatcgcct

SEQ ID NO: 100198 - DNA, 20 bp, Artificial Sequence
  Description of Artificial Sequence: Synthetic oligonucleotide
  Target: ATXN1; (+) strand; PAM type: NRG; PAM sequence: GGG
cacgttgatgctatcgcctc

SEQ ID NO: 100199 - DNA, 20 bp, Artificial Sequence
  Description of Artificial Sequence: Synthetic oligonucleotide
  Target: ATXN1; (+) strand; PAM type: NRG; PAM sequence: GGG
acgttgatgctatcgcctcg

SEQ ID NO: 100200 - DNA, 20 bp, Artificial Sequence
  Description of Artificial Sequence: Synthetic oligonucleotide
  Target: ATXN1; (+) strand; PAM type: NRG; PAM sequence: GGG
cgttgatgctatcgcctcgg

SEQ ID NO: 100201 - DNA, 20 bp, Artificial Sequence
  Description of Artificial Sequence: Synthetic oligonucleotide
  Target: ATXN1; (+) strand; PAM type: NRG; PAM sequence: TGG
atcgcctcgggggtcgcatc

SEQ ID NO: 100202 - DNA, 20 bp, Artificial Sequence
  Description of Artificial Sequence: Synthetic oligonucleotide
  Target: ATXN1; (+) strand; PAM type: NRG; PAM sequence: CAG
ggtcgcatctggatgcgcca

SEQ ID NO: 100203 - DNA, 20 bp, Artificial Sequence
  Description of Artificial Sequence: Synthetic oligonucleotide
  Target: ATXN1; (+) strand; PAM type: NRG; PAM sequence: TGG
ctggatgcgccacagactta

SEQ ID NO: 100204 - DNA, 20 bp, Artificial Sequence
  Description of Artificial Sequence: Synthetic oligonucleotide
  Target: ATXN1; (+) strand; PAM type: NRG; PAM sequence: TGG
cagacttatggcctcaaact

SEQ ID NO: 100205 - DNA, 20 bp, Artificial Sequence
  Description of Artificial Sequence: Synthetic oligonucleotide
  Target: ATXN1; (+) strand; PAM type: NRG; PAM sequence: GAG
gacttatggcctcaaacttg

SEQ ID NO: 100206 - DNA, 20 bp, Artificial Sequence
  Description of Artificial Sequence: Synthetic oligonucleotide
  Target: ATXN1; (+) strand; PAM type: NRG; PAM sequence: AGG
acttatggcctcaaacttgg

SEQ ID NO: 100207 - DNA, 20 bp, Artificial Sequence
  Description of Artificial Sequence: Synthetic oligonucleotide
  Target: ATXN1; (+) strand; PAM type: NRG; PAM sequence: AAG
cctcaaacttggaggatatt

SEQ ID NO: 100208 - DNA, 20 bp, Artificial Sequence
  Description of Artificial Sequence: Synthetic oligonucleotide
  Target: ATXN1; (+) strand; PAM type: NRG; PAM sequence: TGG
caaacttggaggatattaag

SEQ ID NO: 100209 - DNA, 20 bp, Artificial Sequence
  Description of Artificial Sequence: Synthetic oligonucleotide
  Target: ATXN1; (+) strand; PAM type: NRG; PAM sequence: TGG
gatattaagtggattatatt

SEQ ID NO: 100210 - DNA, 20 bp, Artificial Sequence
  Description of Artificial Sequence: Synthetic oligonucleotide
  Target: ATXN1; (+) strand; PAM type: NRG; PAM sequence: CAG
attaagtggattatatttgg

SEQ ID NO: 100211 - DNA, 20 bp, Artificial Sequence
  Description of Artificial Sequence: Synthetic oligonucleotide
  Target: ATXN1; (+) strand; PAM type: NRG; PAM sequence: GAG
agtggattatatttggcagt

SEQ ID NO: 100212 - DNA, 20 bp, Artificial Sequence
  Description of Artificial Sequence: Synthetic oligonucleotide
  Target: ATXN1; (+) strand; PAM type: NRG; PAM sequence: AGG
gtggattatatttggcagtg

SEQ ID NO: 100213 - DNA, 20 bp, Artificial Sequence
  Description of Artificial Sequence: Synthetic oligonucleotide
  Target: ATXN1; (+) strand; PAM type: NRG; PAM sequence: AAG
tatatttggcagtgaggccc

SEQ ID NO: 100214 - DNA, 20 bp, Artificial Sequence
  Description of Artificial Sequence: Synthetic oligonucleotide
  Target: ATXN1; (+) strand; PAM type: NRG; PAM sequence: AGG
atatttggcagtgaggccca

SEQ ID NO: 100215 - DNA, 20 bp, Artificial Sequence
  Description of Artificial Sequence: Synthetic oligonucleotide
  Target: ATXN1; (+) strand; PAM type: NRG; PAM sequence: GGG
tatttggcagtgaggcccaa

SEQ ID NO: 100216 - DNA, 20 bp, Artificial Sequence
  Description of Artificial Sequence: Synthetic oligonucleotide
  Target: ATXN1; (+) strand; PAM type: NRG; PAM sequence: AAG
ttggcagtgaggcccaaggg

SEQ ID NO: 100217 - DNA, 20 bp, Artificial Sequence
  Description of Artificial Sequence: Synthetic oligonucleotide
  Target: ATXN1; (+) strand; PAM type: NRG; PAM sequence: TGG
gaagtgattctgtcatcctt

SEQ ID NO: 100218 - DNA, 20 bp, Artificial Sequence
  Description of Artificial Sequence: Synthetic oligonucleotide
  Target: ATXN1; (+) strand; PAM type: NRG; PAM sequence: GGG
aagtgattctgtcatccttt

SEQ ID NO: 100219 - DNA, 20 bp, Artificial Sequence
  Description of Artificial Sequence: Synthetic oligonucleotide
  Target: ATXN1; (+) strand; PAM type: NRG; PAM sequence: CAG
catcctttgggactctcaac

SEQ ID NO: 100220 - DNA, 20 bp, Artificial Sequence
  Description of Artificial Sequence: Synthetic oligonucleotide
  Target: ATXN1; (+) strand; PAM type: NRG; PAM sequence: AAG
tgggactctcaaccagaatc

SEQ ID NO: 100221 - DNA, 20 bp, Artificial Sequence
  Description of Artificial Sequence: Synthetic oligonucleotide
  Target: ATXN1; (+) strand; PAM type: NRG; PAM sequence: AGG
gggactctcaaccagaatca

SEQ ID NO: 100222 - DNA, 20 bp, Artificial Sequence
  Description of Artificial Sequence: Synthetic oligonucleotide
  Target: ATXN1; (+) strand; PAM type: NRG; PAM sequence: TGG
tctcaaccagaatcaaggca

SEQ ID NO: 100223 - DNA, 20 bp, Artificial Sequence
  Description of Artificial Sequence: Synthetic oligonucleotide
  Target: ATXN1; (+) strand; PAM type: NRG; PAM sequence: AAG
accagaatcaaggcatggca

SEQ ID NO: 100224 - DNA, 20 bp, Artificial Sequence
  Description of Artificial Sequence: Synthetic oligonucleotide
  Target: ATXN1; (+) strand; PAM type: NRG; PAM sequence: CAG
agaatcaaggcatggcaaag

SEQ ID NO: 100225 - DNA, 20 bp, Artificial Sequence
  Description of Artificial Sequence: Synthetic oligonucleotide
  Target: ATXN1; (+) strand; PAM type: NRG; PAM sequence: CAG
gcaaagcagcaactctcttc

SEQ ID NO: 100226 - DNA, 20 bp, Artificial Sequence
  Description of Artificial Sequence: Synthetic oligonucleotide
  Target: ATXN1; (+) strand; PAM type: NRG; PAM sequence: AGG
caaagcagcaactctcttcc

SEQ ID NO: 100227 - DNA, 20 bp, Artificial Sequence
  Description of Artificial Sequence: Synthetic oligonucleotide
  Target: ATXN1; (+) strand; PAM type: NRG; PAM sequence: GGG
aaagcagcaactctcttcca

SEQ ID NO: 100228 - DNA, 20 bp, Artificial Sequence
  Description of Artificial Sequence: Synthetic oligonucleotide
  Target: ATXN1; (+) strand; PAM type: NRG; PAM sequence: TGG
gcagcaactctcttccaggg

SEQ ID NO: 100229 - DNA, 20 bp, Artificial Sequence
  Description of Artificial Sequence: Synthetic oligonucleotide
  Target: ATXN1; (+) strand; PAM type: NRG; PAM sequence: GGG
cagcaactctcttccagggt

SEQ ID NO: 100230 - DNA, 20 bp, Artificial Sequence
  Description of Artificial Sequence: Synthetic oligonucleotide
  Target: ATXN1; (+) strand; PAM type: NRG; PAM sequence: GGG
agcaactctcttccagggtg

SEQ ID NO: 100231 - DNA, 20 bp, Artificial Sequence
  Description of Artificial Sequence: Synthetic oligonucleotide
  Target: ATXN1; (+) strand; PAM type: NRG; PAM sequence: AAG
cgtgctatcaccctccactg

SEQ ID NO: 100232 - DNA, 20 bp, Artificial Sequence
  Description of Artificial Sequence: Synthetic oligonucleotide
  Target: ATXN1; (+) strand; PAM type: NRG; PAM sequence: GAG
tgctatcaccctccactgaa

SEQ ID NO: 100233 - DNA, 20 bp, Artificial Sequence
  Description of Artificial Sequence: Synthetic oligonucleotide
  Target: ATXN1; (+) strand; PAM type: NRG; PAM sequence: AGG
gctatcaccctccactgaag

SEQ ID NO: 100234 - DNA, 20 bp, Artificial Sequence
  Description of Artificial Sequence: Synthetic oligonucleotide
  Target: ATXN1; (+) strand; PAM type: NRG; PAM sequence: AAG
atcaccctccactgaagagg

SEQ ID NO: 100235 - DNA, 20 bp, Artificial Sequence
  Description of Artificial Sequence: Synthetic oligonucleotide
  Target: ATXN1; (+) strand; PAM type: NRG; PAM sequence: AGG
tcaccctccactgaagagga

SEQ ID NO: 100236 - DNA, 20 bp, Artificial Sequence
  Description of Artificial Sequence: Synthetic oligonucleotide
  Target: ATXN1; (+) strand; PAM type: NRG; PAM sequence: GAG
accctccactgaagaggaag

SEQ ID NO: 100237 - DNA, 20 bp, Artificial Sequence
  Description of Artificial Sequence: Synthetic oligonucleotide
  Target: ATXN1; (+) strand; PAM type: NRG; PAM sequence: AGG
ccctccactgaagaggaagg

SEQ ID NO: 100238 - DNA, 20 bp, Artificial Sequence
  Description of Artificial Sequence: Synthetic oligonucleotide
  Target: ATXN1; (+) strand; PAM type: NRG; PAM sequence: TGG
aagaggaaggaggcttcctt

SEQ ID NO: 100239 - DNA, 20 bp, Artificial Sequence
  Description of Artificial Sequence: Synthetic oligonucleotide
  Target: ATXN1; (+) strand; PAM type: NRG; PAM sequence: CAG
gaggcttcctttggtgcacg

SEQ ID NO: 100240 - DNA, 20 bp, Artificial Sequence
  Description of Artificial Sequence: Synthetic oligonucleotide
  Target: ATXN1; (+) strand; PAM type: NRG; PAM sequence: TGG
tttggtgcacgcagtaacaa

SEQ ID NO: 100241 - DNA, 20 bp, Artificial Sequence
  Description of Artificial Sequence: Synthetic oligonucleotide
  Target: ATXN1; (+) strand; PAM type: NRG; PAM sequence: TGG
cagtaacaatggacaacacc

SEQ ID NO: 100242 - DNA, 20 bp, Artificial Sequence
  Description of Artificial Sequence: Synthetic oligonucleotide
  Target: ATXN1; (+) strand; PAM type: NRG; PAM sequence: CAG
ggcattcccctttcctccca

SEQ ID NO: 100243 - DNA, 20 bp, Artificial Sequence
  Description of Artificial Sequence: Synthetic oligonucleotide
  Target: ATXN1; (+) strand; PAM type: NRG; PAM sequence: TAG
ccctttcctcccacagcacc

SEQ ID NO: 100244 - DNA, 20 bp, Artificial Sequence
  Description of Artificial Sequence: Synthetic oligonucleotide
  Target: ATXN1; (+) strand; PAM type: NRG; PAM sequence: AGG
cctttcctcccacagcacct

SEQ ID NO: 100245 - DNA, 20 bp, Artificial Sequence
  Description of Artificial Sequence: Synthetic oligonucleotide
  Target: ATXN1; (+) strand; PAM type: NRG; PAM sequence: TGG
ttcctcccacagcacctagg

SEQ ID NO: 100246 - DNA, 20 bp, Artificial Sequence
  Description of Artificial Sequence: Synthetic oligonucleotide
  Target: ATXN1; (+) strand; PAM type: NRG; PAM sequence: GGG
tcctcccacagcacctaggt

SEQ ID NO: 100247 - DNA, 20 bp, Artificial Sequence
  Description of Artificial Sequence: Synthetic oligonucleotide
  Target: ATXN1; (+) strand; PAM type: NRG; PAM sequence: GGG
cctcccacagcacctaggtg

SEQ ID NO: 100248 - DNA, 20 bp, Artificial Sequence
  Description of Artificial Sequence: Synthetic oligonucleotide
  Target: ATXN1; (+) strand; PAM type: NRG; PAM sequence: GGG
ctcccacagcacctaggtgg

SEQ ID NO: 100249 - DNA, 20 bp, Artificial Sequence
  Description of Artificial Sequence: Synthetic oligonucleotide
  Target: ATXN1; (+) strand; PAM type: NRG; PAM sequence: TGG
acagcacctaggtgggggcc

SEQ ID NO: 100250 - DNA, 20 bp, Artificial Sequence
  Description of Artificial Sequence: Synthetic oligonucleotide
  Target: ATXN1; (+) strand; PAM type: NRG; PAM sequence: GGG
cagcacctaggtgggggcct

SEQ ID NO: 100251 - DNA, 20 bp, Artificial Sequence
  Description of Artificial Sequence: Synthetic oligonucleotide
  Target: ATXN1; (+) strand; PAM type: NRG; PAM sequence: GGG
agcacctaggtgggggcctg

SEQ ID NO: 100252 - DNA, 20 bp, Artificial Sequence
  Description of Artificial Sequence: Synthetic oligonucleotide
  Target: ATXN1; (+) strand; PAM type: NRG; PAM sequence: GGG
gcacctaggtgggggcctgg

SEQ ID NO: 100253 - DNA, 20 bp, Artificial Sequence
  Description of Artificial Sequence: Synthetic oligonucleotide
  Target: ATXN1; (+) strand; PAM type: NRG; PAM sequence: TAG
gtgggggcctgggggatgca

SEQ ID NO: 100254 - DNA, 20 bp, Artificial Sequence
  Description of Artificial Sequence: Synthetic oligonucleotide
  Target: ATXN1; (+) strand; PAM type: NRG; PAM sequence: GAG
gatgcatagacgctttgctc

SEQ ID NO: 100255 - DNA, 20 bp, Artificial Sequence
  Description of Artificial Sequence: Synthetic oligonucleotide
  Target: ATXN1; (+) strand; PAM type: NRG; PAM sequence: TGG
gcatagacgctttgctcgag

SEQ ID NO: 100256 - DNA, 20 bp, Artificial Sequence
  Description of Artificial Sequence: Synthetic oligonucleotide
  Target: ATXN1; (+) strand; PAM type: NRG; PAM sequence: GAG
atagacgctttgctcgagtg

SEQ ID NO: 100257 - DNA, 20 bp, Artificial Sequence
  Description of Artificial Sequence: Synthetic oligonucleotide
  Target: ATXN1; (+) strand; PAM type: NRG; PAM sequence: AAG
cgctttgctcgagtggagaa

SEQ ID NO: 100258 - DNA, 20 bp, Artificial Sequence
  Description of Artificial Sequence: Synthetic oligonucleotide
  Target: ATXN1; (+) strand; PAM type: NRG; PAM sequence: TGG
cgagtggagaaaagctgtac

SEQ ID NO: 100259 - DNA, 20 bp, Artificial Sequence
  Description of Artificial Sequence: Synthetic oligonucleotide
  Target: ATXN1; (+) strand; PAM type: NRG; PAM sequence: GGG
gagtggagaaaagctgtact

SEQ ID NO: 100260 - DNA, 20 bp, Artificial Sequence
  Description of Artificial Sequence: Synthetic oligonucleotide
  Target: ATXN1; (+) strand; PAM type: NRG; PAM sequence: CAG
tggagaaaagctgtactggg

SEQ ID NO: 100261 - DNA, 20 bp, Artificial Sequence
  Description of Artificial Sequence: Synthetic oligonucleotide
  Target: ATXN1; (+) strand; PAM type: NRG; PAM sequence: AGG
ggagaaaagctgtactgggc

SEQ ID NO: 100262 - DNA, 20 bp, Artificial Sequence
  Description of Artificial Sequence: Synthetic oligonucleotide
  Target: ATXN1; (+) strand; PAM type: NRG; PAM sequence: GGG
gagaaaagctgtactgggca

SEQ ID NO: 100263 - DNA, 20 bp, Artificial Sequence
  Description of Artificial Sequence: Synthetic oligonucleotide
  Target: ATXN1; (+) strand; PAM type: NRG; PAM sequence: CAG
tactgggcagggcaatgcca

SEQ ID NO: 100264 - DNA, 20 bp, Artificial Sequence
  Description of Artificial Sequence: Synthetic oligonucleotide
  Target: ATXN1; (+) strand; PAM type: NRG; PAM sequence: AGG
actgggcagggcaatgccac

SEQ ID NO: 100265 - DNA, 20 bp, Artificial Sequence
  Description of Artificial Sequence: Synthetic oligonucleotide
  Target: ATXN1; (+) strand; PAM type: NRG; PAM sequence: GGG
ctgggcagggcaatgccaca

SEQ ID NO: 100266 - DNA, 20 bp, Artificial Sequence
  Description of Artificial Sequence: Synthetic oligonucleotide
  Target: ATXN1; (+) strand; PAM type: NRG; PAM sequence: TAG
gcagggcaatgccacaggga

SEQ ID NO: 100267 - DNA, 20 bp, Artificial Sequence
  Description of Artificial Sequence: Synthetic oligonucleotide
  Target: ATXN1; (+) strand; PAM type: NRG; PAM sequence: CGG
cacagggatagtgacaaaca

SEQ ID NO: 100268 - DNA, 20 bp, Artificial Sequence
  Description of Artificial Sequence: Synthetic oligonucleotide
  Target: ATXN1; (+) strand; PAM type: NRG; PAM sequence: AAG
ggatagtgacaaacacggaa

SEQ ID NO: 100269 - DNA, 20 bp, Artificial Sequence
  Description of Artificial Sequence: Synthetic oligonucleotide
  Target: ATXN1; (+) strand; PAM type: NRG; PAM sequence: TGG
ttctcctacattgcctcgtc

SEQ ID NO: 100270 - DNA, 20 bp, Artificial Sequence
  Description of Artificial Sequence: Synthetic oligonucleotide
  Target: ATXN1; (+) strand; PAM type: NRG; PAM sequence: GAG
ctcctacattgcctcgtctg

SEQ ID NO: 100271 - DNA, 20 bp, Artificial Sequence
  Description of Artificial Sequence: Synthetic oligonucleotide
  Target: ATXN1; (+) strand; PAM type: NRG; PAM sequence: CAG
cattgcctcgtctggagcgt

SEQ ID NO: 100272 - DNA, 20 bp, Artificial Sequence
  Description of Artificial Sequence: Synthetic oligonucleotide
  Target: ATXN1; (+) strand; PAM type: NRG; PAM sequence: TGG
gcctcgtctggagcgtcagc

SEQ ID NO: 100273 - DNA, 20 bp, Artificial Sequence
  Description of Artificial Sequence: Synthetic oligonucleotide
  Target: ATXN1; (+) strand; PAM type: NRG; PAM sequence: GGG
cctcgtctggagcgtcagct

SEQ ID NO: 100274 - DNA, 20 bp, Artificial Sequence
  Description of Artificial Sequence: Synthetic oligonucleotide
  Target: ATXN1; (+) strand; PAM type: NRG; PAM sequence: TGG
agcgtcagctgggacaatgc

SEQ ID NO: 100275 - DNA, 20 bp, Artificial Sequence
  Description of Artificial Sequence: Synthetic oligonucleotide
  Target: ATXN1; (+) strand; PAM type: NRG; PAM sequence: GGG
gcgtcagctgggacaatgct

SEQ ID NO: 100276 - DNA, 20 bp, Artificial Sequence
  Description of Artificial Sequence: Synthetic oligonucleotide
  Target: ATXN1; (+) strand; PAM type: NRG; PAM sequence: GGG
cgtcagctgggacaatgctg

SEQ ID NO: 100277 - DNA, 20 bp, Artificial Sequence
  Description of Artificial Sequence: Synthetic oligonucleotide
  Target: ATXN1; (+) strand; PAM type: NRG; PAM sequence: GGG
gtcagctgggacaatgctgg

SEQ ID NO: 100278 - DNA, 20 bp, Artificial Sequence
  Description of Artificial Sequence: Synthetic oligonucleotide
  Target: ATXN1; (+) strand; PAM type: NRG; PAM sequence: CAG
atgctgggggcatctttcca

SEQ ID NO: 100279 - DNA, 20 bp, Artificial Sequence
  Description of Artificial Sequence: Synthetic oligonucleotide
  Target: ATXN1; (+) strand; PAM type: NRG; PAM sequence: GAG
catctttccacagtcttaat

SEQ ID NO: 100280 - DNA, 20 bp, Artificial Sequence
  Description of Artificial Sequence: Synthetic oligonucleotide
  Target: ATXN1; (+) strand; PAM type: NRG; PAM sequence: AGG
atctttccacagtcttaatg

SEQ ID NO: 100281 - DNA, 20 bp, Artificial Sequence
  Description of Artificial Sequence: Synthetic oligonucleotide
  Target: ATXN1; (+) strand; PAM type: NRG; PAM sequence: CAG
cacagtcttaatgaggaatt

SEQ ID NO: 100282 - DNA, 20 bp, Artificial Sequence
  Description of Artificial Sequence: Synthetic oligonucleotide
  Target: ATXN1; (+) strand; PAM type: NRG; PAM sequence: CAG
tccccaaactaaacacccct

SEQ ID NO: 100283 - DNA, 20 bp, Artificial Sequence
  Description of Artificial Sequence: Synthetic oligonucleotide
  Target: ATXN1; (+) strand; PAM type: NRG; PAM sequence: TGG
cccctcagttttatatgcca

SEQ ID NO: 100284 - DNA, 20 bp, Artificial Sequence
  Description of Artificial Sequence: Synthetic oligonucleotide
  Target: ATXN1; (+) strand; PAM type: NRG; PAM sequence: TAG
agttttatatgccatggctt

SEQ ID NO: 100285 - DNA, 20 bp, Artificial Sequence
  Description of Artificial Sequence: Synthetic oligonucleotide
  Target: ATXN1; (+) strand; PAM type: NRG; PAM sequence: GAG
gccatggctttagttcccat

SEQ ID NO: 100286 - DNA, 20 bp, Artificial Sequence
  Description of Artificial Sequence: Synthetic oligonucleotide
  Target: ATXN1; (+) strand; PAM type: NRG; PAM sequence: AGG
ccatggctttagttcccatg

SEQ ID NO: 100287 - DNA, 20 bp, Artificial Sequence
  Description of Artificial Sequence: Synthetic oligonucleotide
  Target: ATXN1; (+) strand; PAM type: NRG; PAM sequence: TAG
catgaggtctgtgtgccgct

SEQ ID NO: 100288 - DNA, 20 bp, Artificial Sequence
  Description of Artificial Sequence: Synthetic oligonucleotide
  Target: ATXN1; (+) strand; PAM type: NRG; PAM sequence: GAG
gtctgtgtgccgcttagcat

SEQ ID NO: 100289 - DNA, 20 bp, Artificial Sequence
  Description of Artificial Sequence: Synthetic oligonucleotide
  Target: ATXN1; (+) strand; PAM type: NRG; PAM sequence: AGG
tctgtgtgccgcttagcatg

SEQ ID NO: 100290 - DNA, 20 bp, Artificial Sequence
  Description of Artificial Sequence: Synthetic oligonucleotide
  Target: ATXN1; (+) strand; PAM type: NRG; PAM sequence: CAG
tgtgccgcttagcatgaggt

SEQ ID NO: 100291 - DNA, 20 bp, Artificial Sequence
  Description of Artificial Sequence: Synthetic oligonucleotide
  Target: ATXN1; (+) strand; PAM type: NRG; PAM sequence: TGG
gttcatcttaatgctcttct

SEQ ID NO: 100292 - DNA, 20 bp, Artificial Sequence
  Description of Artificial Sequence: Synthetic oligonucleotide
  Target: ATXN1; (+) strand; PAM type: NRG; PAM sequence: AAG
cgacgctaataaatttttac

SEQ ID NO: 100293 - DNA, 20 bp, Artificial Sequence
  Description of Artificial Sequence: Synthetic oligonucleotide
  Target: ATXN1; (+) strand; PAM type: NRG; PAM sequence: AGG
gacgctaataaatttttaca

SEQ ID NO: 100294 - DNA, 20 bp, Artificial Sequence
  Description of Artificial Sequence: Synthetic oligonucleotide
  Target: ATXN1; (+) strand; PAM type: NRG; PAM sequence: GGG
acgctaataaatttttacaa

SEQ ID NO: 100295 - DNA, 20 bp, Artificial Sequence
  Description of Artificial Sequence: Synthetic oligonucleotide
  Target: ATXN1; (+) strand; PAM type: NRG; PAM sequence: TGG
ttacaagggctgtgctgttc

SEQ ID NO: 100296 - DNA, 20 bp, Artificial Sequence
  Description of Artificial Sequence: Synthetic oligonucleotide
  Target: ATXN1; (+) strand; PAM type: NRG; PAM sequence: AAG
aagggctgtgctgttctgga

SEQ ID NO: 100297 - DNA, 20 bp, Artificial Sequence
  Description of Artificial Sequence: Synthetic oligonucleotide
  Target: ATXN1; (+) strand; PAM type: NRG; PAM sequence: AAG
tgctgttctggaaagtataa

SEQ ID NO: 100298 - DNA, 20 bp, Artificial Sequence
  Description of Artificial Sequence: Synthetic oligonucleotide
  Target: ATXN1; (+) strand; PAM type: NRG; PAM sequence: AAG
ttctggaaagtataaaagtg

SEQ ID NO: 100299 - DNA, 20 bp, Artificial Sequence
  Description of Artificial Sequence: Synthetic oligonucleotide
  Target: ATXN1; (+) strand; PAM type: NRG; PAM sequence: CGG
aaaagtgaagcattaaaaaa

SEQ ID NO: 100300 - DNA, 20 bp, Artificial Sequence
  Description of Artificial Sequence: Synthetic oligonucleotide
  Target: ATXN1; (+) strand; PAM type: NRG; PAM sequence: AAG
ttaaaaaacggaaccctctc

SEQ ID NO: 100301 - DNA, 20 bp, Artificial Sequence
  Description of Artificial Sequence: Synthetic oligonucleotide
  Target: ATXN1; (+) strand; PAM type: NRG; PAM sequence: GAG
aaaaaacggaaccctctcaa

SEQ ID NO: 100302 - DNA, 20 bp, Artificial Sequence
  Description of Artificial Sequence: Synthetic oligonucleotide
  Target: ATXN1; (+) strand; PAM type: NRG; PAM sequence: AAG
tcaagagattatctcctatg

SEQ ID NO: 100303 - DNA, 20 bp, Artificial Sequence
  Description of Artificial Sequence: Synthetic oligonucleotide
  Target: ATXN1; (+) strand; PAM type: NRG; PAM sequence: TGG
ctcctatgaagaatcatacg

SEQ ID NO: 100304 - DNA, 20 bp, Artificial Sequence
  Description of Artificial Sequence: Synthetic oligonucleotide
  Target: ATXN1; (+) strand; PAM type: NRG; PAM sequence: CGG
tatgaagaatcatacgtggc

SEQ ID NO: 100305 - DNA, 20 bp, Artificial Sequence
  Description of Artificial Sequence: Synthetic oligonucleotide
  Target: ATXN1; (+) strand; PAM type: NRG; PAM sequence: GGG
atgaagaatcatacgtggcc

SEQ ID NO: 100306 - DNA, 20 bp, Artificial Sequence
  Description of Artificial Sequence: Synthetic oligonucleotide
  Target: ATXN1; (+) strand; PAM type: NRG; PAM sequence: TGG
tcatacgtggccgggcgccg

SEQ ID NO: 100307 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctataatcc

SEQ ID NO: 100308 - DNA, 20 bp, Artificial Sequence
  Description of Artificial Sequence: Synthetic oligonucleotide
  Target: ATXN1; (+) strand; PAM type: NRG; PAM sequence: TGG
cgcctataatcccagcattt

SEQ ID NO: 100309 - DNA, 20 bp, Artificial Sequence
  Description of Artificial Sequence: Synthetic oligonucleotide
  Target: ATXN1; (+) strand; PAM type: NRG; PAM sequence: GGG
gcctataatcccagcatttt

SEQ ID NO: 100310 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagcattttgg

SEQ ID NO: 100311 - DNA, 20 bp, Artificial Sequence
  Description of Artificial Sequence: Synthetic oligonucleotide
  Target: ATXN1; (+) strand; PAM type: NRG; PAM sequence: GAG
tcccagcattttgggagacc

SEQ ID NO: 100312 - DNA, 20 bp, Artificial Sequence
  Description of Artificial Sequence: Synthetic oligonucleotide
  Target: ATXN1; (+) strand; PAM type: NRG; PAM sequence: AGG
cccagcattttgggagaccg

SEQ ID NO: 100313 - DNA, 20 bp, Artificial Sequence
  Description of Artificial Sequence: Synthetic oligonucleotide
  Target: ATXN1; (+) strand; PAM type: NRG; PAM sequence: TGG
agcattttgggagaccgagg

SEQ ID NO: 100314 - DNA, 20 bp, Artificial Sequence
  Description of Artificial Sequence: Synthetic oligonucleotide
  Target: ATXN1; (+) strand; PAM type: NRG; PAM sequence: GGG
gcattttgggagaccgaggt

SEQ ID NO: 100315 - DNA, 20 bp, Artificial Sequence
  Description of Artificial Sequence: Synthetic oligonucleotide
  Target: ATXN1; (+) strand; PAM type: NRG; PAM sequence: TGG
ttttgggagaccgaggtggg

SEQ ID NO: 100316 - DNA, 20 bp, Artificial Sequence
  Description of Artificial Sequence: Synthetic oligonucleotide
  Target: ATXN1; (+) strand; PAM type: NRG; PAM sequence: GAG
ccgaggtgggtggatcgctt

SEQ ID NO: 100317 - DNA, 20 bp, Artificial Sequence
  Description of Artificial Sequence: Synthetic oligonucleotide
  Target: ATXN1; (+) strand; PAM type: NRG; PAM sequence: CAG
gtgggtggatcgcttgagcc

SEQ ID NO: 100318 - DNA, 20 bp, Artificial Sequence
  Description of Artificial Sequence: Synthetic oligonucleotide
  Target: ATXN1; (+) strand; PAM type: NRG; PAM sequence: AGG
tgggtggatcgcttgagccc

SEQ ID NO: 100319 - DNA, 20 bp, Artificial Sequence
  Description of Artificial Sequence: Synthetic oligonucleotide
  Target: ATXN1; (+) strand; PAM type: NRG; PAM sequence: GAG
ggtggatcgcttgagcccag

SEQ ID NO: 100320 - DNA, 20 bp, Artificial Sequence
  Description of Artificial Sequence: Synthetic oligonucleotide
  Target: ATXN1; (+) strand; PAM type: NRG; PAM sequence: CAG
tcgcttgagcccaggagttc

SEQ ID NO: 100321 - DNA, 20 bp, Artificial Sequence
  Description of Artificial Sequence: Synthetic oligonucleotide
  Target: ATXN1; (+) strand; PAM type: NRG; PAM sequence: CAG
tgagcccaggagttccagac

SEQ ID NO: 100322 - DNA, 20 bp, Artificial Sequence
  Description of Artificial Sequence: Synthetic oligonucleotide
  Target: ATXN1; (+) strand; PAM type: NRG; PAM sequence: CGG
ccaggagttccagaccagca

SEQ ID NO: 100323 - DNA, 20 bp, Artificial Sequence
  Description of Artificial Sequence: Synthetic oligonucleotide
  Target: ATXN1; (+) strand; PAM type: NRG; PAM sequence: GGG
caggagttccagaccagcac

SEQ ID NO: 100324 - DNA, 20 bp, Artificial Sequence
  Description of Artificial Sequence: Synthetic oligonucleotide
  Target: ATXN1; (+) strand; PAM type: NRG; PAM sequence: AAG
agttccagaccagcacgggc

SEQ ID NO: 100325 - DNA, 20 bp, Artificial Sequence
  Description of Artificial Sequence: Synthetic oligonucleotide
  Target: ATXN1; (+) strand; PAM type: NRG; PAM sequence: TAG
ccagaccagcacgggcaaga

SEQ ID NO: 100326 - DNA, 20 bp, Artificial Sequence
  Description of Artificial Sequence: Synthetic oligonucleotide
  Target: ATXN1; (+) strand; PAM type: NRG; PAM sequence: CAG
cctgtctctacaaaaaaaca

SEQ ID NO: 100327 - DNA, 20 bp, Artificial Sequence
  Description of Artificial Sequence: Synthetic oligonucleotide
  Target: ATXN1; (+) strand; PAM type: NRG; PAM sequence: TAG
tacaaaaaaacacagaaaat

SEQ ID NO: 100328 - DNA, 20 bp, Artificial Sequence
  Description of Artificial Sequence: Synthetic oligonucleotide
  Target: ATXN1; (+) strand; PAM type: NRG; PAM sequence: TGG
aaaaaacacagaaaattagc

SEQ ID NO: 100329 - DNA, 20 bp, Artificial Sequence
  Description of Artificial Sequence: Synthetic oligonucleotide
  Target: ATXN1; (+) strand; PAM type: NRG; PAM sequence: GGG
aaaaacacagaaaattagct

SEQ ID NO: 100330 - DNA, 20 bp, Artificial Sequence
  Description of Artificial Sequence: Synthetic oligonucleotide
  Target: ATXN1; (+) strand; PAM type: NRG; PAM sequence: TAG
cacagaaaattagctgggtg

SEQ ID NO: 100331 - DNA, 20 bp, Artificial Sequence
  Description of Artificial Sequence: Synthetic oligonucleotide
  Target: ATXN1; (+) strand; PAM type: NRG; PAM sequence: TGG
agaaaattagctgggtgtag

SEQ ID NO: 100332 - DNA, 20 bp, Artificial Sequence
  Description of Artificial Sequence: Synthetic oligonucleotide
  Target: ATXN1; (+) strand; PAM type: NRG; PAM sequence: TAG
ggtgtagtggtacacaccca

SEQ ID NO: 100333 - DNA, 20 bp, Artificial Sequence
  Description of Artificial Sequence: Synthetic oligonucleotide
  Target: ATXN1; (+) strand; PAM type: NRG; PAM sequence: CAG
gtggtacacacccatagtcc

SEQ ID NO: 100334 - DNA, 20 bp, Artificial Sequence
  Description of Artificial Sequence: Synthetic oligonucleotide
  Target: ATXN1; (+) strand; PAM type: NRG; PAM sequence: TGG
acacccatagtcccagctac

SEQ ID NO: 100335 - DNA, 20 bp, Artificial Sequence
  Description of Artificial Sequence: Synthetic oligonucleotide
  Target: ATXN1; (+) strand; PAM type: NRG; PAM sequence: GGG
cacccatagtcccagctact

SEQ ID NO: 100336 - DNA, 20 bp, Artificial Sequence
  Description of Artificial Sequence: Synthetic oligonucleotide
  Target: ATXN1; (+) strand; PAM type: NRG; PAM sequence: GGG
acccatagtcccagctactg

SEQ ID NO: 100337 - DNA, 20 bp, Artificial Sequence
  Description of Artificial Sequence: Synthetic oligonucleotide
  Target: ATXN1; (+) strand; PAM type: NRG; PAM sequence: GAG
ccatagtcccagctactggg

SEQ ID NO: 100338 - DNA, 20 bp, Artificial Sequence
  Description of Artificial Sequence: Synthetic oligonucleotide
  Target: ATXN1; (+) strand; PAM type: NRG; PAM sequence: AGG
catagtcccagctactgggg

SEQ ID NO: 100339 - DNA, 20 bp, Artificial Sequence
  Description of Artificial Sequence: Synthetic oligonucleotide
  Target: ATXN1; (+) strand; PAM type: NRG; PAM sequence: GAG
tcccagctactggggaggct

SEQ ID NO: 100340 - DNA, 20 bp, Artificial Sequence
  Description of Artificial Sequence: Synthetic oligonucleotide
  Target: ATXN1; (+) strand; PAM type: NRG; PAM sequence: AGG
cccagctactggggaggctg

SEQ ID NO: 100341 - DNA, 20 bp, Artificial Sequence
  Description of Artificial Sequence: Synthetic oligonucleotide
  Target: ATXN1; (+) strand; PAM type: NRG; PAM sequence: TGG
agctactggggaggctgagg

SEQ ID NO: 100342 - DNA, 20 bp, Artificial Sequence
  Description of Artificial Sequence: Synthetic oligonucleotide
  Target: ATXN1; (+) strand; PAM type: NRG; PAM sequence: GGG
gctactggggaggctgaggt

SEQ ID NO: 100343 - DNA, 20 bp, Artificial Sequence
  Description of Artificial Sequence: Synthetic oligonucleotide
  Target: ATXN1; (+) strand; PAM type: NRG; PAM sequence: GAG
tactggggaggctgaggtgg

SEQ ID NO: 100344 - DNA, 20 bp, Artificial Sequence
  Description of Artificial Sequence: Synthetic oligonucleotide
  Target: ATXN1; (+) strand; PAM type: NRG; PAM sequence: AGG
actggggaggctgaggtggg

SEQ ID NO: 100345 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggaggatcaatt

SEQ ID NO: 100346 - DNA, 20 bp, Artificial Sequence
  Description of Artificial Sequence: Synthetic oligonucleotide
  Target: ATXN1; (+) strand; PAM type: NRG; PAM sequence: CAG
gtgggaggatcaattgagtc

SEQ ID NO: 100347 - DNA, 20 bp, Artificial Sequence
  Description of Artificial Sequence: Synthetic oligonucleotide
  Target: ATXN1; (+) strand; PAM type: NRG; PAM sequence: AGG
tgggaggatcaattgagtcc

SEQ ID NO: 100348 - DNA, 20 bp, Artificial Sequence
  Description of Artificial Sequence: Synthetic oligonucleotide
  Target: ATXN1; (+) strand; PAM type: NRG; PAM sequence: GAG
ggaggatcaattgagtccag

SEQ ID NO: 100349 - DNA, 20 bp, Artificial Sequence
  Description of Artificial Sequence: Synthetic oligonucleotide
  Target: ATXN1; (+) strand; PAM type: NRG; PAM sequence: AGG
gaggatcaattgagtccagg

SEQ ID NO: 100350 - DNA, 20 bp, Artificial Sequence
  Description of Artificial Sequence: Synthetic oligonucleotide
  Target: ATXN1; (+) strand; PAM type: NRG; PAM sequence: GAG
tcaattgagtccaggaggtt

SEQ ID NO: 100351 - DNA, 20 bp, Artificial Sequence
  Description of Artificial Sequence: Synthetic oligonucleotide
  Target: ATXN1; (+) strand; PAM type: NRG; PAM sequence: AGG
caattgagtccaggaggttg

SEQ ID NO: 100352 - DNA, 20 bp, Artificial Sequence
  Description of Artificial Sequence: Synthetic oligonucleotide
  Target: ATXN1; (+) strand; PAM type: NRG; PAM sequence: CAG
agtccaggaggttgaggctg

SEQ ID NO: 100353 - DNA, 20 bp, Artificial Sequence
  Description of Artificial Sequence: Synthetic oligonucleotide
  Target: ATXN1; (+) strand; PAM type: NRG; PAM sequence: GAG
caggaggttgaggctgcagt

SEQ ID NO: 100354 - DNA, 20 bp, Artificial Sequence
  Description of Artificial Sequence: Synthetic oligonucleotide
  Target: ATXN1; (+) strand; PAM type: NRG; PAM sequence: CAG
atgatcccatcactgcactt

SEQ ID NO: 100355 - DNA, 20 bp, Artificial Sequence
  Description of Artificial Sequence: Synthetic oligonucleotide
  Target: ATXN1; (+) strand; PAM type: NRG; PAM sequence: TGG
cccatcactgcacttcagcc

SEQ ID NO: 100356 - DNA, 20 bp, Artificial Sequence
  Description of Artificial Sequence: Synthetic oligonucleotide
  Target: ATXN1; (+) strand; PAM type: NRG; PAM sequence: GGG
ccatcactgcacttcagcct

SEQ ID NO: 100357 - DNA, 20 bp, Artificial Sequence
  Description of Artificial Sequence: Synthetic oligonucleotide
  Target: ATXN1; (+) strand; PAM type: NRG; PAM sequence: CAG
ctgcacttcagcctgggtga

SEQ ID NO: 100358 - DNA, 20 bp, Artificial Sequence
  Description of Artificial Sequence: Synthetic oligonucleotide
  Target: ATXN1; (+) strand; PAM type: NRG; PAM sequence: AGG
tgcacttcagcctgggtgac

SEQ ID NO: 100359 - DNA, 20 bp, Artificial Sequence
  Description of Artificial Sequence: Synthetic oligonucleotide
  Target: ATXN1; (+) strand; PAM type: NRG; PAM sequence: GGG
gcacttcagcctgggtgaca

SEQ ID NO: 100360 - DNA, 20 bp, Artificial Sequence
  Description of Artificial Sequence: Synthetic oligonucleotide
  Target: ATXN1; (+) strand; PAM type: NRG; PAM sequence: AAG
ttcagcctgggtgacagggc

SEQ ID NO: 100361 - DNA, 20 bp, Artificial Sequence
  Description of Artificial Sequence: Synthetic oligonucleotide
  Target: ATXN1; (+) strand; PAM type: NRG; PAM sequence: AAG
gcaagaccctgtctcaaaac

SEQ ID NO: 100362 - DNA, 20 bp, Artificial Sequence
  Description of Artificial Sequence: Synthetic oligonucleotide
  Target: ATXN1; (+) strand; PAM type: NRG; PAM sequence: CAG
caaacgaacacaaaaaccca

SEQ ID NO: 100363 - DNA, 20 bp, Artificial Sequence
  Description of Artificial Sequence: Synthetic oligonucleotide
  Target: ATXN1; (+) strand; PAM type: NRG; PAM sequence: TGG
aaaaacaaaactcatttgcc

SEQ ID NO: 100364 - DNA, 20 bp, Artificial Sequence
  Description of Artificial Sequence: Synthetic oligonucleotide
  Target: ATXN1; (+) strand; PAM type: NRG; PAM sequence: TAG
caaaactcatttgcctggtt

SEQ ID NO: 100365 - DNA, 20 bp, Artificial Sequence
  Description of Artificial Sequence: Synthetic oligonucleotide
  Target: ATXN1; (+) strand; PAM type: NRG; PAM sequence: GAG
aaactcatttgcctggttta

SEQ ID NO: 100366 - DNA, 20 bp, Artificial Sequence
  Description of Artificial Sequence: Synthetic oligonucleotide
  Target: ATXN1; (+) strand; PAM type: NRG; PAM sequence: GAG
actcatttgcctggtttaga

SEQ ID NO: 100367 - DNA, 20 bp, Artificial Sequence
  Description of Artificial Sequence: Synthetic oligonucleotide
  Target: ATXN1; (+) strand; PAM type: NRG; PAM sequence: AGG
ctcatttgcctggtttagag

SEQ ID NO: 100368 - DNA, 20 bp, Artificial Sequence
  Description of Artificial Sequence: Synthetic oligonucleotide
  Target: ATXN1; (+) strand; PAM type: NRG; PAM sequence: GAG
catttgcctggtttagagag

SEQ ID NO: 100369 - DNA, 20 bp, Artificial Sequence
  Description of Artificial Sequence: Synthetic oligonucleotide
  Target: ATXN1; (+) strand; PAM type: NRG; PAM sequence: GAG
tttgcctggtttagagagga

SEQ ID NO: 100370 - DNA, 20 bp, Artificial Sequence
  Description of Artificial Sequence: Synthetic oligonucleotide
  Target: ATXN1; (+) strand; PAM type: NRG; PAM sequence: CAG
gtttagagaggagagtgctg

SEQ ID NO: 100371 - DNA, 20 bp, Artificial Sequence
  Description of Artificial Sequence: Synthetic oligonucleotide
  Target: ATXN1; (+) strand; PAM type: NRG; PAM sequence: CAG
gagaggagagtgctgcagct

SEQ ID NO: 100372 - DNA, 20 bp, Artificial Sequence
  Description of Artificial Sequence: Synthetic oligonucleotide
  Target: ATXN1; (+) strand; PAM type: NRG; PAM sequence: GAG
gaggagagtgctgcagctca

SEQ ID NO: 100373 - DNA, 20 bp, Artificial Sequence
  Description of Artificial Sequence: Synthetic oligonucleotide
  Target: ATXN1; (+) strand; PAM type: NRG; PAM sequence: GAG
ggagagtgctgcagctcaga

SEQ ID NO: 100374 - DNA, 20 bp, Artificial Sequence
  Description of Artificial Sequence: Synthetic oligonucleotide
  Target: ATXN1; (+) strand; PAM type: NRG; PAM sequence: AGG
gagagtgctgcagctcagag

SEQ ID NO: 100375 - DNA, 20 bp, Artificial Sequence
  Description of Artificial Sequence: Synthetic oligonucleotide
  Target: ATXN1; (+) strand; PAM type: NRG; PAM sequence: AAG
tgctgcagctcagagaggtg

SEQ ID NO: 100376 - DNA, 20 bp, Artificial Sequence
  Description of Artificial Sequence: Synthetic oligonucleotide
  Target: ATXN1; (+) strand; PAM type: NRG; PAM sequence: CAG
ggtgaagtaacttgtcctgc

SEQ ID NO: 100377 - DNA, 20 bp, Artificial Sequence
  Description of Artificial Sequence: Synthetic oligonucleotide
  Target: ATXN1; (+) strand; PAM type: NRG; PAM sequence: GAG
tgaagtaacttgtcctgcca

SEQ ID NO: 100378 - DNA, 20 bp, Artificial Sequence
  Description of Artificial Sequence: Synthetic oligonucleotide
  Target: ATXN1; (+) strand; PAM type: NRG; PAM sequence: TGG
gagacccaaatccgcacccc

SEQ ID NO: 100379 - DNA, 20 bp, Artificial Sequence
  Description of Artificial Sequence: Synthetic oligonucleotide
  Target: ATXN1; (+) strand; PAM type: NRG; PAM sequence: GGG
agacccaaatccgcacccct

SEQ ID NO: 100380 - DNA, 20 bp, Artificial Sequence
  Description of Artificial Sequence: Synthetic oligonucleotide
  Target: ATXN1; (+) strand; PAM type: NRG; PAM sequence: TGG
ctatatcacactgctttccc

SEQ ID NO: 100381 - DNA, 20 bp, Artificial Sequence
  Description of Artificial Sequence: Synthetic oligonucleotide
  Target: ATXN1; (+) strand; PAM type: NRG; PAM sequence: GGG
tatatcacactgctttccct

SEQ ID NO: 100382 - DNA, 20 bp, Artificial Sequence
  Description of Artificial Sequence: Synthetic oligonucleotide
  Target: ATXN1; (+) strand; PAM type: NRG; PAM sequence: GGG
atatcacactgctttccctg

SEQ ID NO: 100383 - DNA, 20 bp, Artificial Sequence
  Description of Artificial Sequence: Synthetic oligonucleotide
  Target: ATXN1; (+) strand; PAM type: NRG; PAM sequence: GGG
tatcacactgctttccctgg

SEQ ID NO: 100384 - DNA, 20 bp, Artificial Sequence
  Description of Artificial Sequence: Synthetic oligonucleotide
  Target: ATXN1; (+) strand; PAM type: NRG; PAM sequence: TGG
tttccctgggggtgtgatgt

SEQ ID NO: 100385 - DNA, 20 bp, Artificial Sequence
  Description of Artificial Sequence: Synthetic oligonucleotide
  Target: ATXN1; (+) strand; PAM type: NRG; PAM sequence: GGG
ttccctgggggtgtgatgtt

SEQ ID NO: 100386 - DNA, 20 bp, Artificial Sequence
  Description of Artificial Sequence: Synthetic oligonucleotide
  Target: ATXN1; (+) strand; PAM type: NRG; PAM sequence: GGG
tccctgggggtgtgatgttg

SEQ ID NO: 100387 - DNA, 20 bp, Artificial Sequence
  Description of Artificial Sequence: Synthetic oligonucleotide
  Target: ATXN1; (+) strand; PAM type: NRG; PAM sequence: GGG
ccctgggggtgtgatgttgg

SEQ ID NO: 100388 - DNA, 20 bp, Artificial Sequence
  Description of Artificial Sequence: Synthetic oligonucleotide
  Target: ATXN1; (+) strand; PAM type: NRG; PAM sequence: GGG
cctgggggtgtgatgttggg

SEQ ID NO: 100389 - DNA, 20 bp, Artificial Sequence
  Description of Artificial Sequence: Synthetic oligonucleotide
  Target: ATXN1; (+) strand; PAM type: NRG; PAM sequence: GGG
ctgggggtgtgatgttgggg

SEQ ID NO: 100390 - DNA, 20 bp, Artificial Sequence
  Description of Artificial Sequence: Synthetic oligonucleotide
  Target: ATXN1; (+) strand; PAM type: NRG; PAM sequence: GAG
tgatgttgggggggtcttat

SEQ ID NO: 100391 - DNA, 20 bp, Artificial Sequence
  Description of Artificial Sequence: Synthetic oligonucleotide
  Target: ATXN1; (+) strand; PAM type: NRG; PAM sequence: CAG
ttgggggggtcttatgagtt

SEQ ID NO: 100392 - DNA, 20 bp, Artificial Sequence
  Description of Artificial Sequence: Synthetic oligonucleotide
  Target: ATXN1; (+) strand; PAM type: NRG; PAM sequence: AGG
tgggggggtcttatgagttc

SEQ ID NO: 100393 - DNA, 20 bp, Artificial Sequence
  Description of Artificial Sequence: Synthetic oligonucleotide
  Target: ATXN1; (+) strand; PAM type: NRG; PAM sequence: AAG
ttatgagttcaggcatcctc

SEQ ID NO: 100394 - DNA, 20 bp, Artificial Sequence
  Description of Artificial Sequence: Synthetic oligonucleotide
  Target: ATXN1; (+) strand; PAM type: NRG; PAM sequence: GAG
atgagttcaggcatcctcaa

SEQ ID NO: 100395 - DNA, 20 bp, Artificial Sequence
  Description of Artificial Sequence: Synthetic oligonucleotide
  Target: ATXN1; (+) strand; PAM type: NRG; PAM sequence: CAG
tcctcaagagtctgttcatg

SEQ ID NO: 100396 - DNA, 20 bp, Artificial Sequence
  Description of Artificial Sequence: Synthetic oligonucleotide
  Target: ATXN1; (+) strand; PAM type: NRG; PAM sequence: AGG
cctcaagagtctgttcatgc

SEQ ID NO: 100397 - DNA, 20 bp, Artificial Sequence
  Description of Artificial Sequence: Synthetic oligonucleotide
  Target: ATXN1; (+) strand; PAM type: NRG; PAM sequence: TAG
gttcatgcaggatttctgcc

SEQ ID NO: 100398 - DNA, 20 bp, Artificial Sequence
  Description of Artificial Sequence: Synthetic oligonucleotide
  Target: ATXN1; (+) strand; PAM type: NRG; PAM sequence: GAG
tcatgcaggatttctgccta

SEQ ID NO: 100399 - DNA, 20 bp, Artificial Sequence
  Description of Artificial Sequence: Synthetic oligonucleotide
  Target: ATXN1; (+) strand; PAM type: NRG; PAM sequence: TGG
agtcacaatgccatctgttt

SEQ ID NO: 100400 - DNA, 20 bp, Artificial Sequence
  Description of Artificial Sequence: Synthetic oligonucleotide
  Target: ATXN1; (+) strand; PAM type: NRG; PAM sequence: GAG
tcacaatgccatctgttttg

SEQ ID NO: 100401 - DNA, 20 bp, Artificial Sequence
  Description of Artificial Sequence: Synthetic oligonucleotide
  Target: ATXN1; (+) strand; PAM type: NRG; PAM sequence: AAG
aatttgtgattttgcttatt

SEQ ID NO: 100402 - DNA, 20 bp, Artificial Sequence
  Description of Artificial Sequence: Synthetic oligonucleotide
  Target: ATXN1; (+) strand; PAM type: NRG; PAM sequence: TGG
cacatttctgaatttctctg

SEQ ID NO: 100403 - DNA, 20 bp, Artificial Sequence
  Description of Artificial Sequence: Synthetic oligonucleotide
  Target: ATXN1; (+) strand; PAM type: NRG; PAM sequence: GGG
acatttctgaatttctctgt

SEQ ID NO: 100404 - DNA, 20 bp, Artificial Sequence
  Description of Artificial Sequence: Synthetic oligonucleotide
  Target: ATXN1; (+) strand; PAM type: NRG; PAM sequence: CAG
tctgaatttctctgtgggtg

SEQ ID NO: 100405 - DNA, 20 bp, Artificial Sequence
  Description of Artificial Sequence: Synthetic oligonucleotide
  Target: ATXN1; (+) strand; PAM type: NRG; PAM sequence: CAG
tttctctgtgggtgcagtgt

SEQ ID NO: 100406 - DNA, 20 bp, Artificial Sequence
  Description of Artificial Sequence: Synthetic oligonucleotide
  Target: ATXN1; (+) strand; PAM type: NRG; PAM sequence: CAG
ctctgtgggtgcagtgtcag

SEQ ID NO: 100407 - DNA, 20 bp, Artificial Sequence
  Description of Artificial Sequence: Synthetic oligonucleotide
  Target: ATXN1; (+) strand; PAM type: NRG; PAM sequence: CAG
cagtgtcagcagtgcctaac

SEQ ID NO: 100408 - DNA, 20 bp, Artificial Sequence
  Description of Artificial Sequence: Synthetic oligonucleotide
  Target: ATXN1; (+) strand; PAM type: NRG; PAM sequence: GAG
tcagcagtgcctaaccagtt

SEQ ID NO: 100409 - DNA, 20 bp, Artificial Sequence
  Description of Artificial Sequence: Synthetic oligonucleotide
  Target: ATXN1; (+) strand; PAM type: NRG; PAM sequence: AAG
gcagtgcctaaccagttgag

SEQ ID NO: 100410 - DNA, 20 bp, Artificial Sequence
  Description of Artificial Sequence: Synthetic oligonucleotide
  Target: ATXN1; (+) strand; PAM type: NRG; PAM sequence: CAG
gcctaaccagttgagaagac

SEQ ID NO: 100411 - DNA, 20 bp, Artificial Sequence
  Description of Artificial Sequence: Synthetic oligonucleotide
  Target: ATXN1; (+) strand; PAM type: NRG; PAM sequence: AGG
cctaaccagttgagaagacc

SEQ ID NO: 100412 - DNA, 20 bp, Artificial Sequence
  Description of Artificial Sequence: Synthetic oligonucleotide
  Target: ATXN1; (+) strand; PAM type: NRG; PAM sequence: AAG
aaccagttgagaagaccagg

SEQ ID NO: 100413 - DNA, 20 bp, Artificial Sequence
  Description of Artificial Sequence: Synthetic oligonucleotide
  Target: ATXN1; (+) strand; PAM type: NRG; PAM sequence: CAG
agaagaccaggaagattctt

SEQ ID NO: 100414 - DNA, 20 bp, Artificial Sequence
  Description of Artificial Sequence: Synthetic oligonucleotide
  Target: ATXN1; (+) strand; PAM type: NRG; PAM sequence: AGG
gaagaccaggaagattcttc

SEQ ID NO: 100415 - DNA, 20 bp, Artificial Sequence
  Description of Artificial Sequence: Synthetic oligonucleotide
  Target: ATXN1; (+) strand; PAM type: NRG; PAM sequence: TAG
accaggaagattcttcaggc

SEQ ID NO: 100416 - DNA, 20 bp, Artificial Sequence
  Description of Artificial Sequence: Synthetic oligonucleotide
  Target: ATXN1; (+) strand; PAM type: NRG; PAM sequence: AGG
ccaggaagattcttcaggct

SEQ ID NO: 100417 - DNA, 20 bp, Artificial Sequence
  Description of Artificial Sequence: Synthetic oligonucleotide
  Target: ATXN1; (+) strand; PAM type: NRG; PAM sequence: GGG
caggaagattcttcaggcta

SEQ ID NO: 100418 - DNA, 20 bp, Artificial Sequence
  Description of Artificial Sequence: Synthetic oligonucleotide
  Target: ATXN1; (+) strand; PAM type: NRG; PAM sequence: GGG
aggaagattcttcaggctag

SEQ ID NO: 100419 - DNA, 20 bp, Artificial Sequence
  Description of Artificial Sequence: Synthetic oligonucleotide
  Target: ATXN1; (+) strand; PAM type: NRG; PAM sequence: GAG
gaagattcttcaggctaggg

SEQ ID NO: 100420 - DNA, 20 bp, Artificial Sequence
  Description of Artificial Sequence: Synthetic oligonucleotide
  Target: ATXN1; (+) strand; PAM type: NRG; PAM sequence: CAG
ggctaggggagaaaacccct

SEQ ID NO: 100421 - DNA, 20 bp, Artificial Sequence
  Description of Artificial Sequence: Synthetic oligonucleotide
  Target: ATXN1; (+) strand; PAM type: NRG; PAM sequence: AGG
gctaggggagaaaacccctc

SEQ ID NO: 100422 - DNA, 20 bp, Artificial Sequence
  Description of Artificial Sequence: Synthetic oligonucleotide
  Target: ATXN1; (+) strand; PAM type: NRG; PAM sequence: AAG
aggggagaaaacccctcagg

SEQ ID NO: 100423 - DNA, 20 bp, Artificial Sequence
  Description of Artificial Sequence: Synthetic oligonucleotide
  Target: ATXN1; (+) strand; PAM type: NRG; PAM sequence: AGG
ggggagaaaacccctcagga

SEQ ID NO: 100424 - DNA, 20 bp, Artificial Sequence
  Description of Artificial Sequence: Synthetic oligonucleotide
  Target: ATXN1; (+) strand; PAM type: NRG; PAM sequence: CAG
aacccctcaggaaggcactg

SEQ ID NO: 100425 - DNA, 20 bp, Artificial Sequence
  Description of Artificial Sequence: Synthetic oligonucleotide
  Target: ATXN1; (+) strand; PAM type: NRG; PAM sequence: GAG
cccctcaggaaggcactgca

SEQ ID NO: 100426 - DNA, 20 bp, Artificial Sequence
  Description of Artificial Sequence: Synthetic oligonucleotide
  Target: ATXN1; (+) strand; PAM type: NRG; PAM sequence: AGG
ccctcaggaaggcactgcag

SEQ ID NO: 100427 - DNA, 20 bp, Artificial Sequence
  Description of Artificial Sequence: Synthetic oligonucleotide
  Target: ATXN1; (+) strand; PAM type: NRG; PAM sequence: GGG
cctcaggaaggcactgcaga

SEQ ID NO: 100428 - DNA, 20 bp, Artificial Sequence
  Description of Artificial Sequence: Synthetic oligonucleotide
  Target: ATXN1; (+) strand; PAM type: NRG; PAM sequence: GGG
ctcaggaaggcactgcagag

SEQ ID NO: 100429 - DNA, 20 bp, Artificial Sequence
  Description of Artificial Sequence: Synthetic oligonucleotide
  Target: ATXN1; (+) strand; PAM type: NRG; PAM sequence: GAG
caggaaggcactgcagaggg

SEQ ID NO: 100430 - DNA, 20 bp, Artificial Sequence
  Description of Artificial Sequence: Synthetic oligonucleotide
  Target: ATXN1; (+) strand; PAM type: NRG; PAM sequence: AAG
gaaggcactgcagaggggag

SEQ ID NO: 100431 - DNA, 20 bp, Artificial Sequence
  Description of Artificial Sequence: Synthetic oligonucleotide
  Target: ATXN1; (+) strand; PAM type: NRG; PAM sequence: AGG
aaggcactgcagaggggaga

SEQ ID NO: 100432 - DNA, 20 bp, Artificial Sequence
  Description of Artificial Sequence: Synthetic oligonucleotide
  Target: ATXN1; (+) strand; PAM type: NRG; PAM sequence: TAG
ctgcagaggggagaaggatg

SEQ ID NO: 100433 - DNA, 20 bp, Artificial Sequence
  Description of Artificial Sequence: Synthetic oligonucleotide
  Target: ATXN1; (+) strand; PAM type: NRG; PAM sequence: TGG
ggggagaaggatgtagcctt

SEQ ID NO: 100434 - DNA, 20 bp, Artificial Sequence
  Description of Artificial Sequence: Synthetic oligonucleotide
  Target: ATXN1; (+) strand; PAM type: NRG; PAM sequence: AAG
tagcctttggaacctcaatt

SEQ ID NO: 100435 - DNA, 20 bp, Artificial Sequence
  Description of Artificial Sequence: Synthetic oligonucleotide
  Target: ATXN1; (+) strand; PAM type: NRG; PAM sequence: CAG
tttggaacctcaattaagtc

SEQ ID NO: 100436 - DNA, 20 bp, Artificial Sequence
  Description of Artificial Sequence: Synthetic oligonucleotide
  Target: ATXN1; (+) strand; PAM type: NRG; PAM sequence: GAG
cctcaattaagtccagatat

SEQ ID NO: 100437 - DNA, 20 bp, Artificial Sequence
  Description of Artificial Sequence: Synthetic oligonucleotide
  Target: ATXN1; (+) strand; PAM type: NRG; PAM sequence: GAG
ccctctcatgctctctgtct

SEQ ID NO: 100438 - DNA, 20 bp, Artificial Sequence
  Description of Artificial Sequence: Synthetic oligonucleotide
  Target: ATXN1; (+) strand; PAM type: NRG; PAM sequence: TGG
gactctgaacctgtcacttg

SEQ ID NO: 100439 - DNA, 20 bp, Artificial Sequence
  Description of Artificial Sequence: Synthetic oligonucleotide
  Target: ATXN1; (+) strand; PAM type: NRG; PAM sequence: CAG
cctgtcacttgtggcaaaca

SEQ ID NO: 100440 - DNA, 20 bp, Artificial Sequence
  Description of Artificial Sequence: Synthetic oligonucleotide
  Target: ATXN1; (+) strand; PAM type: NRG; PAM sequence: TGG
tcacttgtggcaaacacagc

SEQ ID NO: 100441 - DNA, 20 bp, Artificial Sequence
  Description of Artificial Sequence: Synthetic oligonucleotide
  Target: ATXN1; (+) strand; PAM type: NRG; PAM sequence: TGG
cttgtggcaaacacagctgg

SEQ ID NO: 100442 - DNA, 20 bp, Artificial Sequence
  Description of Artificial Sequence: Synthetic oligonucleotide
  Target: ATXN1; (+) strand; PAM type: NRG; PAM sequence: GAG
tgtggcaaacacagctggtg

SEQ ID NO: 100443 - DNA, 20 bp, Artificial Sequence
  Description of Artificial Sequence: Synthetic oligonucleotide
  Target: ATXN1; (+) strand; PAM type: NRG; PAM sequence: TAG
acacagctggtggagtattt

SEQ ID NO: 100444 - DNA, 20 bp, Artificial Sequence
  Description of Artificial Sequence: Synthetic oligonucleotide
  Target: ATXN1; (+) strand; PAM type: NRG; PAM sequence: CAG
tattttagctgtgatgatgt

SEQ ID NO: 100445 - DNA, 20 bp, Artificial Sequence
  Description of Artificial Sequence: Synthetic oligonucleotide
  Target: ATXN1; (+) strand; PAM type: NRG; PAM sequence: TAG
tgatgtcagccgatttctga

SEQ ID NO: 100446 - DNA, 20 bp, Artificial Sequence
  Description of Artificial Sequence: Synthetic oligonucleotide
  Target: ATXN1; (+) strand; PAM type: NRG; PAM sequence: AGG
gatgtcagccgatttctgat

SEQ ID NO: 100447 - DNA, 20 bp, Artificial Sequence
  Description of Artificial Sequence: Synthetic oligonucleotide
  Target: ATXN1; (+) strand; PAM type: NRG; PAM sequence: CGG
ccgatttctgataggctcct

SEQ ID NO: 100448 - DNA, 20 bp, Artificial Sequence
  Description of Artificial Sequence: Synthetic oligonucleotide
  Target: ATXN1; (+) strand; PAM type: NRG; PAM sequence: AAG
ttctgataggctcctcggta

SEQ ID NO: 100449 - DNA, 20 bp, Artificial Sequence
  Description of Artificial Sequence: Synthetic oligonucleotide
  Target: ATXN1; (+) strand; PAM type: NRG; PAM sequence: TGG
tcggtaaagtgacaaatcat

SEQ ID NO: 100450 - DNA, 20 bp, Artificial Sequence
  Description of Artificial Sequence: Synthetic oligonucleotide
  Target: ATXN1; (+) strand; PAM type: NRG; PAM sequence: CAG
tgacaaatcattggttgcgt

SEQ ID NO: 100451 - DNA, 20 bp, Artificial Sequence
  Description of Artificial Sequence: Synthetic oligonucleotide
  Target: ATXN1; (+) strand; PAM type: NRG; PAM sequence: AGG
gacaaatcattggttgcgtc

SEQ ID NO: 100452 - DNA, 20 bp, Artificial Sequence
  Description of Artificial Sequence: Synthetic oligonucleotide
  Target: ATXN1; (+) strand; PAM type: NRG; PAM sequence: CAG
gccttgcacttttgtttcta

SEQ ID NO: 100453 - DNA, 20 bp, Artificial Sequence
  Description of Artificial Sequence: Synthetic oligonucleotide
  Target: ATXN1; (+) strand; PAM type: NRG; PAM sequence: AAG
acttttgtttctacagcgtg

SEQ ID NO: 100454 - DNA, 20 bp, Artificial Sequence
  Description of Artificial Sequence: Synthetic oligonucleotide
  Target: ATXN1; (+) strand; PAM type: NRG; PAM sequence: TAG
gtttctacagcgtgaagccc

SEQ ID NO: 100455 - DNA, 20 bp, Artificial Sequence
  Description of Artificial Sequence: Synthetic oligonucleotide
  Target: ATXN1; (+) strand; PAM type: NRG; PAM sequence: CAG
tgaagccctagctgcctttt

SEQ ID NO: 100456 - DNA, 20 bp, Artificial Sequence
  Description of Artificial Sequence: Synthetic oligonucleotide
  Target: ATXN1; (+) strand; PAM type: NRG; PAM sequence: CAG
agccctagctgccttttcag

SEQ ID NO: 100457 - DNA, 20 bp, Artificial Sequence
  Description of Artificial Sequence: Synthetic oligonucleotide
  Target: ATXN1; (+) strand; PAM type: NRG; PAM sequence: AGG
gccctagctgccttttcagc

SEQ ID NO: 100458 - DNA, 20 bp, Artificial Sequence
  Description of Artificial Sequence: Synthetic oligonucleotide
  Target: ATXN1; (+) strand; PAM type: NRG; PAM sequence: CAG
gctgccttttcagcaggtct

SEQ ID NO: 100459 - DNA, 20 bp, Artificial Sequence
  Description of Artificial Sequence: Synthetic oligonucleotide
  Target: ATXN1; (+) strand; PAM type: NRG; PAM sequence: GAG
cagcacacttgcctttcttt

SEQ ID NO: 100460 - DNA, 20 bp, Artificial Sequence
  Description of Artificial Sequence: Synthetic oligonucleotide
  Target: ATXN1; (+) strand; PAM type: NRG; PAM sequence: AGG
agcacacttgcctttctttg

SEQ ID NO: 100461 - DNA, 20 bp, Artificial Sequence
  Description of Artificial Sequence: Synthetic oligonucleotide
  Target: ATXN1; (+) strand; PAM type: NRG; PAM sequence: AAG
acacttgcctttctttgagg

SEQ ID NO: 100462 - DNA, 20 bp, Artificial Sequence
  Description of Artificial Sequence: Synthetic oligonucleotide
  Target: ATXN1; (+) strand; PAM type: NRG; PAM sequence: CGG
ttctttgaggaagcccttcc

SEQ ID NO: 100463 - DNA, 20 bp, Artificial Sequence
  Description of Artificial Sequence: Synthetic oligonucleotide
  Target: ATXN1; (+) strand; PAM type: NRG; PAM sequence: CAG
aggaagcccttcccggcatg

SEQ ID NO: 100464 - DNA, 20 bp, Artificial Sequence
  Description of Artificial Sequence: Synthetic oligonucleotide
  Target: ATXN1; (+) strand; PAM type: NRG; PAM sequence: TAG
gcccttcccggcatgcagca

SEQ ID NO: 100465 - DNA, 20 bp, Artificial Sequence
  Description of Artificial Sequence: Synthetic oligonucleotide
  Target: ATXN1; (+) strand; PAM type: NRG; PAM sequence: CGG
cggcatgcagcatagccacg

SEQ ID NO: 100466 - DNA, 20 bp, Artificial Sequence
  Description of Artificial Sequence: Synthetic oligonucleotide
  Target: ATXN1; (+) strand; PAM type: NRG; PAM sequence: GGG
ggcatgcagcatagccacgc

SEQ ID NO: 100467 - DNA, 20 bp, Artificial Sequence
  Description of Artificial Sequence: Synthetic oligonucleotide
  Target: ATXN1; (+) strand; PAM type: NRG; PAM sequence: GGG
gcatgcagcatagccacgcg

SEQ ID NO: 100468 - DNA, 20 bp, Artificial Sequence
  Description of Artificial Sequence: Synthetic oligonucleotide
  Target: ATXN1; (+) strand; PAM type: NRG; PAM sequence: GGG
catgcagcatagccacgcgg

SEQ ID NO: 100469 - DNA, 20 bp, Artificial Sequence
  Description of Artificial Sequence: Synthetic oligonucleotide
  Target: ATXN1; (+) strand; PAM type: NRG; PAM sequence: CAG
ccacgcgggggccaacctca

SEQ ID NO: 100470 - DNA, 20 bp, Artificial Sequence
  Description of Artificial Sequence: Synthetic oligonucleotide
  Target: ATXN1; (+) strand; PAM type: NRG; PAM sequence: CAG
caacctcacagacctgccaa

SEQ ID NO: 100471 - DNA, 20 bp, Artificial Sequence
  Description of Artificial Sequence: Synthetic oligonucleotide
  Target: ATXN1; (+) strand; PAM type: NRG; PAM sequence: AGG
aacctcacagacctgccaac

SEQ ID NO: 100472 - DNA, 20 bp, Artificial Sequence
  Description of Artificial Sequence: Synthetic oligonucleotide
  Target: ATXN1; (+) strand; PAM type: NRG; PAM sequence: TGG
ctacctgctcgtctgcaccc

SEQ ID NO: 100473 - DNA, 20 bp, Artificial Sequence
  Description of Artificial Sequence: Synthetic oligonucleotide
  Target: ATXN1; (+) strand; PAM type: NRG; PAM sequence: CAG
ctcgtctgcaccctggctgt

SEQ ID NO: 100474 - DNA, 20 bp, Artificial Sequence
  Description of Artificial Sequence: Synthetic oligonucleotide
  Target: ATXN1; (+) strand; PAM type: NRG; PAM sequence: TAG
gtctgcaccctggctgtcag

SEQ ID NO: 100475 - DNA, 20 bp, Artificial Sequence
  Description of Artificial Sequence: Synthetic oligonucleotide
  Target: ATXN1; (+) strand; PAM type: NRG; PAM sequence: GAG
ctgcaccctggctgtcagta

SEQ ID NO: 100476 - DNA, 20 bp, Artificial Sequence
  Description of Artificial Sequence: Synthetic oligonucleotide
  Target: ATXN1; (+) strand; PAM type: NRG; PAM sequence: GAG
gcaccctggctgtcagtaga

SEQ ID NO: 100477 - DNA, 20 bp, Artificial Sequence
  Description of Artificial Sequence: Synthetic oligonucleotide
  Target: ATXN1; (+) strand; PAM type: NRG; PAM sequence: TAG
tggctgtcagtagagagatt

SEQ ID NO: 100478 - DNA, 20 bp, Artificial Sequence
  Description of Artificial Sequence: Synthetic oligonucleotide
  Target: ATXN1; (+) strand; PAM type: NRG; PAM sequence: TGG
gagatttagtgatctcacta

SEQ ID NO: 100479 - DNA, 20 bp, Artificial Sequence
  Description of Artificial Sequence: Synthetic oligonucleotide
  Target: ATXN1; (+) strand; PAM type: NRG; PAM sequence: GGG
agatttagtgatctcactat

SEQ ID NO: 100480 - DNA, 20 bp, Artificial Sequence
  Description of Artificial Sequence: Synthetic oligonucleotide
  Target: ATXN1; (+) strand; PAM type: NRG; PAM sequence: GAG
ctcactatgggaaaaaacat

SEQ ID NO: 100481 - DNA, 20 bp, Artificial Sequence
  Description of Artificial Sequence: Synthetic oligonucleotide
  Target: ATXN1; (+) strand; PAM type: NRG; PAM sequence: CAG
tatgggaaaaaacatgagaa

SEQ ID NO: 100482 - DNA, 20 bp, Artificial Sequence
  Description of Artificial Sequence: Synthetic oligonucleotide
  Target: ATXN1; (+) strand; PAM type: NRG; PAM sequence: AGG
atgggaaaaaacatgagaac

SEQ ID NO: 100483 - DNA, 20 bp, Artificial Sequence
  Description of Artificial Sequence: Synthetic oligonucleotide
  Target: ATXN1; (+) strand; PAM type: NRG; PAM sequence: GGG
tgggaaaaaacatgagaaca

SEQ ID NO: 100484 - DNA, 20 bp, Artificial Sequence
  Description of Artificial Sequence: Synthetic oligonucleotide
  Target: ATXN1; (+) strand; PAM type: NRG; PAM sequence: CAG
agaacagggctctgacttca

SEQ ID NO: 100485 - DNA, 20 bp, Artificial Sequence
  Description of Artificial Sequence: Synthetic oligonucleotide
  Target: ATXN1; (+) strand; PAM type: NRG; PAM sequence: AGG
gaacagggctctgacttcac

SEQ ID NO: 100486 - DNA, 20 bp, Artificial Sequence
  Description of Artificial Sequence: Synthetic oligonucleotide
  Target: ATXN1; (+) strand; PAM type: NRG; PAM sequence: GGG
aacagggctctgacttcaca

SEQ ID NO: 100487 - DNA, 20 bp, Artificial Sequence
  Description of Artificial Sequence: Synthetic oligonucleotide
  Target: ATXN1; (+) strand; PAM type: NRG; PAM sequence: AAG
agggctctgacttcacaggg

SEQ ID NO: 100488 - DNA, 20 bp, Artificial Sequence
  Description of Artificial Sequence: Synthetic oligonucleotide
  Target: ATXN1; (+) strand; PAM type: NRG; PAM sequence: AAG
atttaatcattaattttgca

SEQ ID NO: 100489 - DNA, 20 bp, Artificial Sequence
  Description of Artificial Sequence: Synthetic oligonucleotide
  Target: ATXN1; (+) strand; PAM type: NRG; PAM sequence: TGG
atcattaattttgcaaagtt

SEQ ID NO: 100490 - DNA, 20 bp, Artificial Sequence
  Description of Artificial Sequence: Synthetic oligonucleotide
  Target: ATXN1; (+) strand; PAM type: NRG; PAM sequence: GAG
cattaattttgcaaagtttg

SEQ ID NO: 100491 - DNA, 20 bp, Artificial Sequence
  Description of Artificial Sequence: Synthetic oligonucleotide
  Target: ATXN1; (+) strand; PAM type: NRG; PAM sequence: TAG
taattttgcaaagtttggag

SEQ ID NO: 100492 - DNA, 20 bp, Artificial Sequence
  Description of Artificial Sequence: Synthetic oligonucleotide
  Target: ATXN1; (+) strand; PAM type: NRG; PAM sequence: AGG
aattttgcaaagtttggagt

SEQ ID NO: 100493 - DNA, 20 bp, Artificial Sequence
  Description of Artificial Sequence: Synthetic oligonucleotide
  Target: ATXN1; (+) strand; PAM type: NRG; PAM sequence: GGG
attttgcaaagtttggagta

SEQ ID NO: 100494 - DNA, 20 bp, Artificial Sequence
  Description of Artificial Sequence: Synthetic oligonucleotide
  Target: ATXN1; (+) strand; PAM type: NRG; PAM sequence: TAG
ggagtagggaaaaacacacc

SEQ ID NO: 100495 - DNA, 20 bp, Artificial Sequence
  Description of Artificial Sequence: Synthetic oligonucleotide
  Target: ATXN1; (+) strand; PAM type: NRG; PAM sequence: AAG
acacctagatcttcctcccc

SEQ ID NO: 100496 - DNA, 20 bp, Artificial Sequence
  Description of Artificial Sequence: Synthetic oligonucleotide
  Target: ATXN1; (+) strand; PAM type: NRG; PAM sequence: CAG
tagatcttcctccccaagaa

SEQ ID NO: 100497 - DNA, 20 bp, Artificial Sequence
  Description of Artificial Sequence: Synthetic oligonucleotide
  Target: ATXN1; (+) strand; PAM type: NRG; PAM sequence: AAG
atcttcctccccaagaacag

SEQ ID NO: 100498 - DNA, 20 bp, Artificial Sequence
  Description of Artificial Sequence: Synthetic oligonucleotide
  Target: ATXN1; (+) strand; PAM type: NRG; PAM sequence: GAG
cttcctccccaagaacagaa

SEQ ID NO: 100499 - DNA, 20 bp, Artificial Sequence
  Description of Artificial Sequence: Synthetic oligonucleotide
  Target: ATXN1; (+) strand; PAM type: NRG; PAM sequence: AGG
ttcctccccaagaacagaag

SEQ ID NO: 100500 - DNA, 20 bp, Artificial Sequence
  Description of Artificial Sequence: Synthetic oligonucleotide
  Target: ATXN1; (+) strand; PAM type: NRG; PAM sequence: GGG
tcctccccaagaacagaaga

SEQ ID NO: 100501 - DNA, 20 bp, Artificial Sequence
  Description of Artificial Sequence: Synthetic oligonucleotide
  Target: ATXN1; (+) strand; PAM type: NRG; PAM sequence: AAG
caagaacagaagagggctgt

SEQ ID NO: 100502 - DNA, 20 bp, Artificial Sequence
  Description of Artificial Sequence: Synthetic oligonucleotide
  Target: ATXN1; (+) strand; PAM type: NRG; PAM sequence: AGG
aagaacagaagagggctgta

SEQ ID NO: 100503 - DNA, 20 bp, Artificial Sequence
  Description of Artificial Sequence: Synthetic oligonucleotide
  Target: ATXN1; (+) strand; PAM type: NRG; PAM sequence: GGG
agaacagaagagggctgtaa

SEQ ID NO: 100504 - DNA, 20 bp, Artificial Sequence
  Description of Artificial Sequence: Synthetic oligonucleotide
  Target: ATXN1; (+) strand; PAM type: NRG; PAM sequence: GGG
gaacagaagagggctgtaag

SEQ ID NO: 100505 - DNA, 20 bp, Artificial Sequence
  Description of Artificial Sequence: Synthetic oligonucleotide
  Target: ATXN1; (+) strand; PAM type: NRG; PAM sequence: TGG
agaagagggctgtaaggggc

SEQ ID NO: 100506 - DNA, 20 bp, Artificial Sequence
  Description of Artificial Sequence: Synthetic oligonucleotide
  Target: ATXN1; (+) strand; PAM type: NRG; PAM sequence: GGG
gaagagggctgtaaggggct

SEQ ID NO: 100507 - DNA, 20 bp, Artificial Sequence
  Description of Artificial Sequence: Synthetic oligonucleotide
  Target: ATXN1; (+) strand; PAM type: NRG; PAM sequence: CAG
gggctgtaaggggctgggcg

SEQ ID NO: 100508 - DNA, 20 bp, Artificial Sequence
  Description of Artificial Sequence: Synthetic oligonucleotide
  Target: ATXN1; (+) strand; PAM type: NRG; PAM sequence: TGG
ctgtaaggggctgggcgcag

SEQ ID NO: 100509 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctacaatcc

SEQ ID NO: 100510 - DNA, 20 bp, Artificial Sequence
  Description of Artificial Sequence: Synthetic oligonucleotide
  Target: ATXN1; (+) strand; PAM type: NRG; PAM sequence: TAG
cacgcctacaatcccagctt

SEQ ID NO: 100511 - DNA, 20 bp, Artificial Sequence
  Description of Artificial Sequence: Synthetic oligonucleotide
  Target: ATXN1; (+) strand; PAM type: NRG; PAM sequence: AGG
acgcctacaatcccagcttt

SEQ ID NO: 100512 - DNA, 20 bp, Artificial Sequence
  Description of Artificial Sequence: Synthetic oligonucleotide
  Target: ATXN1; (+) strand; PAM type: NRG; PAM sequence: GAG
gcctacaatcccagctttag

SEQ ID NO: 100513 - DNA, 20 bp, Artificial Sequence
  Description of Artificial Sequence: Synthetic oligonucleotide
  Target: ATXN1; (+) strand; PAM type: NRG; PAM sequence: AGG
cctacaatcccagctttagg

SEQ ID NO: 100514 - DNA, 20 bp, Artificial Sequence
  Description of Artificial Sequence: Synthetic oligonucleotide
  Target: ATXN1; (+) strand; PAM type: NRG; PAM sequence: GAG
aatcccagctttaggaggct

SEQ ID NO: 100515 - DNA, 20 bp, Artificial Sequence
  Description of Artificial Sequence: Synthetic oligonucleotide
  Target: ATXN1; (+) strand; PAM type: NRG; PAM sequence: AGG
atcccagctttaggaggctg

SEQ ID NO: 100516 - DNA, 20 bp, Artificial Sequence
  Description of Artificial Sequence: Synthetic oligonucleotide
  Target: ATXN1; (+) strand; PAM type: NRG; PAM sequence: CGG
ccagctttaggaggctgagg

SEQ ID NO: 100517 - DNA, 20 bp, Artificial Sequence
  Description of Artificial Sequence: Synthetic oligonucleotide
  Target: ATXN1; (+) strand; PAM type: NRG; PAM sequence: GGG
cagctttaggaggctgaggc

SEQ ID NO: 100518 - DNA, 20 bp, Artificial Sequence
  Description of Artificial Sequence: Synthetic oligonucleotide
  Target: ATXN1; (+) strand; PAM type: NRG; PAM sequence: GAG
ctgaggcgggtgaatcacct

SEQ ID NO: 100519 - DNA, 20 bp, Artificial Sequence
  Description of Artificial Sequence: Synthetic oligonucleotide
  Target: ATXN1; (+) strand; PAM type: NRG; PAM sequence: AGG
tgaggcgggtgaatcacctg

SEQ ID NO: 100520 - DNA, 20 bp, Artificial Sequence
  Description of Artificial Sequence: Synthetic oligonucleotide
  Target: ATXN1; (+) strand; PAM type: NRG; PAM sequence: CAG
gcgggtgaatcacctgaggt

SEQ ID NO: 100521 - DNA, 20 bp, Artificial Sequence
  Description of Artificial Sequence: Synthetic oligonucleotide
  Target: ATXN1; (+) strand; PAM type: NRG; PAM sequence: AGG
cgggtgaatcacctgaggtc

SEQ ID NO: 100522 - DNA, 20 bp, Artificial Sequence
  Description of Artificial Sequence: Synthetic oligonucleotide
  Target: ATXN1; (+) strand; PAM type: NRG; PAM sequence: GAG
ggtgaatcacctgaggtcag

SEQ ID NO: 100523 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttc

SEQ ID NO: 100524 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 100525 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccagcc

SEQ ID NO: 100526 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctggccaaca

SEQ ID NO: 100527 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 100528 - DNA, 20 bp, Artificial Sequence
  Description of Artificial Sequence: Synthetic oligonucleotide
  Target: ATXN1; (+) strand; PAM type: NRG; PAM sequence: CAG
actaaaaatacaaaaattag

SEQ ID NO: 100529 - DNA, 20 bp, Artificial Sequence
  Description of Artificial Sequence: Synthetic oligonucleotide
  Target: ATXN1; (+) strand; PAM type: NRG; PAM sequence: AGG
ctaaaaatacaaaaattagc

SEQ ID NO: 100530 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagca

SEQ ID NO: 100531 - DNA, 20 bp, Artificial Sequence
  Description of Artificial Sequence: Synthetic oligonucleotide
  Target: ATXN1; (+) strand; PAM type: NRG; PAM sequence: GGG
aaaaatacaaaaattagcag

SEQ ID NO: 100532 - DNA, 20 bp, Artificial Sequence
  Description of Artificial Sequence: Synthetic oligonucleotide
  Target: ATXN1; (+) strand; PAM type: NRG; PAM sequence: GGG
aaaatacaaaaattagcagg

SEQ ID NO: 100533 - DNA, 20 bp, Artificial Sequence
  Description of Artificial Sequence: Synthetic oligonucleotide
  Target: ATXN1; (+) strand; PAM type: NRG; PAM sequence: TGG
caaaaattagcagggggtga

SEQ ID NO: 100534 - DNA, 20 bp, Artificial Sequence
  Description of Artificial Sequence: Synthetic oligonucleotide
  Target: ATXN1; (+) strand; PAM type: NRG; PAM sequence: TAG
ggggtgatggcgtgtgcctg

SEQ ID NO: 100535 - DNA, 20 bp, Artificial Sequence
  Description of Artificial Sequence: Synthetic oligonucleotide
  Target: ATXN1; (+) strand; PAM type: NRG; PAM sequence: CGG
atggcgtgtgcctgtagtct

SEQ ID NO: 100536 - DNA, 20 bp, Artificial Sequence
  Description of Artificial Sequence: Synthetic oligonucleotide
  Target: ATXN1; (+) strand; PAM type: NRG; PAM sequence: TGG
tgcctgtagtctcggctact

SEQ ID NO: 100537 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtctcggctactt

SEQ ID NO: 100538 - DNA, 20 bp, Artificial Sequence
  Description of Artificial Sequence: Synthetic oligonucleotide
  Target: ATXN1; (+) strand; PAM type: NRG; PAM sequence: GAG
ctgtagtctcggctacttgg

SEQ ID NO: 100539 - DNA, 20 bp, Artificial Sequence
  Description of Artificial Sequence: Synthetic oligonucleotide
  Target: ATXN1; (+) strand; PAM type: NRG; PAM sequence: AGG
tgtagtctcggctacttggg

SEQ ID NO: 100540 - DNA, 20 bp, Artificial Sequence
  Description of Artificial Sequence: Synthetic oligonucleotide
  Target: ATXN1; (+) strand; PAM type: NRG; PAM sequence: GAG
tctcggctacttgggaggct

SEQ ID NO: 100541 - DNA, 20 bp, Artificial Sequence
  Description of Artificial Sequence: Synthetic oligonucleotide
  Target: ATXN1; (+) strand; PAM type: NRG; PAM sequence: AGG
ctcggctacttgggaggctg

SEQ ID NO: 100542 - DNA, 20 bp, Artificial Sequence
  Description of Artificial Sequence: Synthetic oligonucleotide
  Target: ATXN1; (+) strand; PAM type: NRG; PAM sequence: CAG
ggctacttgggaggctgagg

SEQ ID NO: 100543 - DNA, 20 bp, Artificial Sequence
  Description of Artificial Sequence: Synthetic oligonucleotide
  Target: ATXN1; (+) strand; PAM type: NRG; PAM sequence: AAG
tacttgggaggctgaggcag

SEQ ID NO: 100544 - DNA, 20 bp, Artificial Sequence
  Description of Artificial Sequence: Synthetic oligonucleotide
  Target: ATXN1; (+) strand; PAM type: NRG; PAM sequence: AAG
gcagaagaatcacttgaacc

SEQ ID NO: 100545 - DNA, 20 bp, Artificial Sequence
  Description of Artificial Sequence: Synthetic oligonucleotide
  Target: ATXN1; (+) strand; PAM type: NRG; PAM sequence: GAG
agaagaatcacttgaaccaa

SEQ ID NO: 100546 - DNA, 20 bp, Artificial Sequence
  Description of Artificial Sequence: Synthetic oligonucleotide
  Target: ATXN1; (+) strand; PAM type: NRG; PAM sequence: AGG
gaagaatcacttgaaccaag

SEQ ID NO: 100547 - DNA, 20 bp, Artificial Sequence
  Description of Artificial Sequence: Synthetic oligonucleotide
  Target: ATXN1; (+) strand; PAM type: NRG; PAM sequence: CAG
gaatcacttgaaccaagagg

SEQ ID NO: 100548 - DNA, 20 bp, Artificial Sequence
  Description of Artificial Sequence: Synthetic oligonucleotide
  Target: ATXN1; (+) strand; PAM type: NRG; PAM sequence: CAG
gaaccaagaggcagatgttg

SEQ ID NO: 100549 - DNA, 20 bp, Artificial Sequence
  Description of Artificial Sequence: Synthetic oligonucleotide
  Target: ATXN1; (+) strand; PAM type: NRG; PAM sequence: GAG
caagaggcagatgttgcagt

SEQ ID NO: 100550 - DNA, 20 bp, Artificial Sequence
  Description of Artificial Sequence: Synthetic oligonucleotide
  Target: ATXN1; (+) strand; PAM type: NRG; PAM sequence: AAG
ggcagatgttgcagtgagcc

SEQ ID NO: 100551 - DNA, 20 bp, Artificial Sequence
  Description of Artificial Sequence: Synthetic oligonucleotide
  Target: ATXN1; (+) strand; PAM type: NRG; PAM sequence: CAG
ccccactgcactctgcactc

SEQ ID NO: 100552 - DNA, 20 bp, Artificial Sequence
  Description of Artificial Sequence: Synthetic oligonucleotide
  Target: ATXN1; (+) strand; PAM type: NRG; PAM sequence: TGG
ctgcactctgcactccagcc

SEQ ID NO: 100553 - DNA, 20 bp, Artificial Sequence
  Description of Artificial Sequence: Synthetic oligonucleotide
  Target: ATXN1; (+) strand; PAM type: NRG; PAM sequence: GGG
tgcactctgcactccagcct

SEQ ID NO: 100554 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 100555 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 100556 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggtgacagagc

SEQ ID NO: 100557 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaaaaaaaaa

SEQ ID NO: 100558 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaatag

SEQ ID NO: 100559 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaatagaa

SEQ ID NO: 100560 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaatagaagagtc

SEQ ID NO: 100561 - DNA, 20 bp, Artificial Sequence
  Description of Artificial Sequence: Synthetic oligonucleotide
  Target: ATXN1; (+) strand; PAM type: NRG; PAM sequence: CAG
atagaagagtctggtttctg

SEQ ID NO: 100562 - DNA, 20 bp, Artificial Sequence
  Description of Artificial Sequence: Synthetic oligonucleotide
  Target: ATXN1; (+) strand; PAM type: NRG; PAM sequence: GAG
agaagagtctggtttctgca

SEQ ID NO: 100563 - DNA, 20 bp, Artificial Sequence
  Description of Artificial Sequence: Synthetic oligonucleotide
  Target: ATXN1; (+) strand; PAM type: NRG; PAM sequence: AGG
gaagagtctggtttctgcag

SEQ ID NO: 100564 - DNA, 20 bp, Artificial Sequence
  Description of Artificial Sequence: Synthetic oligonucleotide
  Target: ATXN1; (+) strand; PAM type: NRG; PAM sequence: CAG
ctggtttctgcagaggctgc

SEQ ID NO: 100565 - DNA, 20 bp, Artificial Sequence
  Description of Artificial Sequence: Synthetic oligonucleotide
  Target: ATXN1; (+) strand; PAM type: NRG; PAM sequence: AGG
tggtttctgcagaggctgcc

SEQ ID NO: 100566 - DNA, 20 bp, Artificial Sequence
  Description of Artificial Sequence: Synthetic oligonucleotide
  Target: ATXN1; (+) strand; PAM type: NRG; PAM sequence: TGG
tctgcagaggctgccaggcc

SEQ ID NO: 100567 - DNA, 20 bp, Artificial Sequence
  Description of Artificial Sequence: Synthetic oligonucleotide
  Target: ATXN1; (+) strand; PAM type: NRG; PAM sequence: GGG
ctgcagaggctgccaggcct

SEQ ID NO: 100568 - DNA, 20 bp, Artificial Sequence
  Description of Artificial Sequence: Synthetic oligonucleotide
  Target: ATXN1; (+) strand; PAM type: NRG; PAM sequence: AAG
cagaggctgccaggcctggg

SEQ ID NO: 100569 - DNA, 20 bp, Artificial Sequence
  Description of Artificial Sequence: Synthetic oligonucleotide
  Target: ATXN1; (+) strand; PAM type: NRG; PAM sequence: TGG
gctgccaggcctgggaagtg

SEQ ID NO: 100570 - DNA, 20 bp, Artificial Sequence
  Description of Artificial Sequence: Synthetic oligonucleotide
  Target: ATXN1; (+) strand; PAM type: NRG; PAM sequence: CAG
ggcctgggaagtgtggccca

SEQ ID NO: 100571 - DNA, 20 bp, Artificial Sequence
  Description of Artificial Sequence: Synthetic oligonucleotide
  Target: ATXN1; (+) strand; PAM type: NRG; PAM sequence: AAG
ggaagtgtggcccacagctg

SEQ ID NO: 100572 - DNA, 20 bp, Artificial Sequence
  Description of Artificial Sequence: Synthetic oligonucleotide
  Target: ATXN1; (+) strand; PAM type: NRG; PAM sequence: TGG
agtgtggcccacagctgaag

SEQ ID NO: 100573 - DNA, 20 bp, Artificial Sequence
  Description of Artificial Sequence: Synthetic oligonucleotide
  Target: ATXN1; (+) strand; PAM type: NRG; PAM sequence: AAG
aagtggctgccttcattctc

SEQ ID NO: 100574 - DNA, 20 bp, Artificial Sequence
  Description of Artificial Sequence: Synthetic oligonucleotide
  Target: ATXN1; (+) strand; PAM type: NRG; PAM sequence: AAG
ctgccttcattctcaagctg

SEQ ID NO: 100575 - DNA, 20 bp, Artificial Sequence
  Description of Artificial Sequence: Synthetic oligonucleotide
  Target: ATXN1; (+) strand; PAM type: NRG; PAM sequence: TGG
tctcaagctgaagttgatgc

SEQ ID NO: 100576 - DNA, 20 bp, Artificial Sequence
  Description of Artificial Sequence: Synthetic oligonucleotide
  Target: ATXN1; (+) strand; PAM type: NRG; PAM sequence: CGG
aagctgaagttgatgctggc

SEQ ID NO: 100577 - DNA, 20 bp, Artificial Sequence
  Description of Artificial Sequence: Synthetic oligonucleotide
  Target: ATXN1; (+) strand; PAM type: NRG; PAM sequence: AAG
tgaagttgatgctggccggc

SEQ ID NO: 100578 - DNA, 20 bp, Artificial Sequence
  Description of Artificial Sequence: Synthetic oligonucleotide
  Target: ATXN1; (+) strand; PAM type: NRG; PAM sequence: AGG
gaagttgatgctggccggca

SEQ ID NO: 100579 - DNA, 20 bp, Artificial Sequence
  Description of Artificial Sequence: Synthetic oligonucleotide
  Target: ATXN1; (+) strand; PAM type: NRG; PAM sequence: CAG
gatgctggccggcaaggaac

SEQ ID NO: 100580 - DNA, 20 bp, Artificial Sequence
  Description of Artificial Sequence: Synthetic oligonucleotide
  Target: ATXN1; (+) strand; PAM type: NRG; PAM sequence: AAG
tctgttcacaaaaatgtgtt

SEQ ID NO: 100581 - DNA, 20 bp, Artificial Sequence
  Description of Artificial Sequence: Synthetic oligonucleotide
  Target: ATXN1; (+) strand; PAM type: NRG; PAM sequence: AGG
ctgttcacaaaaatgtgtta

SEQ ID NO: 100582 - DNA, 20 bp, Artificial Sequence
  Description of Artificial Sequence: Synthetic oligonucleotide
  Target: ATXN1; (+) strand; PAM type: NRG; PAM sequence: AAG
aaaaatgtgttaaggattct

SEQ ID NO: 100583 - DNA, 20 bp, Artificial Sequence
  Description of Artificial Sequence: Synthetic oligonucleotide
  Target: ATXN1; (+) strand; PAM type: NRG; PAM sequence: AAG
aggattctaagtaccatgaa

SEQ ID NO: 100584 - DNA, 20 bp, Artificial Sequence
  Description of Artificial Sequence: Synthetic oligonucleotide
  Target: ATXN1; (+) strand; PAM type: NRG; PAM sequence: TGG
tttattttccatgtgtcacc

SEQ ID NO: 100585 - DNA, 20 bp, Artificial Sequence
  Description of Artificial Sequence: Synthetic oligonucleotide
  Target: ATXN1; (+) strand; PAM type: NRG; PAM sequence: GGG
ttattttccatgtgtcacct

SEQ ID NO: 100586 - DNA, 20 bp, Artificial Sequence
  Description of Artificial Sequence: Synthetic oligonucleotide
  Target: ATXN1; (+) strand; PAM type: NRG; PAM sequence: GGG
tattttccatgtgtcacctg

SEQ ID NO: 100587 - DNA, 20 bp, Artificial Sequence
  Description of Artificial Sequence: Synthetic oligonucleotide
  Target: ATXN1; (+) strand; PAM type: NRG; PAM sequence: AAG
tgtgtcacctggggtctgtg

SEQ ID NO: 100588 - DNA, 20 bp, Artificial Sequence
  Description of Artificial Sequence: Synthetic oligonucleotide
  Target: ATXN1; (+) strand; PAM type: NRG; PAM sequence: GAG
tgtcacctggggtctgtgaa

SEQ ID NO: 100589 - DNA, 20 bp, Artificial Sequence
  Description of Artificial Sequence: Synthetic oligonucleotide
  Target: ATXN1; (+) strand; PAM type: NRG; PAM sequence: AAG
gtgaagagtcaactttgctc

SEQ ID NO: 100590 - DNA, 20 bp, Artificial Sequence
  Description of Artificial Sequence: Synthetic oligonucleotide
  Target: ATXN1; (+) strand; PAM type: NRG; PAM sequence: AGG
tgaagagtcaactttgctca

SEQ ID NO: 100591 - DNA, 20 bp, Artificial Sequence
  Description of Artificial Sequence: Synthetic oligonucleotide
  Target: ATXN1; (+) strand; PAM type: NRG; PAM sequence: TAG
agagtcaactttgctcaagg

SEQ ID NO: 100592 - DNA, 20 bp, Artificial Sequence
  Description of Artificial Sequence: Synthetic oligonucleotide
  Target: ATXN1; (+) strand; PAM type: NRG; PAM sequence: TAG
gtagttcattttctttctcc

SEQ ID NO: 100593 - DNA, 20 bp, Artificial Sequence
  Description of Artificial Sequence: Synthetic oligonucleotide
  Target: ATXN1; (+) strand; PAM type: NRG; PAM sequence: CAG
gtacccacccctaattcatg

SEQ ID NO: 100594 - DNA, 20 bp, Artificial Sequence
  Description of Artificial Sequence: Synthetic oligonucleotide
  Target: ATXN1; (+) strand; PAM type: NRG; PAM sequence: AGG
tacccacccctaattcatgc

SEQ ID NO: 100595 - DNA, 20 bp, Artificial Sequence
  Description of Artificial Sequence: Synthetic oligonucleotide
  Target: ATXN1; (+) strand; PAM type: NRG; PAM sequence: AAG
ccacccctaattcatgcagg

SEQ ID NO: 100596 - DNA, 20 bp, Artificial Sequence
  Description of Artificial Sequence: Synthetic oligonucleotide
  Target: ATXN1; (+) strand; PAM type: NRG; PAM sequence: CAG
taattcatgcaggaagtgaa

SEQ ID NO: 100597 - DNA, 20 bp, Artificial Sequence
  Description of Artificial Sequence: Synthetic oligonucleotide
  Target: ATXN1; (+) strand; PAM type: NRG; PAM sequence: CAG
caggaagtgaacagccacta

SEQ ID NO: 100598 - DNA, 20 bp, Artificial Sequence
  Description of Artificial Sequence: Synthetic oligonucleotide
  Target: ATXN1; (+) strand; PAM type: NRG; PAM sequence: GAG
ggaagtgaacagccactaca

SEQ ID NO: 100599 - DNA, 20 bp, Artificial Sequence
  Description of Artificial Sequence: Synthetic oligonucleotide
  Target: ATXN1; (+) strand; PAM type: NRG; PAM sequence: AGG
gaagtgaacagccactacag

SEQ ID NO: 100600 - DNA, 20 bp, Artificial Sequence
  Description of Artificial Sequence: Synthetic oligonucleotide
  Target: ATXN1; (+) strand; PAM type: NRG; PAM sequence: GGG
aagtgaacagccactacaga

SEQ ID NO: 100601 - DNA, 20 bp, Artificial Sequence
  Description of Artificial Sequence: Synthetic oligonucleotide
  Target: ATXN1; (+) strand; PAM type: NRG; PAM sequence: GGG
agtgaacagccactacagag

SEQ ID NO: 100602 - DNA, 20 bp, Artificial Sequence
  Description of Artificial Sequence: Synthetic oligonucleotide
  Target: ATXN1; (+) strand; PAM type: NRG; PAM sequence: TAG
gaacagccactacagagggg

SEQ ID NO: 100603 - DNA, 20 bp, Artificial Sequence
  Description of Artificial Sequence: Synthetic oligonucleotide
  Target: ATXN1; (+) strand; PAM type: NRG; PAM sequence: GAG
agccactacagaggggtagt

SEQ ID NO: 100604 - DNA, 20 bp, Artificial Sequence
  Description of Artificial Sequence: Synthetic oligonucleotide
  Target: ATXN1; (+) strand; PAM type: NRG; PAM sequence: AAG
attttcttttttttttaaat

SEQ ID NO: 100605 - DNA, 20 bp, Artificial Sequence
  Description of Artificial Sequence: Synthetic oligonucleotide
  Target: ATXN1; (+) strand; PAM type: NRG; PAM sequence: TGG
ttttttttaaataagatctt

SEQ ID NO: 100606 - DNA, 20 bp, Artificial Sequence
  Description of Artificial Sequence: Synthetic oligonucleotide
  Target: ATXN1; (+) strand; PAM type: NRG; PAM sequence: GGG
tttttttaaataagatcttt

SEQ ID NO: 100607 - DNA, 20 bp, Artificial Sequence
  Description of Artificial Sequence: Synthetic oligonucleotide
  Target: ATXN1; (+) strand; PAM type: NRG; PAM sequence: GGG
ttttttaaataagatctttg

SEQ ID NO: 100608 - DNA, 20 bp, Artificial Sequence
  Description of Artificial Sequence: Synthetic oligonucleotide
  Target: ATXN1; (+) strand; PAM type: NRG; PAM sequence: TGG
atctttggggaaatctttct

SEQ ID NO: 100609 - DNA, 20 bp, Artificial Sequence
  Description of Artificial Sequence: Synthetic oligonucleotide
  Target: ATXN1; (+) strand; PAM type: NRG; PAM sequence: GGG
tctttggggaaatctttctt

SEQ ID NO: 100610 - DNA, 20 bp, Artificial Sequence
  Description of Artificial Sequence: Synthetic oligonucleotide
  Target: ATXN1; (+) strand; PAM type: NRG; PAM sequence: AAG
atctttcttgggcccttcca

SEQ ID NO: 100611 - DNA, 20 bp, Artificial Sequence
  Description of Artificial Sequence: Synthetic oligonucleotide
  Target: ATXN1; (+) strand; PAM type: NRG; PAM sequence: CAG
ttccaaagactgtaaaccta

SEQ ID NO: 100612 - DNA, 20 bp, Artificial Sequence
  Description of Artificial Sequence: Synthetic oligonucleotide
  Target: ATXN1; (+) strand; PAM type: NRG; PAM sequence: AAG
cagtgacatctcataataca

SEQ ID NO: 100613 - DNA, 20 bp, Artificial Sequence
  Description of Artificial Sequence: Synthetic oligonucleotide
  Target: ATXN1; (+) strand; PAM type: NRG; PAM sequence: AAG
acatctcataatacaaagaa

SEQ ID NO: 100614 - DNA, 20 bp, Artificial Sequence
  Description of Artificial Sequence: Synthetic oligonucleotide
  Target: ATXN1; (+) strand; PAM type: NRG; PAM sequence: CAG
ataatacaaagaaaagtatt

SEQ ID NO: 100615 - DNA, 20 bp, Artificial Sequence
  Description of Artificial Sequence: Synthetic oligonucleotide
  Target: ATXN1; (+) strand; PAM type: NRG; PAM sequence: AGG
taatacaaagaaaagtattc

SEQ ID NO: 100616 - DNA, 20 bp, Artificial Sequence
  Description of Artificial Sequence: Synthetic oligonucleotide
  Target: ATXN1; (+) strand; PAM type: NRG; PAM sequence: GGG
aatacaaagaaaagtattca

SEQ ID NO: 100617 - DNA, 20 bp, Artificial Sequence
  Description of Artificial Sequence: Synthetic oligonucleotide
  Target: ATXN1; (+) strand; PAM type: NRG; PAM sequence: AAG
agaaaagtattcagggctaa

SEQ ID NO: 100618 - DNA, 20 bp, Artificial Sequence
  Description of Artificial Sequence: Synthetic oligonucleotide
  Target: ATXN1; (+) strand; PAM type: NRG; PAM sequence: CGG
tattcagggctaaaagctct

SEQ ID NO: 100619 - DNA, 20 bp, Artificial Sequence
  Description of Artificial Sequence: Synthetic oligonucleotide
  Target: ATXN1; (+) strand; PAM type: NRG; PAM sequence: CAG
gctaaaagctctcggcaatg

SEQ ID NO: 100620 - DNA, 20 bp, Artificial Sequence
  Description of Artificial Sequence: Synthetic oligonucleotide
  Target: ATXN1; (+) strand; PAM type: NRG; PAM sequence: AGG
ctaaaagctctcggcaatgc

SEQ ID NO: 100621 - DNA, 20 bp, Artificial Sequence
  Description of Artificial Sequence: Synthetic oligonucleotide
  Target: ATXN1; (+) strand; PAM type: NRG; PAM sequence: GGG
taaaagctctcggcaatgca

SEQ ID NO: 100622 - DNA, 20 bp, Artificial Sequence
  Description of Artificial Sequence: Synthetic oligonucleotide
  Target: ATXN1; (+) strand; PAM type: NRG; PAM sequence: CGG
ctctcggcaatgcagggccc

SEQ ID NO: 100623 - DNA, 20 bp, Artificial Sequence
  Description of Artificial Sequence: Synthetic oligonucleotide
  Target: ATXN1; (+) strand; PAM type: NRG; PAM sequence: AAG
gcagggccccggctttgtgc

SEQ ID NO: 100624 - DNA, 20 bp, Artificial Sequence
  Description of Artificial Sequence: Synthetic oligonucleotide
  Target: ATXN1; (+) strand; PAM type: NRG; PAM sequence: CAG
tttgtgcaagcccccatatc

SEQ ID NO: 100625 - DNA, 20 bp, Artificial Sequence
  Description of Artificial Sequence: Synthetic oligonucleotide
  Target: ATXN1; (+) strand; PAM type: NRG; PAM sequence: GAG
ccccatatccagtcattcac

SEQ ID NO: 100626 - DNA, 20 bp, Artificial Sequence
  Description of Artificial Sequence: Synthetic oligonucleotide
  Target: ATXN1; (+) strand; PAM type: NRG; PAM sequence: TGG
catatccagtcattcacgag

SEQ ID NO: 100627 - DNA, 20 bp, Artificial Sequence
  Description of Artificial Sequence: Synthetic oligonucleotide
  Target: ATXN1; (+) strand; PAM type: NRG; PAM sequence: TGG
cagtcattcacgagtggttc

SEQ ID NO: 100628 - DNA, 20 bp, Artificial Sequence
  Description of Artificial Sequence: Synthetic oligonucleotide
  Target: ATXN1; (+) strand; PAM type: NRG; PAM sequence: TGG
gtggttctggaaaactgatt

SEQ ID NO: 100629 - DNA, 20 bp, Artificial Sequence
  Description of Artificial Sequence: Synthetic oligonucleotide
  Target: ATXN1; (+) strand; PAM type: NRG; PAM sequence: TGG
gatttggtcctttcctcact

SEQ ID NO: 100630 - DNA, 20 bp, Artificial Sequence
  Description of Artificial Sequence: Synthetic oligonucleotide
  Target: ATXN1; (+) strand; PAM type: NRG; PAM sequence: GGG
atttggtcctttcctcactt

SEQ ID NO: 100631 - DNA, 20 bp, Artificial Sequence
  Description of Artificial Sequence: Synthetic oligonucleotide
  Target: ATXN1; (+) strand; PAM type: NRG; PAM sequence: AAG
ctttcctcacttgggcattt

SEQ ID NO: 100632 - DNA, 20 bp, Artificial Sequence
  Description of Artificial Sequence: Synthetic oligonucleotide
  Target: ATXN1; (+) strand; PAM type: NRG; PAM sequence: AAG
catttaagaaatgctcaaaa

SEQ ID NO: 100633 - DNA, 20 bp, Artificial Sequence
  Description of Artificial Sequence: Synthetic oligonucleotide
  Target: ATXN1; (+) strand; PAM type: NRG; PAM sequence: CAG
taagaaatgctcaaaaaagc

SEQ ID NO: 100634 - DNA, 20 bp, Artificial Sequence
  Description of Artificial Sequence: Synthetic oligonucleotide
  Target: ATXN1; (+) strand; PAM type: NRG; PAM sequence: TAG
atgctcaaaaaagccagaca

SEQ ID NO: 100635 - DNA, 20 bp, Artificial Sequence
  Description of Artificial Sequence: Synthetic oligonucleotide
  Target: ATXN1; (+) strand; PAM type: NRG; PAM sequence: AGG
tgctcaaaaaagccagacat

SEQ ID NO: 100636 - DNA, 20 bp, Artificial Sequence
  Description of Artificial Sequence: Synthetic oligonucleotide
  Target: ATXN1; (+) strand; PAM type: NRG; PAM sequence: GGG
gctcaaaaaagccagacata

SEQ ID NO: 100637 - DNA, 20 bp, Artificial Sequence
  Description of Artificial Sequence: Synthetic oligonucleotide
  Target: ATXN1; (+) strand; PAM type: NRG; PAM sequence: CAG
gggactcgtgtctgtaatct

SEQ ID NO: 100638 - DNA, 20 bp, Artificial Sequence
  Description of Artificial Sequence: Synthetic oligonucleotide
  Target: ATXN1; (+) strand; PAM type: NRG; PAM sequence: AGG
ggactcgtgtctgtaatctc

SEQ ID NO: 100639 - DNA, 20 bp, Artificial Sequence
  Description of Artificial Sequence: Synthetic oligonucleotide
  Target: ATXN1; (+) strand; PAM type: NRG; PAM sequence: GGG
gactcgtgtctgtaatctca

SEQ ID NO: 100640 - DNA, 20 bp, Artificial Sequence
  Description of Artificial Sequence: Synthetic oligonucleotide
  Target: ATXN1; (+) strand; PAM type: NRG; PAM sequence: TGG
tgtctgtaatctcagggctt

SEQ ID NO: 100641 - DNA, 20 bp, Artificial Sequence
  Description of Artificial Sequence: Synthetic oligonucleotide
  Target: ATXN1; (+) strand; PAM type: NRG; PAM sequence: GGG
gtctgtaatctcagggcttt

SEQ ID NO: 100642 - DNA, 20 bp, Artificial Sequence
  Description of Artificial Sequence: Synthetic oligonucleotide
  Target: ATXN1; (+) strand; PAM type: NRG; PAM sequence: GAG
ctgtaatctcagggctttgg

SEQ ID NO: 100643 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagggctttggg

SEQ ID NO: 100644 - DNA, 20 bp, Artificial Sequence
  Description of Artificial Sequence: Synthetic oligonucleotide
  Target: ATXN1; (+) strand; PAM type: NRG; PAM sequence: GAG
tctcagggctttgggaggcc

SEQ ID NO: 100645 - DNA, 20 bp, Artificial Sequence
  Description of Artificial Sequence: Synthetic oligonucleotide
  Target: ATXN1; (+) strand; PAM type: NRG; PAM sequence: AGG
ctcagggctttgggaggccg

SEQ ID NO: 100646 - DNA, 20 bp, Artificial Sequence
  Description of Artificial Sequence: Synthetic oligonucleotide
  Target: ATXN1; (+) strand; PAM type: NRG; PAM sequence: TGG
agggctttgggaggccgagg

SEQ ID NO: 100647 - DNA, 20 bp, Artificial Sequence
  Description of Artificial Sequence: Synthetic oligonucleotide
  Target: ATXN1; (+) strand; PAM type: NRG; PAM sequence: AAG
gctttgggaggccgaggtgg

SEQ ID NO: 100648 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggccgaggtgga

SEQ ID NO: 100649 - DNA, 20 bp, Artificial Sequence
  Description of Artificial Sequence: Synthetic oligonucleotide
  Target: ATXN1; (+) strand; PAM type: NRG; PAM sequence: TGG
gccgaggtggaaggactgct

SEQ ID NO: 100650 - DNA, 20 bp, Artificial Sequence
  Description of Artificial Sequence: Synthetic oligonucleotide
  Target: ATXN1; (+) strand; PAM type: NRG; PAM sequence: GAG
cgaggtggaaggactgcttg

SEQ ID NO: 100651 - DNA, 20 bp, Artificial Sequence
  Description of Artificial Sequence: Synthetic oligonucleotide
  Target: ATXN1; (+) strand; PAM type: NRG; PAM sequence: CAG
tggaaggactgcttggagcc

SEQ ID NO: 100652 - DNA, 20 bp, Artificial Sequence
  Description of Artificial Sequence: Synthetic oligonucleotide
  Target: ATXN1; (+) strand; PAM type: NRG; PAM sequence: AGG
ggaaggactgcttggagccc

SEQ ID NO: 100653 - DNA, 20 bp, Artificial Sequence
  Description of Artificial Sequence: Synthetic oligonucleotide
  Target: ATXN1; (+) strand; PAM type: NRG; PAM sequence: GAG
aaggactgcttggagcccag

SEQ ID NO: 100654 - DNA, 20 bp, Artificial Sequence
  Description of Artificial Sequence: Synthetic oligonucleotide
  Target: ATXN1; (+) strand; PAM type: NRG; PAM sequence: GAG
tgcttggagcccaggagttt

SEQ ID NO: 100655 - DNA, 20 bp, Artificial Sequence
  Description of Artificial Sequence: Synthetic oligonucleotide
  Target: ATXN1; (+) strand; PAM type: NRG; PAM sequence: CAG
ggagcccaggagtttgagac

SEQ ID NO: 100656 - DNA, 20 bp, Artificial Sequence
  Description of Artificial Sequence: Synthetic oligonucleotide
  Target: ATXN1; (+) strand; PAM type: NRG; PAM sequence: TAG
ccaggagtttgagaccagcc

SEQ ID NO: 100657 - DNA, 20 bp, Artificial Sequence
  Description of Artificial Sequence: Synthetic oligonucleotide
  Target: ATXN1; (+) strand; PAM type: NRG; PAM sequence: AGG
caggagtttgagaccagcct

SEQ ID NO: 100658 - DNA, 20 bp, Artificial Sequence
  Description of Artificial Sequence: Synthetic oligonucleotide
  Target: ATXN1; (+) strand; PAM type: NRG; PAM sequence: CAG
tgagaccagcctaggcaaca

SEQ ID NO: 100659 - DNA, 20 bp, Artificial Sequence
  Description of Artificial Sequence: Synthetic oligonucleotide
  Target: ATXN1; (+) strand; PAM type: NRG; PAM sequence: AAG
accagcctaggcaacacagc

SEQ ID NO: 100660 - DNA, 20 bp, Artificial Sequence
  Description of Artificial Sequence: Synthetic oligonucleotide
  Target: ATXN1; (+) strand; PAM type: NRG; PAM sequence: TAG
aatgttttttatttttaaat

SEQ ID NO: 100661 - DNA, 20 bp, Artificial Sequence
  Description of Artificial Sequence: Synthetic oligonucleotide
  Target: ATXN1; (+) strand; PAM type: NRG; PAM sequence: TGG
ttttttatttttaaattagc

SEQ ID NO: 100662 - DNA, 20 bp, Artificial Sequence
  Description of Artificial Sequence: Synthetic oligonucleotide
  Target: ATXN1; (+) strand; PAM type: NRG; PAM sequence: GGG
tttttatttttaaattagct

SEQ ID NO: 100663 - DNA, 20 bp, Artificial Sequence
  Description of Artificial Sequence: Synthetic oligonucleotide
  Target: ATXN1; (+) strand; PAM type: NRG; PAM sequence: TGG
atttttaaattagctgggca

SEQ ID NO: 100664 - DNA, 20 bp, Artificial Sequence
  Description of Artificial Sequence: Synthetic oligonucleotide
  Target: ATXN1; (+) strand; PAM type: NRG; PAM sequence: TGG
tttaaattagctgggcatgg

SEQ ID NO: 100665 - DNA, 20 bp, Artificial Sequence
  Description of Artificial Sequence: Synthetic oligonucleotide
  Target: ATXN1; (+) strand; PAM type: NRG; PAM sequence: TGG
ggcatggtggtatgcacctg

SEQ ID NO: 100666 - DNA, 20 bp, Artificial Sequence
  Description of Artificial Sequence: Synthetic oligonucleotide
  Target: ATXN1; (+) strand; PAM type: NRG; PAM sequence: TAG
gtggtatgcacctgtggtcc

SEQ ID NO: 100667 - DNA, 20 bp, Artificial Sequence
  Description of Artificial Sequence: Synthetic oligonucleotide
  Target: ATXN1; (+) strand; PAM type: NRG; PAM sequence: TAG
gcacctgtggtcctagctac

SEQ ID NO: 100668 - DNA, 20 bp, Artificial Sequence
  Description of Artificial Sequence: Synthetic oligonucleotide
  Target: ATXN1; (+) strand; PAM type: NRG; PAM sequence: AGG
cacctgtggtcctagctact

SEQ ID NO: 100669 - DNA, 20 bp, Artificial Sequence
  Description of Artificial Sequence: Synthetic oligonucleotide
  Target: ATXN1; (+) strand; PAM type: NRG; PAM sequence: GGG
acctgtggtcctagctacta

SEQ ID NO: 100670 - DNA, 20 bp, Artificial Sequence
  Description of Artificial Sequence: Synthetic oligonucleotide
  Target: ATXN1; (+) strand; PAM type: NRG; PAM sequence: GAG
ctgtggtcctagctactagg

SEQ ID NO: 100671 - DNA, 20 bp, Artificial Sequence
  Description of Artificial Sequence: Synthetic oligonucleotide
  Target: ATXN1; (+) strand; PAM type: NRG; PAM sequence: AGG
tgtggtcctagctactaggg

SEQ ID NO: 100672 - DNA, 20 bp, Artificial Sequence
  Description of Artificial Sequence: Synthetic oligonucleotide
  Target: ATXN1; (+) strand; PAM type: NRG; PAM sequence: TGG
gtcctagctactagggaggt

SEQ ID NO: 100673 - DNA, 20 bp, Artificial Sequence
  Description of Artificial Sequence: Synthetic oligonucleotide
  Target: ATXN1; (+) strand; PAM type: NRG; PAM sequence: GGG
tcctagctactagggaggtt

SEQ ID NO: 100674 - DNA, 20 bp, Artificial Sequence
  Description of Artificial Sequence: Synthetic oligonucleotide
  Target: ATXN1; (+) strand; PAM type: NRG; PAM sequence: GGG
cctagctactagggaggttg

SEQ ID NO: 100675 - DNA, 20 bp, Artificial Sequence
  Description of Artificial Sequence: Synthetic oligonucleotide
  Target: ATXN1; (+) strand; PAM type: NRG; PAM sequence: TGG
agctactagggaggttgggg

SEQ ID NO: 100676 - DNA, 20 bp, Artificial Sequence
  Description of Artificial Sequence: Synthetic oligonucleotide
  Target: ATXN1; (+) strand; PAM type: NRG; PAM sequence: GGG
gctactagggaggttggggt

SEQ ID NO: 100677 - DNA, 20 bp, Artificial Sequence
  Description of Artificial Sequence: Synthetic oligonucleotide
  Target: ATXN1; (+) strand; PAM type: NRG; PAM sequence: GAG
tactagggaggttggggtgg

SEQ ID NO: 100678 - DNA, 20 bp, Artificial Sequence
  Description of Artificial Sequence: Synthetic oligonucleotide
  Target: ATXN1; (+) strand; PAM type: NRG; PAM sequence: AGG
actagggaggttggggtggg

SEQ ID NO: 100679 - DNA, 20 bp, Artificial Sequence
  Description of Artificial Sequence: Synthetic oligonucleotide
  Target: ATXN1; (+) strand; PAM type: NRG; PAM sequence: TGG
ggttggggtgggaggatcgc

SEQ ID NO: 100680 - DNA, 20 bp, Artificial Sequence
  Description of Artificial Sequence: Synthetic oligonucleotide
  Target: ATXN1; (+) strand; PAM type: NRG; PAM sequence: GAG
ttggggtgggaggatcgctg

SEQ ID NO: 100681 - DNA, 20 bp, Artificial Sequence
  Description of Artificial Sequence: Synthetic oligonucleotide
  Target: ATXN1; (+) strand; PAM type: NRG; PAM sequence: TAG
gtgggaggatcgctggagcc

SEQ ID NO: 100682 - DNA, 20 bp, Artificial Sequence
  Description of Artificial Sequence: Synthetic oligonucleotide
  Target: ATXN1; (+) strand; PAM type: NRG; PAM sequence: AGG
tgggaggatcgctggagcct

SEQ ID NO: 100683 - DNA, 20 bp, Artificial Sequence
  Description of Artificial Sequence: Synthetic oligonucleotide
  Target: ATXN1; (+) strand; PAM type: NRG; PAM sequence: GAG
ggaggatcgctggagcctag

SEQ ID NO: 100684 - DNA, 20 bp, Artificial Sequence
  Description of Artificial Sequence: Synthetic oligonucleotide
  Target: ATXN1; (+) strand; PAM type: NRG; PAM sequence: AGG
gaggatcgctggagcctagg

SEQ ID NO: 100685 - DNA, 20 bp, Artificial Sequence
  Description of Artificial Sequence: Synthetic oligonucleotide
  Target: ATXN1; (+) strand; PAM type: NRG; PAM sequence: AAG
tcgctggagcctaggaggtc

SEQ ID NO: 100686 - DNA, 20 bp, Artificial Sequence
  Description of Artificial Sequence: Synthetic oligonucleotide
  Target: ATXN1; (+) strand; PAM type: NRG; PAM sequence: AGG
cgctggagcctaggaggtca

SEQ ID NO: 100687 - DNA, 20 bp, Artificial Sequence
  Description of Artificial Sequence: Synthetic oligonucleotide
  Target: ATXN1; (+) strand; PAM type: NRG; PAM sequence: CAG
agcctaggaggtcaaggcca

SEQ ID NO: 100688 - DNA, 20 bp, Artificial Sequence
  Description of Artificial Sequence: Synthetic oligonucleotide
  Target: ATXN1; (+) strand; PAM type: NRG; PAM sequence: GAG
taggaggtcaaggccacagt

SEQ ID NO: 100689 - DNA, 20 bp, Artificial Sequence
  Description of Artificial Sequence: Synthetic oligonucleotide
  Target: ATXN1; (+) strand; PAM type: NRG; PAM sequence: CAG
atgattgcaccactgcattc

SEQ ID NO: 100690 - DNA, 20 bp, Artificial Sequence
  Description of Artificial Sequence: Synthetic oligonucleotide
  Target: ATXN1; (+) strand; PAM type: NRG; PAM sequence: TAG
tgcaccactgcattccagcc

SEQ ID NO: 100691 - DNA, 20 bp, Artificial Sequence
  Description of Artificial Sequence: Synthetic oligonucleotide
  Target: ATXN1; (+) strand; PAM type: NRG; PAM sequence: AGG
gcaccactgcattccagcct

SEQ ID NO: 100692 - DNA, 20 bp, Artificial Sequence
  Description of Artificial Sequence: Synthetic oligonucleotide
  Target: ATXN1; (+) strand; PAM type: NRG; PAM sequence: GAG
accactgcattccagcctag

SEQ ID NO: 100693 - DNA, 20 bp, Artificial Sequence
  Description of Artificial Sequence: Synthetic oligonucleotide
  Target: ATXN1; (+) strand; PAM type: NRG; PAM sequence: AAG
tgcattccagcctaggagac

SEQ ID NO: 100694 - DNA, 20 bp, Artificial Sequence
  Description of Artificial Sequence: Synthetic oligonucleotide
  Target: ATXN1; (+) strand; PAM type: NRG; PAM sequence: TAG
aaacaattcaaaccattaat

SEQ ID NO: 100695 - DNA, 20 bp, Artificial Sequence
  Description of Artificial Sequence: Synthetic oligonucleotide
  Target: ATXN1; (+) strand; PAM type: NRG; PAM sequence: TAG
ttttatctgaatgtcccaaa

SEQ ID NO: 100696 - DNA, 20 bp, Artificial Sequence
  Description of Artificial Sequence: Synthetic oligonucleotide
  Target: ATXN1; (+) strand; PAM type: NRG; PAM sequence: CAG
tatctgaatgtcccaaatag

SEQ ID NO: 100697 - DNA, 20 bp, Artificial Sequence
  Description of Artificial Sequence: Synthetic oligonucleotide
  Target: ATXN1; (+) strand; PAM type: NRG; PAM sequence: AAG
ttcatgactattttcaactc

SEQ ID NO: 100698 - DNA, 20 bp, Artificial Sequence
  Description of Artificial Sequence: Synthetic oligonucleotide
  Target: ATXN1; (+) strand; PAM type: NRG; PAM sequence: TGG
tgactattttcaactcaagc

SEQ ID NO: 100699 - DNA, 20 bp, Artificial Sequence
  Description of Artificial Sequence: Synthetic oligonucleotide
  Target: ATXN1; (+) strand; PAM type: NRG; PAM sequence: AAG
ctattttcaactcaagctgg

SEQ ID NO: 100700 - DNA, 20 bp, Artificial Sequence
  Description of Artificial Sequence: Synthetic oligonucleotide
  Target: ATXN1; (+) strand; PAM type: NRG; PAM sequence: AGG
tattttcaactcaagctgga

SEQ ID NO: 100701 - DNA, 20 bp, Artificial Sequence
  Description of Artificial Sequence: Synthetic oligonucleotide
  Target: ATXN1; (+) strand; PAM type: NRG; PAM sequence: GAG
ttttcaactcaagctggaag

SEQ ID NO: 100702 - DNA, 20 bp, Artificial Sequence
  Description of Artificial Sequence: Synthetic oligonucleotide
  Target: ATXN1; (+) strand; PAM type: NRG; PAM sequence: AGG
tttcaactcaagctggaagg

SEQ ID NO: 100703 - DNA, 20 bp, Artificial Sequence
  Description of Artificial Sequence: Synthetic oligonucleotide
  Target: ATXN1; (+) strand; PAM type: NRG; PAM sequence: TAG
atttgaatgttttcaaatcc

SEQ ID NO: 100704 - DNA, 20 bp, Artificial Sequence
  Description of Artificial Sequence: Synthetic oligonucleotide
  Target: ATXN1; (+) strand; PAM type: NRG; PAM sequence: TGG
gaatgttttcaaatcctaga

SEQ ID NO: 100705 - DNA, 20 bp, Artificial Sequence
  Description of Artificial Sequence: Synthetic oligonucleotide
  Target: ATXN1; (+) strand; PAM type: NRG; PAM sequence: TAG
atcctagatggaaacacttg

SEQ ID NO: 100706 - DNA, 20 bp, Artificial Sequence
  Description of Artificial Sequence: Synthetic oligonucleotide
  Target: ATXN1; (+) strand; PAM type: NRG; PAM sequence: AAG
tagatggaaacacttgtaga

SEQ ID NO: 100707 - DNA, 20 bp, Artificial Sequence
  Description of Artificial Sequence: Synthetic oligonucleotide
  Target: ATXN1; (+) strand; PAM type: NRG; PAM sequence: TAG
cttgtagaaagtacgctcga

SEQ ID NO: 100708 - DNA, 20 bp, Artificial Sequence
  Description of Artificial Sequence: Synthetic oligonucleotide
  Target: ATXN1; (+) strand; PAM type: NRG; PAM sequence: CAG
tagaaagtacgctcgatagc

SEQ ID NO: 100709 - DNA, 20 bp, Artificial Sequence
  Description of Artificial Sequence: Synthetic oligonucleotide
  Target: ATXN1; (+) strand; PAM type: NRG; PAM sequence: AGG
agaaagtacgctcgatagcc

SEQ ID NO: 100710 - DNA, 20 bp, Artificial Sequence
  Description of Artificial Sequence: Synthetic oligonucleotide
  Target: ATXN1; (+) strand; PAM type: NRG; PAM sequence: AAG
agtacgctcgatagccagga

SEQ ID NO: 100711 - DNA, 20 bp, Artificial Sequence
  Description of Artificial Sequence: Synthetic oligonucleotide
  Target: ATXN1; (+) strand; PAM type: NRG; PAM sequence: CAG
tcgatagccaggaaagctct

SEQ ID NO: 100712 - DNA, 20 bp, Artificial Sequence
  Description of Artificial Sequence: Synthetic oligonucleotide
  Target: ATXN1; (+) strand; PAM type: NRG; PAM sequence: CAG
gccaggaaagctctcagctg

SEQ ID NO: 100713 - DNA, 20 bp, Artificial Sequence
  Description of Artificial Sequence: Synthetic oligonucleotide
  Target: ATXN1; (+) strand; PAM type: NRG; PAM sequence: AGG
ccaggaaagctctcagctgc

SEQ ID NO: 100714 - DNA, 20 bp, Artificial Sequence
  Description of Artificial Sequence: Synthetic oligonucleotide
  Target: ATXN1; (+) strand; PAM type: NRG; PAM sequence: TGG
cagctgcaggctgaacctgc

SEQ ID NO: 100715 - DNA, 20 bp, Artificial Sequence
  Description of Artificial Sequence: Synthetic oligonucleotide
  Target: ATXN1; (+) strand; PAM type: NRG; PAM sequence: CAG
ggctgaacctgctggactcc

SEQ ID NO: 100716 - DNA, 20 bp, Artificial Sequence
  Description of Artificial Sequence: Synthetic oligonucleotide
  Target: ATXN1; (+) strand; PAM type: NRG; PAM sequence: TGG
ctgctggactcccagcaact

SEQ ID NO: 100717 - DNA, 20 bp, Artificial Sequence
  Description of Artificial Sequence: Synthetic oligonucleotide
  Target: ATXN1; (+) strand; PAM type: NRG; PAM sequence: GGG
tgctggactcccagcaactt

SEQ ID NO: 100718 - DNA, 20 bp, Artificial Sequence
  Description of Artificial Sequence: Synthetic oligonucleotide
  Target: ATXN1; (+) strand; PAM type: NRG; PAM sequence: CAG
tggactcccagcaacttggg

SEQ ID NO: 100719 - DNA, 20 bp, Artificial Sequence
  Description of Artificial Sequence: Synthetic oligonucleotide
  Target: ATXN1; (+) strand; PAM type: NRG; PAM sequence: AAG
cccagcaacttgggcagtga

SEQ ID NO: 100720 - DNA, 20 bp, Artificial Sequence
  Description of Artificial Sequence: Synthetic oligonucleotide
  Target: ATXN1; (+) strand; PAM type: NRG; PAM sequence: TGG
aacttgggcagtgaaagaaa

SEQ ID NO: 100721 - DNA, 20 bp, Artificial Sequence
  Description of Artificial Sequence: Synthetic oligonucleotide
  Target: ATXN1; (+) strand; PAM type: NRG; PAM sequence: GGG
acttgggcagtgaaagaaat

SEQ ID NO: 100722 - DNA, 20 bp, Artificial Sequence
  Description of Artificial Sequence: Synthetic oligonucleotide
  Target: ATXN1; (+) strand; PAM type: NRG; PAM sequence: TGG
gcagtgaaagaaatgggctg

SEQ ID NO: 100723 - DNA, 20 bp, Artificial Sequence
  Description of Artificial Sequence: Synthetic oligonucleotide
  Target: ATXN1; (+) strand; PAM type: NRG; PAM sequence: AAG
taaatgcatgtaatcgatct

SEQ ID NO: 100724 - DNA, 20 bp, Artificial Sequence
  Description of Artificial Sequence: Synthetic oligonucleotide
  Target: ATXN1; (+) strand; PAM type: NRG; PAM sequence: TGG
atgtaatcgatctaagaacc

SEQ ID NO: 100725 - DNA, 20 bp, Artificial Sequence
  Description of Artificial Sequence: Synthetic oligonucleotide
  Target: ATXN1; (+) strand; PAM type: NRG; PAM sequence: AAG
atcgatctaagaacctggaa

SEQ ID NO: 100726 - DNA, 20 bp, Artificial Sequence
  Description of Artificial Sequence: Synthetic oligonucleotide
  Target: ATXN1; (+) strand; PAM type: NRG; PAM sequence: AGG
tcgatctaagaacctggaaa

SEQ ID NO: 100727 - DNA, 20 bp, Artificial Sequence
  Description of Artificial Sequence: Synthetic oligonucleotide
  Target: ATXN1; (+) strand; PAM type: NRG; PAM sequence: GGG
cgatctaagaacctggaaaa

SEQ ID NO: 100728 - DNA, 20 bp, Artificial Sequence
  Description of Artificial Sequence: Synthetic oligonucleotide
  Target: ATXN1; (+) strand; PAM type: NRG; PAM sequence: TAG
tctaagaacctggaaaaggg

SEQ ID NO: 100729 - DNA, 20 bp, Artificial Sequence
  Description of Artificial Sequence: Synthetic oligonucleotide
  Target: ATXN1; (+) strand; PAM type: NRG; PAM sequence: AAG
acctggaaaagggtagattg

SEQ ID NO: 100730 - DNA, 20 bp, Artificial Sequence
  Description of Artificial Sequence: Synthetic oligonucleotide
  Target: ATXN1; (+) strand; PAM type: NRG; PAM sequence: AGG
cctggaaaagggtagattga

SEQ ID NO: 100731 - DNA, 20 bp, Artificial Sequence
  Description of Artificial Sequence: Synthetic oligonucleotide
  Target: ATXN1; (+) strand; PAM type: NRG; PAM sequence: GAG
tggaaaagggtagattgaag

SEQ ID NO: 100732 - DNA, 20 bp, Artificial Sequence
  Description of Artificial Sequence: Synthetic oligonucleotide
  Target: ATXN1; (+) strand; PAM type: NRG; PAM sequence: TGG
gggtagattgaaggagcctg

SEQ ID NO: 100733 - DNA, 20 bp, Artificial Sequence
  Description of Artificial Sequence: Synthetic oligonucleotide
  Target: ATXN1; (+) strand; PAM type: NRG; PAM sequence: AAG
tgaaggagcctgtggaaatt

SEQ ID NO: 100734 - DNA, 20 bp, Artificial Sequence
  Description of Artificial Sequence: Synthetic oligonucleotide
  Target: ATXN1; (+) strand; PAM type: NRG; PAM sequence: GAG
aaggagcctgtggaaattaa

SEQ ID NO: 100735 - DNA, 20 bp, Artificial Sequence
  Description of Artificial Sequence: Synthetic oligonucleotide
  Target: ATXN1; (+) strand; PAM type: NRG; PAM sequence: CAG
aagagcgttaaccatacttc

SEQ ID NO: 100736 - DNA, 20 bp, Artificial Sequence
  Description of Artificial Sequence: Synthetic oligonucleotide
  Target: ATXN1; (+) strand; PAM type: NRG; PAM sequence: TGG
atacttccagtgactcatct

SEQ ID NO: 100737 - DNA, 20 bp, Artificial Sequence
  Description of Artificial Sequence: Synthetic oligonucleotide
  Target: ATXN1; (+) strand; PAM type: NRG; PAM sequence: CAG
ccagtgactcatcttggcta

SEQ ID NO: 100738 - DNA, 20 bp, Artificial Sequence
  Description of Artificial Sequence: Synthetic oligonucleotide
  Target: ATXN1; (+) strand; PAM type: NRG; PAM sequence: AAG
gctacagctgactttacccc

SEQ ID NO: 100739 - DNA, 20 bp, Artificial Sequence
  Description of Artificial Sequence: Synthetic oligonucleotide
  Target: ATXN1; (+) strand; PAM type: NRG; PAM sequence: CAG
agctgactttaccccaagcc

SEQ ID NO: 100740 - DNA, 20 bp, Artificial Sequence
  Description of Artificial Sequence: Synthetic oligonucleotide
  Target: ATXN1; (+) strand; PAM type: NRG; PAM sequence: CAG
tgactttaccccaagcccag

SEQ ID NO: 100741 - DNA, 20 bp, Artificial Sequence
  Description of Artificial Sequence: Synthetic oligonucleotide
  Target: ATXN1; (+) strand; PAM type: NRG; PAM sequence: AGG
gactttaccccaagcccagc

SEQ ID NO: 100742 - DNA, 20 bp, Artificial Sequence
  Description of Artificial Sequence: Synthetic oligonucleotide
  Target: ATXN1; (+) strand; PAM type: NRG; PAM sequence: TGG
cccaagcccagcaggtcacc

SEQ ID NO: 100743 - DNA, 20 bp, Artificial Sequence
  Description of Artificial Sequence: Synthetic oligonucleotide
  Target: ATXN1; (+) strand; PAM type: NRG; PAM sequence: GGG
ccaagcccagcaggtcacct

SEQ ID NO: 100744 - DNA, 20 bp, Artificial Sequence
  Description of Artificial Sequence: Synthetic oligonucleotide
  Target: ATXN1; (+) strand; PAM type: NRG; PAM sequence: CAG
gcccagcaggtcacctggga

SEQ ID NO: 100745 - DNA, 20 bp, Artificial Sequence
  Description of Artificial Sequence: Synthetic oligonucleotide
  Target: ATXN1; (+) strand; PAM type: NRG; PAM sequence: CAG
ctgggacagccctgacttct

SEQ ID NO: 100746 - DNA, 20 bp, Artificial Sequence
  Description of Artificial Sequence: Synthetic oligonucleotide
  Target: ATXN1; (+) strand; PAM type: NRG; PAM sequence: TAG
tttctgatgctttgatattt

SEQ ID NO: 100747 - DNA, 20 bp, Artificial Sequence
  Description of Artificial Sequence: Synthetic oligonucleotide
  Target: ATXN1; (+) strand; PAM type: NRG; PAM sequence: TGG
tttgatattttagtgtcttg

SEQ ID NO: 100748 - DNA, 20 bp, Artificial Sequence
  Description of Artificial Sequence: Synthetic oligonucleotide
  Target: ATXN1; (+) strand; PAM type: NRG; PAM sequence: CAG
ttttagtgtcttgtggatcc

SEQ ID NO: 100749 - DNA, 20 bp, Artificial Sequence
  Description of Artificial Sequence: Synthetic oligonucleotide
  Target: ATXN1; (+) strand; PAM type: NRG; PAM sequence: GAG
ttagtgtcttgtggatccca

SEQ ID NO: 100750 - DNA, 20 bp, Artificial Sequence
  Description of Artificial Sequence: Synthetic oligonucleotide
  Target: ATXN1; (+) strand; PAM type: NRG; PAM sequence: AGG
tagtgtcttgtggatcccag

SEQ ID NO: 100751 - DNA, 20 bp, Artificial Sequence
  Description of Artificial Sequence: Synthetic oligonucleotide
  Target: ATXN1; (+) strand; PAM type: NRG; PAM sequence: TAG
tcttgtggatcccagaggta

SEQ ID NO: 100752 - DNA, 20 bp, Artificial Sequence
  Description of Artificial Sequence: Synthetic oligonucleotide
  Target: ATXN1; (+) strand; PAM type: NRG; PAM sequence: TAG
cccagaggtatagtctctcc

SEQ ID NO: 100753 - DNA, 20 bp, Artificial Sequence
  Description of Artificial Sequence: Synthetic oligonucleotide
  Target: ATXN1; (+) strand; PAM type: NRG; PAM sequence: AGG
ccagaggtatagtctctcct

SEQ ID NO: 100754 - DNA, 20 bp, Artificial Sequence
  Description of Artificial Sequence: Synthetic oligonucleotide
  Target: ATXN1; (+) strand; PAM type: NRG; PAM sequence: TAG
ggtatagtctctcctaggat

SEQ ID NO: 100755 - DNA, 20 bp, Artificial Sequence
  Description of Artificial Sequence: Synthetic oligonucleotide
  Target: ATXN1; (+) strand; PAM type: NRG; PAM sequence: TAG
tcctaggattagctaattcc

SEQ ID NO: 100756 - DNA, 20 bp, Artificial Sequence
  Description of Artificial Sequence: Synthetic oligonucleotide
  Target: ATXN1; (+) strand; PAM type: NRG; PAM sequence: GAG
ctaggattagctaattccta

SEQ ID NO: 100757 - DNA, 20 bp, Artificial Sequence
  Description of Artificial Sequence: Synthetic oligonucleotide
  Target: ATXN1; (+) strand; PAM type: NRG; PAM sequence: AGG
taggattagctaattcctag

SEQ ID NO: 100758 - DNA, 20 bp, Artificial Sequence
  Description of Artificial Sequence: Synthetic oligonucleotide
  Target: ATXN1; (+) strand; PAM type: NRG; PAM sequence: CAG
acttttatatgcaaaccaac

SEQ ID NO: 100759 - DNA, 20 bp, Artificial Sequence
  Description of Artificial Sequence: Synthetic oligonucleotide
  Target: ATXN1; (+) strand; PAM type: NRG; PAM sequence: CAG
tatatgcaaaccaaccagtc

SEQ ID NO: 100760 - DNA, 20 bp, Artificial Sequence
  Description of Artificial Sequence: Synthetic oligonucleotide
  Target: ATXN1; (+) strand; PAM type: NRG; PAM sequence: GAG
tatgcaaaccaaccagtcca

SEQ ID NO: 100761 - DNA, 20 bp, Artificial Sequence
  Description of Artificial Sequence: Synthetic oligonucleotide
  Target: ATXN1; (+) strand; PAM type: NRG; PAM sequence: TAG
accagtccagagctaattcc

SEQ ID NO: 100762 - DNA, 20 bp, Artificial Sequence
  Description of Artificial Sequence: Synthetic oligonucleotide
  Target: ATXN1; (+) strand; PAM type: NRG; PAM sequence: AGG
ccagtccagagctaattcct

SEQ ID NO: 100763 - DNA, 20 bp, Artificial Sequence
  Description of Artificial Sequence: Synthetic oligonucleotide
  Target: ATXN1; (+) strand; PAM type: NRG; PAM sequence: GAG
agtccagagctaattcctag

SEQ ID NO: 100764 - DNA, 20 bp, Artificial Sequence
  Description of Artificial Sequence: Synthetic oligonucleotide
  Target: ATXN1; (+) strand; PAM type: NRG; PAM sequence: CAG
actttcatatgcaaactaac

SEQ ID NO: 100765 - DNA, 20 bp, Artificial Sequence
  Description of Artificial Sequence: Synthetic oligonucleotide
  Target: ATXN1; (+) strand; PAM type: NRG; PAM sequence: CAG
catatgcaaactaaccagtc

SEQ ID NO: 100766 - DNA, 20 bp, Artificial Sequence
  Description of Artificial Sequence: Synthetic oligonucleotide
  Target: ATXN1; (+) strand; PAM type: NRG; PAM sequence: GAG
tatgcaaactaaccagtcca

SEQ ID NO: 100767 - DNA, 20 bp, Artificial Sequence
  Description of Artificial Sequence: Synthetic oligonucleotide
  Target: ATXN1; (+) strand; PAM type: NRG; PAM sequence: CAG
ccagtccagagcccactccc

SEQ ID NO: 100768 - DNA, 20 bp, Artificial Sequence
  Description of Artificial Sequence: Synthetic oligonucleotide
  Target: ATXN1; (+) strand; PAM type: NRG; PAM sequence: CAG
gtccagagcccactccccag

SEQ ID NO: 100769 - DNA, 20 bp, Artificial Sequence
  Description of Artificial Sequence: Synthetic oligonucleotide
  Target: ATXN1; (+) strand; PAM type: NRG; PAM sequence: TGG
tccccagcagcctcctatat

SEQ ID NO: 100770 - DNA, 20 bp, Artificial Sequence
  Description of Artificial Sequence: Synthetic oligonucleotide
  Target: ATXN1; (+) strand; PAM type: NRG; PAM sequence: TAG
ctatattggtccatcacact

SEQ ID NO: 100771 - DNA, 20 bp, Artificial Sequence
  Description of Artificial Sequence: Synthetic oligonucleotide
  Target: ATXN1; (+) strand; PAM type: NRG; PAM sequence: AGG
tatattggtccatcacactt

SEQ ID NO: 100772 - DNA, 20 bp, Artificial Sequence
  Description of Artificial Sequence: Synthetic oligonucleotide
  Target: ATXN1; (+) strand; PAM type: NRG; PAM sequence: GGG
atattggtccatcacactta

SEQ ID NO: 100773 - DNA, 20 bp, Artificial Sequence
  Description of Artificial Sequence: Synthetic oligonucleotide
  Target: ATXN1; (+) strand; PAM type: NRG; PAM sequence: GAG
ctgtttttttttttttgtct

SEQ ID NO: 100774 - DNA, 20 bp, Artificial Sequence
  Description of Artificial Sequence: Synthetic oligonucleotide
  Target: ATXN1; (+) strand; PAM type: NRG; PAM sequence: CAG
ttttttttttttgtctgaga

SEQ ID NO: 100775 - DNA, 20 bp, Artificial Sequence
  Description of Artificial Sequence: Synthetic oligonucleotide
  Target: ATXN1; (+) strand; PAM type: NRG; PAM sequence: GAG
ttttttttttgtctgagaca

SEQ ID NO: 100776 - DNA, 20 bp, Artificial Sequence
  Description of Artificial Sequence: Synthetic oligonucleotide
  Target: ATXN1; (+) strand; PAM type: NRG; PAM sequence: AAG
cagagtcttgctgtgtgtcc

SEQ ID NO: 100777 - DNA, 20 bp, Artificial Sequence
  Description of Artificial Sequence: Synthetic oligonucleotide
  Target: ATXN1; (+) strand; PAM type: NRG; PAM sequence: AGG
agagtcttgctgtgtgtcca

SEQ ID NO: 100778 - DNA, 20 bp, Artificial Sequence
  Description of Artificial Sequence: Synthetic oligonucleotide
  Target: ATXN1; (+) strand; PAM type: NRG; PAM sequence: TGG
tcttgctgtgtgtccaaggc

SEQ ID NO: 100779 - DNA, 20 bp, Artificial Sequence
  Description of Artificial Sequence: Synthetic oligonucleotide
  Target: ATXN1; (+) strand; PAM type: NRG; PAM sequence: GAG
ttgctgtgtgtccaaggctg

SEQ ID NO: 100780 - DNA, 20 bp, Artificial Sequence
  Description of Artificial Sequence: Synthetic oligonucleotide
  Target: ATXN1; (+) strand; PAM type: NRG; PAM sequence: CAG
gtgtgtccaaggctggagtg

SEQ ID NO: 100781 - DNA, 20 bp, Artificial Sequence
  Description of Artificial Sequence: Synthetic oligonucleotide
  Target: ATXN1; (+) strand; PAM type: NRG; PAM sequence: TGG
tgtccaaggctggagtgcag

SEQ ID NO: 100782 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggcctgatct

SEQ ID NO: 100783 - DNA, 20 bp, Artificial Sequence
  Description of Artificial Sequence: Synthetic oligonucleotide
  Target: ATXN1; (+) strand; PAM type: NRG; PAM sequence: CGG
tcactgcaatccccacctcc

SEQ ID NO: 100784 - DNA, 20 bp, Artificial Sequence
  Description of Artificial Sequence: Synthetic oligonucleotide
  Target: ATXN1; (+) strand; PAM type: NRG; PAM sequence: GGG
cactgcaatccccacctccc

SEQ ID NO: 100785 - DNA, 20 bp, Artificial Sequence
  Description of Artificial Sequence: Synthetic oligonucleotide
  Target: ATXN1; (+) strand; PAM type: NRG; PAM sequence: CAG
ttcatgcaattctcctacct

SEQ ID NO: 100786 - DNA, 20 bp, Artificial Sequence
  Description of Artificial Sequence: Synthetic oligonucleotide
  Target: ATXN1; (+) strand; PAM type: NRG; PAM sequence: TGG
aattctcctacctcagcctc

SEQ ID NO: 100787 - DNA, 20 bp, Artificial Sequence
  Description of Artificial Sequence: Synthetic oligonucleotide
  Target: ATXN1; (+) strand; PAM type: NRG; PAM sequence: GAG
ttctcctacctcagcctctg

SEQ ID NO: 100788 - DNA, 20 bp, Artificial Sequence
  Description of Artificial Sequence: Synthetic oligonucleotide
  Target: ATXN1; (+) strand; PAM type: NRG; PAM sequence: TAG
tcctacctcagcctctggag

SEQ ID NO: 100789 - DNA, 20 bp, Artificial Sequence
  Description of Artificial Sequence: Synthetic oligonucleotide
  Target: ATXN1; (+) strand; PAM type: NRG; PAM sequence: TGG
acctcagcctctggagtagc

SEQ ID NO: 100790 - DNA, 20 bp, Artificial Sequence
  Description of Artificial Sequence: Synthetic oligonucleotide
  Target: ATXN1; (+) strand; PAM type: NRG; PAM sequence: GGG
cctcagcctctggagtagct

SEQ ID NO: 100791 - DNA, 20 bp, Artificial Sequence
  Description of Artificial Sequence: Synthetic oligonucleotide
  Target: ATXN1; (+) strand; PAM type: NRG; PAM sequence: CAG
ctctggagtagctgggatta

SEQ ID NO: 100792 - DNA, 20 bp, Artificial Sequence
  Description of Artificial Sequence: Synthetic oligonucleotide
  Target: ATXN1; (+) strand; PAM type: NRG; PAM sequence: AGG
tctggagtagctgggattac

SEQ ID NO: 100793 - DNA, 20 bp, Artificial Sequence
  Description of Artificial Sequence: Synthetic oligonucleotide
  Target: ATXN1; (+) strand; PAM type: NRG; PAM sequence: CGG
caggcacacaccaccatgcc

SEQ ID NO: 100794 - DNA, 20 bp, Artificial Sequence
  Description of Artificial Sequence: Synthetic oligonucleotide
  Target: ATXN1; (+) strand; PAM type: NRG; PAM sequence: TAG
ccggctaatttttgtatttt

SEQ ID NO: 100795 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 100796 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 100797 - DNA, 20 bp, Artificial Sequence
  Description of Artificial Sequence: Synthetic oligonucleotide
  Target: ATXN1; (+) strand; PAM type: NRG; PAM sequence: CAG
ttttgtatttttagtagaga

SEQ ID NO: 100798 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagac

SEQ ID NO: 100799 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagaca

SEQ ID NO: 100800 - DNA, 20 bp, Artificial Sequence
  Description of Artificial Sequence: Synthetic oligonucleotide
  Target: ATXN1; (+) strand; PAM type: NRG; PAM sequence: TGG
gagacagggtttcaccatgt

SEQ ID NO: 100801 - DNA, 20 bp, Artificial Sequence
  Description of Artificial Sequence: Synthetic oligonucleotide
  Target: ATXN1; (+) strand; PAM type: NRG; PAM sequence: CAG
cagggtttcaccatgttggc

SEQ ID NO: 100802 - DNA, 20 bp, Artificial Sequence
  Description of Artificial Sequence: Synthetic oligonucleotide
  Target: ATXN1; (+) strand; PAM type: NRG; PAM sequence: AGG
agggtttcaccatgttggcc

SEQ ID NO: 100803 - DNA, 20 bp, Artificial Sequence
  Description of Artificial Sequence: Synthetic oligonucleotide
  Target: ATXN1; (+) strand; PAM type: NRG; PAM sequence: CGG
tttcaccatgttggccaggc

SEQ ID NO: 100804 - DNA, 20 bp, Artificial Sequence
  Description of Artificial Sequence: Synthetic oligonucleotide
  Target: ATXN1; (+) strand; PAM type: NRG; PAM sequence: TGG
ggtctcgaactcctgacctc

SEQ ID NO: 100805 - DNA, 20 bp, Artificial Sequence
  Description of Artificial Sequence: Synthetic oligonucleotide
  Target: ATXN1; (+) strand; PAM type: NRG; PAM sequence: CAG
ctctggtgatccacccgcct

SEQ ID NO: 100806 - DNA, 20 bp, Artificial Sequence
  Description of Artificial Sequence: Synthetic oligonucleotide
  Target: ATXN1; (+) strand; PAM type: NRG; PAM sequence: AAG
ccacccgcctcagcctccca

SEQ ID NO: 100807 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaaagtgc

SEQ ID NO: 100808 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgct

SEQ ID NO: 100809 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 100810 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 100811 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 100812 - DNA, 20 bp, Artificial Sequence
  Description of Artificial Sequence: Synthetic oligonucleotide
  Target: ATXN1; (+) strand; PAM type: NRG; PAM sequence: CAG
caggtgtgagccactgtgcc

SEQ ID NO: 100813 - DNA, 20 bp, Artificial Sequence
  Description of Artificial Sequence: Synthetic oligonucleotide
  Target: ATXN1; (+) strand; PAM type: NRG; PAM sequence: CAG
tccacctgtattgatcaccc

SEQ ID NO: 100814 - DNA, 20 bp, Artificial Sequence
  Description of Artificial Sequence: Synthetic oligonucleotide
  Target: ATXN1; (+) strand; PAM type: NRG; PAM sequence: CAG
tgtattgatcaccccagcac

SEQ ID NO: 100815 - DNA, 20 bp, Artificial Sequence
  Description of Artificial Sequence: Synthetic oligonucleotide
  Target: ATXN1; (+) strand; PAM type: NRG; PAM sequence: CAG
attgatcaccccagcaccag

SEQ ID NO: 100816 - DNA, 20 bp, Artificial Sequence
  Description of Artificial Sequence: Synthetic oligonucleotide
  Target: ATXN1; (+) strand; PAM type: NRG; PAM sequence: CAG
atcaccccagcaccagcagc

SEQ ID NO: 100817 - DNA, 20 bp, Artificial Sequence
  Description of Artificial Sequence: Synthetic oligonucleotide
  Target: ATXN1; (+) strand; PAM type: NRG; PAM sequence: AAG
gcaccagcagccagacaact

SEQ ID NO: 100818 - DNA, 20 bp, Artificial Sequence
  Description of Artificial Sequence: Synthetic oligonucleotide
  Target: ATXN1; (+) strand; PAM type: NRG; PAM sequence: AGG
caccagcagccagacaacta

SEQ ID NO: 100819 - DNA, 20 bp, Artificial Sequence
  Description of Artificial Sequence: Synthetic oligonucleotide
  Target: ATXN1; (+) strand; PAM type: NRG; PAM sequence: CAG
agcagccagacaactaagga

SEQ ID NO: 100820 - DNA, 20 bp, Artificial Sequence
  Description of Artificial Sequence: Synthetic oligonucleotide
  Target: ATXN1; (+) strand; PAM type: NRG; PAM sequence: CAG
taaggacagcccctacaccc

SEQ ID NO: 100821 - DNA, 20 bp, Artificial Sequence
  Description of Artificial Sequence: Synthetic oligonucleotide
  Target: ATXN1; (+) strand; PAM type: NRG; PAM sequence: GAG
aggacagcccctacacccca

SEQ ID NO: 100822 - DNA, 20 bp, Artificial Sequence
  Description of Artificial Sequence: Synthetic oligonucleotide
  Target: ATXN1; (+) strand; PAM type: NRG; PAM sequence: TGG
ccctacaccccagagcacac

SEQ ID NO: 100823 - DNA, 20 bp, Artificial Sequence
  Description of Artificial Sequence: Synthetic oligonucleotide
  Target: ATXN1; (+) strand; PAM type: NRG; PAM sequence: AAG
cctcccatgaaaccacaata

SEQ ID NO: 100824 - DNA, 20 bp, Artificial Sequence
  Description of Artificial Sequence: Synthetic oligonucleotide
  Target: ATXN1; (+) strand; PAM type: NRG; PAM sequence: AGG
ctcccatgaaaccacaataa

SEQ ID NO: 100825 - DNA, 20 bp, Artificial Sequence
  Description of Artificial Sequence: Synthetic oligonucleotide
  Target: ATXN1; (+) strand; PAM type: NRG; PAM sequence: TGG
cctccacctcctgacccacc

SEQ ID NO: 100826 - DNA, 20 bp, Artificial Sequence
  Description of Artificial Sequence: Synthetic oligonucleotide
  Target: ATXN1; (+) strand; PAM type: NRG; PAM sequence: GGG
ctccacctcctgacccacct

SEQ ID NO: 100827 - DNA, 20 bp, Artificial Sequence
  Description of Artificial Sequence: Synthetic oligonucleotide
  Target: ATXN1; (+) strand; PAM type: NRG; PAM sequence: GGG
tccacctcctgacccacctg

SEQ ID NO: 100828 - DNA, 20 bp, Artificial Sequence
  Description of Artificial Sequence: Synthetic oligonucleotide
  Target: ATXN1; (+) strand; PAM type: NRG; PAM sequence: CAG
tgacccacctggggcttccc

SEQ ID NO: 100829 - DNA, 20 bp, Artificial Sequence
  Description of Artificial Sequence: Synthetic oligonucleotide
  Target: ATXN1; (+) strand; PAM type: NRG; PAM sequence: AGG
gacccacctggggcttcccc

SEQ ID NO: 100830 - DNA, 20 bp, Artificial Sequence
  Description of Artificial Sequence: Synthetic oligonucleotide
  Target: ATXN1; (+) strand; PAM type: NRG; PAM sequence: CGG
cccaggtgccccccacttta

SEQ ID NO: 100831 - DNA, 20 bp, Artificial Sequence
  Description of Artificial Sequence: Synthetic oligonucleotide
  Target: ATXN1; (+) strand; PAM type: NRG; PAM sequence: TGG
ttacggtgttctacacctct

SEQ ID NO: 100832 - DNA, 20 bp, Artificial Sequence
  Description of Artificial Sequence: Synthetic oligonucleotide
  Target: ATXN1; (+) strand; PAM type: NRG; PAM sequence: TAG
gtgttctacacctcttggtg

SEQ ID NO: 100833 - DNA, 20 bp, Artificial Sequence
  Description of Artificial Sequence: Synthetic oligonucleotide
  Target: ATXN1; (+) strand; PAM type: NRG; PAM sequence: GAG
gttctacacctcttggtgta

SEQ ID NO: 100834 - DNA, 20 bp, Artificial Sequence
  Description of Artificial Sequence: Synthetic oligonucleotide
  Target: ATXN1; (+) strand; PAM type: NRG; PAM sequence: TGG
tgtagagtgccctttcctct

SEQ ID NO: 100835 - DNA, 20 bp, Artificial Sequence
  Description of Artificial Sequence: Synthetic oligonucleotide
  Target: ATXN1; (+) strand; PAM type: NRG; PAM sequence: GGG
gtagagtgccctttcctctt

SEQ ID NO: 100836 - DNA, 20 bp, Artificial Sequence
  Description of Artificial Sequence: Synthetic oligonucleotide
  Target: ATXN1; (+) strand; PAM type: NRG; PAM sequence: CAG
gtgccctttcctcttgggat

SEQ ID NO: 100837 - DNA, 20 bp, Artificial Sequence
  Description of Artificial Sequence: Synthetic oligonucleotide
  Target: ATXN1; (+) strand; PAM type: NRG; PAM sequence: GAG
gccctttcctcttgggatca

SEQ ID NO: 100838 - DNA, 20 bp, Artificial Sequence
  Description of Artificial Sequence: Synthetic oligonucleotide
  Target: ATXN1; (+) strand; PAM type: NRG; PAM sequence: GAG
cctttcctcttgggatcaga

SEQ ID NO: 100839 - DNA, 20 bp, Artificial Sequence
  Description of Artificial Sequence: Synthetic oligonucleotide
  Target: ATXN1; (+) strand; PAM type: NRG; PAM sequence: AAG
gtataaaaattatctcgtca

SEQ ID NO: 100840 - DNA, 20 bp, Artificial Sequence
  Description of Artificial Sequence: Synthetic oligonucleotide
  Target: ATXN1; (+) strand; PAM type: NRG; PAM sequence: GAG
ataaaaattatctcgtcaaa

SEQ ID NO: 100841 - DNA, 20 bp, Artificial Sequence
  Description of Artificial Sequence: Synthetic oligonucleotide
  Target: ATXN1; (+) strand; PAM type: NRG; PAM sequence: GAG
aaaaattatctcgtcaaaga

SEQ ID NO: 100842 - DNA, 20 bp, Artificial Sequence
  Description of Artificial Sequence: Synthetic oligonucleotide
  Target: ATXN1; (+) strand; PAM type: NRG; PAM sequence: TGG
ttgtctgctgatctatctgt

SEQ ID NO: 100843 - DNA, 20 bp, Artificial Sequence
  Description of Artificial Sequence: Synthetic oligonucleotide
  Target: ATXN1; (+) strand; PAM type: NRG; PAM sequence: AAG
ccttatcatacctaaataat

SEQ ID NO: 100844 - DNA, 20 bp, Artificial Sequence
  Description of Artificial Sequence: Synthetic oligonucleotide
  Target: ATXN1; (+) strand; PAM type: NRG; PAM sequence: TGG
ataagacattatatatatgt

SEQ ID NO: 100845 - DNA, 20 bp, Artificial Sequence
  Description of Artificial Sequence: Synthetic oligonucleotide
  Target: ATXN1; (+) strand; PAM type: NRG; PAM sequence: GAG
aagacattatatatatgttg

SEQ ID NO: 100846 - DNA, 20 bp, Artificial Sequence
  Description of Artificial Sequence: Synthetic oligonucleotide
  Target: ATXN1; (+) strand; PAM type: NRG; PAM sequence: CGG
attatatatatgttggagac

SEQ ID NO: 100847 - DNA, 20 bp, Artificial Sequence
  Description of Artificial Sequence: Synthetic oligonucleotide
  Target: ATXN1; (+) strand; PAM type: NRG; PAM sequence: GGG
ttatatatatgttggagacc

SEQ ID NO: 100848 - DNA, 20 bp, Artificial Sequence
  Description of Artificial Sequence: Synthetic oligonucleotide
  Target: ATXN1; (+) strand; PAM type: NRG; PAM sequence: CAG
ccgggccttgctatgttgcc

SEQ ID NO: 100849 - DNA, 20 bp, Artificial Sequence
  Description of Artificial Sequence: Synthetic oligonucleotide
  Target: ATXN1; (+) strand; PAM type: NRG; PAM sequence: AGG
cgggccttgctatgttgccc

SEQ ID NO: 100850 - DNA, 20 bp, Artificial Sequence
  Description of Artificial Sequence: Synthetic oligonucleotide
  Target: ATXN1; (+) strand; PAM type: NRG; PAM sequence: GAG
ttgctatgttgcccaggctt

SEQ ID NO: 100851 - DNA, 20 bp, Artificial Sequence
  Description of Artificial Sequence: Synthetic oligonucleotide
  Target: ATXN1; (+) strand; PAM type: NRG; PAM sequence: CAG
atgttgcccaggcttgagtg

SEQ ID NO: 100852 - DNA, 20 bp, Artificial Sequence
  Description of Artificial Sequence: Synthetic oligonucleotide
  Target: ATXN1; (+) strand; PAM type: NRG; PAM sequence: TAG
cccaggcttgagtgcagtga

SEQ ID NO: 100853 - DNA, 20 bp, Artificial Sequence
  Description of Artificial Sequence: Synthetic oligonucleotide
  Target: ATXN1; (+) strand; PAM type: NRG; PAM sequence: CAG
cttgagtgcagtgatagtca

SEQ ID NO: 100854 - DNA, 20 bp, Artificial Sequence
  Description of Artificial Sequence: Synthetic oligonucleotide
  Target: ATXN1; (+) strand; PAM type: NRG; PAM sequence: AGG
ttgagtgcagtgatagtcac

SEQ ID NO: 100855 - DNA, 20 bp, Artificial Sequence
  Description of Artificial Sequence: Synthetic oligonucleotide
  Target: ATXN1; (+) strand; PAM type: NRG; PAM sequence: CAG
tgcagtgatagtcacaggtt

SEQ ID NO: 100856 - DNA, 20 bp, Artificial Sequence
  Description of Artificial Sequence: Synthetic oligonucleotide
  Target: ATXN1; (+) strand; PAM type: NRG; PAM sequence: TAG
gatagtcacaggttcagcca

SEQ ID NO: 100857 - DNA, 20 bp, Artificial Sequence
  Description of Artificial Sequence: Synthetic oligonucleotide
  Target: ATXN1; (+) strand; PAM type: NRG; PAM sequence: CAG
ggttcagccatagctcacta

SEQ ID NO: 100858 - DNA, 20 bp, Artificial Sequence
  Description of Artificial Sequence: Synthetic oligonucleotide
  Target: ATXN1; (+) strand; PAM type: NRG; PAM sequence: TGG
tcactacagcctcgaactcc

SEQ ID NO: 100859 - DNA, 20 bp, Artificial Sequence
  Description of Artificial Sequence: Synthetic oligonucleotide
  Target: ATXN1; (+) strand; PAM type: NRG; PAM sequence: GGG
cactacagcctcgaactcct

SEQ ID NO: 100860 - DNA, 20 bp, Artificial Sequence
  Description of Artificial Sequence: Synthetic oligonucleotide
  Target: ATXN1; (+) strand; PAM type: NRG; PAM sequence: AAG
agcctcgaactcctgggctc

SEQ ID NO: 100861 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatcctcctgcct

SEQ ID NO: 100862 - DNA, 20 bp, Artificial Sequence
  Description of Artificial Sequence: Synthetic oligonucleotide
  Target: ATXN1; (+) strand; PAM type: NRG; PAM sequence: TGG
gatcctcctgcctcagtctc

SEQ ID NO: 100863 - DNA, 20 bp, Artificial Sequence
  Description of Artificial Sequence: Synthetic oligonucleotide
  Target: ATXN1; (+) strand; PAM type: NRG; PAM sequence: GAG
tcctcctgcctcagtctctg

SEQ ID NO: 100864 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagtctctggag

SEQ ID NO: 100865 - DNA, 20 bp, Artificial Sequence
  Description of Artificial Sequence: Synthetic oligonucleotide
  Target: ATXN1; (+) strand; PAM type: NRG; PAM sequence: TGG
gcctcagtctctggagtagc

SEQ ID NO: 100866 - DNA, 20 bp, Artificial Sequence
  Description of Artificial Sequence: Synthetic oligonucleotide
  Target: ATXN1; (+) strand; PAM type: NRG; PAM sequence: GGG
cctcagtctctggagtagct

SEQ ID NO: 100867 - DNA, 20 bp, Artificial Sequence
  Description of Artificial Sequence: Synthetic oligonucleotide
  Target: ATXN1; (+) strand; PAM type: NRG; PAM sequence: AAG
ctctggagtagctgggaccg

SEQ ID NO: 100868 - DNA, 20 bp, Artificial Sequence
  Description of Artificial Sequence: Synthetic oligonucleotide
  Target: ATXN1; (+) strand; PAM type: NRG; PAM sequence: AGG
tctggagtagctgggaccga

SEQ ID NO: 100869 - DNA, 20 bp, Artificial Sequence
  Description of Artificial Sequence: Synthetic oligonucleotide
  Target: ATXN1; (+) strand; PAM type: NRG; PAM sequence: CAG
aaggcatataccactgtacc

SEQ ID NO: 100870 - DNA, 20 bp, Artificial Sequence
  Description of Artificial Sequence: Synthetic oligonucleotide
  Target: ATXN1; (+) strand; PAM type: NRG; PAM sequence: AAG
taccactgtacccagctaat

SEQ ID NO: 100871 - DNA, 20 bp, Artificial Sequence
  Description of Artificial Sequence: Synthetic oligonucleotide
  Target: ATXN1; (+) strand; PAM type: NRG; PAM sequence: TGG
ataagacatattttaaaaca

SEQ ID NO: 100872 - DNA, 20 bp, Artificial Sequence
  Description of Artificial Sequence: Synthetic oligonucleotide
  Target: ATXN1; (+) strand; PAM type: NRG; PAM sequence: TGG
ttaaaacatggatgttgcaa

SEQ ID NO: 100873 - DNA, 20 bp, Artificial Sequence
  Description of Artificial Sequence: Synthetic oligonucleotide
  Target: ATXN1; (+) strand; PAM type: NRG; PAM sequence: GGG
taaaacatggatgttgcaat

SEQ ID NO: 100874 - DNA, 20 bp, Artificial Sequence
  Description of Artificial Sequence: Synthetic oligonucleotide
  Target: ATXN1; (+) strand; PAM type: NRG; PAM sequence: TAG
gcaatgggatatgattgctt

SEQ ID NO: 100875 - DNA, 20 bp, Artificial Sequence
  Description of Artificial Sequence: Synthetic oligonucleotide
  Target: ATXN1; (+) strand; PAM type: NRG; PAM sequence: CGG
atctaatcccctcactccaa

SEQ ID NO: 100876 - DNA, 20 bp, Artificial Sequence
  Description of Artificial Sequence: Synthetic oligonucleotide
  Target: ATXN1; (+) strand; PAM type: NRG; PAM sequence: TGG
cggcatcctctgtcttttcc

SEQ ID NO: 100877 - DNA, 20 bp, Artificial Sequence
  Description of Artificial Sequence: Synthetic oligonucleotide
  Target: ATXN1; (+) strand; PAM type: NRG; PAM sequence: AAG
atcctctgtcttttcctggt

SEQ ID NO: 100878 - DNA, 20 bp, Artificial Sequence
  Description of Artificial Sequence: Synthetic oligonucleotide
  Target: ATXN1; (+) strand; PAM type: NRG; PAM sequence: AAG
tgtcttttcctggtaagaaa

SEQ ID NO: 100879 - DNA, 20 bp, Artificial Sequence
  Description of Artificial Sequence: Synthetic oligonucleotide
  Target: ATXN1; (+) strand; PAM type: NRG; PAM sequence: TAG
aaaaagtgccgaatgaccac

SEQ ID NO: 100880 - DNA, 20 bp, Artificial Sequence
  Description of Artificial Sequence: Synthetic oligonucleotide
  Target: ATXN1; (+) strand; PAM type: NRG; PAM sequence: AAG
aagtgccgaatgaccactag

SEQ ID NO: 100881 - DNA, 20 bp, Artificial Sequence
  Description of Artificial Sequence: Synthetic oligonucleotide
  Target: ATXN1; (+) strand; PAM type: NRG; PAM sequence: AGG
agtgccgaatgaccactaga

SEQ ID NO: 100882 - DNA, 20 bp, Artificial Sequence
  Description of Artificial Sequence: Synthetic oligonucleotide
  Target: ATXN1; (+) strand; PAM type: NRG; PAM sequence: AAG
atgaccactagaaggacctg

SEQ ID NO: 100883 - DNA, 20 bp, Artificial Sequence
  Description of Artificial Sequence: Synthetic oligonucleotide
  Target: ATXN1; (+) strand; PAM type: NRG; PAM sequence: CAG
cactagaaggacctgaagtc

SEQ ID NO: 100884 - DNA, 20 bp, Artificial Sequence
  Description of Artificial Sequence: Synthetic oligonucleotide
  Target: ATXN1; (+) strand; PAM type: NRG; PAM sequence: CAG
tagaaggacctgaagtccag

SEQ ID NO: 100885 - DNA, 20 bp, Artificial Sequence
  Description of Artificial Sequence: Synthetic oligonucleotide
  Target: ATXN1; (+) strand; PAM type: NRG; PAM sequence: CAG
gtccagcagcgtttcctaat

SEQ ID NO: 100886 - DNA, 20 bp, Artificial Sequence
  Description of Artificial Sequence: Synthetic oligonucleotide
  Target: ATXN1; (+) strand; PAM type: NRG; PAM sequence: AGG
tccagcagcgtttcctaatc

SEQ ID NO: 100887 - DNA, 20 bp, Artificial Sequence
  Description of Artificial Sequence: Synthetic oligonucleotide
  Target: ATXN1; (+) strand; PAM type: NRG; PAM sequence: GGG
ccagcagcgtttcctaatca

SEQ ID NO: 100888 - DNA, 20 bp, Artificial Sequence
  Description of Artificial Sequence: Synthetic oligonucleotide
  Target: ATXN1; (+) strand; PAM type: NRG; PAM sequence: CAG
agggttcctcatcttaatca

SEQ ID NO: 100889 - DNA, 20 bp, Artificial Sequence
  Description of Artificial Sequence: Synthetic oligonucleotide
  Target: ATXN1; (+) strand; PAM type: NRG; PAM sequence: TAG
cacagaattcaaaaaataac

SEQ ID NO: 100890 - DNA, 20 bp, Artificial Sequence
  Description of Artificial Sequence: Synthetic oligonucleotide
  Target: ATXN1; (+) strand; PAM type: NRG; PAM sequence: GAG
cagaattcaaaaaataacta

SEQ ID NO: 100891 - DNA, 20 bp, Artificial Sequence
  Description of Artificial Sequence: Synthetic oligonucleotide
  Target: ATXN1; (+) strand; PAM type: NRG; PAM sequence: TGG
aattcaaaaaataactagag

SEQ ID NO: 100892 - DNA, 20 bp, Artificial Sequence
  Description of Artificial Sequence: Synthetic oligonucleotide
  Target: ATXN1; (+) strand; PAM type: NRG; PAM sequence: GAG
caaaaaataactagagtggt

SEQ ID NO: 100893 - DNA, 20 bp, Artificial Sequence
  Description of Artificial Sequence: Synthetic oligonucleotide
  Target: ATXN1; (+) strand; PAM type: NRG; PAM sequence: TGG
taactagagtggtgagtttc

SEQ ID NO: 100894 - DNA, 20 bp, Artificial Sequence
  Description of Artificial Sequence: Synthetic oligonucleotide
  Target: ATXN1; (+) strand; PAM type: NRG; PAM sequence: AAG
gtgagtttctggattgtctc

SEQ ID NO: 100895 - DNA, 20 bp, Artificial Sequence
  Description of Artificial Sequence: Synthetic oligonucleotide
  Target: ATXN1; (+) strand; PAM type: NRG; PAM sequence: AGG
tgagtttctggattgtctca

SEQ ID NO: 100896 - DNA, 20 bp, Artificial Sequence
  Description of Artificial Sequence: Synthetic oligonucleotide
  Target: ATXN1; (+) strand; PAM type: NRG; PAM sequence: TAG
tgtctcaaggactccataac

SEQ ID NO: 100897 - DNA, 20 bp, Artificial Sequence
  Description of Artificial Sequence: Synthetic oligonucleotide
  Target: ATXN1; (+) strand; PAM type: NRG; PAM sequence: TGG
ctagccccactctccatgca

SEQ ID NO: 100898 - DNA, 20 bp, Artificial Sequence
  Description of Artificial Sequence: Synthetic oligonucleotide
  Target: ATXN1; (+) strand; PAM type: NRG; PAM sequence: GAG
agccccactctccatgcatg

SEQ ID NO: 100899 - DNA, 20 bp, Artificial Sequence
  Description of Artificial Sequence: Synthetic oligonucleotide
  Target: ATXN1; (+) strand; PAM type: NRG; PAM sequence: AGG
gccccactctccatgcatgg

SEQ ID NO: 100900 - DNA, 20 bp, Artificial Sequence
  Description of Artificial Sequence: Synthetic oligonucleotide
  Target: ATXN1; (+) strand; PAM type: NRG; PAM sequence: CAG
ggaggttaattcattacaca

SEQ ID NO: 100901 - DNA, 20 bp, Artificial Sequence
  Description of Artificial Sequence: Synthetic oligonucleotide
  Target: ATXN1; (+) strand; PAM type: NRG; PAM sequence: CAG
ggttaattcattacacacag

SEQ ID NO: 100902 - DNA, 20 bp, Artificial Sequence
  Description of Artificial Sequence: Synthetic oligonucleotide
  Target: ATXN1; (+) strand; PAM type: NRG; PAM sequence: GAG
ttaattcattacacacagca

SEQ ID NO: 100903 - DNA, 20 bp, Artificial Sequence
  Description of Artificial Sequence: Synthetic oligonucleotide
  Target: ATXN1; (+) strand; PAM type: NRG; PAM sequence: CGG
attacacacagcagagatca

SEQ ID NO: 100904 - DNA, 20 bp, Artificial Sequence
  Description of Artificial Sequence: Synthetic oligonucleotide
  Target: ATXN1; (+) strand; PAM type: NRG; PAM sequence: GGG
ttacacacagcagagatcac

SEQ ID NO: 100905 - DNA, 20 bp, Artificial Sequence
  Description of Artificial Sequence: Synthetic oligonucleotide
  Target: ATXN1; (+) strand; PAM type: NRG; PAM sequence: GGG
tacacacagcagagatcacg

SEQ ID NO: 100906 - DNA, 20 bp, Artificial Sequence
  Description of Artificial Sequence: Synthetic oligonucleotide
  Target: ATXN1; (+) strand; PAM type: NRG; PAM sequence: TGG
cagcagagatcacggggaaa

SEQ ID NO: 100907 - DNA, 20 bp, Artificial Sequence
  Description of Artificial Sequence: Synthetic oligonucleotide
  Target: ATXN1; (+) strand; PAM type: NRG; PAM sequence: GGG
agcagagatcacggggaaat

SEQ ID NO: 100908 - DNA, 20 bp, Artificial Sequence
  Description of Artificial Sequence: Synthetic oligonucleotide
  Target: ATXN1; (+) strand; PAM type: NRG; PAM sequence: GGG
gcagagatcacggggaaatg

SEQ ID NO: 100909 - DNA, 20 bp, Artificial Sequence
  Description of Artificial Sequence: Synthetic oligonucleotide
  Target: ATXN1; (+) strand; PAM type: NRG; PAM sequence: TAG
gaaatggggcttattttttc

SEQ ID NO: 100910 - DNA, 20 bp, Artificial Sequence
  Description of Artificial Sequence: Synthetic oligonucleotide
  Target: ATXN1; (+) strand; PAM type: NRG; PAM sequence: GAG
aatggggcttattttttcta

SEQ ID NO: 100911 - DNA, 20 bp, Artificial Sequence
  Description of Artificial Sequence: Synthetic oligonucleotide
  Target: ATXN1; (+) strand; PAM type: NRG; PAM sequence: CAG
cttattttttctagagaacg

SEQ ID NO: 100912 - DNA, 20 bp, Artificial Sequence
  Description of Artificial Sequence: Synthetic oligonucleotide
  Target: ATXN1; (+) strand; PAM type: NRG; PAM sequence: TGG
ttttttctagagaacgcagt

SEQ ID NO: 100913 - DNA, 20 bp, Artificial Sequence
  Description of Artificial Sequence: Synthetic oligonucleotide
  Target: ATXN1; (+) strand; PAM type: NRG; PAM sequence: GGG
tttttctagagaacgcagtt

SEQ ID NO: 100914 - DNA, 20 bp, Artificial Sequence
  Description of Artificial Sequence: Synthetic oligonucleotide
  Target: ATXN1; (+) strand; PAM type: NRG; PAM sequence: AAG
tctagagaacgcagttggga

SEQ ID NO: 100915 - DNA, 20 bp, Artificial Sequence
  Description of Artificial Sequence: Synthetic oligonucleotide
  Target: ATXN1; (+) strand; PAM type: NRG; PAM sequence: AGG
ctagagaacgcagttgggaa

SEQ ID NO: 100916 - DNA, 20 bp, Artificial Sequence
  Description of Artificial Sequence: Synthetic oligonucleotide
  Target: ATXN1; (+) strand; PAM type: NRG; PAM sequence: GAG
gaacgcagttgggaaaggcc

SEQ ID NO: 100917 - DNA, 20 bp, Artificial Sequence
  Description of Artificial Sequence: Synthetic oligonucleotide
  Target: ATXN1; (+) strand; PAM type: NRG; PAM sequence: AAG
agttgggaaaggccgagtct

SEQ ID NO: 100918 - DNA, 20 bp, Artificial Sequence
  Description of Artificial Sequence: Synthetic oligonucleotide
  Target: ATXN1; (+) strand; PAM type: NRG; PAM sequence: AGG
gttgggaaaggccgagtcta

SEQ ID NO: 100919 - DNA, 20 bp, Artificial Sequence
  Description of Artificial Sequence: Synthetic oligonucleotide
  Target: ATXN1; (+) strand; PAM type: NRG; PAM sequence: TAG
gaaaggccgagtctaaggtc

SEQ ID NO: 100920 - DNA, 20 bp, Artificial Sequence
  Description of Artificial Sequence: Synthetic oligonucleotide
  Target: ATXN1; (+) strand; PAM type: NRG; PAM sequence: AGG
aaaggccgagtctaaggtct

SEQ ID NO: 100921 - DNA, 20 bp, Artificial Sequence
  Description of Artificial Sequence: Synthetic oligonucleotide
  Target: ATXN1; (+) strand; PAM type: NRG; PAM sequence: GAG
tctaaggtctaggtgtaccc

SEQ ID NO: 100922 - DNA, 20 bp, Artificial Sequence
  Description of Artificial Sequence: Synthetic oligonucleotide
  Target: ATXN1; (+) strand; PAM type: NRG; PAM sequence: TAG
gaacccttaatcctgcctca

SEQ ID NO: 100923 - DNA, 20 bp, Artificial Sequence
  Description of Artificial Sequence: Synthetic oligonucleotide
  Target: ATXN1; (+) strand; PAM type: NRG; PAM sequence: AAG
cccttaatcctgcctcatag

SEQ ID NO: 100924 - DNA, 20 bp, Artificial Sequence
  Description of Artificial Sequence: Synthetic oligonucleotide
  Target: ATXN1; (+) strand; PAM type: NRG; PAM sequence: CAG
atagaagcaattcgtcttgc

SEQ ID NO: 100925 - DNA, 20 bp, Artificial Sequence
  Description of Artificial Sequence: Synthetic oligonucleotide
  Target: ATXN1; (+) strand; PAM type: NRG; PAM sequence: AGG
tagaagcaattcgtcttgcc

SEQ ID NO: 100926 - DNA, 20 bp, Artificial Sequence
  Description of Artificial Sequence: Synthetic oligonucleotide
  Target: ATXN1; (+) strand; PAM type: NRG; PAM sequence: GAG
gaagcaattcgtcttgccag

SEQ ID NO: 100927 - DNA, 20 bp, Artificial Sequence
  Description of Artificial Sequence: Synthetic oligonucleotide
  Target: ATXN1; (+) strand; PAM type: NRG; PAM sequence: TGG
gtcttgccaggagatgatga

SEQ ID NO: 100928 - DNA, 20 bp, Artificial Sequence
  Description of Artificial Sequence: Synthetic oligonucleotide
  Target: ATXN1; (+) strand; PAM type: NRG; PAM sequence: CGG
aggagatgatgatggcatca

SEQ ID NO: 100929 - DNA, 20 bp, Artificial Sequence
  Description of Artificial Sequence: Synthetic oligonucleotide
  Target: ATXN1; (+) strand; PAM type: NRG; PAM sequence: TGG
atgatgatggcatcacggtg

SEQ ID NO: 100930 - DNA, 20 bp, Artificial Sequence
  Description of Artificial Sequence: Synthetic oligonucleotide
  Target: ATXN1; (+) strand; PAM type: NRG; PAM sequence: TGG
gtcccatccctgtgccaccc

SEQ ID NO: 100931 - DNA, 20 bp, Artificial Sequence
  Description of Artificial Sequence: Synthetic oligonucleotide
  Target: ATXN1; (+) strand; PAM type: NRG; PAM sequence: TGG
ccaccctggctaacgttacc

SEQ ID NO: 100932 - DNA, 20 bp, Artificial Sequence
  Description of Artificial Sequence: Synthetic oligonucleotide
  Target: ATXN1; (+) strand; PAM type: NRG; PAM sequence: GGG
caccctggctaacgttacct

SEQ ID NO: 100933 - DNA, 20 bp, Artificial Sequence
  Description of Artificial Sequence: Synthetic oligonucleotide
  Target: ATXN1; (+) strand; PAM type: NRG; PAM sequence: CGG
tggctaacgttacctgggct

SEQ ID NO: 100934 - DNA, 20 bp, Artificial Sequence
  Description of Artificial Sequence: Synthetic oligonucleotide
  Target: ATXN1; (+) strand; PAM type: NRG; PAM sequence: CGG
ctgggctcggtgctccccga

SEQ ID NO: 100935 - DNA, 20 bp, Artificial Sequence
  Description of Artificial Sequence: Synthetic oligonucleotide
  Target: ATXN1; (+) strand; PAM type: NRG; PAM sequence: CGG
cccgacggcgaactgtatca

SEQ ID NO: 100936 - DNA, 20 bp, Artificial Sequence
  Description of Artificial Sequence: Synthetic oligonucleotide
  Target: ATXN1; (+) strand; PAM type: NRG; PAM sequence: CGG
aactgtatcacggccacgcc

SEQ ID NO: 100937 - DNA, 20 bp, Artificial Sequence
  Description of Artificial Sequence: Synthetic oligonucleotide
  Target: ATXN1; (+) strand; PAM type: NRG; PAM sequence: GGG
actgtatcacggccacgccc

SEQ ID NO: 100938 - DNA, 20 bp, Artificial Sequence
  Description of Artificial Sequence: Synthetic oligonucleotide
  Target: ATXN1; (+) strand; PAM type: NRG; PAM sequence: TGG
tcacggccacgcccgggcta

SEQ ID NO: 100939 - DNA, 20 bp, Artificial Sequence
  Description of Artificial Sequence: Synthetic oligonucleotide
  Target: ATXN1; (+) strand; PAM type: NRG; PAM sequence: CGG
gctgtcttcaatcctctcta

SEQ ID NO: 100940 - DNA, 20 bp, Artificial Sequence
  Description of Artificial Sequence: Synthetic oligonucleotide
  Target: ATXN1; (+) strand; PAM type: NRG; PAM sequence: TGG
ttcaatcctctctacggtgc

SEQ ID NO: 100941 - DNA, 20 bp, Artificial Sequence
  Description of Artificial Sequence: Synthetic oligonucleotide
  Target: ATXN1; (+) strand; PAM type: NRG; PAM sequence: GAG
caatcctctctacggtgctg

SEQ ID NO: 100942 - DNA, 20 bp, Artificial Sequence
  Description of Artificial Sequence: Synthetic oligonucleotide
  Target: ATXN1; (+) strand; PAM type: NRG; PAM sequence: CAG
acggtgctggagtcgatctt

SEQ ID NO: 100943 - DNA, 20 bp, Artificial Sequence
  Description of Artificial Sequence: Synthetic oligonucleotide
  Target: ATXN1; (+) strand; PAM type: NRG; PAM sequence: AGG
cggtgctggagtcgatcttc

SEQ ID NO: 100944 - DNA, 20 bp, Artificial Sequence
  Description of Artificial Sequence: Synthetic oligonucleotide
  Target: ATXN1; (+) strand; PAM type: NRG; PAM sequence: TGG
cgttgcttatctctgcactc

SEQ ID NO: 100945 - DNA, 20 bp, Artificial Sequence
  Description of Artificial Sequence: Synthetic oligonucleotide
  Target: ATXN1; (+) strand; PAM type: NRG; PAM sequence: AAG
ggatgaaatcttctgttttt

SEQ ID NO: 100946 - DNA, 20 bp, Artificial Sequence
  Description of Artificial Sequence: Synthetic oligonucleotide
  Target: ATXN1; (+) strand; PAM type: NRG; PAM sequence: TAG
tttaagtcttccaccttctt

SEQ ID NO: 100947 - DNA, 20 bp, Artificial Sequence
  Description of Artificial Sequence: Synthetic oligonucleotide
  Target: ATXN1; (+) strand; PAM type: NRG; PAM sequence: TGG
caccttctttagctccccgt

SEQ ID NO: 100948 - DNA, 20 bp, Artificial Sequence
  Description of Artificial Sequence: Synthetic oligonucleotide
  Target: ATXN1; (+) strand; PAM type: NRG; PAM sequence: TGG
ttagctccccgttggccaac

SEQ ID NO: 100949 - DNA, 20 bp, Artificial Sequence
  Description of Artificial Sequence: Synthetic oligonucleotide
  Target: ATXN1; (+) strand; PAM type: NRG; PAM sequence: TGG
cccgttggccaactggatga

SEQ ID NO: 100950 - DNA, 20 bp, Artificial Sequence
  Description of Artificial Sequence: Synthetic oligonucleotide
  Target: ATXN1; (+) strand; PAM type: NRG; PAM sequence: GAG
cgttggccaactggatgatg

SEQ ID NO: 100951 - DNA, 20 bp, Artificial Sequence
  Description of Artificial Sequence: Synthetic oligonucleotide
  Target: ATXN1; (+) strand; PAM type: NRG; PAM sequence: AAG
ggatgatggagcctttcatg

SEQ ID NO: 100952 - DNA, 20 bp, Artificial Sequence
  Description of Artificial Sequence: Synthetic oligonucleotide
  Target: ATXN1; (+) strand; PAM type: NRG; PAM sequence: TAG
tgatggagcctttcatgaag

SEQ ID NO: 100953 - DNA, 20 bp, Artificial Sequence
  Description of Artificial Sequence: Synthetic oligonucleotide
  Target: ATXN1; (+) strand; PAM type: NRG; PAM sequence: AGG
gatggagcctttcatgaagt

SEQ ID NO: 100954 - DNA, 20 bp, Artificial Sequence
  Description of Artificial Sequence: Synthetic oligonucleotide
  Target: ATXN1; (+) strand; PAM type: NRG; PAM sequence: GGG
atggagcctttcatgaagta

SEQ ID NO: 100955 - DNA, 20 bp, Artificial Sequence
  Description of Artificial Sequence: Synthetic oligonucleotide
  Target: ATXN1; (+) strand; PAM type: NRG; PAM sequence: GAG
ggagcctttcatgaagtagg

SEQ ID NO: 100956 - DNA, 20 bp, Artificial Sequence
  Description of Artificial Sequence: Synthetic oligonucleotide
  Target: ATXN1; (+) strand; PAM type: NRG; PAM sequence: AGG
gagcctttcatgaagtaggg

SEQ ID NO: 100957 - DNA, 20 bp, Artificial Sequence
  Description of Artificial Sequence: Synthetic oligonucleotide
  Target: ATXN1; (+) strand; PAM type: NRG; PAM sequence: CAG
cctttcatgaagtagggagg

SEQ ID NO: 100958 - DNA, 20 bp, Artificial Sequence
  Description of Artificial Sequence: Synthetic oligonucleotide
  Target: ATXN1; (+) strand; PAM type: NRG; PAM sequence: TAG
catgaagtagggaggcagcg

SEQ ID NO: 100959 - DNA, 20 bp, Artificial Sequence
  Description of Artificial Sequence: Synthetic oligonucleotide
  Target: ATXN1; (+) strand; PAM type: NRG; PAM sequence: AGG
atgaagtagggaggcagcgt

SEQ ID NO: 100960 - DNA, 20 bp, Artificial Sequence
  Description of Artificial Sequence: Synthetic oligonucleotide
  Target: ATXN1; (+) strand; PAM type: NRG; PAM sequence: GGG
tgaagtagggaggcagcgta

SEQ ID NO: 100961 - DNA, 20 bp, Artificial Sequence
  Description of Artificial Sequence: Synthetic oligonucleotide
  Target: ATXN1; (+) strand; PAM type: NRG; PAM sequence: GGG
gaagtagggaggcagcgtag

SEQ ID NO: 100962 - DNA, 20 bp, Artificial Sequence
  Description of Artificial Sequence: Synthetic oligonucleotide
  Target: ATXN1; (+) strand; PAM type: NRG; PAM sequence: GGG
aagtagggaggcagcgtagg

SEQ ID NO: 100963 - DNA, 20 bp, Artificial Sequence
  Description of Artificial Sequence: Synthetic oligonucleotide
  Target: ATXN1; (+) strand; PAM type: NRG; PAM sequence: GAG
gtagggaggcagcgtagggg

SEQ ID NO: 100964 - DNA, 20 bp, Artificial Sequence
  Description of Artificial Sequence: Synthetic oligonucleotide
  Target: ATXN1; (+) strand; PAM type: NRG; PAM sequence: CGG
agcgtagggggagccgccgc

SEQ ID NO: 100965 - DNA, 20 bp, Artificial Sequence
  Description of Artificial Sequence: Synthetic oligonucleotide
  Target: ATXN1; (+) strand; PAM type: NRG; PAM sequence: GGG
gcgtagggggagccgccgcc

SEQ ID NO: 100966 - DNA, 20 bp, Artificial Sequence
  Description of Artificial Sequence: Synthetic oligonucleotide
  Target: ATXN1; (+) strand; PAM type: NRG; PAM sequence: GGG
cgtagggggagccgccgccg

SEQ ID NO: 100967 - DNA, 20 bp, Artificial Sequence
  Description of Artificial Sequence: Synthetic oligonucleotide
  Target: ATXN1; (+) strand; PAM type: NRG; PAM sequence: GAG
tagggggagccgccgccggg

SEQ ID NO: 100968 - DNA, 20 bp, Artificial Sequence
  Description of Artificial Sequence: Synthetic oligonucleotide
  Target: ATXN1; (+) strand; PAM type: NRG; PAM sequence: AGG
agggggagccgccgccgggg

SEQ ID NO: 100969 - DNA, 20 bp, Artificial Sequence
  Description of Artificial Sequence: Synthetic oligonucleotide
  Target: ATXN1; (+) strand; PAM type: NRG; PAM sequence: CGG
agccgccgccggggaggcca

SEQ ID NO: 100970 - DNA, 20 bp, Artificial Sequence
  Description of Artificial Sequence: Synthetic oligonucleotide
  Target: ATXN1; (+) strand; PAM type: NRG; PAM sequence: CAG
ggaggccacggactgcacca

SEQ ID NO: 100971 - DNA, 20 bp, Artificial Sequence
  Description of Artificial Sequence: Synthetic oligonucleotide
  Target: ATXN1; (+) strand; PAM type: NRG; PAM sequence: AGG
gaggccacggactgcaccac

SEQ ID NO: 100972 - DNA, 20 bp, Artificial Sequence
  Description of Artificial Sequence: Synthetic oligonucleotide
  Target: ATXN1; (+) strand; PAM type: NRG; PAM sequence: CAG
gccacggactgcaccacagg

SEQ ID NO: 100973 - DNA, 20 bp, Artificial Sequence
  Description of Artificial Sequence: Synthetic oligonucleotide
  Target: ATXN1; (+) strand; PAM type: NRG; PAM sequence: AGG
ccacggactgcaccacaggc

SEQ ID NO: 100974 - DNA, 20 bp, Artificial Sequence
  Description of Artificial Sequence: Synthetic oligonucleotide
  Target: ATXN1; (+) strand; PAM type: NRG; PAM sequence: TGG
cggactgcaccacaggcagg

SEQ ID NO: 100975 - DNA, 20 bp, Artificial Sequence
  Description of Artificial Sequence: Synthetic oligonucleotide
  Target: ATXN1; (+) strand; PAM type: NRG; PAM sequence: TGG
gcaccacaggcaggtggatc

SEQ ID NO: 100976 - DNA, 20 bp, Artificial Sequence
  Description of Artificial Sequence: Synthetic oligonucleotide
  Target: ATXN1; (+) strand; PAM type: NRG; PAM sequence: GGG
caccacaggcaggtggatct

SEQ ID NO: 100977 - DNA, 20 bp, Artificial Sequence
  Description of Artificial Sequence: Synthetic oligonucleotide
  Target: ATXN1; (+) strand; PAM type: NRG; PAM sequence: TGG
gtggatctgggcctgcacca

SEQ ID NO: 100978 - DNA, 20 bp, Artificial Sequence
  Description of Artificial Sequence: Synthetic oligonucleotide
  Target: ATXN1; (+) strand; PAM type: NRG; PAM sequence: TGG
atctgggcctgcaccatggc

SEQ ID NO: 100979 - DNA, 20 bp, Artificial Sequence
  Description of Artificial Sequence: Synthetic oligonucleotide
  Target: ATXN1; (+) strand; PAM type: NRG; PAM sequence: GGG
tctgggcctgcaccatggct

SEQ ID NO: 100980 - DNA, 20 bp, Artificial Sequence
  Description of Artificial Sequence: Synthetic oligonucleotide
  Target: ATXN1; (+) strand; PAM type: NRG; PAM sequence: TAG
gggcctgcaccatggctggg

SEQ ID NO: 100981 - DNA, 20 bp, Artificial Sequence
  Description of Artificial Sequence: Synthetic oligonucleotide
  Target: ATXN1; (+) strand; PAM type: NRG; PAM sequence: AGG
ggcctgcaccatggctgggt

SEQ ID NO: 100982 - DNA, 20 bp, Artificial Sequence
  Description of Artificial Sequence: Synthetic oligonucleotide
  Target: ATXN1; (+) strand; PAM type: NRG; PAM sequence: CGG
ctgcaccatggctgggtagg

SEQ ID NO: 100983 - DNA, 20 bp, Artificial Sequence
  Description of Artificial Sequence: Synthetic oligonucleotide
  Target: ATXN1; (+) strand; PAM type: NRG; PAM sequence: TGG
ccatggctgggtaggcggcc

SEQ ID NO: 100984 - DNA, 20 bp, Artificial Sequence
  Description of Artificial Sequence: Synthetic oligonucleotide
  Target: ATXN1; (+) strand; PAM type: NRG; PAM sequence: GGG
catggctgggtaggcggcct

SEQ ID NO: 100985 - DNA, 20 bp, Artificial Sequence
  Description of Artificial Sequence: Synthetic oligonucleotide
  Target: ATXN1; (+) strand; PAM type: NRG; PAM sequence: CAG
gggtaggcggcctgggtgac

SEQ ID NO: 100986 - DNA, 20 bp, Artificial Sequence
  Description of Artificial Sequence: Synthetic oligonucleotide
  Target: ATXN1; (+) strand; PAM type: NRG; PAM sequence: AGG
ggtaggcggcctgggtgacc

SEQ ID NO: 100987 - DNA, 20 bp, Artificial Sequence
  Description of Artificial Sequence: Synthetic oligonucleotide
  Target: ATXN1; (+) strand; PAM type: NRG; PAM sequence: GGG
gtaggcggcctgggtgacca

SEQ ID NO: 100988 - DNA, 20 bp, Artificial Sequence
  Description of Artificial Sequence: Synthetic oligonucleotide
  Target: ATXN1; (+) strand; PAM type: NRG; PAM sequence: CAG
ggcctgggtgaccagggcct

SEQ ID NO: 100989 - DNA, 20 bp, Artificial Sequence
  Description of Artificial Sequence: Synthetic oligonucleotide
  Target: ATXN1; (+) strand; PAM type: NRG; PAM sequence: AGG
gcctgggtgaccagggcctc

SEQ ID NO: 100990 - DNA, 20 bp, Artificial Sequence
  Description of Artificial Sequence: Synthetic oligonucleotide
  Target: ATXN1; (+) strand; PAM type: NRG; PAM sequence: GGG
cctgggtgaccagggcctca

SEQ ID NO: 100991 - DNA, 20 bp, Artificial Sequence
  Description of Artificial Sequence: Synthetic oligonucleotide
  Target: ATXN1; (+) strand; PAM type: NRG; PAM sequence: AAG
tgaccagggcctcagggttg

SEQ ID NO: 100992 - DNA, 20 bp, Artificial Sequence
  Description of Artificial Sequence: Synthetic oligonucleotide
  Target: ATXN1; (+) strand; PAM type: NRG; PAM sequence: TGG
agggttgaagttctcgctct

SEQ ID NO: 100993 - DNA, 20 bp, Artificial Sequence
  Description of Artificial Sequence: Synthetic oligonucleotide
  Target: ATXN1; (+) strand; PAM type: NRG; PAM sequence: GGG
gggttgaagttctcgctctt

SEQ ID NO: 100994 - DNA, 20 bp, Artificial Sequence
  Description of Artificial Sequence: Synthetic oligonucleotide
  Target: ATXN1; (+) strand; PAM type: NRG; PAM sequence: AAG
ttgaagttctcgctcttggg

SEQ ID NO: 100995 - DNA, 20 bp, Artificial Sequence
  Description of Artificial Sequence: Synthetic oligonucleotide
  Target: ATXN1; (+) strand; PAM type: NRG; PAM sequence: AGG
tgaagttctcgctcttggga

SEQ ID NO: 100996 - DNA, 20 bp, Artificial Sequence
  Description of Artificial Sequence: Synthetic oligonucleotide
  Target: ATXN1; (+) strand; PAM type: NRG; PAM sequence: GGG
gaagttctcgctcttgggaa

SEQ ID NO: 100997 - DNA, 20 bp, Artificial Sequence
  Description of Artificial Sequence: Synthetic oligonucleotide
  Target: ATXN1; (+) strand; PAM type: NRG; PAM sequence: CGG
gttctcgctcttgggaaggg

SEQ ID NO: 100998 - DNA, 20 bp, Artificial Sequence
  Description of Artificial Sequence: Synthetic oligonucleotide
  Target: ATXN1; (+) strand; PAM type: NRG; PAM sequence: TGG
ctcgctcttgggaagggcgg

SEQ ID NO: 100999 - DNA, 20 bp, Artificial Sequence
  Description of Artificial Sequence: Synthetic oligonucleotide
  Target: ATXN1; (+) strand; PAM type: NRG; PAM sequence: GAG
ggcggtggtgacgaacgtgt

SEQ ID NO: 101000 - DNA, 20 bp, Artificial Sequence
  Description of Artificial Sequence: Synthetic oligonucleotide
  Target: ATXN1; (+) strand; PAM type: NRG; PAM sequence: AGG
gcggtggtgacgaacgtgtg

SEQ ID NO: 101001 - DNA, 20 bp, Artificial Sequence
  Description of Artificial Sequence: Synthetic oligonucleotide
  Target: ATXN1; (+) strand; PAM type: NRG; PAM sequence: CAG
gacgaacgtgtgaggcactg

SEQ ID NO: 101002 - DNA, 20 bp, Artificial Sequence
  Description of Artificial Sequence: Synthetic oligonucleotide
  Target: ATXN1; (+) strand; PAM type: NRG; PAM sequence: TGG
tgtgaggcactgcagcaaac

SEQ ID NO: 101003 - DNA, 20 bp, Artificial Sequence
  Description of Artificial Sequence: Synthetic oligonucleotide
  Target: ATXN1; (+) strand; PAM type: NRG; PAM sequence: GGG
gtgaggcactgcagcaaact

SEQ ID NO: 101004 - DNA, 20 bp, Artificial Sequence
  Description of Artificial Sequence: Synthetic oligonucleotide
  Target: ATXN1; (+) strand; PAM type: NRG; PAM sequence: GGG
tgaggcactgcagcaaactg

SEQ ID NO: 101005 - DNA, 20 bp, Artificial Sequence
  Description of Artificial Sequence: Synthetic oligonucleotide
  Target: ATXN1; (+) strand; PAM type: NRG; PAM sequence: GGG
gaggcactgcagcaaactgg

SEQ ID NO: 101006 - DNA, 20 bp, Artificial Sequence
  Description of Artificial Sequence: Synthetic oligonucleotide
  Target: ATXN1; (+) strand; PAM type: NRG; PAM sequence: GGG
aggcactgcagcaaactggg

SEQ ID NO: 101007 - DNA, 20 bp, Artificial Sequence
  Description of Artificial Sequence: Synthetic oligonucleotide
  Target: ATXN1; (+) strand; PAM type: NRG; PAM sequence: TGG
ctggggggatgacgtgacta

SEQ ID NO: 101008 - DNA, 20 bp, Artificial Sequence
  Description of Artificial Sequence: Synthetic oligonucleotide
  Target: ATXN1; (+) strand; PAM type: NRG; PAM sequence: CGG
ggggatgacgtgactatggc

SEQ ID NO: 101009 - DNA, 20 bp, Artificial Sequence
  Description of Artificial Sequence: Synthetic oligonucleotide
  Target: ATXN1; (+) strand; PAM type: NRG; PAM sequence: GGG
gggatgacgtgactatggcc

SEQ ID NO: 101010 - DNA, 20 bp, Artificial Sequence
  Description of Artificial Sequence: Synthetic oligonucleotide
  Target: ATXN1; (+) strand; PAM type: NRG; PAM sequence: GGG
ggatgacgtgactatggccg

SEQ ID NO: 101011 - DNA, 20 bp, Artificial Sequence
  Description of Artificial Sequence: Synthetic oligonucleotide
  Target: ATXN1; (+) strand; PAM type: NRG; PAM sequence: CAG
tgcccccgacgcttccatgt

SEQ ID NO: 101012 - DNA, 20 bp, Artificial Sequence
  Description of Artificial Sequence: Synthetic oligonucleotide
  Target: ATXN1; (+) strand; PAM type: NRG; PAM sequence: CGG
tccatgtcagtgctgccgac

SEQ ID NO: 101013 - DNA, 20 bp, Artificial Sequence
  Description of Artificial Sequence: Synthetic oligonucleotide
  Target: ATXN1; (+) strand; PAM type: NRG; PAM sequence: GGG
ccatgtcagtgctgccgacc

SEQ ID NO: 101014 - DNA, 20 bp, Artificial Sequence
  Description of Artificial Sequence: Synthetic oligonucleotide
  Target: ATXN1; (+) strand; PAM type: NRG; PAM sequence: GAG
tcagtgctgccgaccgggat

SEQ ID NO: 101015 - DNA, 20 bp, Artificial Sequence
  Description of Artificial Sequence: Synthetic oligonucleotide
  Target: ATXN1; (+) strand; PAM type: NRG; PAM sequence: CAG
gtgctgccgaccgggatgag

SEQ ID NO: 101016 - DNA, 20 bp, Artificial Sequence
  Description of Artificial Sequence: Synthetic oligonucleotide
  Target: ATXN1; (+) strand; PAM type: NRG; PAM sequence: AGG
tgctgccgaccgggatgagc

SEQ ID NO: 101017 - DNA, 20 bp, Artificial Sequence
  Description of Artificial Sequence: Synthetic oligonucleotide
  Target: ATXN1; (+) strand; PAM type: NRG; PAM sequence: GGG
gctgccgaccgggatgagca

SEQ ID NO: 101018 - DNA, 20 bp, Artificial Sequence
  Description of Artificial Sequence: Synthetic oligonucleotide
  Target: ATXN1; (+) strand; PAM type: NRG; PAM sequence: GGG
ctgccgaccgggatgagcag

SEQ ID NO: 101019 - DNA, 20 bp, Artificial Sequence
  Description of Artificial Sequence: Synthetic oligonucleotide
  Target: ATXN1; (+) strand; PAM type: NRG; PAM sequence: CGG
gatgagcaggggctgtgtgc

SEQ ID NO: 101020 - DNA, 20 bp, Artificial Sequence
  Description of Artificial Sequence: Synthetic oligonucleotide
  Target: ATXN1; (+) strand; PAM type: NRG; PAM sequence: GGG
atgagcaggggctgtgtgcc

SEQ ID NO: 101021 - DNA, 20 bp, Artificial Sequence
  Description of Artificial Sequence: Synthetic oligonucleotide
  Target: ATXN1; (+) strand; PAM type: NRG; PAM sequence: GGG
tgagcaggggctgtgtgccg

SEQ ID NO: 101022 - DNA, 20 bp, Artificial Sequence
  Description of Artificial Sequence: Synthetic oligonucleotide
  Target: ATXN1; (+) strand; PAM type: NRG; PAM sequence: CAG
ggctgtgtgccggggatcac

SEQ ID NO: 101023 - DNA, 20 bp, Artificial Sequence
  Description of Artificial Sequence: Synthetic oligonucleotide
  Target: ATXN1; (+) strand; PAM type: NRG; PAM sequence: AGG
gctgtgtgccggggatcacc

SEQ ID NO: 101024 - DNA, 20 bp, Artificial Sequence
  Description of Artificial Sequence: Synthetic oligonucleotide
  Target: ATXN1; (+) strand; PAM type: NRG; PAM sequence: TGG
tgccggggatcaccaggtgc

SEQ ID NO: 101025 - DNA, 20 bp, Artificial Sequence
  Description of Artificial Sequence: Synthetic oligonucleotide
  Target: ATXN1; (+) strand; PAM type: NRG; PAM sequence: GGG
gccggggatcaccaggtgct

SEQ ID NO: 101026 - DNA, 20 bp, Artificial Sequence
  Description of Artificial Sequence: Synthetic oligonucleotide
  Target: ATXN1; (+) strand; PAM type: NRG; PAM sequence: GGG
ccggggatcaccaggtgctg

SEQ ID NO: 101027 - DNA, 20 bp, Artificial Sequence
  Description of Artificial Sequence: Synthetic oligonucleotide
  Target: ATXN1; (+) strand; PAM type: NRG; PAM sequence: CAG
gggatcaccaggtgctgggg

SEQ ID NO: 101028 - DNA, 20 bp, Artificial Sequence
  Description of Artificial Sequence: Synthetic oligonucleotide
  Target: ATXN1; (+) strand; PAM type: NRG; PAM sequence: AGG
ggatcaccaggtgctggggc

SEQ ID NO: 101029 - DNA, 20 bp, Artificial Sequence
  Description of Artificial Sequence: Synthetic oligonucleotide
  Target: ATXN1; (+) strand; PAM type: NRG; PAM sequence: CGG
caggtgctggggcaggctgc

SEQ ID NO: 101030 - DNA, 20 bp, Artificial Sequence
  Description of Artificial Sequence: Synthetic oligonucleotide
  Target: ATXN1; (+) strand; PAM type: NRG; PAM sequence: TAG
gctggggcaggctgccggcg

SEQ ID NO: 101031 - DNA, 20 bp, Artificial Sequence
  Description of Artificial Sequence: Synthetic oligonucleotide
  Target: ATXN1; (+) strand; PAM type: NRG; PAM sequence: AGG
ctggggcaggctgccggcgt

SEQ ID NO: 101032 - DNA, 20 bp, Artificial Sequence
  Description of Artificial Sequence: Synthetic oligonucleotide
  Target: ATXN1; (+) strand; PAM type: NRG; PAM sequence: TGG
cgtaggtgattgcttgctgc

SEQ ID NO: 101033 - DNA, 20 bp, Artificial Sequence
  Description of Artificial Sequence: Synthetic oligonucleotide
  Target: ATXN1; (+) strand; PAM type: NRG; PAM sequence: CAG
attgcttgctgctggccgct

SEQ ID NO: 101034 - DNA, 20 bp, Artificial Sequence
  Description of Artificial Sequence: Synthetic oligonucleotide
  Target: ATXN1; (+) strand; PAM type: NRG; PAM sequence: AGG
ttgcttgctgctggccgctc

SEQ ID NO: 101035 - DNA, 20 bp, Artificial Sequence
  Description of Artificial Sequence: Synthetic oligonucleotide
  Target: ATXN1; (+) strand; PAM type: NRG; PAM sequence: TAG
cttgctgctggccgctcagg

SEQ ID NO: 101036 - DNA, 20 bp, Artificial Sequence
  Description of Artificial Sequence: Synthetic oligonucleotide
  Target: ATXN1; (+) strand; PAM type: NRG; PAM sequence: CAG
gccgctcaggtagccgatga

SEQ ID NO: 101037 - DNA, 20 bp, Artificial Sequence
  Description of Artificial Sequence: Synthetic oligonucleotide
  Target: ATXN1; (+) strand; PAM type: NRG; PAM sequence: AGG
ccgctcaggtagccgatgac

SEQ ID NO: 101038 - DNA, 20 bp, Artificial Sequence
  Description of Artificial Sequence: Synthetic oligonucleotide
  Target: ATXN1; (+) strand; PAM type: NRG; PAM sequence: GGG
cgctcaggtagccgatgaca

SEQ ID NO: 101039 - DNA, 20 bp, Artificial Sequence
  Description of Artificial Sequence: Synthetic oligonucleotide
  Target: ATXN1; (+) strand; PAM type: NRG; PAM sequence: GGG
gctcaggtagccgatgacag

SEQ ID NO: 101040 - DNA, 20 bp, Artificial Sequence
  Description of Artificial Sequence: Synthetic oligonucleotide
  Target: ATXN1; (+) strand; PAM type: NRG; PAM sequence: GGG
ctcaggtagccgatgacagg

SEQ ID NO: 101041 - DNA, 20 bp, Artificial Sequence
  Description of Artificial Sequence: Synthetic oligonucleotide
  Target: ATXN1; (+) strand; PAM type: NRG; PAM sequence: GAG
gtagccgatgacagggggtt

SEQ ID NO: 101042 - DNA, 20 bp, Artificial Sequence
  Description of Artificial Sequence: Synthetic oligonucleotide
  Target: ATXN1; (+) strand; PAM type: NRG; PAM sequence: TAG
cagggggttgagtccctgcg

SEQ ID NO: 101043 - DNA, 20 bp, Artificial Sequence
  Description of Artificial Sequence: Synthetic oligonucleotide
  Target: ATXN1; (+) strand; PAM type: NRG; PAM sequence: AAG
ggggttgagtccctgcgtag

SEQ ID NO: 101044 - DNA, 20 bp, Artificial Sequence
  Description of Artificial Sequence: Synthetic oligonucleotide
  Target: ATXN1; (+) strand; PAM type: NRG; PAM sequence: AGG
gggttgagtccctgcgtaga

SEQ ID NO: 101045 - DNA, 20 bp, Artificial Sequence
  Description of Artificial Sequence: Synthetic oligonucleotide
  Target: ATXN1; (+) strand; PAM type: NRG; PAM sequence: TGG
agtccctgcgtagaaggccg

SEQ ID NO: 101046 - DNA, 20 bp, Artificial Sequence
  Description of Artificial Sequence: Synthetic oligonucleotide
  Target: ATXN1; (+) strand; PAM type: NRG; PAM sequence: TGG
cctgcgtagaaggccgtggc

SEQ ID NO: 101047 - DNA, 20 bp, Artificial Sequence
  Description of Artificial Sequence: Synthetic oligonucleotide
  Target: ATXN1; (+) strand; PAM type: NRG; PAM sequence: CAG
gcgtagaaggccgtggctgg

SEQ ID NO: 101048 - DNA, 20 bp, Artificial Sequence
  Description of Artificial Sequence: Synthetic oligonucleotide
  Target: ATXN1; (+) strand; PAM type: NRG; PAM sequence: CGG
gccgtggctggcagtcccac

SEQ ID NO: 101049 - DNA, 20 bp, Artificial Sequence
  Description of Artificial Sequence: Synthetic oligonucleotide
  Target: ATXN1; (+) strand; PAM type: NRG; PAM sequence: GGG
ccgtggctggcagtcccacc

SEQ ID NO: 101050 - DNA, 20 bp, Artificial Sequence
  Description of Artificial Sequence: Synthetic oligonucleotide
  Target: ATXN1; (+) strand; PAM type: NRG; PAM sequence: GAG
gtggctggcagtcccaccgg

SEQ ID NO: 101051 - DNA, 20 bp, Artificial Sequence
  Description of Artificial Sequence: Synthetic oligonucleotide
  Target: ATXN1; (+) strand; PAM type: NRG; PAM sequence: TGG
gctggcagtcccaccgggag

SEQ ID NO: 101052 - DNA, 20 bp, Artificial Sequence
  Description of Artificial Sequence: Synthetic oligonucleotide
  Target: ATXN1; (+) strand; PAM type: NRG; PAM sequence: AAG
tcccaccgggagtggctctg

SEQ ID NO: 101053 - DNA, 20 bp, Artificial Sequence
  Description of Artificial Sequence: Synthetic oligonucleotide
  Target: ATXN1; (+) strand; PAM type: NRG; PAM sequence: TGG
tggctctgaagcactgtgtg

SEQ ID NO: 101054 - DNA, 20 bp, Artificial Sequence
  Description of Artificial Sequence: Synthetic oligonucleotide
  Target: ATXN1; (+) strand; PAM type: NRG; PAM sequence: TGG
gtgtggtctgaatgaccgtg

SEQ ID NO: 101055 - DNA, 20 bp, Artificial Sequence
  Description of Artificial Sequence: Synthetic oligonucleotide
  Target: ATXN1; (+) strand; PAM type: NRG; PAM sequence: GGG
tgtggtctgaatgaccgtgt

SEQ ID NO: 101056 - DNA, 20 bp, Artificial Sequence
  Description of Artificial Sequence: Synthetic oligonucleotide
  Target: ATXN1; (+) strand; PAM type: NRG; PAM sequence: GGG
gtggtctgaatgaccgtgtg

SEQ ID NO: 101057 - DNA, 20 bp, Artificial Sequence
  Description of Artificial Sequence: Synthetic oligonucleotide
  Target: ATXN1; (+) strand; PAM type: NRG; PAM sequence: GAG
tctgaatgaccgtgtggggt

SEQ ID NO: 101058 - DNA, 20 bp, Artificial Sequence
  Description of Artificial Sequence: Synthetic oligonucleotide
  Target: ATXN1; (+) strand; PAM type: NRG; PAM sequence: GAG
tgaatgaccgtgtggggtga

SEQ ID NO: 101059 - DNA, 20 bp, Artificial Sequence
  Description of Artificial Sequence: Synthetic oligonucleotide
  Target: ATXN1; (+) strand; PAM type: NRG; PAM sequence: TAG
ccgtgtggggtgagagcgcg

SEQ ID NO: 101060 - DNA, 20 bp, Artificial Sequence
  Description of Artificial Sequence: Synthetic oligonucleotide
  Target: ATXN1; (+) strand; PAM type: NRG; PAM sequence: AGG
cgtgtggggtgagagcgcgt

SEQ ID NO: 101061 - DNA, 20 bp, Artificial Sequence
  Description of Artificial Sequence: Synthetic oligonucleotide
  Target: ATXN1; (+) strand; PAM type: NRG; PAM sequence: CGG
ggggtgagagcgcgtaggac

SEQ ID NO: 101062 - DNA, 20 bp, Artificial Sequence
  Description of Artificial Sequence: Synthetic oligonucleotide
  Target: ATXN1; (+) strand; PAM type: NRG; PAM sequence: TGG
gtgagagcgcgtaggaccgg

SEQ ID NO: 101063 - DNA, 20 bp, Artificial Sequence
  Description of Artificial Sequence: Synthetic oligonucleotide
  Target: ATXN1; (+) strand; PAM type: NRG; PAM sequence: CAG
gagcgcgtaggaccggtggc

SEQ ID NO: 101064 - DNA, 20 bp, Artificial Sequence
  Description of Artificial Sequence: Synthetic oligonucleotide
  Target: ATXN1; (+) strand; PAM type: NRG; PAM sequence: AGG
agcgcgtaggaccggtggcc

SEQ ID NO: 101065 - DNA, 20 bp, Artificial Sequence
  Description of Artificial Sequence: Synthetic oligonucleotide
  Target: ATXN1; (+) strand; PAM type: NRG; PAM sequence: CAG
tggccaggcttccctaaatg

SEQ ID NO: 101066 - DNA, 20 bp, Artificial Sequence
  Description of Artificial Sequence: Synthetic oligonucleotide
  Target: ATXN1; (+) strand; PAM type: NRG; PAM sequence: AGG
ggccaggcttccctaaatgc

SEQ ID NO: 101067 - DNA, 20 bp, Artificial Sequence
  Description of Artificial Sequence: Synthetic oligonucleotide
  Target: ATXN1; (+) strand; PAM type: NRG; PAM sequence: GAG
tgcaggccacttttgtcgtt

SEQ ID NO: 101068 - DNA, 20 bp, Artificial Sequence
  Description of Artificial Sequence: Synthetic oligonucleotide
  Target: ATXN1; (+) strand; PAM type: NRG; PAM sequence: AGG
gcaggccacttttgtcgttg

SEQ ID NO: 101069 - DNA, 20 bp, Artificial Sequence
  Description of Artificial Sequence: Synthetic oligonucleotide
  Target: ATXN1; (+) strand; PAM type: NRG; PAM sequence: GGG
caggccacttttgtcgttga

SEQ ID NO: 101070 - DNA, 20 bp, Artificial Sequence
  Description of Artificial Sequence: Synthetic oligonucleotide
  Target: ATXN1; (+) strand; PAM type: NRG; PAM sequence: TAG
gccacttttgtcgttgaggg

SEQ ID NO: 101071 - DNA, 20 bp, Artificial Sequence
  Description of Artificial Sequence: Synthetic oligonucleotide
  Target: ATXN1; (+) strand; PAM type: NRG; PAM sequence: AAG
acttttgtcgttgagggtag

SEQ ID NO: 101072 - DNA, 20 bp, Artificial Sequence
  Description of Artificial Sequence: Synthetic oligonucleotide
  Target: ATXN1; (+) strand; PAM type: NRG; PAM sequence: AGG
cttttgtcgttgagggtaga

SEQ ID NO: 101073 - DNA, 20 bp, Artificial Sequence
  Description of Artificial Sequence: Synthetic oligonucleotide
  Target: ATXN1; (+) strand; PAM type: NRG; PAM sequence: GGG
ttttgtcgttgagggtagaa

SEQ ID NO: 101074 - DNA, 20 bp, Artificial Sequence
  Description of Artificial Sequence: Synthetic oligonucleotide
  Target: ATXN1; (+) strand; PAM type: NRG; PAM sequence: GGG
tttgtcgttgagggtagaag

SEQ ID NO: 101075 - DNA, 20 bp, Artificial Sequence
  Description of Artificial Sequence: Synthetic oligonucleotide
  Target: ATXN1; (+) strand; PAM type: NRG; PAM sequence: GAG
tgtcgttgagggtagaaggg

SEQ ID NO: 101076 - DNA, 20 bp, Artificial Sequence
  Description of Artificial Sequence: Synthetic oligonucleotide
  Target: ATXN1; (+) strand; PAM type: NRG; PAM sequence: AGG
gtcgttgagggtagaagggg

SEQ ID NO: 101077 - DNA, 20 bp, Artificial Sequence
  Description of Artificial Sequence: Synthetic oligonucleotide
  Target: ATXN1; (+) strand; PAM type: NRG; PAM sequence: GAG
agaaggggaggcttcacgat

SEQ ID NO: 101078 - DNA, 20 bp, Artificial Sequence
  Description of Artificial Sequence: Synthetic oligonucleotide
  Target: ATXN1; (+) strand; PAM type: NRG; PAM sequence: TGG
aggggaggcttcacgatgag

SEQ ID NO: 101079 - DNA, 20 bp, Artificial Sequence
  Description of Artificial Sequence: Synthetic oligonucleotide
  Target: ATXN1; (+) strand; PAM type: NRG; PAM sequence: CAG
tgagtggcctgttgcacctc

SEQ ID NO: 101080 - DNA, 20 bp, Artificial Sequence
  Description of Artificial Sequence: Synthetic oligonucleotide
  Target: ATXN1; (+) strand; PAM type: NRG; PAM sequence: AGG
gagtggcctgttgcacctcc

SEQ ID NO: 101081 - DNA, 20 bp, Artificial Sequence
  Description of Artificial Sequence: Synthetic oligonucleotide
  Target: ATXN1; (+) strand; PAM type: NRG; PAM sequence: CAG
ggcctgttgcacctccaggt

SEQ ID NO: 101082 - DNA, 20 bp, Artificial Sequence
  Description of Artificial Sequence: Synthetic oligonucleotide
  Target: ATXN1; (+) strand; PAM type: NRG; PAM sequence: CGG
ttgcacctccaggtcagctg

SEQ ID NO: 101083 - DNA, 20 bp, Artificial Sequence
  Description of Artificial Sequence: Synthetic oligonucleotide
  Target: ATXN1; (+) strand; PAM type: NRG; PAM sequence: GGG
tgcacctccaggtcagctgc

SEQ ID NO: 101084 - DNA, 20 bp, Artificial Sequence
  Description of Artificial Sequence: Synthetic oligonucleotide
  Target: ATXN1; (+) strand; PAM type: NRG; PAM sequence: TGG
agctgcgggcgtgttgctgt

SEQ ID NO: 101085 - DNA, 20 bp, Artificial Sequence
  Description of Artificial Sequence: Synthetic oligonucleotide
  Target: ATXN1; (+) strand; PAM type: NRG; PAM sequence: GGG
gctgcgggcgtgttgctgtt

SEQ ID NO: 101086 - DNA, 20 bp, Artificial Sequence
  Description of Artificial Sequence: Synthetic oligonucleotide
  Target: ATXN1; (+) strand; PAM type: NRG; PAM sequence: CAG
gcgggcgtgttgctgttggg

SEQ ID NO: 101087 - DNA, 20 bp, Artificial Sequence
  Description of Artificial Sequence: Synthetic oligonucleotide
  Target: ATXN1; (+) strand; PAM type: NRG; PAM sequence: AGG
cgggcgtgttgctgttgggc

SEQ ID NO: 101088 - DNA, 20 bp, Artificial Sequence
  Description of Artificial Sequence: Synthetic oligonucleotide
  Target: ATXN1; (+) strand; PAM type: NRG; PAM sequence: CAG
gctgttgggcaggaccatca

SEQ ID NO: 101089 - DNA, 20 bp, Artificial Sequence
  Description of Artificial Sequence: Synthetic oligonucleotide
  Target: ATXN1; (+) strand; PAM type: NRG; PAM sequence: GAG
tgttgggcaggaccatcaca

SEQ ID NO: 101090 - DNA, 20 bp, Artificial Sequence
  Description of Artificial Sequence: Synthetic oligonucleotide
  Target: ATXN1; (+) strand; PAM type: NRG; PAM sequence: AGG
gttgggcaggaccatcacag

SEQ ID NO: 101091 - DNA, 20 bp, Artificial Sequence
  Description of Artificial Sequence: Synthetic oligonucleotide
  Target: ATXN1; (+) strand; PAM type: NRG; PAM sequence: CGG
gcaggaccatcacagaggcc

SEQ ID NO: 101092 - DNA, 20 bp, Artificial Sequence
  Description of Artificial Sequence: Synthetic oligonucleotide
  Target: ATXN1; (+) strand; PAM type: NRG; PAM sequence: AAG
cacagaggcccggacccccg

SEQ ID NO: 101093 - DNA, 20 bp, Artificial Sequence
  Description of Artificial Sequence: Synthetic oligonucleotide
  Target: ATXN1; (+) strand; PAM type: NRG; PAM sequence: AGG
acagaggcccggacccccga

SEQ ID NO: 101094 - DNA, 20 bp, Artificial Sequence
  Description of Artificial Sequence: Synthetic oligonucleotide
  Target: ATXN1; (+) strand; PAM type: NRG; PAM sequence: TAG
ccgaaggatcacgactgctg

SEQ ID NO: 101095 - DNA, 20 bp, Artificial Sequence
  Description of Artificial Sequence: Synthetic oligonucleotide
  Target: ATXN1; (+) strand; PAM type: NRG; PAM sequence: GAG
gatcacgactgctgtagtct

SEQ ID NO: 101096 - DNA, 20 bp, Artificial Sequence
  Description of Artificial Sequence: Synthetic oligonucleotide
  Target: ATXN1; (+) strand; PAM type: NRG; PAM sequence: AGG
atcacgactgctgtagtctg

SEQ ID NO: 101097 - DNA, 20 bp, Artificial Sequence
  Description of Artificial Sequence: Synthetic oligonucleotide
  Target: ATXN1; (+) strand; PAM type: NRG; PAM sequence: GGG
tcacgactgctgtagtctga

SEQ ID NO: 101098 - DNA, 20 bp, Artificial Sequence
  Description of Artificial Sequence: Synthetic oligonucleotide
  Target: ATXN1; (+) strand; PAM type: NRG; PAM sequence: GGG
cacgactgctgtagtctgag

SEQ ID NO: 101099 - DNA, 20 bp, Artificial Sequence
  Description of Artificial Sequence: Synthetic oligonucleotide
  Target: ATXN1; (+) strand; PAM type: NRG; PAM sequence: CGG
ctgctgtagtctgaggggct

SEQ ID NO: 101100 - DNA, 20 bp, Artificial Sequence
  Description of Artificial Sequence: Synthetic oligonucleotide
  Target: ATXN1; (+) strand; PAM type: NRG; PAM sequence: GGG
tgctgtagtctgaggggctc

SEQ ID NO: 101101 - DNA, 20 bp, Artificial Sequence
  Description of Artificial Sequence: Synthetic oligonucleotide
  Target: ATXN1; (+) strand; PAM type: NRG; PAM sequence: TGG
tgtagtctgaggggctcggg

SEQ ID NO: 101102 - DNA, 20 bp, Artificial Sequence
  Description of Artificial Sequence: Synthetic oligonucleotide
  Target: ATXN1; (+) strand; PAM type: NRG; PAM sequence: TGG
cgggtggaccaccacgtgcc

SEQ ID NO: 101103 - DNA, 20 bp, Artificial Sequence
  Description of Artificial Sequence: Synthetic oligonucleotide
  Target: ATXN1; (+) strand; PAM type: NRG; PAM sequence: CGG
accacgtgcctggactcgta

SEQ ID NO: 101104 - DNA, 20 bp, Artificial Sequence
  Description of Artificial Sequence: Synthetic oligonucleotide
  Target: ATXN1; (+) strand; PAM type: NRG; PAM sequence: GGG
ccacgtgcctggactcgtac

SEQ ID NO: 101105 - DNA, 20 bp, Artificial Sequence
  Description of Artificial Sequence: Synthetic oligonucleotide
  Target: ATXN1; (+) strand; PAM type: NRG; PAM sequence: GAG
gtgcctggactcgtacgggt

SEQ ID NO: 101106 - DNA, 20 bp, Artificial Sequence
  Description of Artificial Sequence: Synthetic oligonucleotide
  Target: ATXN1; (+) strand; PAM type: NRG; PAM sequence: AGG
tgcctggactcgtacgggtg

SEQ ID NO: 101107 - DNA, 20 bp, Artificial Sequence
  Description of Artificial Sequence: Synthetic oligonucleotide
  Target: ATXN1; (+) strand; PAM type: NRG; PAM sequence: CAG
gacttgccgcctgccttgcc

SEQ ID NO: 101108 - DNA, 20 bp, Artificial Sequence
  Description of Artificial Sequence: Synthetic oligonucleotide
  Target: ATXN1; (+) strand; PAM type: NRG; PAM sequence: AGG
acttgccgcctgccttgccc

SEQ ID NO: 101109 - DNA, 20 bp, Artificial Sequence
  Description of Artificial Sequence: Synthetic oligonucleotide
  Target: ATXN1; (+) strand; PAM type: NRG; PAM sequence: CAG
ccgcctgccttgcccaggcc

SEQ ID NO: 101110 - DNA, 20 bp, Artificial Sequence
  Description of Artificial Sequence: Synthetic oligonucleotide
  Target: ATXN1; (+) strand; PAM type: NRG; PAM sequence: AGG
cgcctgccttgcccaggccc

SEQ ID NO: 101111 - DNA, 20 bp, Artificial Sequence
  Description of Artificial Sequence: Synthetic oligonucleotide
  Target: ATXN1; (+) strand; PAM type: NRG; PAM sequence: CGG
tgccttgcccaggcccaggt

SEQ ID NO: 101112 - DNA, 20 bp, Artificial Sequence
  Description of Artificial Sequence: Synthetic oligonucleotide
  Target: ATXN1; (+) strand; PAM type: NRG; PAM sequence: GAG
tgcccaggcccaggtcggct

SEQ ID NO: 101113 - DNA, 20 bp, Artificial Sequence
  Description of Artificial Sequence: Synthetic oligonucleotide
  Target: ATXN1; (+) strand; PAM type: NRG; PAM sequence: AGG
gcccaggcccaggtcggctg

SEQ ID NO: 101114 - DNA, 20 bp, Artificial Sequence
  Description of Artificial Sequence: Synthetic oligonucleotide
  Target: ATXN1; (+) strand; PAM type: NRG; PAM sequence: CGG
aggcccaggtcggctgagga

SEQ ID NO: 101115 - DNA, 20 bp, Artificial Sequence
  Description of Artificial Sequence: Synthetic oligonucleotide
  Target: ATXN1; (+) strand; PAM type: NRG; PAM sequence: GGG
ggcccaggtcggctgaggac

SEQ ID NO: 101116 - DNA, 20 bp, Artificial Sequence
  Description of Artificial Sequence: Synthetic oligonucleotide
  Target: ATXN1; (+) strand; PAM type: NRG; PAM sequence: GGG
gcccaggtcggctgaggacg

SEQ ID NO: 101117 - DNA, 20 bp, Artificial Sequence
  Description of Artificial Sequence: Synthetic oligonucleotide
  Target: ATXN1; (+) strand; PAM type: NRG; PAM sequence: CGG
aggacggggccccgtaccgc

SEQ ID NO: 101118 - DNA, 20 bp, Artificial Sequence
  Description of Artificial Sequence: Synthetic oligonucleotide
  Target: ATXN1; (+) strand; PAM type: NRG; PAM sequence: CAG
ctcttctccatctcaccgtt

SEQ ID NO: 101119 - DNA, 20 bp, Artificial Sequence
  Description of Artificial Sequence: Synthetic oligonucleotide
  Target: ATXN1; (+) strand; PAM type: NRG; PAM sequence: AGG
tcttctccatctcaccgttc

SEQ ID NO: 101120 - DNA, 20 bp, Artificial Sequence
  Description of Artificial Sequence: Synthetic oligonucleotide
  Target: ATXN1; (+) strand; PAM type: NRG; PAM sequence: TGG
ctcaccgttcaggacctcct

SEQ ID NO: 101121 - DNA, 20 bp, Artificial Sequence
  Description of Artificial Sequence: Synthetic oligonucleotide
  Target: ATXN1; (+) strand; PAM type: NRG; PAM sequence: TGG
cgttcaggacctccttggcc

SEQ ID NO: 101122 - DNA, 20 bp, Artificial Sequence
  Description of Artificial Sequence: Synthetic oligonucleotide
  Target: ATXN1; (+) strand; PAM type: NRG; PAM sequence: TGG
caggacctccttggcctgga

SEQ ID NO: 101123 - DNA, 20 bp, Artificial Sequence
  Description of Artificial Sequence: Synthetic oligonucleotide
  Target: ATXN1; (+) strand; PAM type: NRG; PAM sequence: CAG
ttggcctggatggcctgctg

SEQ ID NO: 101124 - DNA, 20 bp, Artificial Sequence
  Description of Artificial Sequence: Synthetic oligonucleotide
  Target: ATXN1; (+) strand; PAM type: NRG; PAM sequence: CGG
cctggatggcctgctgcagc

SEQ ID NO: 101125 - DNA, 20 bp, Artificial Sequence
  Description of Artificial Sequence: Synthetic oligonucleotide
  Target: ATXN1; (+) strand; PAM type: NRG; PAM sequence: CAG
ctgctgcagccggctgctct

SEQ ID NO: 101126 - DNA, 20 bp, Artificial Sequence
  Description of Artificial Sequence: Synthetic oligonucleotide
  Target: ATXN1; (+) strand; PAM type: NRG; PAM sequence: TGG
ccggctgctctcagctttct

SEQ ID NO: 101127 - DNA, 20 bp, Artificial Sequence
  Description of Artificial Sequence: Synthetic oligonucleotide
  Target: ATXN1; (+) strand; PAM type: NRG; PAM sequence: TGG
gctgctctcagctttcttgg

SEQ ID NO: 101128 - DNA, 20 bp, Artificial Sequence
  Description of Artificial Sequence: Synthetic oligonucleotide
  Target: ATXN1; (+) strand; PAM type: NRG; PAM sequence: GAG
agctttcttggtggcctccc

SEQ ID NO: 101129 - DNA, 20 bp, Artificial Sequence
  Description of Artificial Sequence: Synthetic oligonucleotide
  Target: ATXN1; (+) strand; PAM type: NRG; PAM sequence: AGG
gctttcttggtggcctcccg

SEQ ID NO: 101130 - DNA, 20 bp, Artificial Sequence
  Description of Artificial Sequence: Synthetic oligonucleotide
  Target: ATXN1; (+) strand; PAM type: NRG; PAM sequence: GGG
ctttcttggtggcctcccga

SEQ ID NO: 101131 - DNA, 20 bp, Artificial Sequence
  Description of Artificial Sequence: Synthetic oligonucleotide
  Target: ATXN1; (+) strand; PAM type: NRG; PAM sequence: AAG
tggtggcctcccgagggaca

SEQ ID NO: 101132 - DNA, 20 bp, Artificial Sequence
  Description of Artificial Sequence: Synthetic oligonucleotide
  Target: ATXN1; (+) strand; PAM type: NRG; PAM sequence: TGG
tggcctcccgagggacaaag

SEQ ID NO: 101133 - DNA, 20 bp, Artificial Sequence
  Description of Artificial Sequence: Synthetic oligonucleotide
  Target: ATXN1; (+) strand; PAM type: NRG; PAM sequence: CGG
ccgagggacaaagtggctgc

SEQ ID NO: 101134 - DNA, 20 bp, Artificial Sequence
  Description of Artificial Sequence: Synthetic oligonucleotide
  Target: ATXN1; (+) strand; PAM type: NRG; PAM sequence: GAG
gagggacaaagtggctgccg

SEQ ID NO: 101135 - DNA, 20 bp, Artificial Sequence
  Description of Artificial Sequence: Synthetic oligonucleotide
  Target: ATXN1; (+) strand; PAM type: NRG; PAM sequence: CGG
gacaaagtggctgccggagt

SEQ ID NO: 101136 - DNA, 20 bp, Artificial Sequence
  Description of Artificial Sequence: Synthetic oligonucleotide
  Target: ATXN1; (+) strand; PAM type: NRG; PAM sequence: TGG
cggcgtattgcatgacgacc

SEQ ID NO: 101137 - DNA, 20 bp, Artificial Sequence
  Description of Artificial Sequence: Synthetic oligonucleotide
  Target: ATXN1; (+) strand; PAM type: NRG; PAM sequence: GGG
ggcgtattgcatgacgacct

SEQ ID NO: 101138 - DNA, 20 bp, Artificial Sequence
  Description of Artificial Sequence: Synthetic oligonucleotide
  Target: ATXN1; (+) strand; PAM type: NRG; PAM sequence: GAG
cgtattgcatgacgacctgg

SEQ ID NO: 101139 - DNA, 20 bp, Artificial Sequence
  Description of Artificial Sequence: Synthetic oligonucleotide
  Target: ATXN1; (+) strand; PAM type: NRG; PAM sequence: AGG
gtattgcatgacgacctggg

SEQ ID NO: 101140 - DNA, 20 bp, Artificial Sequence
  Description of Artificial Sequence: Synthetic oligonucleotide
  Target: ATXN1; (+) strand; PAM type: NRG; PAM sequence: GGG
tattgcatgacgacctggga

SEQ ID NO: 101141 - DNA, 20 bp, Artificial Sequence
  Description of Artificial Sequence: Synthetic oligonucleotide
  Target: ATXN1; (+) strand; PAM type: NRG; PAM sequence: GGG
attgcatgacgacctgggag

SEQ ID NO: 101142 - DNA, 20 bp, Artificial Sequence
  Description of Artificial Sequence: Synthetic oligonucleotide
  Target: ATXN1; (+) strand; PAM type: NRG; PAM sequence: GGG
ttgcatgacgacctgggagg

SEQ ID NO: 101143 - DNA, 20 bp, Artificial Sequence
  Description of Artificial Sequence: Synthetic oligonucleotide
  Target: ATXN1; (+) strand; PAM type: NRG; PAM sequence: GGG
tgcatgacgacctgggaggg

SEQ ID NO: 101144 - DNA, 20 bp, Artificial Sequence
  Description of Artificial Sequence: Synthetic oligonucleotide
  Target: ATXN1; (+) strand; PAM type: NRG; PAM sequence: CAG
acgacctgggaggggggccc

SEQ ID NO: 101145 - DNA, 20 bp, Artificial Sequence
  Description of Artificial Sequence: Synthetic oligonucleotide
  Target: ATXN1; (+) strand; PAM type: NRG; PAM sequence: AGG
cgacctgggaggggggcccc

SEQ ID NO: 101146 - DNA, 20 bp, Artificial Sequence
  Description of Artificial Sequence: Synthetic oligonucleotide
  Target: ATXN1; (+) strand; PAM type: NRG; PAM sequence: GGG
gacctgggaggggggcccca

SEQ ID NO: 101147 - DNA, 20 bp, Artificial Sequence
  Description of Artificial Sequence: Synthetic oligonucleotide
  Target: ATXN1; (+) strand; PAM type: NRG; PAM sequence: GAG
tgggaggggggccccagggt

SEQ ID NO: 101148 - DNA, 20 bp, Artificial Sequence
  Description of Artificial Sequence: Synthetic oligonucleotide
  Target: ATXN1; (+) strand; PAM type: NRG; PAM sequence: TGG
ggccccagggtgagcgtgtg

SEQ ID NO: 101149 - DNA, 20 bp, Artificial Sequence
  Description of Artificial Sequence: Synthetic oligonucleotide
  Target: ATXN1; (+) strand; PAM type: NRG; PAM sequence: GGG
gccccagggtgagcgtgtgt

SEQ ID NO: 101150 - DNA, 20 bp, Artificial Sequence
  Description of Artificial Sequence: Synthetic oligonucleotide
  Target: ATXN1; (+) strand; PAM type: NRG; PAM sequence: TGG
gcgtgtgtgggatcatcgtc

SEQ ID NO: 101151 - DNA, 20 bp, Artificial Sequence
  Description of Artificial Sequence: Synthetic oligonucleotide
  Target: ATXN1; (+) strand; PAM type: NRG; PAM sequence: TGG
tgtgtgggatcatcgtctgg

SEQ ID NO: 101152 - DNA, 20 bp, Artificial Sequence
  Description of Artificial Sequence: Synthetic oligonucleotide
  Target: ATXN1; (+) strand; PAM type: NRG; PAM sequence: GGG
gtgtgggatcatcgtctggt

SEQ ID NO: 101153 - DNA, 20 bp, Artificial Sequence
  Description of Artificial Sequence: Synthetic oligonucleotide
  Target: ATXN1; (+) strand; PAM type: NRG; PAM sequence: GGG
tgtgggatcatcgtctggtg

SEQ ID NO: 101154 - DNA, 20 bp, Artificial Sequence
  Description of Artificial Sequence: Synthetic oligonucleotide
  Target: ATXN1; (+) strand; PAM type: NRG; PAM sequence: GGG
gtgggatcatcgtctggtgg

SEQ ID NO: 101155 - DNA, 20 bp, Artificial Sequence
  Description of Artificial Sequence: Synthetic oligonucleotide
  Target: ATXN1; (+) strand; PAM type: NRG; PAM sequence: TGG
ggatcatcgtctggtggggg

SEQ ID NO: 101156 - DNA, 20 bp, Artificial Sequence
  Description of Artificial Sequence: Synthetic oligonucleotide
  Target: ATXN1; (+) strand; PAM type: NRG; PAM sequence: GAG
atcatcgtctggtgggggtg

SEQ ID NO: 101157 - DNA, 20 bp, Artificial Sequence
  Description of Artificial Sequence: Synthetic oligonucleotide
  Target: ATXN1; (+) strand; PAM type: NRG; PAM sequence: AGG
tcatcgtctggtgggggtgg

SEQ ID NO: 101158 - DNA, 20 bp, Artificial Sequence
  Description of Artificial Sequence: Synthetic oligonucleotide
  Target: ATXN1; (+) strand; PAM type: NRG; PAM sequence: TGG
tcgtctggtgggggtggagg

SEQ ID NO: 101159 - DNA, 20 bp, Artificial Sequence
  Description of Artificial Sequence: Synthetic oligonucleotide
  Target: ATXN1; (+) strand; PAM type: NRG; PAM sequence: CGG
ctggtgggggtggaggtgga

SEQ ID NO: 101160 - DNA, 20 bp, Artificial Sequence
  Description of Artificial Sequence: Synthetic oligonucleotide
  Target: ATXN1; (+) strand; PAM type: NRG; PAM sequence: GGG
tggtgggggtggaggtggac

SEQ ID NO: 101161 - DNA, 20 bp, Artificial Sequence
  Description of Artificial Sequence: Synthetic oligonucleotide
  Target: ATXN1; (+) strand; PAM type: NRG; PAM sequence: GGG
ggtgggggtggaggtggacg

SEQ ID NO: 101162 - DNA, 20 bp, Artificial Sequence
  Description of Artificial Sequence: Synthetic oligonucleotide
  Target: ATXN1; (+) strand; PAM type: NRG; PAM sequence: TGG
ggggtggaggtggacgggga

SEQ ID NO: 101163 - DNA, 20 bp, Artificial Sequence
  Description of Artificial Sequence: Synthetic oligonucleotide
  Target: ATXN1; (+) strand; PAM type: NRG; PAM sequence: CGG
tggaggtggacggggatggc

SEQ ID NO: 101164 - DNA, 20 bp, Artificial Sequence
  Description of Artificial Sequence: Synthetic oligonucleotide
  Target: ATXN1; (+) strand; PAM type: NRG; PAM sequence: GAG
gaggtggacggggatggccg

SEQ ID NO: 101165 - DNA, 20 bp, Artificial Sequence
  Description of Artificial Sequence: Synthetic oligonucleotide
  Target: ATXN1; (+) strand; PAM type: NRG; PAM sequence: AGG
aggtggacggggatggccgg

SEQ ID NO: 101166 - DNA, 20 bp, Artificial Sequence
  Description of Artificial Sequence: Synthetic oligonucleotide
  Target: ATXN1; (+) strand; PAM type: NRG; PAM sequence: GAG
gtggacggggatggccggag

SEQ ID NO: 101167 - DNA, 20 bp, Artificial Sequence
  Description of Artificial Sequence: Synthetic oligonucleotide
  Target: ATXN1; (+) strand; PAM type: NRG; PAM sequence: GAG
ggacggggatggccggagga

SEQ ID NO: 101168 - DNA, 20 bp, Artificial Sequence
  Description of Artificial Sequence: Synthetic oligonucleotide
  Target: ATXN1; (+) strand; PAM type: NRG; PAM sequence: AGG
gacggggatggccggaggag

SEQ ID NO: 101169 - DNA, 20 bp, Artificial Sequence
  Description of Artificial Sequence: Synthetic oligonucleotide
  Target: ATXN1; (+) strand; PAM type: NRG; PAM sequence: CGG
ggggatggccggaggagagg

SEQ ID NO: 101170 - DNA, 20 bp, Artificial Sequence
  Description of Artificial Sequence: Synthetic oligonucleotide
  Target: ATXN1; (+) strand; PAM type: NRG; PAM sequence: CGG
tggccggaggagaggcggtg

SEQ ID NO: 101171 - DNA, 20 bp, Artificial Sequence
  Description of Artificial Sequence: Synthetic oligonucleotide
  Target: ATXN1; (+) strand; PAM type: NRG; PAM sequence: CGG
cggaggagaggcggtgcggc

SEQ ID NO: 101172 - DNA, 20 bp, Artificial Sequence
  Description of Artificial Sequence: Synthetic oligonucleotide
  Target: ATXN1; (+) strand; PAM type: NRG; PAM sequence: CGG
gcggtgcggccggtgttctg

SEQ ID NO: 101173 - DNA, 20 bp, Artificial Sequence
  Description of Artificial Sequence: Synthetic oligonucleotide
  Target: ATXN1; (+) strand; PAM type: NRG; PAM sequence: GAG
ggtgcggccggtgttctgcg

SEQ ID NO: 101174 - DNA, 20 bp, Artificial Sequence
  Description of Artificial Sequence: Synthetic oligonucleotide
  Target: ATXN1; (+) strand; PAM type: NRG; PAM sequence: TGG
gccggtgttctgcggagaac

SEQ ID NO: 101175 - DNA, 20 bp, Artificial Sequence
  Description of Artificial Sequence: Synthetic oligonucleotide
  Target: ATXN1; (+) strand; PAM type: NRG; PAM sequence: TGG
tctgcggagaactggaaatg

SEQ ID NO: 101176 - DNA, 20 bp, Artificial Sequence
  Description of Artificial Sequence: Synthetic oligonucleotide
  Target: ATXN1; (+) strand; PAM type: NRG; PAM sequence: TGG
aactggaaatgtggacgtac

SEQ ID NO: 101177 - DNA, 20 bp, Artificial Sequence
  Description of Artificial Sequence: Synthetic oligonucleotide
  Target: ATXN1; (+) strand; PAM type: NRG; PAM sequence: TGG
tgtggacgtactggttctgc

SEQ ID NO: 101178 - DNA, 20 bp, Artificial Sequence
  Description of Artificial Sequence: Synthetic oligonucleotide
  Target: ATXN1; (+) strand; PAM type: NRG; PAM sequence: GGG
gtggacgtactggttctgct

SEQ ID NO: 101179 - DNA, 20 bp, Artificial Sequence
  Description of Artificial Sequence: Synthetic oligonucleotide
  Target: ATXN1; (+) strand; PAM type: NRG; PAM sequence: TGG
acgtactggttctgctgggc

SEQ ID NO: 101180 - DNA, 20 bp, Artificial Sequence
  Description of Artificial Sequence: Synthetic oligonucleotide
  Target: ATXN1; (+) strand; PAM type: NRG; PAM sequence: TGG
tactggttctgctgggctgg

SEQ ID NO: 101181 - DNA, 20 bp, Artificial Sequence
  Description of Artificial Sequence: Synthetic oligonucleotide
  Target: ATXN1; (+) strand; PAM type: NRG; PAM sequence: GGG
actggttctgctgggctggt

SEQ ID NO: 101182 - DNA, 20 bp, Artificial Sequence
  Description of Artificial Sequence: Synthetic oligonucleotide
  Target: ATXN1; (+) strand; PAM type: NRG; PAM sequence: GGG
ctggttctgctgggctggtg

SEQ ID NO: 101183 - DNA, 20 bp, Artificial Sequence
  Description of Artificial Sequence: Synthetic oligonucleotide
  Target: ATXN1; (+) strand; PAM type: NRG; PAM sequence: GGG
tggttctgctgggctggtgg

SEQ ID NO: 101184 - DNA, 20 bp, Artificial Sequence
  Description of Artificial Sequence: Synthetic oligonucleotide
  Target: ATXN1; (+) strand; PAM type: NRG; PAM sequence: GGG
ggttctgctgggctggtggg

SEQ ID NO: 101185 - DNA, 20 bp, Artificial Sequence
  Description of Artificial Sequence: Synthetic oligonucleotide
  Target: ATXN1; (+) strand; PAM type: NRG; PAM sequence: GGG
gttctgctgggctggtgggg

SEQ ID NO: 101186 - DNA, 20 bp, Artificial Sequence
  Description of Artificial Sequence: Synthetic oligonucleotide
  Target: ATXN1; (+) strand; PAM type: NRG; PAM sequence: CGG
tgggctggtgggggggaccc

SEQ ID NO: 101187 - DNA, 20 bp, Artificial Sequence
  Description of Artificial Sequence: Synthetic oligonucleotide
  Target: ATXN1; (+) strand; PAM type: NRG; PAM sequence: GGG
gggctggtgggggggacccc

SEQ ID NO: 101188 - DNA, 20 bp, Artificial Sequence
  Description of Artificial Sequence: Synthetic oligonucleotide
  Target: ATXN1; (+) strand; PAM type: NRG; PAM sequence: GGG
ggctggtgggggggaccccg

SEQ ID NO: 101189 - DNA, 20 bp, Artificial Sequence
  Description of Artificial Sequence: Synthetic oligonucleotide
  Target: ATXN1; (+) strand; PAM type: NRG; PAM sequence: GAG
gggggggaccccggggtgat

SEQ ID NO: 101190 - DNA, 20 bp, Artificial Sequence
  Description of Artificial Sequence: Synthetic oligonucleotide
  Target: ATXN1; (+) strand; PAM type: NRG; PAM sequence: CGG
gaccccggggtgatgagccc

SEQ ID NO: 101191 - DNA, 20 bp, Artificial Sequence
  Description of Artificial Sequence: Synthetic oligonucleotide
  Target: ATXN1; (+) strand; PAM type: NRG; PAM sequence: GAG
ccccggggtgatgagccccg

SEQ ID NO: 101192 - DNA, 20 bp, Artificial Sequence
  Description of Artificial Sequence: Synthetic oligonucleotide
  Target: ATXN1; (+) strand; PAM type: NRG; PAM sequence: GAG
atgagccccggagccctgct

SEQ ID NO: 101193 - DNA, 20 bp, Artificial Sequence
  Description of Artificial Sequence: Synthetic oligonucleotide
  Target: ATXN1; (+) strand; PAM type: NRG; PAM sequence: AGG
tgagccccggagccctgctg

SEQ ID NO: 101194 - DNA, 20 bp, Artificial Sequence
  Description of Artificial Sequence: Synthetic oligonucleotide
  Target: ATXN1; (+) strand; PAM type: NRG; PAM sequence: CAG
ctgctgctgctgctgctgct

SEQ ID NO: 101195 - DNA, 20 bp, Artificial Sequence
  Description of Artificial Sequence: Synthetic oligonucleotide
  Target: ATXN1; (+) strand; PAM type: NRG; PAM sequence: CGG
tgctgctcagccttgtgtcc

SEQ ID NO: 101196 - DNA, 20 bp, Artificial Sequence
  Description of Artificial Sequence: Synthetic oligonucleotide
  Target: ATXN1; (+) strand; PAM type: NRG; PAM sequence: TGG
cagccttgtgtcccggcgtc

SEQ ID NO: 101197 - DNA, 20 bp, Artificial Sequence
  Description of Artificial Sequence: Synthetic oligonucleotide
  Target: ATXN1; (+) strand; PAM type: NRG; PAM sequence: CAG
ttgtgtcccggcgtctggct

SEQ ID NO: 101198 - DNA, 20 bp, Artificial Sequence
  Description of Artificial Sequence: Synthetic oligonucleotide
  Target: ATXN1; (+) strand; PAM type: NRG; PAM sequence: TGG
ctggctcagactgcccatgt

SEQ ID NO: 101199 - DNA, 20 bp, Artificial Sequence
  Description of Artificial Sequence: Synthetic oligonucleotide
  Target: ATXN1; (+) strand; PAM type: NRG; PAM sequence: CAG
ctcagactgcccatgttggc

SEQ ID NO: 101200 - DNA, 20 bp, Artificial Sequence
  Description of Artificial Sequence: Synthetic oligonucleotide
  Target: ATXN1; (+) strand; PAM type: NRG; PAM sequence: CAG
agactgcccatgttggccag

SEQ ID NO: 101201 - DNA, 20 bp, Artificial Sequence
  Description of Artificial Sequence: Synthetic oligonucleotide
  Target: ATXN1; (+) strand; PAM type: NRG; PAM sequence: GAG
actgcccatgttggccagca

SEQ ID NO: 101202 - DNA, 20 bp, Artificial Sequence
  Description of Artificial Sequence: Synthetic oligonucleotide
  Target: ATXN1; (+) strand; PAM type: NRG; PAM sequence: TGG
gcccatgttggccagcagag

SEQ ID NO: 101203 - DNA, 20 bp, Artificial Sequence
  Description of Artificial Sequence: Synthetic oligonucleotide
  Target: ATXN1; (+) strand; PAM type: NRG; PAM sequence: TAG
tgttggccagcagagtggaa

SEQ ID NO: 101204 - DNA, 20 bp, Artificial Sequence
  Description of Artificial Sequence: Synthetic oligonucleotide
  Target: ATXN1; (+) strand; PAM type: NRG; PAM sequence: AGG
gttggccagcagagtggaat

SEQ ID NO: 101205 - DNA, 20 bp, Artificial Sequence
  Description of Artificial Sequence: Synthetic oligonucleotide
  Target: ATXN1; (+) strand; PAM type: NRG; PAM sequence: CAG
agcagagtggaataggcctc

SEQ ID NO: 101206 - DNA, 20 bp, Artificial Sequence
  Description of Artificial Sequence: Synthetic oligonucleotide
  Target: ATXN1; (+) strand; PAM type: NRG; PAM sequence: TGG
gagtggaataggcctccagc

SEQ ID NO: 101207 - DNA, 20 bp, Artificial Sequence
  Description of Artificial Sequence: Synthetic oligonucleotide
  Target: ATXN1; (+) strand; PAM type: NRG; PAM sequence: GGG
agtggaataggcctccagct

SEQ ID NO: 101208 - DNA, 20 bp, Artificial Sequence
  Description of Artificial Sequence: Synthetic oligonucleotide
  Target: ATXN1; (+) strand; PAM type: NRG; PAM sequence: GAG
tggaataggcctccagctgg

SEQ ID NO: 101209 - DNA, 20 bp, Artificial Sequence
  Description of Artificial Sequence: Synthetic oligonucleotide
  Target: ATXN1; (+) strand; PAM type: NRG; PAM sequence: TGG
aggcctccagctgggagcgc

SEQ ID NO: 101210 - DNA, 20 bp, Artificial Sequence
  Description of Artificial Sequence: Synthetic oligonucleotide
  Target: ATXN1; (+) strand; PAM type: NRG; PAM sequence: GGG
ggcctccagctgggagcgct

SEQ ID NO: 101211 - DNA, 20 bp, Artificial Sequence
  Description of Artificial Sequence: Synthetic oligonucleotide
  Target: ATXN1; (+) strand; PAM type: NRG; PAM sequence: TGG
tccagctgggagcgctggga

SEQ ID NO: 101212 - DNA, 20 bp, Artificial Sequence
  Description of Artificial Sequence: Synthetic oligonucleotide
  Target: ATXN1; (+) strand; PAM type: NRG; PAM sequence: GAG
cagctgggagcgctgggatg

SEQ ID NO: 101213 - DNA, 20 bp, Artificial Sequence
  Description of Artificial Sequence: Synthetic oligonucleotide
  Target: ATXN1; (+) strand; PAM type: NRG; PAM sequence: TGG
ctgggagcgctgggatggag

SEQ ID NO: 101214 - DNA, 20 bp, Artificial Sequence
  Description of Artificial Sequence: Synthetic oligonucleotide
  Target: ATXN1; (+) strand; PAM type: NRG; PAM sequence: TGG
ggagcgctgggatggagtgg

SEQ ID NO: 101215 - DNA, 20 bp, Artificial Sequence
  Description of Artificial Sequence: Synthetic oligonucleotide
  Target: ATXN1; (+) strand; PAM type: NRG; PAM sequence: CGG
ggatggagtggtggcccctg

SEQ ID NO: 101216 - DNA, 20 bp, Artificial Sequence
  Description of Artificial Sequence: Synthetic oligonucleotide
  Target: ATXN1; (+) strand; PAM type: NRG; PAM sequence: GAG
gagtggtggcccctgcggcc

SEQ ID NO: 101217 - DNA, 20 bp, Artificial Sequence
  Description of Artificial Sequence: Synthetic oligonucleotide
  Target: ATXN1; (+) strand; PAM type: NRG; PAM sequence: AGG
agtggtggcccctgcggccg

SEQ ID NO: 101218 - DNA, 20 bp, Artificial Sequence
  Description of Artificial Sequence: Synthetic oligonucleotide
  Target: ATXN1; (+) strand; PAM type: NRG; PAM sequence: TGG
tgcggccgaggccactgcac

SEQ ID NO: 101219 - DNA, 20 bp, Artificial Sequence
  Description of Artificial Sequence: Synthetic oligonucleotide
  Target: ATXN1; (+) strand; PAM type: NRG; PAM sequence: CGG
cgaggccactgcactggtga

SEQ ID NO: 101220 - DNA, 20 bp, Artificial Sequence
  Description of Artificial Sequence: Synthetic oligonucleotide
  Target: ATXN1; (+) strand; PAM type: NRG; PAM sequence: GGG
gaggccactgcactggtgac

SEQ ID NO: 101221 - DNA, 20 bp, Artificial Sequence
  Description of Artificial Sequence: Synthetic oligonucleotide
  Target: ATXN1; (+) strand; PAM type: NRG; PAM sequence: GGG
aggccactgcactggtgacg

SEQ ID NO: 101222 - DNA, 20 bp, Artificial Sequence
  Description of Artificial Sequence: Synthetic oligonucleotide
  Target: ATXN1; (+) strand; PAM type: NRG; PAM sequence: TGG
cactgcactggtgacggggt

SEQ ID NO: 101223 - DNA, 20 bp, Artificial Sequence
  Description of Artificial Sequence: Synthetic oligonucleotide
  Target: ATXN1; (+) strand; PAM type: NRG; PAM sequence: CGG
tgcactggtgacggggttgg

SEQ ID NO: 101224 - DNA, 20 bp, Artificial Sequence
  Description of Artificial Sequence: Synthetic oligonucleotide
  Target: ATXN1; (+) strand; PAM type: NRG; PAM sequence: TGG
ctggtgacggggttggcggt

SEQ ID NO: 101225 - DNA, 20 bp, Artificial Sequence
  Description of Artificial Sequence: Synthetic oligonucleotide
  Target: ATXN1; (+) strand; PAM type: NRG; PAM sequence: GGG
tggtgacggggttggcggtt

SEQ ID NO: 101226 - DNA, 20 bp, Artificial Sequence
  Description of Artificial Sequence: Synthetic oligonucleotide
  Target: ATXN1; (+) strand; PAM type: NRG; PAM sequence: GGG
ggtgacggggttggcggttg

SEQ ID NO: 101227 - DNA, 20 bp, Artificial Sequence
  Description of Artificial Sequence: Synthetic oligonucleotide
  Target: ATXN1; (+) strand; PAM type: NRG; PAM sequence: GGG
gtgacggggttggcggttgg

SEQ ID NO: 101228 - DNA, 20 bp, Artificial Sequence
  Description of Artificial Sequence: Synthetic oligonucleotide
  Target: ATXN1; (+) strand; PAM type: NRG; PAM sequence: GGG
tgacggggttggcggttggg

SEQ ID NO: 101229 - DNA, 20 bp, Artificial Sequence
  Description of Artificial Sequence: Synthetic oligonucleotide
  Target: ATXN1; (+) strand; PAM type: NRG; PAM sequence: CAG
gggttggcggttggggggat

SEQ ID NO: 101230 - DNA, 20 bp, Artificial Sequence
  Description of Artificial Sequence: Synthetic oligonucleotide
  Target: ATXN1; (+) strand; PAM type: NRG; PAM sequence: TGG
gttggggggatcagctgtga

SEQ ID NO: 101231 - DNA, 20 bp, Artificial Sequence
  Description of Artificial Sequence: Synthetic oligonucleotide
  Target: ATXN1; (+) strand; PAM type: NRG; PAM sequence: GGG
ttggggggatcagctgtgat

SEQ ID NO: 101232 - DNA, 20 bp, Artificial Sequence
  Description of Artificial Sequence: Synthetic oligonucleotide
  Target: ATXN1; (+) strand; PAM type: NRG; PAM sequence: AAG
ggatcagctgtgatgggatg

SEQ ID NO: 101233 - DNA, 20 bp, Artificial Sequence
  Description of Artificial Sequence: Synthetic oligonucleotide
  Target: ATXN1; (+) strand; PAM type: NRG; PAM sequence: TGG
cagctgtgatgggatgaagc

SEQ ID NO: 101234 - DNA, 20 bp, Artificial Sequence
  Description of Artificial Sequence: Synthetic oligonucleotide
  Target: ATXN1; (+) strand; PAM type: NRG; PAM sequence: TAG
gtgatgggatgaagctggca

SEQ ID NO: 101235 - DNA, 20 bp, Artificial Sequence
  Description of Artificial Sequence: Synthetic oligonucleotide
  Target: ATXN1; (+) strand; PAM type: NRG; PAM sequence: AGG
tgatgggatgaagctggcat

SEQ ID NO: 101236 - DNA, 20 bp, Artificial Sequence
  Description of Artificial Sequence: Synthetic oligonucleotide
  Target: ATXN1; (+) strand; PAM type: NRG; PAM sequence: TGG
tggcataggttccactgtat

SEQ ID NO: 101237 - DNA, 20 bp, Artificial Sequence
  Description of Artificial Sequence: Synthetic oligonucleotide
  Target: ATXN1; (+) strand; PAM type: NRG; PAM sequence: GGG
ggcataggttccactgtatt

SEQ ID NO: 101238 - DNA, 20 bp, Artificial Sequence
  Description of Artificial Sequence: Synthetic oligonucleotide
  Target: ATXN1; (+) strand; PAM type: NRG; PAM sequence: GAG
cataggttccactgtattgg

SEQ ID NO: 101239 - DNA, 20 bp, Artificial Sequence
  Description of Artificial Sequence: Synthetic oligonucleotide
  Target: ATXN1; (+) strand; PAM type: NRG; PAM sequence: AGG
ataggttccactgtattggg

SEQ ID NO: 101240 - DNA, 20 bp, Artificial Sequence
  Description of Artificial Sequence: Synthetic oligonucleotide
  Target: ATXN1; (+) strand; PAM type: NRG; PAM sequence: TGG
attgggaggacccaatgaac

SEQ ID NO: 101241 - DNA, 20 bp, Artificial Sequence
  Description of Artificial Sequence: Synthetic oligonucleotide
  Target: ATXN1; (+) strand; PAM type: NRG; PAM sequence: AAG
gggaggacccaatgaactgg

SEQ ID NO: 101242 - DNA, 20 bp, Artificial Sequence
  Description of Artificial Sequence: Synthetic oligonucleotide
  Target: ATXN1; (+) strand; PAM type: NRG; PAM sequence: AGG
ggaggacccaatgaactgga

SEQ ID NO: 101243 - DNA, 20 bp, Artificial Sequence
  Description of Artificial Sequence: Synthetic oligonucleotide
  Target: ATXN1; (+) strand; PAM type: NRG; PAM sequence: CGG
ccaatgaactggaaggtgtg

SEQ ID NO: 101244 - DNA, 20 bp, Artificial Sequence
  Description of Artificial Sequence: Synthetic oligonucleotide
  Target: ATXN1; (+) strand; PAM type: NRG; PAM sequence: CAG
atgaactggaaggtgtgcgg

SEQ ID NO: 101245 - DNA, 20 bp, Artificial Sequence
  Description of Artificial Sequence: Synthetic oligonucleotide
  Target: ATXN1; (+) strand; PAM type: NRG; PAM sequence: AGG
tgaactggaaggtgtgcggc

SEQ ID NO: 101246 - DNA, 20 bp, Artificial Sequence
  Description of Artificial Sequence: Synthetic oligonucleotide
  Target: ATXN1; (+) strand; PAM type: NRG; PAM sequence: GAG
ctggaaggtgtgcggcaggt

SEQ ID NO: 101247 - DNA, 20 bp, Artificial Sequence
  Description of Artificial Sequence: Synthetic oligonucleotide
  Target: ATXN1; (+) strand; PAM type: NRG; PAM sequence: CGG
cggcaggtgagcgtactgca

SEQ ID NO: 101248 - DNA, 20 bp, Artificial Sequence
  Description of Artificial Sequence: Synthetic oligonucleotide
  Target: ATXN1; (+) strand; PAM type: NRG; PAM sequence: GGG
ggcaggtgagcgtactgcac

SEQ ID NO: 101249 - DNA, 20 bp, Artificial Sequence
  Description of Artificial Sequence: Synthetic oligonucleotide
  Target: ATXN1; (+) strand; PAM type: NRG; PAM sequence: GGG
gcaggtgagcgtactgcacg

SEQ ID NO: 101250 - DNA, 20 bp, Artificial Sequence
  Description of Artificial Sequence: Synthetic oligonucleotide
  Target: ATXN1; (+) strand; PAM type: NRG; PAM sequence: GGG
caggtgagcgtactgcacgg

SEQ ID NO: 101251 - DNA, 20 bp, Artificial Sequence
  Description of Artificial Sequence: Synthetic oligonucleotide
  Target: ATXN1; (+) strand; PAM type: NRG; PAM sequence: CGG
gcgtactgcacgggggacac

SEQ ID NO: 101252 - DNA, 20 bp, Artificial Sequence
  Description of Artificial Sequence: Synthetic oligonucleotide
  Target: ATXN1; (+) strand; PAM type: NRG; PAM sequence: GGG
cgtactgcacgggggacacc

SEQ ID NO: 101253 - DNA, 20 bp, Artificial Sequence
  Description of Artificial Sequence: Synthetic oligonucleotide
  Target: ATXN1; (+) strand; PAM type: NRG; PAM sequence: GGG
gtactgcacgggggacaccg

SEQ ID NO: 101254 - DNA, 20 bp, Artificial Sequence
  Description of Artificial Sequence: Synthetic oligonucleotide
  Target: ATXN1; (+) strand; PAM type: NRG; PAM sequence: TGG
acgggggacaccggggtccc

SEQ ID NO: 101255 - DNA, 20 bp, Artificial Sequence
  Description of Artificial Sequence: Synthetic oligonucleotide
  Target: ATXN1; (+) strand; PAM type: NRG; PAM sequence: CGG
gacaccggggtccctggctg

SEQ ID NO: 101256 - DNA, 20 bp, Artificial Sequence
  Description of Artificial Sequence: Synthetic oligonucleotide
  Target: ATXN1; (+) strand; PAM type: NRG; PAM sequence: GGG
acaccggggtccctggctgc

SEQ ID NO: 101257 - DNA, 20 bp, Artificial Sequence
  Description of Artificial Sequence: Synthetic oligonucleotide
  Target: ATXN1; (+) strand; PAM type: NRG; PAM sequence: GGG
caccggggtccctggctgcg

SEQ ID NO: 101258 - DNA, 20 bp, Artificial Sequence
  Description of Artificial Sequence: Synthetic oligonucleotide
  Target: ATXN1; (+) strand; PAM type: NRG; PAM sequence: TGG
cggggtccctggctgcgggg

SEQ ID NO: 101259 - DNA, 20 bp, Artificial Sequence
  Description of Artificial Sequence: Synthetic oligonucleotide
  Target: ATXN1; (+) strand; PAM type: NRG; PAM sequence: CGG
tggctgcggggtggcgtacg

SEQ ID NO: 101260 - DNA, 20 bp, Artificial Sequence
  Description of Artificial Sequence: Synthetic oligonucleotide
  Target: ATXN1; (+) strand; PAM type: NRG; PAM sequence: CAG
ctgcggggtggcgtacgcgg

SEQ ID NO: 101261 - DNA, 20 bp, Artificial Sequence
  Description of Artificial Sequence: Synthetic oligonucleotide
  Target: ATXN1; (+) strand; PAM type: NRG; PAM sequence: AGG
tgcggggtggcgtacgcggc

SEQ ID NO: 101262 - DNA, 20 bp, Artificial Sequence
  Description of Artificial Sequence: Synthetic oligonucleotide
  Target: ATXN1; (+) strand; PAM type: NRG; PAM sequence: CAG
ggggtggcgtacgcggcagg

SEQ ID NO: 101263 - DNA, 20 bp, Artificial Sequence
  Description of Artificial Sequence: Synthetic oligonucleotide
  Target: ATXN1; (+) strand; PAM type: NRG; PAM sequence: TGG
ggcgtacgcggcaggcagcg

SEQ ID NO: 101264 - DNA, 20 bp, Artificial Sequence
  Description of Artificial Sequence: Synthetic oligonucleotide
  Target: ATXN1; (+) strand; PAM type: NRG; PAM sequence: TGG
gtacgcggcaggcagcgtgg

SEQ ID NO: 101265 - DNA, 20 bp, Artificial Sequence
  Description of Artificial Sequence: Synthetic oligonucleotide
  Target: ATXN1; (+) strand; PAM type: NRG; PAM sequence: CGG
ggcaggcagcgtggtggcca

SEQ ID NO: 101266 - DNA, 20 bp, Artificial Sequence
  Description of Artificial Sequence: Synthetic oligonucleotide
  Target: ATXN1; (+) strand; PAM type: NRG; PAM sequence: GGG
gcaggcagcgtggtggccac

SEQ ID NO: 101267 - DNA, 20 bp, Artificial Sequence
  Description of Artificial Sequence: Synthetic oligonucleotide
  Target: ATXN1; (+) strand; PAM type: NRG; PAM sequence: GGG
caggcagcgtggtggccacg

SEQ ID NO: 101268 - DNA, 20 bp, Artificial Sequence
  Description of Artificial Sequence: Synthetic oligonucleotide
  Target: ATXN1; (+) strand; PAM type: NRG; PAM sequence: CAG
cagcgtggtggccacgggga

SEQ ID NO: 101269 - DNA, 20 bp, Artificial Sequence
  Description of Artificial Sequence: Synthetic oligonucleotide
  Target: ATXN1; (+) strand; PAM type: NRG; PAM sequence: TGG
ggtggccacggggacagacc

SEQ ID NO: 101270 - DNA, 20 bp, Artificial Sequence
  Description of Artificial Sequence: Synthetic oligonucleotide
  Target: ATXN1; (+) strand; PAM type: NRG; PAM sequence: GGG
gtggccacggggacagacct

SEQ ID NO: 101271 - DNA, 20 bp, Artificial Sequence
  Description of Artificial Sequence: Synthetic oligonucleotide
  Target: ATXN1; (+) strand; PAM type: NRG; PAM sequence: GAG
ggccacggggacagacctgg

SEQ ID NO: 101272 - DNA, 20 bp, Artificial Sequence
  Description of Artificial Sequence: Synthetic oligonucleotide
  Target: ATXN1; (+) strand; PAM type: NRG; PAM sequence: TGG
ggggacagacctgggagcgc

SEQ ID NO: 101273 - DNA, 20 bp, Artificial Sequence
  Description of Artificial Sequence: Synthetic oligonucleotide
  Target: ATXN1; (+) strand; PAM type: NRG; PAM sequence: GGG
gggacagacctgggagcgct

SEQ ID NO: 101274 - DNA, 20 bp, Artificial Sequence
  Description of Artificial Sequence: Synthetic oligonucleotide
  Target: ATXN1; (+) strand; PAM type: NRG; PAM sequence: CGG
acagacctgggagcgctggg

SEQ ID NO: 101275 - DNA, 20 bp, Artificial Sequence
  Description of Artificial Sequence: Synthetic oligonucleotide
  Target: ATXN1; (+) strand; PAM type: NRG; PAM sequence: GGG
cagacctgggagcgctgggc

SEQ ID NO: 101276 - DNA, 20 bp, Artificial Sequence
  Description of Artificial Sequence: Synthetic oligonucleotide
  Target: ATXN1; (+) strand; PAM type: NRG; PAM sequence: GGG
agacctgggagcgctgggcg

SEQ ID NO: 101277 - DNA, 20 bp, Artificial Sequence
  Description of Artificial Sequence: Synthetic oligonucleotide
  Target: ATXN1; (+) strand; PAM type: NRG; PAM sequence: GAG
acctgggagcgctgggcggg

SEQ ID NO: 101278 - DNA, 20 bp, Artificial Sequence
  Description of Artificial Sequence: Synthetic oligonucleotide
  Target: ATXN1; (+) strand; PAM type: NRG; PAM sequence: TAG
tgggagcgctgggcggggag

SEQ ID NO: 101279 - DNA, 20 bp, Artificial Sequence
  Description of Artificial Sequence: Synthetic oligonucleotide
  Target: ATXN1; (+) strand; PAM type: NRG; PAM sequence: CAG
gcgctgggcggggagtagtc

SEQ ID NO: 101280 - DNA, 20 bp, Artificial Sequence
  Description of Artificial Sequence: Synthetic oligonucleotide
  Target: ATXN1; (+) strand; PAM type: NRG; PAM sequence: TGG
cggggagtagtccagccctg

SEQ ID NO: 101281 - DNA, 20 bp, Artificial Sequence
  Description of Artificial Sequence: Synthetic oligonucleotide
  Target: ATXN1; (+) strand; PAM type: NRG; PAM sequence: AAG
cctattccctgttgtaaacc

SEQ ID NO: 101282 - DNA, 20 bp, Artificial Sequence
  Description of Artificial Sequence: Synthetic oligonucleotide
  Target: ATXN1; (+) strand; PAM type: NRG; PAM sequence: GAG
gttgtaaaccaagctccacc

SEQ ID NO: 101283 - DNA, 20 bp, Artificial Sequence
  Description of Artificial Sequence: Synthetic oligonucleotide
  Target: ATXN1; (+) strand; PAM type: NRG; PAM sequence: AGG
ttgtaaaccaagctccaccg

SEQ ID NO: 101284 - DNA, 20 bp, Artificial Sequence
  Description of Artificial Sequence: Synthetic oligonucleotide
  Target: ATXN1; (+) strand; PAM type: NRG; PAM sequence: CGG
agctccaccgaggtccctgc

SEQ ID NO: 101285 - DNA, 20 bp, Artificial Sequence
  Description of Artificial Sequence: Synthetic oligonucleotide
  Target: ATXN1; (+) strand; PAM type: NRG; PAM sequence: TGG
gcccatgcctcccgcccccg

SEQ ID NO: 101286 - DNA, 20 bp, Artificial Sequence
  Description of Artificial Sequence: Synthetic oligonucleotide
  Target: ATXN1; (+) strand; PAM type: NRG; PAM sequence: CGG
gcctcccgcccccgtggccc

SEQ ID NO: 101287 - DNA, 20 bp, Artificial Sequence
  Description of Artificial Sequence: Synthetic oligonucleotide
  Target: ATXN1; (+) strand; PAM type: NRG; PAM sequence: CAG
gcccccgtggccccggccac

SEQ ID NO: 101288 - DNA, 20 bp, Artificial Sequence
  Description of Artificial Sequence: Synthetic oligonucleotide
  Target: ATXN1; (+) strand; PAM type: NRG; PAM sequence: AGG
cccccgtggccccggccacc

SEQ ID NO: 101289 - DNA, 20 bp, Artificial Sequence
  Description of Artificial Sequence: Synthetic oligonucleotide
  Target: ATXN1; (+) strand; PAM type: NRG; PAM sequence: GGG
ccccgtggccccggccacca

SEQ ID NO: 101290 - DNA, 20 bp, Artificial Sequence
  Description of Artificial Sequence: Synthetic oligonucleotide
  Target: ATXN1; (+) strand; PAM type: NRG; PAM sequence: CGG
ccccggccaccagggttgcc

SEQ ID NO: 101291 - DNA, 20 bp, Artificial Sequence
  Description of Artificial Sequence: Synthetic oligonucleotide
  Target: ATXN1; (+) strand; PAM type: NRG; PAM sequence: GGG
cccggccaccagggttgccc

SEQ ID NO: 101292 - DNA, 20 bp, Artificial Sequence
  Description of Artificial Sequence: Synthetic oligonucleotide
  Target: ATXN1; (+) strand; PAM type: NRG; PAM sequence: GAG
cggccaccagggttgcccgg

SEQ ID NO: 101293 - DNA, 20 bp, Artificial Sequence
  Description of Artificial Sequence: Synthetic oligonucleotide
  Target: ATXN1; (+) strand; PAM type: NRG; PAM sequence: CGG
gccatgctgtgccctccacc

SEQ ID NO: 101294 - DNA, 20 bp, Artificial Sequence
  Description of Artificial Sequence: Synthetic oligonucleotide
  Target: ATXN1; (+) strand; PAM type: NRG; PAM sequence: TGG
atgctgtgccctccacccgg

SEQ ID NO: 101295 - DNA, 20 bp, Artificial Sequence
  Description of Artificial Sequence: Synthetic oligonucleotide
  Target: ATXN1; (+) strand; PAM type: NRG; PAM sequence: TGG
ctccacccggtggttgtcgc

SEQ ID NO: 101296 - DNA, 20 bp, Artificial Sequence
  Description of Artificial Sequence: Synthetic oligonucleotide
  Target: ATXN1; (+) strand; PAM type: NRG; PAM sequence: GGG
tccacccggtggttgtcgct

SEQ ID NO: 101297 - DNA, 20 bp, Artificial Sequence
  Description of Artificial Sequence: Synthetic oligonucleotide
  Target: ATXN1; (+) strand; PAM type: NRG; PAM sequence: CAG
acccggtggttgtcgctggg

SEQ ID NO: 101298 - DNA, 20 bp, Artificial Sequence
  Description of Artificial Sequence: Synthetic oligonucleotide
  Target: ATXN1; (+) strand; PAM type: NRG; PAM sequence: AGG
cccggtggttgtcgctgggc

SEQ ID NO: 101299 - DNA, 20 bp, Artificial Sequence
  Description of Artificial Sequence: Synthetic oligonucleotide
  Target: ATXN1; (+) strand; PAM type: NRG; PAM sequence: GGG
ccggtggttgtcgctgggca

SEQ ID NO: 101300 - DNA, 20 bp, Artificial Sequence
  Description of Artificial Sequence: Synthetic oligonucleotide
  Target: ATXN1; (+) strand; PAM type: NRG; PAM sequence: TAG
gtggttgtcgctgggcaggg

SEQ ID NO: 101301 - DNA, 20 bp, Artificial Sequence
  Description of Artificial Sequence: Synthetic oligonucleotide
  Target: ATXN1; (+) strand; PAM type: NRG; PAM sequence: AGG
tggttgtcgctgggcagggt

SEQ ID NO: 101302 - DNA, 20 bp, Artificial Sequence
  Description of Artificial Sequence: Synthetic oligonucleotide
  Target: ATXN1; (+) strand; PAM type: NRG; PAM sequence: GGG
ggttgtcgctgggcagggta

SEQ ID NO: 101303 - DNA, 20 bp, Artificial Sequence
  Description of Artificial Sequence: Synthetic oligonucleotide
  Target: ATXN1; (+) strand; PAM type: NRG; PAM sequence: GGG
gttgtcgctgggcagggtag

SEQ ID NO: 101304 - DNA, 20 bp, Artificial Sequence
  Description of Artificial Sequence: Synthetic oligonucleotide
  Target: ATXN1; (+) strand; PAM type: NRG; PAM sequence: CGG
cagggtaggggccttctcct

SEQ ID NO: 101305 - DNA, 20 bp, Artificial Sequence
  Description of Artificial Sequence: Synthetic oligonucleotide
  Target: ATXN1; (+) strand; PAM type: NRG; PAM sequence: GAG
gggtaggggccttctcctcg

SEQ ID NO: 101306 - DNA, 20 bp, Artificial Sequence
  Description of Artificial Sequence: Synthetic oligonucleotide
  Target: ATXN1; (+) strand; PAM type: NRG; PAM sequence: AGG
ggtaggggccttctcctcgg

SEQ ID NO: 101307 - DNA, 20 bp, Artificial Sequence
  Description of Artificial Sequence: Synthetic oligonucleotide
  Target: ATXN1; (+) strand; PAM type: NRG; PAM sequence: CGG
gggccttctcctcggaggac

SEQ ID NO: 101308 - DNA, 20 bp, Artificial Sequence
  Description of Artificial Sequence: Synthetic oligonucleotide
  Target: ATXN1; (+) strand; PAM type: NRG; PAM sequence: TGG
cttctcctcggaggaccggc

SEQ ID NO: 101309 - DNA, 20 bp, Artificial Sequence
  Description of Artificial Sequence: Synthetic oligonucleotide
  Target: ATXN1; (+) strand; PAM type: NRG; PAM sequence: TGG
ctcctcggaggaccggctgg

SEQ ID NO: 101310 - DNA, 20 bp, Artificial Sequence
  Description of Artificial Sequence: Synthetic oligonucleotide
  Target: ATXN1; (+) strand; PAM type: NRG; PAM sequence: CGG
ctcggaggaccggctggtgg

SEQ ID NO: 101311 - DNA, 20 bp, Artificial Sequence
  Description of Artificial Sequence: Synthetic oligonucleotide
  Target: ATXN1; (+) strand; PAM type: NRG; PAM sequence: GGG
tcggaggaccggctggtggc

SEQ ID NO: 101312 - DNA, 20 bp, Artificial Sequence
  Description of Artificial Sequence: Synthetic oligonucleotide
  Target: ATXN1; (+) strand; PAM type: NRG; PAM sequence: GGG
cggaggaccggctggtggcg

SEQ ID NO: 101313 - DNA, 20 bp, Artificial Sequence
  Description of Artificial Sequence: Synthetic oligonucleotide
  Target: ATXN1; (+) strand; PAM type: NRG; PAM sequence: TGG
ggcggggatctcgcgcttct

SEQ ID NO: 101314 - DNA, 20 bp, Artificial Sequence
  Description of Artificial Sequence: Synthetic oligonucleotide
  Target: ATXN1; (+) strand; PAM type: NRG; PAM sequence: GGG
gcggggatctcgcgcttctt

SEQ ID NO: 101315 - DNA, 20 bp, Artificial Sequence
  Description of Artificial Sequence: Synthetic oligonucleotide
  Target: ATXN1; (+) strand; PAM type: NRG; PAM sequence: GAG
ggggatctcgcgcttcttgg

SEQ ID NO: 101316 - DNA, 20 bp, Artificial Sequence
  Description of Artificial Sequence: Synthetic oligonucleotide
  Target: ATXN1; (+) strand; PAM type: NRG; PAM sequence: AGG
gggatctcgcgcttcttggg

SEQ ID NO: 101317 - DNA, 20 bp, Artificial Sequence
  Description of Artificial Sequence: Synthetic oligonucleotide
  Target: ATXN1; (+) strand; PAM type: NRG; PAM sequence: CAG
atctcgcgcttcttgggagg

SEQ ID NO: 101318 - DNA, 20 bp, Artificial Sequence
  Description of Artificial Sequence: Synthetic oligonucleotide
  Target: ATXN1; (+) strand; PAM type: NRG; PAM sequence: AGG
tctcgcgcttcttgggaggc

SEQ ID NO: 101319 - DNA, 20 bp, Artificial Sequence
  Description of Artificial Sequence: Synthetic oligonucleotide
  Target: ATXN1; (+) strand; PAM type: NRG; PAM sequence: TGG
ggcattcgttgctccgctct

SEQ ID NO: 101320 - DNA, 20 bp, Artificial Sequence
  Description of Artificial Sequence: Synthetic oligonucleotide
  Target: ATXN1; (+) strand; PAM type: NRG; PAM sequence: TGG
ttcgttgctccgctcttggt

SEQ ID NO: 101321 - DNA, 20 bp, Artificial Sequence
  Description of Artificial Sequence: Synthetic oligonucleotide
  Target: ATXN1; (+) strand; PAM type: NRG; PAM sequence: CGG
ttttcgccgtcccccctcca

SEQ ID NO: 101322 - DNA, 20 bp, Artificial Sequence
  Description of Artificial Sequence: Synthetic oligonucleotide
  Target: ATXN1; (+) strand; PAM type: NRG; PAM sequence: TGG
acggtgactgtttcactgtc

SEQ ID NO: 101323 - DNA, 20 bp, Artificial Sequence
  Description of Artificial Sequence: Synthetic oligonucleotide
  Target: ATXN1; (+) strand; PAM type: NRG; PAM sequence: TGG
tgactgtttcactgtctgga

SEQ ID NO: 101324 - DNA, 20 bp, Artificial Sequence
  Description of Artificial Sequence: Synthetic oligonucleotide
  Target: ATXN1; (+) strand; PAM type: NRG; PAM sequence: TAG
tgtctggatggctctgattt

SEQ ID NO: 101325 - DNA, 20 bp, Artificial Sequence
  Description of Artificial Sequence: Synthetic oligonucleotide
  Target: ATXN1; (+) strand; PAM type: NRG; PAM sequence: CGG
tctgattttagtctgataaa

SEQ ID NO: 101326 - DNA, 20 bp, Artificial Sequence
  Description of Artificial Sequence: Synthetic oligonucleotide
  Target: ATXN1; (+) strand; PAM type: NRG; PAM sequence: AAG
attttagtctgataaacgga

SEQ ID NO: 101327 - DNA, 20 bp, Artificial Sequence
  Description of Artificial Sequence: Synthetic oligonucleotide
  Target: ATXN1; (+) strand; PAM type: NRG; PAM sequence: TAG
aaagtcacatttgatttctg

SEQ ID NO: 101328 - DNA, 20 bp, Artificial Sequence
  Description of Artificial Sequence: Synthetic oligonucleotide
  Target: ATXN1; (+) strand; PAM type: NRG; PAM sequence: AGG
aagtcacatttgatttctgt

SEQ ID NO: 101329 - DNA, 20 bp, Artificial Sequence
  Description of Artificial Sequence: Synthetic oligonucleotide
  Target: ATXN1; (+) strand; PAM type: NRG; PAM sequence: GGG
agtcacatttgatttctgta

SEQ ID NO: 101330 - DNA, 20 bp, Artificial Sequence
  Description of Artificial Sequence: Synthetic oligonucleotide
  Target: ATXN1; (+) strand; PAM type: NRG; PAM sequence: GGG
gtcacatttgatttctgtag

SEQ ID NO: 101331 - DNA, 20 bp, Artificial Sequence
  Description of Artificial Sequence: Synthetic oligonucleotide
  Target: ATXN1; (+) strand; PAM type: NRG; PAM sequence: CAG
tttgatttctgtaggggatc

SEQ ID NO: 101332 - DNA, 20 bp, Artificial Sequence
  Description of Artificial Sequence: Synthetic oligonucleotide
  Target: ATXN1; (+) strand; PAM type: NRG; PAM sequence: AGG
ttgatttctgtaggggatcc

SEQ ID NO: 101333 - DNA, 20 bp, Artificial Sequence
  Description of Artificial Sequence: Synthetic oligonucleotide
  Target: ATXN1; (+) strand; PAM type: NRG; PAM sequence: GAG
aggggatccaggctcttcat

SEQ ID NO: 101334 - DNA, 20 bp, Artificial Sequence
  Description of Artificial Sequence: Synthetic oligonucleotide
  Target: ATXN1; (+) strand; PAM type: NRG; PAM sequence: AGG
ggggatccaggctcttcatg

SEQ ID NO: 101335 - DNA, 20 bp, Artificial Sequence
  Description of Artificial Sequence: Synthetic oligonucleotide
  Target: ATXN1; (+) strand; PAM type: NRG; PAM sequence: TGG
catgaggaatcatctccccg

SEQ ID NO: 101336 - DNA, 20 bp, Artificial Sequence
  Description of Artificial Sequence: Synthetic oligonucleotide
  Target: ATXN1; (+) strand; PAM type: NRG; PAM sequence: GGG
atgaggaatcatctccccgt

SEQ ID NO: 101337 - DNA, 20 bp, Artificial Sequence
  Description of Artificial Sequence: Synthetic oligonucleotide
  Target: ATXN1; (+) strand; PAM type: NRG; PAM sequence: CAG
ccgtgggtacaatccgccaa

SEQ ID NO: 101338 - DNA, 20 bp, Artificial Sequence
  Description of Artificial Sequence: Synthetic oligonucleotide
  Target: ATXN1; (+) strand; PAM type: NRG; PAM sequence: CAG
tgggtacaatccgccaacag

SEQ ID NO: 101339 - DNA, 20 bp, Artificial Sequence
  Description of Artificial Sequence: Synthetic oligonucleotide
  Target: ATXN1; (+) strand; PAM type: NRG; PAM sequence: TGG
caatccgccaacagcagctc

SEQ ID NO: 101340 - DNA, 20 bp, Artificial Sequence
  Description of Artificial Sequence: Synthetic oligonucleotide
  Target: ATXN1; (+) strand; PAM type: NRG; PAM sequence: TGG
ccaacagcagctctggatgc

SEQ ID NO: 101341 - DNA, 20 bp, Artificial Sequence
  Description of Artificial Sequence: Synthetic oligonucleotide
  Target: ATXN1; (+) strand; PAM type: NRG; PAM sequence: GGG
caacagcagctctggatgct

SEQ ID NO: 101342 - DNA, 20 bp, Artificial Sequence
  Description of Artificial Sequence: Synthetic oligonucleotide
  Target: ATXN1; (+) strand; PAM type: NRG; PAM sequence: AAG
agcagctctggatgctggga

SEQ ID NO: 101343 - DNA, 20 bp, Artificial Sequence
  Description of Artificial Sequence: Synthetic oligonucleotide
  Target: ATXN1; (+) strand; PAM type: NRG; PAM sequence: AGG
gcagctctggatgctgggaa

SEQ ID NO: 101344 - DNA, 20 bp, Artificial Sequence
  Description of Artificial Sequence: Synthetic oligonucleotide
  Target: ATXN1; (+) strand; PAM type: NRG; PAM sequence: GGG
cagctctggatgctgggaaa

SEQ ID NO: 101345 - DNA, 20 bp, Artificial Sequence
  Description of Artificial Sequence: Synthetic oligonucleotide
  Target: ATXN1; (+) strand; PAM type: NRG; PAM sequence: AAG
ctctggatgctgggaaaggg

SEQ ID NO: 101346 - DNA, 20 bp, Artificial Sequence
  Description of Artificial Sequence: Synthetic oligonucleotide
  Target: ATXN1; (+) strand; PAM type: NRG; PAM sequence: GAG
ctggatgctgggaaagggaa

SEQ ID NO: 101347 - DNA, 20 bp, Artificial Sequence
  Description of Artificial Sequence: Synthetic oligonucleotide
  Target: ATXN1; (+) strand; PAM type: NRG; PAM sequence: AGG
tggatgctgggaaagggaag

SEQ ID NO: 101348 - DNA, 20 bp, Artificial Sequence
  Description of Artificial Sequence: Synthetic oligonucleotide
  Target: ATXN1; (+) strand; PAM type: NRG; PAM sequence: GGG
ggatgctgggaaagggaaga

SEQ ID NO: 101349 - DNA, 20 bp, Artificial Sequence
  Description of Artificial Sequence: Synthetic oligonucleotide
  Target: ATXN1; (+) strand; PAM type: NRG; PAM sequence: CAG
tgctgggaaagggaagaggg

SEQ ID NO: 101350 - DNA, 20 bp, Artificial Sequence
  Description of Artificial Sequence: Synthetic oligonucleotide
  Target: ATXN1; (+) strand; PAM type: NRG; PAM sequence: AAG
aagggaagagggcagtgaca

SEQ ID NO: 101351 - DNA, 20 bp, Artificial Sequence
  Description of Artificial Sequence: Synthetic oligonucleotide
  Target: ATXN1; (+) strand; PAM type: NRG; PAM sequence: AGG
agggaagagggcagtgacaa

SEQ ID NO: 101352 - DNA, 20 bp, Artificial Sequence
  Description of Artificial Sequence: Synthetic oligonucleotide
  Target: ATXN1; (+) strand; PAM type: NRG; PAM sequence: GGG
gggaagagggcagtgacaaa

SEQ ID NO: 101353 - DNA, 20 bp, Artificial Sequence
  Description of Artificial Sequence: Synthetic oligonucleotide
  Target: ATXN1; (+) strand; PAM type: NRG; PAM sequence: AAG
gagggcagtgacaaagggaa

SEQ ID NO: 101354 - DNA, 20 bp, Artificial Sequence
  Description of Artificial Sequence: Synthetic oligonucleotide
  Target: ATXN1; (+) strand; PAM type: NRG; PAM sequence: AGG
agggcagtgacaaagggaaa

SEQ ID NO: 101355 - DNA, 20 bp, Artificial Sequence
  Description of Artificial Sequence: Synthetic oligonucleotide
  Target: ATXN1; (+) strand; PAM type: NRG; PAM sequence: AAG
cagtgacaaagggaaaagga

SEQ ID NO: 101356 - DNA, 20 bp, Artificial Sequence
  Description of Artificial Sequence: Synthetic oligonucleotide
  Target: ATXN1; (+) strand; PAM type: NRG; PAM sequence: AGG
agtgacaaagggaaaaggaa

SEQ ID NO: 101357 - DNA, 20 bp, Artificial Sequence
  Description of Artificial Sequence: Synthetic oligonucleotide
  Target: ATXN1; (+) strand; PAM type: NRG; PAM sequence: GGG
gtgacaaagggaaaaggaaa

SEQ ID NO: 101358 - DNA, 20 bp, Artificial Sequence
  Description of Artificial Sequence: Synthetic oligonucleotide
  Target: ATXN1; (+) strand; PAM type: NRG; PAM sequence: GAG
gacaaagggaaaaggaaagg

SEQ ID NO: 101359 - DNA, 20 bp, Artificial Sequence
  Description of Artificial Sequence: Synthetic oligonucleotide
  Target: ATXN1; (+) strand; PAM type: NRG; PAM sequence: AGG
acaaagggaaaaggaaaggg

SEQ ID NO: 101360 - DNA, 20 bp, Artificial Sequence
  Description of Artificial Sequence: Synthetic oligonucleotide
  Target: ATXN1; (+) strand; PAM type: NRG; PAM sequence: GAG
aaagggaaaaggaaagggag

SEQ ID NO: 101361 - DNA, 20 bp, Artificial Sequence
  Description of Artificial Sequence: Synthetic oligonucleotide
  Target: ATXN1; (+) strand; PAM type: NRG; PAM sequence: AAG
ggaaaaggaaagggaggaga

SEQ ID NO: 101362 - DNA, 20 bp, Artificial Sequence
  Description of Artificial Sequence: Synthetic oligonucleotide
  Target: ATXN1; (+) strand; PAM type: NRG; PAM sequence: AGG
gaaaaggaaagggaggagaa

SEQ ID NO: 101363 - DNA, 20 bp, Artificial Sequence
  Description of Artificial Sequence: Synthetic oligonucleotide
  Target: ATXN1; (+) strand; PAM type: NRG; PAM sequence: GGG
aaaaggaaagggaggagaaa

SEQ ID NO: 101364 - DNA, 20 bp, Artificial Sequence
  Description of Artificial Sequence: Synthetic oligonucleotide
  Target: ATXN1; (+) strand; PAM type: NRG; PAM sequence: AAG
aggaaagggaggagaaaggg

SEQ ID NO: 101365 - DNA, 20 bp, Artificial Sequence
  Description of Artificial Sequence: Synthetic oligonucleotide
  Target: ATXN1; (+) strand; PAM type: NRG; PAM sequence: AGG
ggaaagggaggagaaaggga

SEQ ID NO: 101366 - DNA, 20 bp, Artificial Sequence
  Description of Artificial Sequence: Synthetic oligonucleotide
  Target: ATXN1; (+) strand; PAM type: NRG; PAM sequence: GAG
aaagggaggagaaagggaag

SEQ ID NO: 101367 - DNA, 20 bp, Artificial Sequence
  Description of Artificial Sequence: Synthetic oligonucleotide
  Target: ATXN1; (+) strand; PAM type: NRG; PAM sequence: AGG
aagggaggagaaagggaagg

SEQ ID NO: 101368 - DNA, 20 bp, Artificial Sequence
  Description of Artificial Sequence: Synthetic oligonucleotide
  Target: ATXN1; (+) strand; PAM type: NRG; PAM sequence: GGG
agggaggagaaagggaagga

SEQ ID NO: 101369 - DNA, 20 bp, Artificial Sequence
  Description of Artificial Sequence: Synthetic oligonucleotide
  Target: ATXN1; (+) strand; PAM type: NRG; PAM sequence: AAG
aggagaaagggaaggaggga

SEQ ID NO: 101370 - DNA, 20 bp, Artificial Sequence
  Description of Artificial Sequence: Synthetic oligonucleotide
  Target: ATXN1; (+) strand; PAM type: NRG; PAM sequence: AGG
ggagaaagggaaggagggaa

SEQ ID NO: 101371 - DNA, 20 bp, Artificial Sequence
  Description of Artificial Sequence: Synthetic oligonucleotide
  Target: ATXN1; (+) strand; PAM type: NRG; PAM sequence: CAG
gggaaggagggaaaggacat

SEQ ID NO: 101372 - DNA, 20 bp, Artificial Sequence
  Description of Artificial Sequence: Synthetic oligonucleotide
  Target: ATXN1; (+) strand; PAM type: NRG; PAM sequence: GAG
gggaaaggacatcagaacat

SEQ ID NO: 101373 - DNA, 20 bp, Artificial Sequence
  Description of Artificial Sequence: Synthetic oligonucleotide
  Target: ATXN1; (+) strand; PAM type: NRG; PAM sequence: CGG
ggacatcagaacatgagcac

SEQ ID NO: 101374 - DNA, 20 bp, Artificial Sequence
  Description of Artificial Sequence: Synthetic oligonucleotide
  Target: ATXN1; (+) strand; PAM type: NRG; PAM sequence: GGG
gacatcagaacatgagcacc

SEQ ID NO: 101375 - DNA, 20 bp, Artificial Sequence
  Description of Artificial Sequence: Synthetic oligonucleotide
  Target: ATXN1; (+) strand; PAM type: NRG; PAM sequence: GGG
acatcagaacatgagcaccg

SEQ ID NO: 101376 - DNA, 20 bp, Artificial Sequence
  Description of Artificial Sequence: Synthetic oligonucleotide
  Target: ATXN1; (+) strand; PAM type: NRG; PAM sequence: AAG
cagaacatgagcaccgggga

SEQ ID NO: 101377 - DNA, 20 bp, Artificial Sequence
  Description of Artificial Sequence: Synthetic oligonucleotide
  Target: ATXN1; (+) strand; PAM type: NRG; PAM sequence: TGG
caccggggaaagaacatctt

SEQ ID NO: 101378 - DNA, 20 bp, Artificial Sequence
  Description of Artificial Sequence: Synthetic oligonucleotide
  Target: ATXN1; (+) strand; PAM type: NRG; PAM sequence: AAG
ggggaaagaacatctttggc

SEQ ID NO: 101379 - DNA, 20 bp, Artificial Sequence
  Description of Artificial Sequence: Synthetic oligonucleotide
  Target: ATXN1; (+) strand; PAM type: NRG; PAM sequence: AAG
agaacatctttggcaagatt

SEQ ID NO: 101380 - DNA, 20 bp, Artificial Sequence
  Description of Artificial Sequence: Synthetic oligonucleotide
  Target: ATXN1; (+) strand; PAM type: NRG; PAM sequence: TAG
atctttggcaagattaagac

SEQ ID NO: 101381 - DNA, 20 bp, Artificial Sequence
  Description of Artificial Sequence: Synthetic oligonucleotide
  Target: ATXN1; (+) strand; PAM type: NRG; PAM sequence: AGG
tctttggcaagattaagact

SEQ ID NO: 101382 - DNA, 20 bp, Artificial Sequence
  Description of Artificial Sequence: Synthetic oligonucleotide
  Target: ATXN1; (+) strand; PAM type: NRG; PAM sequence: TGG
gcaagattaagactaggccc

SEQ ID NO: 101383 - DNA, 20 bp, Artificial Sequence
  Description of Artificial Sequence: Synthetic oligonucleotide
  Target: ATXN1; (+) strand; PAM type: NRG; PAM sequence: CGG
ttaagactaggccctggact

SEQ ID NO: 101384 - DNA, 20 bp, Artificial Sequence
  Description of Artificial Sequence: Synthetic oligonucleotide
  Target: ATXN1; (+) strand; PAM type: NRG; PAM sequence: AAG
ccataacccaatcatacccc

SEQ ID NO: 101385 - DNA, 20 bp, Artificial Sequence
  Description of Artificial Sequence: Synthetic oligonucleotide
  Target: ATXN1; (+) strand; PAM type: NRG; PAM sequence: AAG
caatcataccccaagcactg

SEQ ID NO: 101386 - DNA, 20 bp, Artificial Sequence
  Description of Artificial Sequence: Synthetic oligonucleotide
  Target: ATXN1; (+) strand; PAM type: NRG; PAM sequence: CAG
tcataccccaagcactgaag

SEQ ID NO: 101387 - DNA, 20 bp, Artificial Sequence
  Description of Artificial Sequence: Synthetic oligonucleotide
  Target: ATXN1; (+) strand; PAM type: NRG; PAM sequence: GAG
ataccccaagcactgaagca

SEQ ID NO: 101388 - DNA, 20 bp, Artificial Sequence
  Description of Artificial Sequence: Synthetic oligonucleotide
  Target: ATXN1; (+) strand; PAM type: NRG; PAM sequence: TAG
cactgaagcagagaaaacac

SEQ ID NO: 101389 - DNA, 20 bp, Artificial Sequence
  Description of Artificial Sequence: Synthetic oligonucleotide
  Target: ATXN1; (+) strand; PAM type: NRG; PAM sequence: TGG
gaaaacactagccaacactt

SEQ ID NO: 101390 - DNA, 20 bp, Artificial Sequence
  Description of Artificial Sequence: Synthetic oligonucleotide
  Target: ATXN1; (+) strand; PAM type: NRG; PAM sequence: GGG
aaaacactagccaacacttt

SEQ ID NO: 101391 - DNA, 20 bp, Artificial Sequence
  Description of Artificial Sequence: Synthetic oligonucleotide
  Target: ATXN1; (+) strand; PAM type: NRG; PAM sequence: GAG
aacactagccaacactttgg

SEQ ID NO: 101392 - DNA, 20 bp, Artificial Sequence
  Description of Artificial Sequence: Synthetic oligonucleotide
  Target: ATXN1; (+) strand; PAM type: NRG; PAM sequence: AGG
acactagccaacactttggg

SEQ ID NO: 101393 - DNA, 20 bp, Artificial Sequence
  Description of Artificial Sequence: Synthetic oligonucleotide
  Target: ATXN1; (+) strand; PAM type: NRG; PAM sequence: GAG
agccaacactttgggaggcc

SEQ ID NO: 101394 - DNA, 20 bp, Artificial Sequence
  Description of Artificial Sequence: Synthetic oligonucleotide
  Target: ATXN1; (+) strand; PAM type: NRG; PAM sequence: AGG
gccaacactttgggaggccg

SEQ ID NO: 101395 - DNA, 20 bp, Artificial Sequence
  Description of Artificial Sequence: Synthetic oligonucleotide
  Target: ATXN1; (+) strand; PAM type: NRG; PAM sequence: CAG
aacactttgggaggccgagg

SEQ ID NO: 101396 - DNA, 20 bp, Artificial Sequence
  Description of Artificial Sequence: Synthetic oligonucleotide
  Target: ATXN1; (+) strand; PAM type: NRG; PAM sequence: AGG
acactttgggaggccgaggc

SEQ ID NO: 101397 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccgaggcagg

SEQ ID NO: 101398 - DNA, 20 bp, Artificial Sequence
  Description of Artificial Sequence: Synthetic oligonucleotide
  Target: ATXN1; (+) strand; PAM type: NRG; PAM sequence: GAG
ggccgaggcaggcagatcac

SEQ ID NO: 101399 - DNA, 20 bp, Artificial Sequence
  Description of Artificial Sequence: Synthetic oligonucleotide
  Target: ATXN1; (+) strand; PAM type: NRG; PAM sequence: AGG
gccgaggcaggcagatcacg

SEQ ID NO: 101400 - DNA, 20 bp, Artificial Sequence
  Description of Artificial Sequence: Synthetic oligonucleotide
  Target: ATXN1; (+) strand; PAM type: NRG; PAM sequence: CAG
aggcaggcagatcacgaggt

SEQ ID NO: 101401 - DNA, 20 bp, Artificial Sequence
  Description of Artificial Sequence: Synthetic oligonucleotide
  Target: ATXN1; (+) strand; PAM type: NRG; PAM sequence: AGG
ggcaggcagatcacgaggtc

SEQ ID NO: 101402 - DNA, 20 bp, Artificial Sequence
  Description of Artificial Sequence: Synthetic oligonucleotide
  Target: ATXN1; (+) strand; PAM type: NRG; PAM sequence: GAG
caggcagatcacgaggtcag

SEQ ID NO: 101403 - DNA, 20 bp, Artificial Sequence
  Description of Artificial Sequence: Synthetic oligonucleotide
  Target: ATXN1; (+) strand; PAM type: NRG; PAM sequence: AAG
gatcacgaggtcaggagatt

SEQ ID NO: 101404 - DNA, 20 bp, Artificial Sequence
  Description of Artificial Sequence: Synthetic oligonucleotide
  Target: ATXN1; (+) strand; PAM type: NRG; PAM sequence: TGG
tcaggagattaagaccatcc

SEQ ID NO: 101405 - DNA, 20 bp, Artificial Sequence
  Description of Artificial Sequence: Synthetic oligonucleotide
  Target: ATXN1; (+) strand; PAM type: NRG; PAM sequence: TGG
taagaccatcctggctaaca

SEQ ID NO: 101406 - DNA, 20 bp, Artificial Sequence
  Description of Artificial Sequence: Synthetic oligonucleotide
  Target: ATXN1; (+) strand; PAM type: NRG; PAM sequence: TAG
taaaaaataaaaaacaaatt

SEQ ID NO: 101407 - DNA, 20 bp, Artificial Sequence
  Description of Artificial Sequence: Synthetic oligonucleotide
  Target: ATXN1; (+) strand; PAM type: NRG; PAM sequence: TGG
aataaaaaacaaatttagcc

SEQ ID NO: 101408 - DNA, 20 bp, Artificial Sequence
  Description of Artificial Sequence: Synthetic oligonucleotide
  Target: ATXN1; (+) strand; PAM type: NRG; PAM sequence: TAG
aatttagcctggtgtaacat

SEQ ID NO: 101409 - DNA, 20 bp, Artificial Sequence
  Description of Artificial Sequence: Synthetic oligonucleotide
  Target: ATXN1; (+) strand; PAM type: NRG; PAM sequence: TGG
tagcctggtgtaacattagc

SEQ ID NO: 101410 - DNA, 20 bp, Artificial Sequence
  Description of Artificial Sequence: Synthetic oligonucleotide
  Target: ATXN1; (+) strand; PAM type: NRG; PAM sequence: CGG
gtgtaacattagctggcaca

SEQ ID NO: 101411 - DNA, 20 bp, Artificial Sequence
  Description of Artificial Sequence: Synthetic oligonucleotide
  Target: ATXN1; (+) strand; PAM type: NRG; PAM sequence: TAG
cattagctggcacacggctg

SEQ ID NO: 101412 - DNA, 20 bp, Artificial Sequence
  Description of Artificial Sequence: Synthetic oligonucleotide
  Target: ATXN1; (+) strand; PAM type: NRG; PAM sequence: CAG
ctggcacacggctgtagtcc

SEQ ID NO: 101413 - DNA, 20 bp, Artificial Sequence
  Description of Artificial Sequence: Synthetic oligonucleotide
  Target: ATXN1; (+) strand; PAM type: NRG; PAM sequence: GAG
ggctgtagtcccagctactt

SEQ ID NO: 101414 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctacttga

SEQ ID NO: 101415 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctacttgag

SEQ ID NO: 101416 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgagaggct

SEQ ID NO: 101417 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgagaggctg

SEQ ID NO: 101418 - DNA, 20 bp, Artificial Sequence
  Description of Artificial Sequence: Synthetic oligonucleotide
  Target: ATXN1; (+) strand; PAM type: NRG; PAM sequence: CAG
agctacttgagaggctgagg

SEQ ID NO: 101419 - DNA, 20 bp, Artificial Sequence
  Description of Artificial Sequence: Synthetic oligonucleotide
  Target: ATXN1; (+) strand; PAM type: NRG; PAM sequence: AGG
gctacttgagaggctgaggc

SEQ ID NO: 101420 - DNA, 20 bp, Artificial Sequence
  Description of Artificial Sequence: Synthetic oligonucleotide
  Target: ATXN1; (+) strand; PAM type: NRG; PAM sequence: GAG
tacttgagaggctgaggcag

SEQ ID NO: 101421 - DNA, 20 bp, Artificial Sequence
  Description of Artificial Sequence: Synthetic oligonucleotide
  Target: ATXN1; (+) strand; PAM type: NRG; PAM sequence: CAG
gcaggagaattgcttgaacc

SEQ ID NO: 101422 - DNA, 20 bp, Artificial Sequence
  Description of Artificial Sequence: Synthetic oligonucleotide
  Target: ATXN1; (+) strand; PAM type: NRG; PAM sequence: AGG
caggagaattgcttgaaccc

SEQ ID NO: 101423 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaacccag

SEQ ID NO: 101424 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttgaacccagg

SEQ ID NO: 101425 - DNA, 20 bp, Artificial Sequence
  Description of Artificial Sequence: Synthetic oligonucleotide
  Target: ATXN1; (+) strand; PAM type: NRG; PAM sequence: CAG
aattgcttgaacccaggagg

SEQ ID NO: 101426 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacccaggaggca

SEQ ID NO: 101427 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacccaggaggcag

SEQ ID NO: 101428 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcagaggttg

SEQ ID NO: 101429 - DNA, 20 bp, Artificial Sequence
  Description of Artificial Sequence: Synthetic oligonucleotide
  Target: ATXN1; (+) strand; PAM type: NRG; PAM sequence: GAG
caggaggcagaggttgcagt

SEQ ID NO: 101430 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgagcc

SEQ ID NO: 101431 - DNA, 20 bp, Artificial Sequence
  Description of Artificial Sequence: Synthetic oligonucleotide
  Target: ATXN1; (+) strand; PAM type: NRG; PAM sequence: CAG
gagattgcaccattgtactc

SEQ ID NO: 101432 - DNA, 20 bp, Artificial Sequence
  Description of Artificial Sequence: Synthetic oligonucleotide
  Target: ATXN1; (+) strand; PAM type: NRG; PAM sequence: TGG
tgcaccattgtactccagcc

SEQ ID NO: 101433 - DNA, 20 bp, Artificial Sequence
  Description of Artificial Sequence: Synthetic oligonucleotide
  Target: ATXN1; (+) strand; PAM type: NRG; PAM sequence: GGG
gcaccattgtactccagcct

SEQ ID NO: 101434 - DNA, 20 bp, Artificial Sequence
  Description of Artificial Sequence: Synthetic oligonucleotide
  Target: ATXN1; (+) strand; PAM type: NRG; PAM sequence: CAG
ttgtactccagcctgggcaa

SEQ ID NO: 101435 - DNA, 20 bp, Artificial Sequence
  Description of Artificial Sequence: Synthetic oligonucleotide
  Target: ATXN1; (+) strand; PAM type: NRG; PAM sequence: GAG
gtactccagcctgggcaaca

SEQ ID NO: 101436 - DNA, 20 bp, Artificial Sequence
  Description of Artificial Sequence: Synthetic oligonucleotide
  Target: ATXN1; (+) strand; PAM type: NRG; PAM sequence: TAG
aacaacaaaaacaaaaacac

SEQ ID NO: 101437 - DNA, 20 bp, Artificial Sequence
  Description of Artificial Sequence: Synthetic oligonucleotide
  Target: ATXN1; (+) strand; PAM type: NRG; PAM sequence: TGG
aaaaacaaaaacactagccg

SEQ ID NO: 101438 - DNA, 20 bp, Artificial Sequence
  Description of Artificial Sequence: Synthetic oligonucleotide
  Target: ATXN1; (+) strand; PAM type: NRG; PAM sequence: CAG
aacaaaaacactagccgtgg

SEQ ID NO: 101439 - DNA, 20 bp, Artificial Sequence
  Description of Artificial Sequence: Synthetic oligonucleotide
  Target: ATXN1; (+) strand; PAM type: NRG; PAM sequence: AAG
cgtggcagctgcacattata

SEQ ID NO: 101440 - DNA, 20 bp, Artificial Sequence
  Description of Artificial Sequence: Synthetic oligonucleotide
  Target: ATXN1; (+) strand; PAM type: NRG; PAM sequence: AGG
gtggcagctgcacattataa

SEQ ID NO: 101441 - DNA, 20 bp, Artificial Sequence
  Description of Artificial Sequence: Synthetic oligonucleotide
  Target: ATXN1; (+) strand; PAM type: NRG; PAM sequence: AAG
gcagctgcacattataaagg

SEQ ID NO: 101442 - DNA, 20 bp, Artificial Sequence
  Description of Artificial Sequence: Synthetic oligonucleotide
  Target: ATXN1; (+) strand; PAM type: NRG; PAM sequence: AAG
cattataaaggaagattatg

SEQ ID NO: 101443 - DNA, 20 bp, Artificial Sequence
  Description of Artificial Sequence: Synthetic oligonucleotide
  Target: ATXN1; (+) strand; PAM type: NRG; PAM sequence: TGG
aaggaagattatgaagacac

SEQ ID NO: 101444 - DNA, 20 bp, Artificial Sequence
  Description of Artificial Sequence: Synthetic oligonucleotide
  Target: ATXN1; (+) strand; PAM type: NRG; PAM sequence: GGG
aggaagattatgaagacact

SEQ ID NO: 101445 - DNA, 20 bp, Artificial Sequence
  Description of Artificial Sequence: Synthetic oligonucleotide
  Target: ATXN1; (+) strand; PAM type: NRG; PAM sequence: AAG
agattatgaagacactgggc

SEQ ID NO: 101446 - DNA, 20 bp, Artificial Sequence
  Description of Artificial Sequence: Synthetic oligonucleotide
  Target: ATXN1; (+) strand; PAM type: NRG; PAM sequence: TGG
gtaacacatatattttttaa

SEQ ID NO: 101447 - DNA, 20 bp, Artificial Sequence
  Description of Artificial Sequence: Synthetic oligonucleotide
  Target: ATXN1; (+) strand; PAM type: NRG; PAM sequence: GAG
aacacatatattttttaatg

SEQ ID NO: 101448 - DNA, 20 bp, Artificial Sequence
  Description of Artificial Sequence: Synthetic oligonucleotide
  Target: ATXN1; (+) strand; PAM type: NRG; PAM sequence: AAG
atggagttaacaactcccct

SEQ ID NO: 101449 - DNA, 20 bp, Artificial Sequence
  Description of Artificial Sequence: Synthetic oligonucleotide
  Target: ATXN1; (+) strand; PAM type: NRG; PAM sequence: AAG
tttttctccttttcttcttc

SEQ ID NO: 101450 - DNA, 20 bp, Artificial Sequence
  Description of Artificial Sequence: Synthetic oligonucleotide
  Target: ATXN1; (+) strand; PAM type: NRG; PAM sequence: AGG
ttttctccttttcttcttca

SEQ ID NO: 101451 - DNA, 20 bp, Artificial Sequence
  Description of Artificial Sequence: Synthetic oligonucleotide
  Target: ATXN1; (+) strand; PAM type: NRG; PAM sequence: GGG
tttctccttttcttcttcaa

SEQ ID NO: 101452 - DNA, 20 bp, Artificial Sequence
  Description of Artificial Sequence: Synthetic oligonucleotide
  Target: ATXN1; (+) strand; PAM type: NRG; PAM sequence: CAG
ctccttttcttcttcaaggg

SEQ ID NO: 101453 - DNA, 20 bp, Artificial Sequence
  Description of Artificial Sequence: Synthetic oligonucleotide
  Target: ATXN1; (+) strand; PAM type: NRG; PAM sequence: CAG
ttcttcaagggcagatgatg

SEQ ID NO: 101454 - DNA, 20 bp, Artificial Sequence
  Description of Artificial Sequence: Synthetic oligonucleotide
  Target: ATXN1; (+) strand; PAM type: NRG; PAM sequence: CAG
cagttcttaaatttcctttt

SEQ ID NO: 101455 - DNA, 20 bp, Artificial Sequence
  Description of Artificial Sequence: Synthetic oligonucleotide
  Target: ATXN1; (+) strand; PAM type: NRG; PAM sequence: TGG
aatttccttttcagaaatgt

SEQ ID NO: 101456 - DNA, 20 bp, Artificial Sequence
  Description of Artificial Sequence: Synthetic oligonucleotide
  Target: ATXN1; (+) strand; PAM type: NRG; PAM sequence: TGG
tttctcacctctcctttgcc

SEQ ID NO: 101457 - DNA, 20 bp, Artificial Sequence
  Description of Artificial Sequence: Synthetic oligonucleotide
  Target: ATXN1; (+) strand; PAM type: NRG; PAM sequence: TGG
tcacctctcctttgcctggc

SEQ ID NO: 101458 - DNA, 20 bp, Artificial Sequence
  Description of Artificial Sequence: Synthetic oligonucleotide
  Target: ATXN1; (+) strand; PAM type: NRG; PAM sequence: AAG
cctggctggaacataaaatg

SEQ ID NO: 101459 - DNA, 20 bp, Artificial Sequence
  Description of Artificial Sequence: Synthetic oligonucleotide
  Target: ATXN1; (+) strand; PAM type: NRG; PAM sequence: TGG
ggaacataaaatgaagccct

SEQ ID NO: 101460 - DNA, 20 bp, Artificial Sequence
  Description of Artificial Sequence: Synthetic oligonucleotide
  Target: ATXN1; (+) strand; PAM type: NRG; PAM sequence: GAG
aacataaaatgaagcccttg

SEQ ID NO: 101461 - DNA, 20 bp, Artificial Sequence
  Description of Artificial Sequence: Synthetic oligonucleotide
  Target: ATXN1; (+) strand; PAM type: NRG; PAM sequence: GAG
cataaaatgaagcccttgga

SEQ ID NO: 101462 - DNA, 20 bp, Artificial Sequence
  Description of Artificial Sequence: Synthetic oligonucleotide
  Target: ATXN1; (+) strand; PAM type: NRG; PAM sequence: CAG
gcccttggagagcatgacac

SEQ ID NO: 101463 - DNA, 20 bp, Artificial Sequence
  Description of Artificial Sequence: Synthetic oligonucleotide
  Target: ATXN1; (+) strand; PAM type: NRG; PAM sequence: TGG
ttggagagcatgacaccagc

SEQ ID NO: 101464 - DNA, 20 bp, Artificial Sequence
  Description of Artificial Sequence: Synthetic oligonucleotide
  Target: ATXN1; (+) strand; PAM type: NRG; PAM sequence: CAG
caccagctggaccctgccct

SEQ ID NO: 101465 - DNA, 20 bp, Artificial Sequence
  Description of Artificial Sequence: Synthetic oligonucleotide
  Target: ATXN1; (+) strand; PAM type: NRG; PAM sequence: GAG
ccagctggaccctgccctca

SEQ ID NO: 101466 - DNA, 20 bp, Artificial Sequence
  Description of Artificial Sequence: Synthetic oligonucleotide
  Target: ATXN1; (+) strand; PAM type: NRG; PAM sequence: CAG
ctggaccctgccctcagagc

SEQ ID NO: 101467 - DNA, 20 bp, Artificial Sequence
  Description of Artificial Sequence: Synthetic oligonucleotide
  Target: ATXN1; (+) strand; PAM type: NRG; PAM sequence: AGG
tggaccctgccctcagagcc

SEQ ID NO: 101468 - DNA, 20 bp, Artificial Sequence
  Description of Artificial Sequence: Synthetic oligonucleotide
  Target: ATXN1; (+) strand; PAM type: NRG; PAM sequence: GAG
tgccctcagagccaggcact

SEQ ID NO: 101469 - DNA, 20 bp, Artificial Sequence
  Description of Artificial Sequence: Synthetic oligonucleotide
  Target: ATXN1; (+) strand; PAM type: NRG; PAM sequence: AAG
cagagccaggcactgagaaa

SEQ ID NO: 101470 - DNA, 20 bp, Artificial Sequence
  Description of Artificial Sequence: Synthetic oligonucleotide
  Target: ATXN1; (+) strand; PAM type: NRG; PAM sequence: CAG
agccaggcactgagaaaaag

SEQ ID NO: 101471 - DNA, 20 bp, Artificial Sequence
  Description of Artificial Sequence: Synthetic oligonucleotide
  Target: ATXN1; (+) strand; PAM type: NRG; PAM sequence: AGG
gccaggcactgagaaaaagc

SEQ ID NO: 101472 - DNA, 20 bp, Artificial Sequence
  Description of Artificial Sequence: Synthetic oligonucleotide
  Target: ATXN1; (+) strand; PAM type: NRG; PAM sequence: TAG
ggcactgagaaaaagcaggt

SEQ ID NO: 101473 - DNA, 20 bp, Artificial Sequence
  Description of Artificial Sequence: Synthetic oligonucleotide
  Target: ATXN1; (+) strand; PAM type: NRG; PAM sequence: CAG
actgagaaaaagcaggttag

SEQ ID NO: 101474 - DNA, 20 bp, Artificial Sequence
  Description of Artificial Sequence: Synthetic oligonucleotide
  Target: ATXN1; (+) strand; PAM type: NRG; PAM sequence: AAG
aaaaagcaggttagcagtga

SEQ ID NO: 101475 - DNA, 20 bp, Artificial Sequence
  Description of Artificial Sequence: Synthetic oligonucleotide
  Target: ATXN1; (+) strand; PAM type: NRG; PAM sequence: CAG
gcaggttagcagtgaaagtc

SEQ ID NO: 101476 - DNA, 20 bp, Artificial Sequence
  Description of Artificial Sequence: Synthetic oligonucleotide
  Target: ATXN1; (+) strand; PAM type: NRG; PAM sequence: CAG
ttagcagtgaaagtccagaa

SEQ ID NO: 101477 - DNA, 20 bp, Artificial Sequence
  Description of Artificial Sequence: Synthetic oligonucleotide
  Target: ATXN1; (+) strand; PAM type: NRG; PAM sequence: CAG
atttctgaatcctcatctgc

SEQ ID NO: 101478 - DNA, 20 bp, Artificial Sequence
  Description of Artificial Sequence: Synthetic oligonucleotide
  Target: ATXN1; (+) strand; PAM type: NRG; PAM sequence: GAG
ttctgaatcctcatctgcca

SEQ ID NO: 101479 - DNA, 20 bp, Artificial Sequence
  Description of Artificial Sequence: Synthetic oligonucleotide
  Target: ATXN1; (+) strand; PAM type: NRG; PAM sequence: AAG
tgccagagccactactctcc

SEQ ID NO: 101480 - DNA, 20 bp, Artificial Sequence
  Description of Artificial Sequence: Synthetic oligonucleotide
  Target: ATXN1; (+) strand; PAM type: NRG; PAM sequence: TAG
ctactctccaagattcccct

SEQ ID NO: 101481 - DNA, 20 bp, Artificial Sequence
  Description of Artificial Sequence: Synthetic oligonucleotide
  Target: ATXN1; (+) strand; PAM type: NRG; PAM sequence: TGG
tccaagattccccttagctc

SEQ ID NO: 101482 - DNA, 20 bp, Artificial Sequence
  Description of Artificial Sequence: Synthetic oligonucleotide
  Target: ATXN1; (+) strand; PAM type: NRG; PAM sequence: GGG
ccaagattccccttagctct

SEQ ID NO: 101483 - DNA, 20 bp, Artificial Sequence
  Description of Artificial Sequence: Synthetic oligonucleotide
  Target: ATXN1; (+) strand; PAM type: NRG; PAM sequence: TGG
ccttagctctgggtccacac

SEQ ID NO: 101484 - DNA, 20 bp, Artificial Sequence
  Description of Artificial Sequence: Synthetic oligonucleotide
  Target: ATXN1; (+) strand; PAM type: NRG; PAM sequence: CAG
cacacacacacacgccaact

SEQ ID NO: 101485 - DNA, 20 bp, Artificial Sequence
  Description of Artificial Sequence: Synthetic oligonucleotide
  Target: ATXN1; (+) strand; PAM type: NRG; PAM sequence: CAG
acacacacacgccaactcag

SEQ ID NO: 101486 - DNA, 20 bp, Artificial Sequence
  Description of Artificial Sequence: Synthetic oligonucleotide
  Target: ATXN1; (+) strand; PAM type: NRG; PAM sequence: GAG
acacacacgccaactcagca

SEQ ID NO: 101487 - DNA, 20 bp, Artificial Sequence
  Description of Artificial Sequence: Synthetic oligonucleotide
  Target: ATXN1; (+) strand; PAM type: NRG; PAM sequence: AGG
cacacacgccaactcagcag

SEQ ID NO: 101488 - DNA, 20 bp, Artificial Sequence
  Description of Artificial Sequence: Synthetic oligonucleotide
  Target: ATXN1; (+) strand; PAM type: NRG; PAM sequence: CAG
gccaactcagcagaggccgc

SEQ ID NO: 101489 - DNA, 20 bp, Artificial Sequence
  Description of Artificial Sequence: Synthetic oligonucleotide
  Target: ATXN1; (+) strand; PAM type: NRG; PAM sequence: AAG
gaaataatcctgttctctgc

SEQ ID NO: 101490 - DNA, 20 bp, Artificial Sequence
  Description of Artificial Sequence: Synthetic oligonucleotide
  Target: ATXN1; (+) strand; PAM type: NRG; PAM sequence: AAG
ctgttctctgcaagtttcaa

SEQ ID NO: 101491 - DNA, 20 bp, Artificial Sequence
  Description of Artificial Sequence: Synthetic oligonucleotide
  Target: ATXN1; (+) strand; PAM type: NRG; PAM sequence: CAG
gcaagtttcaaaagaattcc

SEQ ID NO: 101492 - DNA, 20 bp, Artificial Sequence
  Description of Artificial Sequence: Synthetic oligonucleotide
  Target: ATXN1; (+) strand; PAM type: NRG; PAM sequence: CAG
tttcaaaagaattcccagta

SEQ ID NO: 101493 - DNA, 20 bp, Artificial Sequence
  Description of Artificial Sequence: Synthetic oligonucleotide
  Target: ATXN1; (+) strand; PAM type: NRG; PAM sequence: CGG
tacagccactcatatgatga

SEQ ID NO: 101494 - DNA, 20 bp, Artificial Sequence
  Description of Artificial Sequence: Synthetic oligonucleotide
  Target: ATXN1; (+) strand; PAM type: NRG; PAM sequence: GAG
cagccactcatatgatgacg

SEQ ID NO: 101495 - DNA, 20 bp, Artificial Sequence
  Description of Artificial Sequence: Synthetic oligonucleotide
  Target: ATXN1; (+) strand; PAM type: NRG; PAM sequence: GAG
cactcatatgatgacggagt

SEQ ID NO: 101496 - DNA, 20 bp, Artificial Sequence
  Description of Artificial Sequence: Synthetic oligonucleotide
  Target: ATXN1; (+) strand; PAM type: NRG; PAM sequence: TGG
ttaaaaaccgaatttgatta

SEQ ID NO: 101497 - DNA, 20 bp, Artificial Sequence
  Description of Artificial Sequence: Synthetic oligonucleotide
  Target: ATXN1; (+) strand; PAM type: NRG; PAM sequence: TAG
acccaaataccatacaaaaa

SEQ ID NO: 101498 - DNA, 20 bp, Artificial Sequence
  Description of Artificial Sequence: Synthetic oligonucleotide
  Target: ATXN1; (+) strand; PAM type: NRG; PAM sequence: AGG
cccaaataccatacaaaaat

SEQ ID NO: 101499 - DNA, 20 bp, Artificial Sequence
  Description of Artificial Sequence: Synthetic oligonucleotide
  Target: ATXN1; (+) strand; PAM type: NRG; PAM sequence: GGG
ccaaataccatacaaaaata

SEQ ID NO: 101500 - DNA, 20 bp, Artificial Sequence
  Description of Artificial Sequence: Synthetic oligonucleotide
  Target: ATXN1; (+) strand; PAM type: NRG; PAM sequence: TAG
ataccatacaaaaatagggc

SEQ ID NO: 101501 - DNA, 20 bp, Artificial Sequence
  Description of Artificial Sequence: Synthetic oligonucleotide
  Target: ATXN1; (+) strand; PAM type: NRG; PAM sequence: CAG
tagtgcactgaatgttttct

SEQ ID NO: 101502 - DNA, 20 bp, Artificial Sequence
  Description of Artificial Sequence: Synthetic oligonucleotide
  Target: ATXN1; (+) strand; PAM type: NRG; PAM sequence: TGG
tgcactgaatgttttctcag

SEQ ID NO: 101503 - DNA, 20 bp, Artificial Sequence
  Description of Artificial Sequence: Synthetic oligonucleotide
  Target: ATXN1; (+) strand; PAM type: NRG; PAM sequence: GGG
gcactgaatgttttctcagt

SEQ ID NO: 101504 - DNA, 20 bp, Artificial Sequence
  Description of Artificial Sequence: Synthetic oligonucleotide
  Target: ATXN1; (+) strand; PAM type: NRG; PAM sequence: TGG
ttctcagtgggttacatgct

SEQ ID NO: 101505 - DNA, 20 bp, Artificial Sequence
  Description of Artificial Sequence: Synthetic oligonucleotide
  Target: ATXN1; (+) strand; PAM type: NRG; PAM sequence: AAG
ccatctctctcttccttttc

SEQ ID NO: 101506 - DNA, 20 bp, Artificial Sequence
  Description of Artificial Sequence: Synthetic oligonucleotide
  Target: ATXN1; (+) strand; PAM type: NRG; PAM sequence: AAG
tccttttcaagttgtcattg

SEQ ID NO: 101507 - DNA, 20 bp, Artificial Sequence
  Description of Artificial Sequence: Synthetic oligonucleotide
  Target: ATXN1; (+) strand; PAM type: NRG; PAM sequence: TGG
cacaccgtcccctttctcat

SEQ ID NO: 101508 - DNA, 20 bp, Artificial Sequence
  Description of Artificial Sequence: Synthetic oligonucleotide
  Target: ATXN1; (+) strand; PAM type: NRG; PAM sequence: AAG
ccgtcccctttctcattgga

SEQ ID NO: 101509 - DNA, 20 bp, Artificial Sequence
  Description of Artificial Sequence: Synthetic oligonucleotide
  Target: ATXN1; (+) strand; PAM type: NRG; PAM sequence: TAG
taacaactcgccattaacac

SEQ ID NO: 101510 - DNA, 20 bp, Artificial Sequence
  Description of Artificial Sequence: Synthetic oligonucleotide
  Target: ATXN1; (+) strand; PAM type: NRG; PAM sequence: GAG
acaactcgccattaacacta

SEQ ID NO: 101511 - DNA, 20 bp, Artificial Sequence
  Description of Artificial Sequence: Synthetic oligonucleotide
  Target: ATXN1; (+) strand; PAM type: NRG; PAM sequence: CAG
gccattaacactagagacga

SEQ ID NO: 101512 - DNA, 20 bp, Artificial Sequence
  Description of Artificial Sequence: Synthetic oligonucleotide
  Target: ATXN1; (+) strand; PAM type: NRG; PAM sequence: CAG
actagagacgacagctcttt

SEQ ID NO: 101513 - DNA, 20 bp, Artificial Sequence
  Description of Artificial Sequence: Synthetic oligonucleotide
  Target: ATXN1; (+) strand; PAM type: NRG; PAM sequence: CAG
gacagctctttcagacaaat

SEQ ID NO: 101514 - DNA, 20 bp, Artificial Sequence
  Description of Artificial Sequence: Synthetic oligonucleotide
  Target: ATXN1; (+) strand; PAM type: NRG; PAM sequence: CAG
ctctttcagacaaatcagat

SEQ ID NO: 101515 - DNA, 20 bp, Artificial Sequence
  Description of Artificial Sequence: Synthetic oligonucleotide
  Target: ATXN1; (+) strand; PAM type: NRG; PAM sequence: TGG
cagatcagtgtgttcaaacc

SEQ ID NO: 101516 - DNA, 20 bp, Artificial Sequence
  Description of Artificial Sequence: Synthetic oligonucleotide
  Target: ATXN1; (+) strand; PAM type: NRG; PAM sequence: TGG
ttcaaacctggacatacaaa

SEQ ID NO: 101517 - DNA, 20 bp, Artificial Sequence
  Description of Artificial Sequence: Synthetic oligonucleotide
  Target: ATXN1; (+) strand; PAM type: NRG; PAM sequence: TGG
ggacatacaaatggtgaccc

SEQ ID NO: 101518 - DNA, 20 bp, Artificial Sequence
  Description of Artificial Sequence: Synthetic oligonucleotide
  Target: ATXN1; (+) strand; PAM type: NRG; PAM sequence: GAG
acatacaaatggtgaccctg

SEQ ID NO: 101519 - DNA, 20 bp, Artificial Sequence
  Description of Artificial Sequence: Synthetic oligonucleotide
  Target: ATXN1; (+) strand; PAM type: NRG; PAM sequence: CAG
acaaatggtgaccctggagc

SEQ ID NO: 101520 - DNA, 20 bp, Artificial Sequence
  Description of Artificial Sequence: Synthetic oligonucleotide
  Target: ATXN1; (+) strand; PAM type: NRG; PAM sequence: TGG
gaccctggagccagttctta

SEQ ID NO: 101521 - DNA, 20 bp, Artificial Sequence
  Description of Artificial Sequence: Synthetic oligonucleotide
  Target: ATXN1; (+) strand; PAM type: NRG; PAM sequence: AAG
tggagccagttcttatggtc

SEQ ID NO: 101522 - DNA, 20 bp, Artificial Sequence
  Description of Artificial Sequence: Synthetic oligonucleotide
  Target: ATXN1; (+) strand; PAM type: NRG; PAM sequence: CAG
gttcttatggtcaagtatct

SEQ ID NO: 101523 - DNA, 20 bp, Artificial Sequence
  Description of Artificial Sequence: Synthetic oligonucleotide
  Target: ATXN1; (+) strand; PAM type: NRG; PAM sequence: AAG
cagtctcttactaaccactg

SEQ ID NO: 101524 - DNA, 20 bp, Artificial Sequence
  Description of Artificial Sequence: Synthetic oligonucleotide
  Target: ATXN1; (+) strand; PAM type: NRG; PAM sequence: GAG
cttactaaccactgaagtct

SEQ ID NO: 101525 - DNA, 20 bp, Artificial Sequence
  Description of Artificial Sequence: Synthetic oligonucleotide
  Target: ATXN1; (+) strand; PAM type: NRG; PAM sequence: TGG
tctgagttactgctgctgtg

SEQ ID NO: 101526 - DNA, 20 bp, Artificial Sequence
  Description of Artificial Sequence: Synthetic oligonucleotide
  Target: ATXN1; (+) strand; PAM type: NRG; PAM sequence: GGG
ctgagttactgctgctgtgt

SEQ ID NO: 101527 - DNA, 20 bp, Artificial Sequence
  Description of Artificial Sequence: Synthetic oligonucleotide
  Target: ATXN1; (+) strand; PAM type: NRG; PAM sequence: CAG
gtgggcaaaccaatgcccaa

SEQ ID NO: 101528 - DNA, 20 bp, Artificial Sequence
  Description of Artificial Sequence: Synthetic oligonucleotide
  Target: ATXN1; (+) strand; PAM type: NRG; PAM sequence: AAG
caaaccaatgcccaacagac

SEQ ID NO: 101529 - DNA, 20 bp, Artificial Sequence
  Description of Artificial Sequence: Synthetic oligonucleotide
  Target: ATXN1; (+) strand; PAM type: NRG; PAM sequence: GAG
aaccaatgcccaacagacaa

SEQ ID NO: 101530 - DNA, 20 bp, Artificial Sequence
  Description of Artificial Sequence: Synthetic oligonucleotide
  Target: ATXN1; (+) strand; PAM type: NRG; PAM sequence: AGG
accaatgcccaacagacaag

SEQ ID NO: 101531 - DNA, 20 bp, Artificial Sequence
  Description of Artificial Sequence: Synthetic oligonucleotide
  Target: ATXN1; (+) strand; PAM type: NRG; PAM sequence: CAG
acagacaagaggccaaatat

SEQ ID NO: 101532 - DNA, 20 bp, Artificial Sequence
  Description of Artificial Sequence: Synthetic oligonucleotide
  Target: ATXN1; (+) strand; PAM type: NRG; PAM sequence: TGG
gacaagaggccaaatatcag

SEQ ID NO: 101533 - DNA, 20 bp, Artificial Sequence
  Description of Artificial Sequence: Synthetic oligonucleotide
  Target: ATXN1; (+) strand; PAM type: NRG; PAM sequence: CAG
tcagtggaactgacatgacc

SEQ ID NO: 101534 - DNA, 20 bp, Artificial Sequence
  Description of Artificial Sequence: Synthetic oligonucleotide
  Target: ATXN1; (+) strand; PAM type: NRG; PAM sequence: AGG
cagtggaactgacatgaccc

SEQ ID NO: 101535 - DNA, 20 bp, Artificial Sequence
  Description of Artificial Sequence: Synthetic oligonucleotide
  Target: ATXN1; (+) strand; PAM type: NRG; PAM sequence: TAG
ggaactgacatgacccaggc

SEQ ID NO: 101536 - DNA, 20 bp, Artificial Sequence
  Description of Artificial Sequence: Synthetic oligonucleotide
  Target: ATXN1; (+) strand; PAM type: NRG; PAM sequence: AAG
ctgacatgacccaggctagc

SEQ ID NO: 101537 - DNA, 20 bp, Artificial Sequence
  Description of Artificial Sequence: Synthetic oligonucleotide
  Target: ATXN1; (+) strand; PAM type: NRG; PAM sequence: CAG
acatgacccaggctagcaag

SEQ ID NO: 101538 - DNA, 20 bp, Artificial Sequence
  Description of Artificial Sequence: Synthetic oligonucleotide
  Target: ATXN1; (+) strand; PAM type: NRG; PAM sequence: CGG
tgacccaggctagcaagcag

SEQ ID NO: 101539 - DNA, 20 bp, Artificial Sequence
  Description of Artificial Sequence: Synthetic oligonucleotide
  Target: ATXN1; (+) strand; PAM type: NRG; PAM sequence: CAG
agcggatgtgattgcttcca

SEQ ID NO: 101540 - DNA, 20 bp, Artificial Sequence
  Description of Artificial Sequence: Synthetic oligonucleotide
  Target: ATXN1; (+) strand; PAM type: NRG; PAM sequence: AGG
gcggatgtgattgcttccac

SEQ ID NO: 101541 - DNA, 20 bp, Artificial Sequence
  Description of Artificial Sequence: Synthetic oligonucleotide
  Target: ATXN1; (+) strand; PAM type: NRG; PAM sequence: TAG
gatgtgattgcttccacagg

SEQ ID NO: 101542 - DNA, 20 bp, Artificial Sequence
  Description of Artificial Sequence: Synthetic oligonucleotide
  Target: ATXN1; (+) strand; PAM type: NRG; PAM sequence: CAG
gtgattgcttccacaggtag

SEQ ID NO: 101543 - DNA, 20 bp, Artificial Sequence
  Description of Artificial Sequence: Synthetic oligonucleotide
  Target: ATXN1; (+) strand; PAM type: NRG; PAM sequence: TAG
gcttccacaggtagcagctg

SEQ ID NO: 101544 - DNA, 20 bp, Artificial Sequence
  Description of Artificial Sequence: Synthetic oligonucleotide
  Target: ATXN1; (+) strand; PAM type: NRG; PAM sequence: AGG
cttccacaggtagcagctgt

SEQ ID NO: 101545 - DNA, 20 bp, Artificial Sequence
  Description of Artificial Sequence: Synthetic oligonucleotide
  Target: ATXN1; (+) strand; PAM type: NRG; PAM sequence: CAG
gtagcagctgtaggtatgca

SEQ ID NO: 101546 - DNA, 20 bp, Artificial Sequence
  Description of Artificial Sequence: Synthetic oligonucleotide
  Target: ATXN1; (+) strand; PAM type: NRG; PAM sequence: GAG
gtgcaacatgctgtgattct

SEQ ID NO: 101547 - DNA, 20 bp, Artificial Sequence
  Description of Artificial Sequence: Synthetic oligonucleotide
  Target: ATXN1; (+) strand; PAM type: NRG; PAM sequence: GAG
gcaacatgctgtgattctga

SEQ ID NO: 101548 - DNA, 20 bp, Artificial Sequence
  Description of Artificial Sequence: Synthetic oligonucleotide
  Target: ATXN1; (+) strand; PAM type: NRG; PAM sequence: TGG
tgctgtgattctgagagctg

SEQ ID NO: 101549 - DNA, 20 bp, Artificial Sequence
  Description of Artificial Sequence: Synthetic oligonucleotide
  Target: ATXN1; (+) strand; PAM type: NRG; PAM sequence: GGG
gctgtgattctgagagctgt

SEQ ID NO: 101550 - DNA, 20 bp, Artificial Sequence
  Description of Artificial Sequence: Synthetic oligonucleotide
  Target: ATXN1; (+) strand; PAM type: NRG; PAM sequence: TGG
gattctgagagctgtgggat

SEQ ID NO: 101551 - DNA, 20 bp, Artificial Sequence
  Description of Artificial Sequence: Synthetic oligonucleotide
  Target: ATXN1; (+) strand; PAM type: NRG; PAM sequence: GGG
attctgagagctgtgggatt

SEQ ID NO: 101552 - DNA, 20 bp, Artificial Sequence
  Description of Artificial Sequence: Synthetic oligonucleotide
  Target: ATXN1; (+) strand; PAM type: NRG; PAM sequence: TGG
agagctgtgggattgggctt

SEQ ID NO: 101553 - DNA, 20 bp, Artificial Sequence
  Description of Artificial Sequence: Synthetic oligonucleotide
  Target: ATXN1; (+) strand; PAM type: NRG; PAM sequence: GGG
gagctgtgggattgggcttt

SEQ ID NO: 101554 - DNA, 20 bp, Artificial Sequence
  Description of Artificial Sequence: Synthetic oligonucleotide
  Target: ATXN1; (+) strand; PAM type: NRG; PAM sequence: TGG
ctttgggaattccacaccct

SEQ ID NO: 101555 - DNA, 20 bp, Artificial Sequence
  Description of Artificial Sequence: Synthetic oligonucleotide
  Target: ATXN1; (+) strand; PAM type: NRG; PAM sequence: GGG
tttgggaattccacaccctt

SEQ ID NO: 101556 - DNA, 20 bp, Artificial Sequence
  Description of Artificial Sequence: Synthetic oligonucleotide
  Target: ATXN1; (+) strand; PAM type: NRG; PAM sequence: TGG
aattccacacccttgggttt

SEQ ID NO: 101557 - DNA, 20 bp, Artificial Sequence
  Description of Artificial Sequence: Synthetic oligonucleotide
  Target: ATXN1; (+) strand; PAM type: NRG; PAM sequence: CAG
gggttttggtatctcacatc

SEQ ID NO: 101558 - DNA, 20 bp, Artificial Sequence
  Description of Artificial Sequence: Synthetic oligonucleotide
  Target: ATXN1; (+) strand; PAM type: NRG; PAM sequence: TGG
tctttctttctttctttctt

SEQ ID NO: 101559 - DNA, 20 bp, Artificial Sequence
  Description of Artificial Sequence: Synthetic oligonucleotide
  Target: ATXN1; (+) strand; PAM type: NRG; PAM sequence: GAG
tttctttctttctttctttg

SEQ ID NO: 101560 - DNA, 20 bp, Artificial Sequence
  Description of Artificial Sequence: Synthetic oligonucleotide
  Target: ATXN1; (+) strand; PAM type: NRG; PAM sequence: GAG
tctttctttctttctttgga

SEQ ID NO: 101561 - DNA, 20 bp, Artificial Sequence
  Description of Artificial Sequence: Synthetic oligonucleotide
  Target: ATXN1; (+) strand; PAM type: NRG; PAM sequence: TGG
tctttctttctttggagaga

SEQ ID NO: 101562 - DNA, 20 bp, Artificial Sequence
  Description of Artificial Sequence: Synthetic oligonucleotide
  Target: ATXN1; (+) strand; PAM type: NRG; PAM sequence: GGG
ctttctttctttggagagat

SEQ ID NO: 101563 - DNA, 20 bp, Artificial Sequence
  Description of Artificial Sequence: Synthetic oligonucleotide
  Target: ATXN1; (+) strand; PAM type: NRG; PAM sequence: GGG
tttctttctttggagagatg

SEQ ID NO: 101564 - DNA, 20 bp, Artificial Sequence
  Description of Artificial Sequence: Synthetic oligonucleotide
  Target: ATXN1; (+) strand; PAM type: NRG; PAM sequence: CAG
tggggtcttgctatgttaac

SEQ ID NO: 101565 - DNA, 20 bp, Artificial Sequence
  Description of Artificial Sequence: Synthetic oligonucleotide
  Target: ATXN1; (+) strand; PAM type: NRG; PAM sequence: AGG
ggggtcttgctatgttaacc

SEQ ID NO: 101566 - DNA, 20 bp, Artificial Sequence
  Description of Artificial Sequence: Synthetic oligonucleotide
  Target: ATXN1; (+) strand; PAM type: NRG; PAM sequence: TGG
tcttgctatgttaaccaggc

SEQ ID NO: 101567 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtcttgaaatcc

SEQ ID NO: 101568 - DNA, 20 bp, Artificial Sequence
  Description of Artificial Sequence: Synthetic oligonucleotide
  Target: ATXN1; (+) strand; PAM type: NRG; PAM sequence: AAG
ggtcttgaaatcctggcctc

SEQ ID NO: 101569 - DNA, 20 bp, Artificial Sequence
  Description of Artificial Sequence: Synthetic oligonucleotide
  Target: ATXN1; (+) strand; PAM type: NRG; PAM sequence: TGG
ctcaagaaatcctccttcct

SEQ ID NO: 101570 - DNA, 20 bp, Artificial Sequence
  Description of Artificial Sequence: Synthetic oligonucleotide
  Target: ATXN1; (+) strand; PAM type: NRG; PAM sequence: AAG
cctccttccttggcctccca

SEQ ID NO: 101571 - DNA, 20 bp, Artificial Sequence
  Description of Artificial Sequence: Synthetic oligonucleotide
  Target: ATXN1; (+) strand; PAM type: NRG; PAM sequence: TAG
tccttggcctcccaaagtgc

SEQ ID NO: 101572 - DNA, 20 bp, Artificial Sequence
  Description of Artificial Sequence: Synthetic oligonucleotide
  Target: ATXN1; (+) strand; PAM type: NRG; PAM sequence: AGG
ccttggcctcccaaagtgct

SEQ ID NO: 101573 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctaggattc

SEQ ID NO: 101574 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctaggattcc

SEQ ID NO: 101575 - DNA, 20 bp, Artificial Sequence
  Description of Artificial Sequence: Synthetic oligonucleotide
  Target: ATXN1; (+) strand; PAM type: NRG; PAM sequence: GAG
agtgctaggattccaggcat

SEQ ID NO: 101576 - DNA, 20 bp, Artificial Sequence
  Description of Artificial Sequence: Synthetic oligonucleotide
  Target: ATXN1; (+) strand; PAM type: NRG; PAM sequence: TAG
caggcatgagccactgtgtg

SEQ ID NO: 101577 - DNA, 20 bp, Artificial Sequence
  Description of Artificial Sequence: Synthetic oligonucleotide
  Target: ATXN1; (+) strand; PAM type: NRG; PAM sequence: AAG
attttaaaacaaacacaata

SEQ ID NO: 101578 - DNA, 20 bp, Artificial Sequence
  Description of Artificial Sequence: Synthetic oligonucleotide
  Target: ATXN1; (+) strand; PAM type: NRG; PAM sequence: TAG
ttaaaacaaacacaataaag

SEQ ID NO: 101579 - DNA, 20 bp, Artificial Sequence
  Description of Artificial Sequence: Synthetic oligonucleotide
  Target: ATXN1; (+) strand; PAM type: NRG; PAM sequence: CGG
aaacaaacacaataaagtag

SEQ ID NO: 101580 - DNA, 20 bp, Artificial Sequence
  Description of Artificial Sequence: Synthetic oligonucleotide
  Target: ATXN1; (+) strand; PAM type: NRG; PAM sequence: CAG
cacaataaagtagcggcctt

SEQ ID NO: 101581 - DNA, 20 bp, Artificial Sequence
  Description of Artificial Sequence: Synthetic oligonucleotide
  Target: ATXN1; (+) strand; PAM type: NRG; PAM sequence: TGG
cattcaatccttgtccatgt

SEQ ID NO: 101582 - DNA, 20 bp, Artificial Sequence
  Description of Artificial Sequence: Synthetic oligonucleotide
  Target: ATXN1; (+) strand; PAM type: NRG; PAM sequence: GAG
ttcaatccttgtccatgttg

SEQ ID NO: 101583 - DNA, 20 bp, Artificial Sequence
  Description of Artificial Sequence: Synthetic oligonucleotide
  Target: ATXN1; (+) strand; PAM type: NRG; PAM sequence: TAG
cctactttgtaactattttt

SEQ ID NO: 101584 - DNA, 20 bp, Artificial Sequence
  Description of Artificial Sequence: Synthetic oligonucleotide
  Target: ATXN1; (+) strand; PAM type: NRG; PAM sequence: GAG
tactttgtaactatttttta

SEQ ID NO: 101585 - DNA, 20 bp, Artificial Sequence
  Description of Artificial Sequence: Synthetic oligonucleotide
  Target: ATXN1; (+) strand; PAM type: NRG; PAM sequence: AGG
actttgtaactattttttag

SEQ ID NO: 101586 - DNA, 20 bp, Artificial Sequence
  Description of Artificial Sequence: Synthetic oligonucleotide
  Target: ATXN1; (+) strand; PAM type: NRG; PAM sequence: GGG
ctttgtaactattttttaga

SEQ ID NO: 101587 - DNA, 20 bp, Artificial Sequence
  Description of Artificial Sequence: Synthetic oligonucleotide
  Target: ATXN1; (+) strand; PAM type: NRG; PAM sequence: GGG
tttgtaactattttttagag

SEQ ID NO: 101588 - DNA, 20 bp, Artificial Sequence
  Description of Artificial Sequence: Synthetic oligonucleotide
  Target: ATXN1; (+) strand; PAM type: NRG; PAM sequence: GGG
ttgtaactattttttagagg

SEQ ID NO: 101589 - DNA, 20 bp, Artificial Sequence
  Description of Artificial Sequence: Synthetic oligonucleotide
  Target: ATXN1; (+) strand; PAM type: NRG; PAM sequence: AAG
tttttttttttttttttgaa

SEQ ID NO: 101590 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttttttgaaa

SEQ ID NO: 101591 - DNA, 20 bp, Artificial Sequence
  Description of Artificial Sequence: Synthetic oligonucleotide
  Target: ATXN1; (+) strand; PAM type: NRG; PAM sequence: CAG
aaaggtcttgcttcgttgct

SEQ ID NO: 101592 - DNA, 20 bp, Artificial Sequence
  Description of Artificial Sequence: Synthetic oligonucleotide
  Target: ATXN1; (+) strand; PAM type: NRG; PAM sequence: AAG
ttgcttcgttgctcagactg

SEQ ID NO: 101593 - DNA, 20 bp, Artificial Sequence
  Description of Artificial Sequence: Synthetic oligonucleotide
  Target: ATXN1; (+) strand; PAM type: NRG; PAM sequence: CAG
tcgttgctcagactgaagtg

SEQ ID NO: 101594 - DNA, 20 bp, Artificial Sequence
  Description of Artificial Sequence: Synthetic oligonucleotide
  Target: ATXN1; (+) strand; PAM type: NRG; PAM sequence: TGG
ttgctcagactgaagtgcag

SEQ ID NO: 101595 - DNA, 20 bp, Artificial Sequence
  Description of Artificial Sequence: Synthetic oligonucleotide
  Target: ATXN1; (+) strand; PAM type: NRG; PAM sequence: CGG
gaagtgcagtggcgtgatct

SEQ ID NO: 101596 - DNA, 20 bp, Artificial Sequence
  Description of Artificial Sequence: Synthetic oligonucleotide
  Target: ATXN1; (+) strand; PAM type: NRG; PAM sequence: TGG
ttgctgcaacctgtgcctcc

SEQ ID NO: 101597 - DNA, 20 bp, Artificial Sequence
  Description of Artificial Sequence: Synthetic oligonucleotide
  Target: ATXN1; (+) strand; PAM type: NRG; PAM sequence: GGG
tgctgcaacctgtgcctcct

SEQ ID NO: 101598 - DNA, 20 bp, Artificial Sequence
  Description of Artificial Sequence: Synthetic oligonucleotide
  Target: ATXN1; (+) strand; PAM type: NRG; PAM sequence: AAG
aacctgtgcctcctgggctc

SEQ ID NO: 101599 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatcctcccacct

SEQ ID NO: 101600 - DNA, 20 bp, Artificial Sequence
  Description of Artificial Sequence: Synthetic oligonucleotide
  Target: ATXN1; (+) strand; PAM type: NRG; PAM sequence: CAG
atcctcccacctcagcctcc

SEQ ID NO: 101601 - DNA, 20 bp, Artificial Sequence
  Description of Artificial Sequence: Synthetic oligonucleotide
  Target: ATXN1; (+) strand; PAM type: NRG; PAM sequence: AGG
tcctcccacctcagcctccc

SEQ ID NO: 101602 - DNA, 20 bp, Artificial Sequence
  Description of Artificial Sequence: Synthetic oligonucleotide
  Target: ATXN1; (+) strand; PAM type: NRG; PAM sequence: TAG
tcccacctcagcctcccagg

SEQ ID NO: 101603 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcccaggtagc

SEQ ID NO: 101604 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaggtagct

SEQ ID NO: 101605 - DNA, 20 bp, Artificial Sequence
  Description of Artificial Sequence: Synthetic oligonucleotide
  Target: ATXN1; (+) strand; PAM type: NRG; PAM sequence: CAG
ctcccaggtagctgggacta

SEQ ID NO: 101606 - DNA, 20 bp, Artificial Sequence
  Description of Artificial Sequence: Synthetic oligonucleotide
  Target: ATXN1; (+) strand; PAM type: NRG; PAM sequence: AGG
tcccaggtagctgggactac

SEQ ID NO: 101607 - DNA, 20 bp, Artificial Sequence
  Description of Artificial Sequence: Synthetic oligonucleotide
  Target: ATXN1; (+) strand; PAM type: NRG; PAM sequence: CGG
caggtgcacgccaccacacc

SEQ ID NO: 101608 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtactttttg

SEQ ID NO: 101609 - DNA, 20 bp, Artificial Sequence
  Description of Artificial Sequence: Synthetic oligonucleotide
  Target: ATXN1; (+) strand; PAM type: NRG; PAM sequence: GAG
taatttttgtactttttgta

SEQ ID NO: 101610 - DNA, 20 bp, Artificial Sequence
  Description of Artificial Sequence: Synthetic oligonucleotide
  Target: ATXN1; (+) strand; PAM type: NRG; PAM sequence: AGG
aatttttgtactttttgtag

SEQ ID NO: 101611 - DNA, 20 bp, Artificial Sequence
  Description of Artificial Sequence: Synthetic oligonucleotide
  Target: ATXN1; (+) strand; PAM type: NRG; PAM sequence: TGG
ttttgtactttttgtagagg

SEQ ID NO: 101612 - DNA, 20 bp, Artificial Sequence
  Description of Artificial Sequence: Synthetic oligonucleotide
  Target: ATXN1; (+) strand; PAM type: NRG; PAM sequence: GGG
tttgtactttttgtagaggt

SEQ ID NO: 101613 - DNA, 20 bp, Artificial Sequence
  Description of Artificial Sequence: Synthetic oligonucleotide
  Target: ATXN1; (+) strand; PAM type: NRG; PAM sequence: GGG
ttgtactttttgtagaggtg

SEQ ID NO: 101614 - DNA, 20 bp, Artificial Sequence
  Description of Artificial Sequence: Synthetic oligonucleotide
  Target: ATXN1; (+) strand; PAM type: NRG; PAM sequence: TGG
gaggtggggttttgccatgt

SEQ ID NO: 101615 - DNA, 20 bp, Artificial Sequence
  Description of Artificial Sequence: Synthetic oligonucleotide
  Target: ATXN1; (+) strand; PAM type: NRG; PAM sequence: CAG
tggggttttgccatgttggc

SEQ ID NO: 101616 - DNA, 20 bp, Artificial Sequence
  Description of Artificial Sequence: Synthetic oligonucleotide
  Target: ATXN1; (+) strand; PAM type: NRG; PAM sequence: AGG
ggggttttgccatgttggcc

SEQ ID NO: 101617 - DNA, 20 bp, Artificial Sequence
  Description of Artificial Sequence: Synthetic oligonucleotide
  Target: ATXN1; (+) strand; PAM type: NRG; PAM sequence: TGG
ttttgccatgttggccaggc

SEQ ID NO: 101618 - DNA, 20 bp, Artificial Sequence
  Description of Artificial Sequence: Synthetic oligonucleotide
  Target: ATXN1; (+) strand; PAM type: NRG; PAM sequence: CAG
ttggccaggctggtcttgaa

SEQ ID NO: 101619 - DNA, 20 bp, Artificial Sequence
  Description of Artificial Sequence: Synthetic oligonucleotide
  Target: ATXN1; (+) strand; PAM type: NRG; PAM sequence: AGG
tggccaggctggtcttgaac

SEQ ID NO: 101620 - DNA, 20 bp, Artificial Sequence
  Description of Artificial Sequence: Synthetic oligonucleotide
  Target: ATXN1; (+) strand; PAM type: NRG; PAM sequence: CAG
ggctggtcttgaacaggcct

SEQ ID NO: 101621 - DNA, 20 bp, Artificial Sequence
  Description of Artificial Sequence: Synthetic oligonucleotide
  Target: ATXN1; (+) strand; PAM type: NRG; PAM sequence: TGG
gcctcagtgatccacccact

SEQ ID NO: 101622 - DNA, 20 bp, Artificial Sequence
  Description of Artificial Sequence: Synthetic oligonucleotide
  Target: ATXN1; (+) strand; PAM type: NRG; PAM sequence: CGG
gatccacccacttggcctcc

SEQ ID NO: 101623 - DNA, 20 bp, Artificial Sequence
  Description of Artificial Sequence: Synthetic oligonucleotide
  Target: ATXN1; (+) strand; PAM type: NRG; PAM sequence: TGG
cccacttggcctcccggtgc

SEQ ID NO: 101624 - DNA, 20 bp, Artificial Sequence
  Description of Artificial Sequence: Synthetic oligonucleotide
  Target: ATXN1; (+) strand; PAM type: NRG; PAM sequence: GGG
ccacttggcctcccggtgct

SEQ ID NO: 101625 - DNA, 20 bp, Artificial Sequence
  Description of Artificial Sequence: Synthetic oligonucleotide
  Target: ATXN1; (+) strand; PAM type: NRG; PAM sequence: CAG
gcctcccggtgctgggatta

SEQ ID NO: 101626 - DNA, 20 bp, Artificial Sequence
  Description of Artificial Sequence: Synthetic oligonucleotide
  Target: ATXN1; (+) strand; PAM type: NRG; PAM sequence: AGG
cctcccggtgctgggattac

SEQ ID NO: 101627 - DNA, 20 bp, Artificial Sequence
  Description of Artificial Sequence: Synthetic oligonucleotide
  Target: ATXN1; (+) strand; PAM type: NRG; PAM sequence: GAG
ggtgctgggattacaggcat

SEQ ID NO: 101628 - DNA, 20 bp, Artificial Sequence
  Description of Artificial Sequence: Synthetic oligonucleotide
  Target: ATXN1; (+) strand; PAM type: NRG; PAM sequence: CAG
attacaggcatgagccactg

SEQ ID NO: 101629 - DNA, 20 bp, Artificial Sequence
  Description of Artificial Sequence: Synthetic oligonucleotide
  Target: ATXN1; (+) strand; PAM type: NRG; PAM sequence: CAG
caggcatgagccactgcagc

SEQ ID NO: 101630 - DNA, 20 bp, Artificial Sequence
  Description of Artificial Sequence: Synthetic oligonucleotide
  Target: ATXN1; (+) strand; PAM type: NRG; PAM sequence: TGG
atgagccactgcagccagct

SEQ ID NO: 101631 - DNA, 20 bp, Artificial Sequence
  Description of Artificial Sequence: Synthetic oligonucleotide
  Target: ATXN1; (+) strand; PAM type: NRG; PAM sequence: AAG
agccactgcagccagcttgg

SEQ ID NO: 101632 - DNA, 20 bp, Artificial Sequence
  Description of Artificial Sequence: Synthetic oligonucleotide
  Target: ATXN1; (+) strand; PAM type: NRG; PAM sequence: AGG
gccactgcagccagcttgga

SEQ ID NO: 101633 - DNA, 20 bp, Artificial Sequence
  Description of Artificial Sequence: Synthetic oligonucleotide
  Target: ATXN1; (+) strand; PAM type: NRG; PAM sequence: GGG
ccactgcagccagcttggaa

SEQ ID NO: 101634 - DNA, 20 bp, Artificial Sequence
  Description of Artificial Sequence: Synthetic oligonucleotide
  Target: ATXN1; (+) strand; PAM type: NRG; PAM sequence: GGG
cactgcagccagcttggaag

SEQ ID NO: 101635 - DNA, 20 bp, Artificial Sequence
  Description of Artificial Sequence: Synthetic oligonucleotide
  Target: ATXN1; (+) strand; PAM type: NRG; PAM sequence: TGG
tggaaggggcaatgatttaa

SEQ ID NO: 101636 - DNA, 20 bp, Artificial Sequence
  Description of Artificial Sequence: Synthetic oligonucleotide
  Target: ATXN1; (+) strand; PAM type: NRG; PAM sequence: TGG
aatgatttaatggcccttat

SEQ ID NO: 101637 - DNA, 20 bp, Artificial Sequence
  Description of Artificial Sequence: Synthetic oligonucleotide
  Target: ATXN1; (+) strand; PAM type: NRG; PAM sequence: CAG
tgaaatgacaaatgatacaa

SEQ ID NO: 101638 - DNA, 20 bp, Artificial Sequence
  Description of Artificial Sequence: Synthetic oligonucleotide
  Target: ATXN1; (+) strand; PAM type: NRG; PAM sequence: AAG
atgacaaatgatacaacaga

SEQ ID NO: 101639 - DNA, 20 bp, Artificial Sequence
  Description of Artificial Sequence: Synthetic oligonucleotide
  Target: ATXN1; (+) strand; PAM type: NRG; PAM sequence: CAG
caatccttaatgattttgat

SEQ ID NO: 101640 - DNA, 20 bp, Artificial Sequence
  Description of Artificial Sequence: Synthetic oligonucleotide
  Target: ATXN1; (+) strand; PAM type: NRG; PAM sequence: TAG
aatgattttgatcagatatc

SEQ ID NO: 101641 - DNA, 20 bp, Artificial Sequence
  Description of Artificial Sequence: Synthetic oligonucleotide
  Target: ATXN1; (+) strand; PAM type: NRG; PAM sequence: AGG
atgattttgatcagatatct

SEQ ID NO: 101642 - DNA, 20 bp, Artificial Sequence
  Description of Artificial Sequence: Synthetic oligonucleotide
  Target: ATXN1; (+) strand; PAM type: NRG; PAM sequence: AAG
attttgatcagatatctagg

SEQ ID NO: 101643 - DNA, 20 bp, Artificial Sequence
  Description of Artificial Sequence: Synthetic oligonucleotide
  Target: ATXN1; (+) strand; PAM type: NRG; PAM sequence: AGG
ttttgatcagatatctagga

SEQ ID NO: 101644 - DNA, 20 bp, Artificial Sequence
  Description of Artificial Sequence: Synthetic oligonucleotide
  Target: ATXN1; (+) strand; PAM type: NRG; PAM sequence: CAG
atcagatatctaggaaggtg

SEQ ID NO: 101645 - DNA, 20 bp, Artificial Sequence
  Description of Artificial Sequence: Synthetic oligonucleotide
  Target: ATXN1; (+) strand; PAM type: NRG; PAM sequence: AGG
tcagatatctaggaaggtgc

SEQ ID NO: 101646 - DNA, 20 bp, Artificial Sequence
  Description of Artificial Sequence: Synthetic oligonucleotide
  Target: ATXN1; (+) strand; PAM type: NRG; PAM sequence: TAG
tatctaggaaggtgcaggtt

SEQ ID NO: 101647 - DNA, 20 bp, Artificial Sequence
  Description of Artificial Sequence: Synthetic oligonucleotide
  Target: ATXN1; (+) strand; PAM type: NRG; PAM sequence: TGG
aaggtgcaggtttagaaatt

SEQ ID NO: 101648 - DNA, 20 bp, Artificial Sequence
  Description of Artificial Sequence: Synthetic oligonucleotide
  Target: ATXN1; (+) strand; PAM type: NRG; PAM sequence: AAG
aatttggtgtctcgatatca

SEQ ID NO: 101649 - DNA, 20 bp, Artificial Sequence
  Description of Artificial Sequence: Synthetic oligonucleotide
  Target: ATXN1; (+) strand; PAM type: NRG; PAM sequence: AGG
atttggtgtctcgatatcaa

SEQ ID NO: 101650 - DNA, 20 bp, Artificial Sequence
  Description of Artificial Sequence: Synthetic oligonucleotide
  Target: ATXN1; (+) strand; PAM type: NRG; PAM sequence: CAG
ctcgatatcaaaggacattt

SEQ ID NO: 101651 - DNA, 20 bp, Artificial Sequence
  Description of Artificial Sequence: Synthetic oligonucleotide
  Target: ATXN1; (+) strand; PAM type: NRG; PAM sequence: AAG
atatcaaaggacatttcagt

SEQ ID NO: 101652 - DNA, 20 bp, Artificial Sequence
  Description of Artificial Sequence: Synthetic oligonucleotide
  Target: ATXN1; (+) strand; PAM type: NRG; PAM sequence: TAG
aaaggacatttcagtaagaa

SEQ ID NO: 101653 - DNA, 20 bp, Artificial Sequence
  Description of Artificial Sequence: Synthetic oligonucleotide
  Target: ATXN1; (+) strand; PAM type: NRG; PAM sequence: AAG
aatagaatttctcatatgac

SEQ ID NO: 101654 - DNA, 20 bp, Artificial Sequence
  Description of Artificial Sequence: Synthetic oligonucleotide
  Target: ATXN1; (+) strand; PAM type: NRG; PAM sequence: GAG
tagaatttctcatatgacaa

SEQ ID NO: 101655 - DNA, 20 bp, Artificial Sequence
  Description of Artificial Sequence: Synthetic oligonucleotide
  Target: ATXN1; (+) strand; PAM type: NRG; PAM sequence: GAG
gaatttctcatatgacaaga

SEQ ID NO: 101656 - DNA, 20 bp, Artificial Sequence
  Description of Artificial Sequence: Synthetic oligonucleotide
  Target: ATXN1; (+) strand; PAM type: NRG; PAM sequence: AGG
aatttctcatatgacaagag

SEQ ID NO: 101657 - DNA, 20 bp, Artificial Sequence
  Description of Artificial Sequence: Synthetic oligonucleotide
  Target: ATXN1; (+) strand; PAM type: NRG; PAM sequence: AAG
tatgacaagagaggcgctta

SEQ ID NO: 101658 - DNA, 20 bp, Artificial Sequence
  Description of Artificial Sequence: Synthetic oligonucleotide
  Target: ATXN1; (+) strand; PAM type: NRG; PAM sequence: TGG
caagagaggcgcttaaagac

SEQ ID NO: 101659 - DNA, 20 bp, Artificial Sequence
  Description of Artificial Sequence: Synthetic oligonucleotide
  Target: ATXN1; (+) strand; PAM type: NRG; PAM sequence: GGG
aagagaggcgcttaaagact

SEQ ID NO: 101660 - DNA, 20 bp, Artificial Sequence
  Description of Artificial Sequence: Synthetic oligonucleotide
  Target: ATXN1; (+) strand; PAM type: NRG; PAM sequence: CGG
gaggcgcttaaagactggga

SEQ ID NO: 101661 - DNA, 20 bp, Artificial Sequence
  Description of Artificial Sequence: Synthetic oligonucleotide
  Target: ATXN1; (+) strand; PAM type: NRG; PAM sequence: AAG
ctgggacggaaatgaaaaat

SEQ ID NO: 101662 - DNA, 20 bp, Artificial Sequence
  Description of Artificial Sequence: Synthetic oligonucleotide
  Target: ATXN1; (+) strand; PAM type: NRG; PAM sequence: AGG
tgggacggaaatgaaaaata

SEQ ID NO: 101663 - DNA, 20 bp, Artificial Sequence
  Description of Artificial Sequence: Synthetic oligonucleotide
  Target: ATXN1; (+) strand; PAM type: NRG; PAM sequence: AAG
accctaaaacacttatgctg

SEQ ID NO: 101664 - DNA, 20 bp, Artificial Sequence
  Description of Artificial Sequence: Synthetic oligonucleotide
  Target: ATXN1; (+) strand; PAM type: NRG; PAM sequence: AAG
acacttatgctgaagaaatg

SEQ ID NO: 101665 - DNA, 20 bp, Artificial Sequence
  Description of Artificial Sequence: Synthetic oligonucleotide
  Target: ATXN1; (+) strand; PAM type: NRG; PAM sequence: AAG
gctgaagaaatgaagtgttg

SEQ ID NO: 101666 - DNA, 20 bp, Artificial Sequence
  Description of Artificial Sequence: Synthetic oligonucleotide
  Target: ATXN1; (+) strand; PAM type: NRG; PAM sequence: AGG
ctgaagaaatgaagtgttga

SEQ ID NO: 101667 - DNA, 20 bp, Artificial Sequence
  Description of Artificial Sequence: Synthetic oligonucleotide
  Target: ATXN1; (+) strand; PAM type: NRG; PAM sequence: GAG
gaagaaatgaagtgttgaag

SEQ ID NO: 101668 - DNA, 20 bp, Artificial Sequence
  Description of Artificial Sequence: Synthetic oligonucleotide
  Target: ATXN1; (+) strand; PAM type: NRG; PAM sequence: CAG
acttatttactctcgcaacc

SEQ ID NO: 101669 - DNA, 20 bp, Artificial Sequence
  Description of Artificial Sequence: Synthetic oligonucleotide
  Target: ATXN1; (+) strand; PAM type: NRG; PAM sequence: AGG
cttatttactctcgcaaccc

SEQ ID NO: 101670 - DNA, 20 bp, Artificial Sequence
  Description of Artificial Sequence: Synthetic oligonucleotide
  Target: ATXN1; (+) strand; PAM type: NRG; PAM sequence: GAG
aacccaggtgtttttttttt

SEQ ID NO: 101671 - DNA, 20 bp, Artificial Sequence
  Description of Artificial Sequence: Synthetic oligonucleotide
  Target: ATXN1; (+) strand; PAM type: NRG; PAM sequence: TGG
caggtgttttttttttgaga

SEQ ID NO: 101672 - DNA, 20 bp, Artificial Sequence
  Description of Artificial Sequence: Synthetic oligonucleotide
  Target: ATXN1; (+) strand; PAM type: NRG; PAM sequence: GAG
ggtgttttttttttgagatg

SEQ ID NO: 101673 - DNA, 20 bp, Artificial Sequence
  Description of Artificial Sequence: Synthetic oligonucleotide
  Target: ATXN1; (+) strand; PAM type: NRG; PAM sequence: CAG
tggagtctcactctgtcgcc

SEQ ID NO: 101674 - DNA, 20 bp, Artificial Sequence
  Description of Artificial Sequence: Synthetic oligonucleotide
  Target: ATXN1; (+) strand; PAM type: NRG; PAM sequence: AGG
ggagtctcactctgtcgccc

SEQ ID NO: 101675 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcgcccaggc

SEQ ID NO: 101676 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgcccaggctg

SEQ ID NO: 101677 - DNA, 20 bp, Artificial Sequence
  Description of Artificial Sequence: Synthetic oligonucleotide
  Target: ATXN1; (+) strand; PAM type: NRG; PAM sequence: AGG
cactctgtcgcccaggctgg

SEQ ID NO: 101678 - DNA, 20 bp, Artificial Sequence
  Description of Artificial Sequence: Synthetic oligonucleotide
  Target: ATXN1; (+) strand; PAM type: NRG; PAM sequence: GGG
actctgtcgcccaggctgga

SEQ ID NO: 101679 - DNA, 20 bp, Artificial Sequence
  Description of Artificial Sequence: Synthetic oligonucleotide
  Target: ATXN1; (+) strand; PAM type: NRG; PAM sequence: CGG
ggagggcaatgtgccaatct

SEQ ID NO: 101680 - DNA, 20 bp, Artificial Sequence
  Description of Artificial Sequence: Synthetic oligonucleotide
  Target: ATXN1; (+) strand; PAM type: NRG; PAM sequence: CGG
tcactgcaacctccgcctcc

SEQ ID NO: 101681 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctccgcctccc

SEQ ID NO: 101682 - DNA, 20 bp, Artificial Sequence
  Description of Artificial Sequence: Synthetic oligonucleotide
  Target: ATXN1; (+) strand; PAM type: NRG; PAM sequence: AAG
aacctccgcctcccgggttc

SEQ ID NO: 101683 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 101684 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctcct

SEQ ID NO: 101685 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 101686 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 101687 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 101688 - DNA, 20 bp, Artificial Sequence
  Description of Artificial Sequence: Synthetic oligonucleotide
  Target: ATXN1; (+) strand; PAM type: NRG; PAM sequence: TAG
ctcctgagtagctgggatta

SEQ ID NO: 101689 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggattat

SEQ ID NO: 101690 - DNA, 20 bp, Artificial Sequence
  Description of Artificial Sequence: Synthetic oligonucleotide
  Target: ATXN1; (+) strand; PAM type: NRG; PAM sequence: CGG
tgagtagctgggattatagg

SEQ ID NO: 101691 - DNA, 20 bp, Artificial Sequence
  Description of Artificial Sequence: Synthetic oligonucleotide
  Target: ATXN1; (+) strand; PAM type: NRG; PAM sequence: TGG
taggcggctgccgccatgcc

SEQ ID NO: 101692 - DNA, 20 bp, Artificial Sequence
  Description of Artificial Sequence: Synthetic oligonucleotide
  Target: ATXN1; (+) strand; PAM type: NRG; PAM sequence: TAG
ctggctaatttttgtatttt

SEQ ID NO: 101693 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 101694 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 101695 - DNA, 20 bp, Artificial Sequence
  Description of Artificial Sequence: Synthetic oligonucleotide
  Target: ATXN1; (+) strand; PAM type: NRG; PAM sequence: AGG
aatttttgtatttttagtag

SEQ ID NO: 101696 - DNA, 20 bp, Artificial Sequence
  Description of Artificial Sequence: Synthetic oligonucleotide
  Target: ATXN1; (+) strand; PAM type: NRG; PAM sequence: CGG
ttttgtatttttagtagagg

SEQ ID NO: 101697 - DNA, 20 bp, Artificial Sequence
  Description of Artificial Sequence: Synthetic oligonucleotide
  Target: ATXN1; (+) strand; PAM type: NRG; PAM sequence: GAG
ttgtatttttagtagaggcg

SEQ ID NO: 101698 - DNA, 20 bp, Artificial Sequence
  Description of Artificial Sequence: Synthetic oligonucleotide
  Target: ATXN1; (+) strand; PAM type: NRG; PAM sequence: TGG
gaggcggagtttcaccatgt

SEQ ID NO: 101699 - DNA, 20 bp, Artificial Sequence
  Description of Artificial Sequence: Synthetic oligonucleotide
  Target: ATXN1; (+) strand; PAM type: NRG; PAM sequence: CAG
cggagtttcaccatgttggc

SEQ ID NO: 101700 - DNA, 20 bp, Artificial Sequence
  Description of Artificial Sequence: Synthetic oligonucleotide
  Target: ATXN1; (+) strand; PAM type: NRG; PAM sequence: AGG
ggagtttcaccatgttggcc

SEQ ID NO: 101701 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccaggc

SEQ ID NO: 101702 - DNA, 20 bp, Artificial Sequence
  Description of Artificial Sequence: Synthetic oligonucleotide
  Target: ATXN1; (+) strand; PAM type: NRG; PAM sequence: CAG
cctgacctcaaatgatccac

SEQ ID NO: 101703 - DNA, 20 bp, Artificial Sequence
  Description of Artificial Sequence: Synthetic oligonucleotide
  Target: ATXN1; (+) strand; PAM type: NRG; PAM sequence: AAG
ccaccagcctctacctccca

SEQ ID NO: 101704 - DNA, 20 bp, Artificial Sequence
  Description of Artificial Sequence: Synthetic oligonucleotide
  Target: ATXN1; (+) strand; PAM type: NRG; PAM sequence: TGG
gcctctacctcccaaagtgc

SEQ ID NO: 101705 - DNA, 20 bp, Artificial Sequence
  Description of Artificial Sequence: Synthetic oligonucleotide
  Target: ATXN1; (+) strand; PAM type: NRG; PAM sequence: GGG
cctctacctcccaaagtgct

SEQ ID NO: 101706 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 101707 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 101708 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 101709 - DNA, 20 bp, Artificial Sequence
  Description of Artificial Sequence: Synthetic oligonucleotide
  Target: ATXN1; (+) strand; PAM type: NRG; PAM sequence: TAG
gccactgcgccctgcccacc

SEQ ID NO: 101710 - DNA, 20 bp, Artificial Sequence
  Description of Artificial Sequence: Synthetic oligonucleotide
  Target: ATXN1; (+) strand; PAM type: NRG; PAM sequence: AGG
ccactgcgccctgcccacct

SEQ ID NO: 101711 - DNA, 20 bp, Artificial Sequence
  Description of Artificial Sequence: Synthetic oligonucleotide
  Target: ATXN1; (+) strand; PAM type: NRG; PAM sequence: GGG
cactgcgccctgcccaccta

SEQ ID NO: 101712 - DNA, 20 bp, Artificial Sequence
  Description of Artificial Sequence: Synthetic oligonucleotide
  Target: ATXN1; (+) strand; PAM type: NRG; PAM sequence: AAG
tgcccacctagggtttttgt

SEQ ID NO: 101713 - DNA, 20 bp, Artificial Sequence
  Description of Artificial Sequence: Synthetic oligonucleotide
  Target: ATXN1; (+) strand; PAM type: NRG; PAM sequence: CAG
acaaataactgtgttctgta

SEQ ID NO: 101714 - DNA, 20 bp, Artificial Sequence
  Description of Artificial Sequence: Synthetic oligonucleotide
  Target: ATXN1; (+) strand; PAM type: NRG; PAM sequence: AAG
gtacagccttcccttgtaaa

SEQ ID NO: 101715 - DNA, 20 bp, Artificial Sequence
  Description of Artificial Sequence: Synthetic oligonucleotide
  Target: ATXN1; (+) strand; PAM type: NRG; PAM sequence: AAG
cagccttcccttgtaaaaag

SEQ ID NO: 101716 - DNA, 20 bp, Artificial Sequence
  Description of Artificial Sequence: Synthetic oligonucleotide
  Target: ATXN1; (+) strand; PAM type: NRG; PAM sequence: AAG
aacttttatctttaaatttc

SEQ ID NO: 101717 - DNA, 20 bp, Artificial Sequence
  Description of Artificial Sequence: Synthetic oligonucleotide
  Target: ATXN1; (+) strand; PAM type: NRG; PAM sequence: AAG
aaatttcaagactcactctt

SEQ ID NO: 101718 - DNA, 20 bp, Artificial Sequence
  Description of Artificial Sequence: Synthetic oligonucleotide
  Target: ATXN1; (+) strand; PAM type: NRG; PAM sequence: AAG
ttcaagactcactcttaaga

SEQ ID NO: 101719 - DNA, 20 bp, Artificial Sequence
  Description of Artificial Sequence: Synthetic oligonucleotide
  Target: ATXN1; (+) strand; PAM type: NRG; PAM sequence: AGG
tcaagactcactcttaagaa

SEQ ID NO: 101720 - DNA, 20 bp, Artificial Sequence
  Description of Artificial Sequence: Synthetic oligonucleotide
  Target: ATXN1; (+) strand; PAM type: NRG; PAM sequence: GGG
caagactcactcttaagaaa

SEQ ID NO: 101721 - DNA, 20 bp, Artificial Sequence
  Description of Artificial Sequence: Synthetic oligonucleotide
  Target: ATXN1; (+) strand; PAM type: NRG; PAM sequence: GAG
tcccacatttccataccaac

SEQ ID NO: 101722 - DNA, 20 bp, Artificial Sequence
  Description of Artificial Sequence: Synthetic oligonucleotide
  Target: ATXN1; (+) strand; PAM type: NRG; PAM sequence: AAG
acatttccataccaacgagc

SEQ ID NO: 101723 - DNA, 20 bp, Artificial Sequence
  Description of Artificial Sequence: Synthetic oligonucleotide
  Target: ATXN1; (+) strand; PAM type: NRG; PAM sequence: AGG
catttccataccaacgagca

SEQ ID NO: 101724 - DNA, 20 bp, Artificial Sequence
  Description of Artificial Sequence: Synthetic oligonucleotide
  Target: ATXN1; (+) strand; PAM type: NRG; PAM sequence: GAG
agcaaggaaaactcatgcgt

SEQ ID NO: 101725 - DNA, 20 bp, Artificial Sequence
  Description of Artificial Sequence: Synthetic oligonucleotide
  Target: ATXN1; (+) strand; PAM type: NRG; PAM sequence: CAG
actcatgcgtgagacctact

SEQ ID NO: 101726 - DNA, 20 bp, Artificial Sequence
  Description of Artificial Sequence: Synthetic oligonucleotide
  Target: ATXN1; (+) strand; PAM type: NRG; PAM sequence: GAG
tcatgcgtgagacctactca

SEQ ID NO: 101727 - DNA, 20 bp, Artificial Sequence
  Description of Artificial Sequence: Synthetic oligonucleotide
  Target: ATXN1; (+) strand; PAM type: NRG; PAM sequence: GAG
atgcgtgagacctactcaga

SEQ ID NO: 101728 - DNA, 20 bp, Artificial Sequence
  Description of Artificial Sequence: Synthetic oligonucleotide
  Target: ATXN1; (+) strand; PAM type: NRG; PAM sequence: CAG
gagacctactcagagagaac

SEQ ID NO: 101729 - DNA, 20 bp, Artificial Sequence
  Description of Artificial Sequence: Synthetic oligonucleotide
  Target: ATXN1; (+) strand; PAM type: NRG; PAM sequence: TGG
ccagtccatgcgccccctgc

SEQ ID NO: 101730 - DNA, 20 bp, Artificial Sequence
  Description of Artificial Sequence: Synthetic oligonucleotide
  Target: ATXN1; (+) strand; PAM type: NRG; PAM sequence: CAG
gccccctgctggccctcctg

SEQ ID NO: 101731 - DNA, 20 bp, Artificial Sequence
  Description of Artificial Sequence: Synthetic oligonucleotide
  Target: ATXN1; (+) strand; PAM type: NRG; PAM sequence: CAG
actgatccaataaaacccca

SEQ ID NO: 101732 - DNA, 20 bp, Artificial Sequence
  Description of Artificial Sequence: Synthetic oligonucleotide
  Target: ATXN1; (+) strand; PAM type: NRG; PAM sequence: AGG
ctgatccaataaaaccccac

SEQ ID NO: 101733 - DNA, 20 bp, Artificial Sequence
  Description of Artificial Sequence: Synthetic oligonucleotide
  Target: ATXN1; (+) strand; PAM type: NRG; PAM sequence: GGG
tgatccaataaaaccccaca

SEQ ID NO: 101734 - DNA, 20 bp, Artificial Sequence
  Description of Artificial Sequence: Synthetic oligonucleotide
  Target: ATXN1; (+) strand; PAM type: NRG; PAM sequence: GAG
aaaaccccacagggtttcat

SEQ ID NO: 101735 - DNA, 20 bp, Artificial Sequence
  Description of Artificial Sequence: Synthetic oligonucleotide
  Target: ATXN1; (+) strand; PAM type: NRG; PAM sequence: AGG
aaaccccacagggtttcatg

SEQ ID NO: 101736 - DNA, 20 bp, Artificial Sequence
  Description of Artificial Sequence: Synthetic oligonucleotide
  Target: ATXN1; (+) strand; PAM type: NRG; PAM sequence: GGG
aaccccacagggtttcatga

SEQ ID NO: 101737 - DNA, 20 bp, Artificial Sequence
  Description of Artificial Sequence: Synthetic oligonucleotide
  Target: ATXN1; (+) strand; PAM type: NRG; PAM sequence: AAG
ttcatgagggatatttatgc

SEQ ID NO: 101738 - DNA, 20 bp, Artificial Sequence
  Description of Artificial Sequence: Synthetic oligonucleotide
  Target: ATXN1; (+) strand; PAM type: NRG; PAM sequence: GAG
catgagggatatttatgcaa

SEQ ID NO: 101739 - DNA, 20 bp, Artificial Sequence
  Description of Artificial Sequence: Synthetic oligonucleotide
  Target: ATXN1; (+) strand; PAM type: NRG; PAM sequence: CAG
tttatgcaagagtgatgtgt

SEQ ID NO: 101740 - DNA, 20 bp, Artificial Sequence
  Description of Artificial Sequence: Synthetic oligonucleotide
  Target: ATXN1; (+) strand; PAM type: NRG; PAM sequence: GAG
gatgtgtcagaatgcaaaat

SEQ ID NO: 101741 - DNA, 20 bp, Artificial Sequence
  Description of Artificial Sequence: Synthetic oligonucleotide
  Target: ATXN1; (+) strand; PAM type: NRG; PAM sequence: TAG
aaaatgagaacatttgcata

SEQ ID NO: 101742 - DNA, 20 bp, Artificial Sequence
  Description of Artificial Sequence: Synthetic oligonucleotide
  Target: ATXN1; (+) strand; PAM type: NRG; PAM sequence: TAG
atgagaacatttgcatatag

SEQ ID NO: 101743 - DNA, 20 bp, Artificial Sequence
  Description of Artificial Sequence: Synthetic oligonucleotide
  Target: ATXN1; (+) strand; PAM type: NRG; PAM sequence: AGG
tgagaacatttgcatatagt

SEQ ID NO: 101744 - DNA, 20 bp, Artificial Sequence
  Description of Artificial Sequence: Synthetic oligonucleotide
  Target: ATXN1; (+) strand; PAM type: NRG; PAM sequence: CAG
acatttgcatatagtaggcc

SEQ ID NO: 101745 - DNA, 20 bp, Artificial Sequence
  Description of Artificial Sequence: Synthetic oligonucleotide
  Target: ATXN1; (+) strand; PAM type: NRG; PAM sequence: CAG
ttgcatatagtaggcccagc

SEQ ID NO: 101746 - DNA, 20 bp, Artificial Sequence
  Description of Artificial Sequence: Synthetic oligonucleotide
  Target: ATXN1; (+) strand; PAM type: NRG; PAM sequence: AAG
atatagtaggcccagccagt

SEQ ID NO: 101747 - DNA, 20 bp, Artificial Sequence
  Description of Artificial Sequence: Synthetic oligonucleotide
  Target: ATXN1; (+) strand; PAM type: NRG; PAM sequence: AGG
tatagtaggcccagccagta

SEQ ID NO: 101748 - DNA, 20 bp, Artificial Sequence
  Description of Artificial Sequence: Synthetic oligonucleotide
  Target: ATXN1; (+) strand; PAM type: NRG; PAM sequence: GGG
atagtaggcccagccagtaa

SEQ ID NO: 101749 - DNA, 20 bp, Artificial Sequence
  Description of Artificial Sequence: Synthetic oligonucleotide
  Target: ATXN1; (+) strand; PAM type: NRG; PAM sequence: TAG
aggcccagccagtaagggaa

SEQ ID NO: 101750 - DNA, 20 bp, Artificial Sequence
  Description of Artificial Sequence: Synthetic oligonucleotide
  Target: ATXN1; (+) strand; PAM type: NRG; PAM sequence: AGG
ggcccagccagtaagggaat

SEQ ID NO: 101751 - DNA, 20 bp, Artificial Sequence
  Description of Artificial Sequence: Synthetic oligonucleotide
  Target: ATXN1; (+) strand; PAM type: NRG; PAM sequence: TAG
cagtaagggaataggttaat

SEQ ID NO: 101752 - DNA, 20 bp, Artificial Sequence
  Description of Artificial Sequence: Synthetic oligonucleotide
  Target: ATXN1; (+) strand; PAM type: NRG; PAM sequence: AAG
gggaataggttaattagccc

SEQ ID NO: 101753 - DNA, 20 bp, Artificial Sequence
  Description of Artificial Sequence: Synthetic oligonucleotide
  Target: ATXN1; (+) strand; PAM type: NRG; PAM sequence: AGG
ggaataggttaattagccca

SEQ ID NO: 101754 - DNA, 20 bp, Artificial Sequence
  Description of Artificial Sequence: Synthetic oligonucleotide
  Target: ATXN1; (+) strand; PAM type: NRG; PAM sequence: CAG
ataggttaattagcccaagg

SEQ ID NO: 101755 - DNA, 20 bp, Artificial Sequence
  Description of Artificial Sequence: Synthetic oligonucleotide
  Target: ATXN1; (+) strand; PAM type: NRG; PAM sequence: TAG
taattagcccaaggcagcac

SEQ ID NO: 101756 - DNA, 20 bp, Artificial Sequence
  Description of Artificial Sequence: Synthetic oligonucleotide
  Target: ATXN1; (+) strand; PAM type: NRG; PAM sequence: AGG
aattagcccaaggcagcact

SEQ ID NO: 101757 - DNA, 20 bp, Artificial Sequence
  Description of Artificial Sequence: Synthetic oligonucleotide
  Target: ATXN1; (+) strand; PAM type: NRG; PAM sequence: GGG
attagcccaaggcagcacta

SEQ ID NO: 101758 - DNA, 20 bp, Artificial Sequence
  Description of Artificial Sequence: Synthetic oligonucleotide
  Target: ATXN1; (+) strand; PAM type: NRG; PAM sequence: AAG
agcccaaggcagcactaggg

SEQ ID NO: 101759 - DNA, 20 bp, Artificial Sequence
  Description of Artificial Sequence: Synthetic oligonucleotide
  Target: ATXN1; (+) strand; PAM type: NRG; PAM sequence: AAG
aggcagcactagggaagaaa

SEQ ID NO: 101760 - DNA, 20 bp, Artificial Sequence
  Description of Artificial Sequence: Synthetic oligonucleotide
  Target: ATXN1; (+) strand; PAM type: NRG; PAM sequence: CAG
cagcactagggaagaaaaag

SEQ ID NO: 101761 - DNA, 20 bp, Artificial Sequence
  Description of Artificial Sequence: Synthetic oligonucleotide
  Target: ATXN1; (+) strand; PAM type: NRG; PAM sequence: CGG
cactagggaagaaaaagcag

SEQ ID NO: 101762 - DNA, 20 bp, Artificial Sequence
  Description of Artificial Sequence: Synthetic oligonucleotide
  Target: ATXN1; (+) strand; PAM type: NRG; PAM sequence: AAG
aagaaaaagcagcggcataa

SEQ ID NO: 101763 - DNA, 20 bp, Artificial Sequence
  Description of Artificial Sequence: Synthetic oligonucleotide
  Target: ATXN1; (+) strand; PAM type: NRG; PAM sequence: AAG
gcggcataaaagtcctttca

SEQ ID NO: 101764 - DNA, 20 bp, Artificial Sequence
  Description of Artificial Sequence: Synthetic oligonucleotide
  Target: ATXN1; (+) strand; PAM type: NRG; PAM sequence: AAG
ataaaagtcctttcaaagcc

SEQ ID NO: 101765 - DNA, 20 bp, Artificial Sequence
  Description of Artificial Sequence: Synthetic oligonucleotide
  Target: ATXN1; (+) strand; PAM type: NRG; PAM sequence: CAG
agtaaaatgtcaaacacatt

SEQ ID NO: 101766 - DNA, 20 bp, Artificial Sequence
  Description of Artificial Sequence: Synthetic oligonucleotide
  Target: ATXN1; (+) strand; PAM type: NRG; PAM sequence: AGG
gtaaaatgtcaaacacattc

SEQ ID NO: 101767 - DNA, 20 bp, Artificial Sequence
  Description of Artificial Sequence: Synthetic oligonucleotide
  Target: ATXN1; (+) strand; PAM type: NRG; PAM sequence: AAG
aaatgtcaaacacattcagg

SEQ ID NO: 101768 - DNA, 20 bp, Artificial Sequence
  Description of Artificial Sequence: Synthetic oligonucleotide
  Target: ATXN1; (+) strand; PAM type: NRG; PAM sequence: AGG
aatgtcaaacacattcagga

SEQ ID NO: 101769 - DNA, 20 bp, Artificial Sequence
  Description of Artificial Sequence: Synthetic oligonucleotide
  Target: ATXN1; (+) strand; PAM type: NRG; PAM sequence: GGG
atgtcaaacacattcaggaa

SEQ ID NO: 101770 - DNA, 20 bp, Artificial Sequence
  Description of Artificial Sequence: Synthetic oligonucleotide
  Target: ATXN1; (+) strand; PAM type: NRG; PAM sequence: TAG
cacattcaggaagggtctat

SEQ ID NO: 101771 - DNA, 20 bp, Artificial Sequence
  Description of Artificial Sequence: Synthetic oligonucleotide
  Target: ATXN1; (+) strand; PAM type: NRG; PAM sequence: TAG
gaatgcacaatacacaaaac

SEQ ID NO: 101772 - DNA, 20 bp, Artificial Sequence
  Description of Artificial Sequence: Synthetic oligonucleotide
  Target: ATXN1; (+) strand; PAM type: NRG; PAM sequence: AAG
aaaactagaaaactcctctg

SEQ ID NO: 101773 - DNA, 20 bp, Artificial Sequence
  Description of Artificial Sequence: Synthetic oligonucleotide
  Target: ATXN1; (+) strand; PAM type: NRG; PAM sequence: AGG
aaactagaaaactcctctga

SEQ ID NO: 101774 - DNA, 20 bp, Artificial Sequence
  Description of Artificial Sequence: Synthetic oligonucleotide
  Target: ATXN1; (+) strand; PAM type: NRG; PAM sequence: TAG
ctcctctgaaggtacttctt

SEQ ID NO: 101775 - DNA, 20 bp, Artificial Sequence
  Description of Artificial Sequence: Synthetic oligonucleotide
  Target: ATXN1; (+) strand; PAM type: NRG; PAM sequence: AGG
tcctctgaaggtacttcttt

SEQ ID NO: 101776 - DNA, 20 bp, Artificial Sequence
  Description of Artificial Sequence: Synthetic oligonucleotide
  Target: ATXN1; (+) strand; PAM type: NRG; PAM sequence: AAG
tctgaaggtacttctttagg

SEQ ID NO: 101777 - DNA, 20 bp, Artificial Sequence
  Description of Artificial Sequence: Synthetic oligonucleotide
  Target: ATXN1; (+) strand; PAM type: NRG; PAM sequence: CAG
aaggtacttctttaggaagc

SEQ ID NO: 101778 - DNA, 20 bp, Artificial Sequence
  Description of Artificial Sequence: Synthetic oligonucleotide
  Target: ATXN1; (+) strand; PAM type: NRG; PAM sequence: AAG
cagctttcgtaaatttgaaa

SEQ ID NO: 101779 - DNA, 20 bp, Artificial Sequence
  Description of Artificial Sequence: Synthetic oligonucleotide
  Target: ATXN1; (+) strand; PAM type: NRG; PAM sequence: TGG
tttgaaaaagaatgctgact

SEQ ID NO: 101780 - DNA, 20 bp, Artificial Sequence
  Description of Artificial Sequence: Synthetic oligonucleotide
  Target: ATXN1; (+) strand; PAM type: NRG; PAM sequence: CAG
aagaatgctgacttggttct

SEQ ID NO: 101781 - DNA, 20 bp, Artificial Sequence
  Description of Artificial Sequence: Synthetic oligonucleotide
  Target: ATXN1; (+) strand; PAM type: NRG; PAM sequence: TAG
aatgctgacttggttctcag

SEQ ID NO: 101782 - DNA, 20 bp, Artificial Sequence
  Description of Artificial Sequence: Synthetic oligonucleotide
  Target: ATXN1; (+) strand; PAM type: NRG; PAM sequence: CAG
acttggttctcagtagtgct

SEQ ID NO: 101783 - DNA, 20 bp, Artificial Sequence
  Description of Artificial Sequence: Synthetic oligonucleotide
  Target: ATXN1; (+) strand; PAM type: NRG; PAM sequence: AGG
cttggttctcagtagtgctc

SEQ ID NO: 101784 - DNA, 20 bp, Artificial Sequence
  Description of Artificial Sequence: Synthetic oligonucleotide
  Target: ATXN1; (+) strand; PAM type: NRG; PAM sequence: GAG
tttaattatactgtttattt

SEQ ID NO: 101785 - DNA, 20 bp, Artificial Sequence
  Description of Artificial Sequence: Synthetic oligonucleotide
  Target: ATXN1; (+) strand; PAM type: NRG; PAM sequence: GAG
taattatactgtttatttga

SEQ ID NO: 101786 - DNA, 20 bp, Artificial Sequence
  Description of Artificial Sequence: Synthetic oligonucleotide
  Target: ATXN1; (+) strand; PAM type: NRG; PAM sequence: CGG
actgtttatttgagagacat

SEQ ID NO: 101787 - DNA, 20 bp, Artificial Sequence
  Description of Artificial Sequence: Synthetic oligonucleotide
  Target: ATXN1; (+) strand; PAM type: NRG; PAM sequence: TAG
ttatttgagagacatcggct

SEQ ID NO: 101788 - DNA, 20 bp, Artificial Sequence
  Description of Artificial Sequence: Synthetic oligonucleotide
  Target: ATXN1; (+) strand; PAM type: NRG; PAM sequence: CAG
ttgagagacatcggcttagt

SEQ ID NO: 101789 - DNA, 20 bp, Artificial Sequence
  Description of Artificial Sequence: Synthetic oligonucleotide
  Target: ATXN1; (+) strand; PAM type: NRG; PAM sequence: AAG
catcggcttagtcagccctg

SEQ ID NO: 101790 - DNA, 20 bp, Artificial Sequence
  Description of Artificial Sequence: Synthetic oligonucleotide
  Target: ATXN1; (+) strand; PAM type: NRG; PAM sequence: TGG
agtcagccctgaagactcac

SEQ ID NO: 101791 - DNA, 20 bp, Artificial Sequence
  Description of Artificial Sequence: Synthetic oligonucleotide
  Target: ATXN1; (+) strand; PAM type: NRG; PAM sequence: TGG
gccctgaagactcactggac

SEQ ID NO: 101792 - DNA, 20 bp, Artificial Sequence
  Description of Artificial Sequence: Synthetic oligonucleotide
  Target: ATXN1; (+) strand; PAM type: NRG; PAM sequence: AAG
tcttctgcgaaatgattgct

SEQ ID NO: 101793 - DNA, 20 bp, Artificial Sequence
  Description of Artificial Sequence: Synthetic oligonucleotide
  Target: ATXN1; (+) strand; PAM type: NRG; PAM sequence: TGG
aaatgattgctaagacatat

SEQ ID NO: 101794 - DNA, 20 bp, Artificial Sequence
  Description of Artificial Sequence: Synthetic oligonucleotide
  Target: ATXN1; (+) strand; PAM type: NRG; PAM sequence: CAG
aaaacttatccattgataaa

SEQ ID NO: 101795 - DNA, 20 bp, Artificial Sequence
  Description of Artificial Sequence: Synthetic oligonucleotide
  Target: ATXN1; (+) strand; PAM type: NRG; PAM sequence: CAG
ttgataaacagcatcttttc

SEQ ID NO: 101796 - DNA, 20 bp, Artificial Sequence
  Description of Artificial Sequence: Synthetic oligonucleotide
  Target: ATXN1; (+) strand; PAM type: NRG; PAM sequence: GAG
gataaacagcatcttttcca

SEQ ID NO: 101797 - DNA, 20 bp, Artificial Sequence
  Description of Artificial Sequence: Synthetic oligonucleotide
  Target: ATXN1; (+) strand; PAM type: NRG; PAM sequence: GAG
cttttccagagattgccaat

SEQ ID NO: 101798 - DNA, 20 bp, Artificial Sequence
  Description of Artificial Sequence: Synthetic oligonucleotide
  Target: ATXN1; (+) strand; PAM type: NRG; PAM sequence: AAG
gagattgccaatgagaaatc

SEQ ID NO: 101799 - DNA, 20 bp, Artificial Sequence
  Description of Artificial Sequence: Synthetic oligonucleotide
  Target: ATXN1; (+) strand; PAM type: NRG; PAM sequence: AGG
agattgccaatgagaaatca

SEQ ID NO: 101800 - DNA, 20 bp, Artificial Sequence
  Description of Artificial Sequence: Synthetic oligonucleotide
  Target: ATXN1; (+) strand; PAM type: NRG; PAM sequence: AAG
aaatcaaggacacaatgatt

SEQ ID NO: 101801 - DNA, 20 bp, Artificial Sequence
  Description of Artificial Sequence: Synthetic oligonucleotide
  Target: ATXN1; (+) strand; PAM type: NRG; PAM sequence: CAG
caaggacacaatgattaaga

SEQ ID NO: 101802 - DNA, 20 bp, Artificial Sequence
  Description of Artificial Sequence: Synthetic oligonucleotide
  Target: ATXN1; (+) strand; PAM type: NRG; PAM sequence: CAG
ggacacaatgattaagacag

SEQ ID NO: 101803 - DNA, 20 bp, Artificial Sequence
  Description of Artificial Sequence: Synthetic oligonucleotide
  Target: ATXN1; (+) strand; PAM type: NRG; PAM sequence: CAG
aatgattaagacagcagttg

SEQ ID NO: 101804 - DNA, 20 bp, Artificial Sequence
  Description of Artificial Sequence: Synthetic oligonucleotide
  Target: ATXN1; (+) strand; PAM type: NRG; PAM sequence: GAG
attaagacagcagttgcagc

SEQ ID NO: 101805 - DNA, 20 bp, Artificial Sequence
  Description of Artificial Sequence: Synthetic oligonucleotide
  Target: ATXN1; (+) strand; PAM type: NRG; PAM sequence: TGG
agacagcagttgcagcgagc

SEQ ID NO: 101806 - DNA, 20 bp, Artificial Sequence
  Description of Artificial Sequence: Synthetic oligonucleotide
  Target: ATXN1; (+) strand; PAM type: NRG; PAM sequence: GGG
gacagcagttgcagcgagct

SEQ ID NO: 101807 - DNA, 20 bp, Artificial Sequence
  Description of Artificial Sequence: Synthetic oligonucleotide
  Target: ATXN1; (+) strand; PAM type: NRG; PAM sequence: GGG
acagcagttgcagcgagctg

SEQ ID NO: 101808 - DNA, 20 bp, Artificial Sequence
  Description of Artificial Sequence: Synthetic oligonucleotide
  Target: ATXN1; (+) strand; PAM type: NRG; PAM sequence: AAG
agctggggccaaaccgataa

SEQ ID NO: 101809 - DNA, 20 bp, Artificial Sequence
  Description of Artificial Sequence: Synthetic oligonucleotide
  Target: ATXN1; (+) strand; PAM type: NRG; PAM sequence: TAG
acccatcctcctcctacatt

SEQ ID NO: 101810 - DNA, 20 bp, Artificial Sequence
  Description of Artificial Sequence: Synthetic oligonucleotide
  Target: ATXN1; (+) strand; PAM type: NRG; PAM sequence: AGG
cccatcctcctcctacattt

SEQ ID NO: 101811 - DNA, 20 bp, Artificial Sequence
  Description of Artificial Sequence: Synthetic oligonucleotide
  Target: ATXN1; (+) strand; PAM type: NRG; PAM sequence: GGG
ccatcctcctcctacattta

SEQ ID NO: 101812 - DNA, 20 bp, Artificial Sequence
  Description of Artificial Sequence: Synthetic oligonucleotide
  Target: ATXN1; (+) strand; PAM type: NRG; PAM sequence: CAG
ctacatttagggctatttac

SEQ ID NO: 101813 - DNA, 20 bp, Artificial Sequence
  Description of Artificial Sequence: Synthetic oligonucleotide
  Target: ATXN1; (+) strand; PAM type: NRG; PAM sequence: CAG
tttagggctatttaccagtg

SEQ ID NO: 101814 - DNA, 20 bp, Artificial Sequence
  Description of Artificial Sequence: Synthetic oligonucleotide
  Target: ATXN1; (+) strand; PAM type: NRG; PAM sequence: CGG
ggctatttaccagtgcagca

SEQ ID NO: 101815 - DNA, 20 bp, Artificial Sequence
  Description of Artificial Sequence: Synthetic oligonucleotide
  Target: ATXN1; (+) strand; PAM type: NRG; PAM sequence: GAG
ctatttaccagtgcagcacg

SEQ ID NO: 101816 - DNA, 20 bp, Artificial Sequence
  Description of Artificial Sequence: Synthetic oligonucleotide
  Target: ATXN1; (+) strand; PAM type: NRG; PAM sequence: CAG
tttaccagtgcagcacggag

SEQ ID NO: 101817 - DNA, 20 bp, Artificial Sequence
  Description of Artificial Sequence: Synthetic oligonucleotide
  Target: ATXN1; (+) strand; PAM type: NRG; PAM sequence: CAG
ccagtgcagcacggagcaga

SEQ ID NO: 101818 - DNA, 20 bp, Artificial Sequence
  Description of Artificial Sequence: Synthetic oligonucleotide
  Target: ATXN1; (+) strand; PAM type: NRG; PAM sequence: AGG
cagtgcagcacggagcagac

SEQ ID NO: 101819 - DNA, 20 bp, Artificial Sequence
  Description of Artificial Sequence: Synthetic oligonucleotide
  Target: ATXN1; (+) strand; PAM type: NRG; PAM sequence: GGG
agtgcagcacggagcagaca

SEQ ID NO: 101820 - DNA, 20 bp, Artificial Sequence
  Description of Artificial Sequence: Synthetic oligonucleotide
  Target: ATXN1; (+) strand; PAM type: NRG; PAM sequence: GAG
agacagggctctctaacgct

SEQ ID NO: 101821 - DNA, 20 bp, Artificial Sequence
  Description of Artificial Sequence: Synthetic oligonucleotide
  Target: ATXN1; (+) strand; PAM type: NRG; PAM sequence: AGG
gacagggctctctaacgctg

SEQ ID NO: 101822 - DNA, 20 bp, Artificial Sequence
  Description of Artificial Sequence: Synthetic oligonucleotide
  Target: ATXN1; (+) strand; PAM type: NRG; PAM sequence: TGG
tgaggtatgtgtcccttctc

SEQ ID NO: 101823 - DNA, 20 bp, Artificial Sequence
  Description of Artificial Sequence: Synthetic oligonucleotide
  Target: ATXN1; (+) strand; PAM type: NRG; PAM sequence: GGG
gaggtatgtgtcccttctct

SEQ ID NO: 101824 - DNA, 20 bp, Artificial Sequence
  Description of Artificial Sequence: Synthetic oligonucleotide
  Target: ATXN1; (+) strand; PAM type: NRG; PAM sequence: AAG
gtcccttctctgggccccgt

SEQ ID NO: 101825 - DNA, 20 bp, Artificial Sequence
  Description of Artificial Sequence: Synthetic oligonucleotide
  Target: ATXN1; (+) strand; PAM type: NRG; PAM sequence: CAG
ctctgggccccgtaagcttt

SEQ ID NO: 101826 - DNA, 20 bp, Artificial Sequence
  Description of Artificial Sequence: Synthetic oligonucleotide
  Target: ATXN1; (+) strand; PAM type: NRG; PAM sequence: AAG
cgtaagctttcagtactgat

SEQ ID NO: 101827 - DNA, 20 bp, Artificial Sequence
  Description of Artificial Sequence: Synthetic oligonucleotide
  Target: ATXN1; (+) strand; PAM type: NRG; PAM sequence: AGG
gtaagctttcagtactgata

SEQ ID NO: 101828 - DNA, 20 bp, Artificial Sequence
  Description of Artificial Sequence: Synthetic oligonucleotide
  Target: ATXN1; (+) strand; PAM type: NRG; PAM sequence: GGG
taagctttcagtactgataa

SEQ ID NO: 101829 - DNA, 20 bp, Artificial Sequence
  Description of Artificial Sequence: Synthetic oligonucleotide
  Target: ATXN1; (+) strand; PAM type: NRG; PAM sequence: GGG
aagctttcagtactgataag

SEQ ID NO: 101830 - DNA, 20 bp, Artificial Sequence
  Description of Artificial Sequence: Synthetic oligonucleotide
  Target: ATXN1; (+) strand; PAM type: NRG; PAM sequence: CGG
tactgataaggggaaaccca

SEQ ID NO: 101831 - DNA, 20 bp, Artificial Sequence
  Description of Artificial Sequence: Synthetic oligonucleotide
  Target: ATXN1; (+) strand; PAM type: NRG; PAM sequence: GGG
actgataaggggaaacccac

SEQ ID NO: 101832 - DNA, 20 bp, Artificial Sequence
  Description of Artificial Sequence: Synthetic oligonucleotide
  Target: ATXN1; (+) strand; PAM type: NRG; PAM sequence: TAG
gataaggggaaacccacggg

SEQ ID NO: 101833 - DNA, 20 bp, Artificial Sequence
  Description of Artificial Sequence: Synthetic oligonucleotide
  Target: ATXN1; (+) strand; PAM type: NRG; PAM sequence: GAG
taaggggaaacccacgggta

SEQ ID NO: 101834 - DNA, 20 bp, Artificial Sequence
  Description of Artificial Sequence: Synthetic oligonucleotide
  Target: ATXN1; (+) strand; PAM type: NRG; PAM sequence: TGG
ggaaacccacgggtagagat

SEQ ID NO: 101835 - DNA, 20 bp, Artificial Sequence
  Description of Artificial Sequence: Synthetic oligonucleotide
  Target: ATXN1; (+) strand; PAM type: NRG; PAM sequence: GGG
gaaacccacgggtagagatt

SEQ ID NO: 101836 - DNA, 20 bp, Artificial Sequence
  Description of Artificial Sequence: Synthetic oligonucleotide
  Target: ATXN1; (+) strand; PAM type: NRG; PAM sequence: CAG
ctgtattttcaatgaaccac

SEQ ID NO: 101837 - DNA, 20 bp, Artificial Sequence
  Description of Artificial Sequence: Synthetic oligonucleotide
  Target: ATXN1; (+) strand; PAM type: NRG; PAM sequence: GAG
gtattttcaatgaaccacca

SEQ ID NO: 101838 - DNA, 20 bp, Artificial Sequence
  Description of Artificial Sequence: Synthetic oligonucleotide
  Target: ATXN1; (+) strand; PAM type: NRG; PAM sequence: AGG
tattttcaatgaaccaccag

SEQ ID NO: 101839 - DNA, 20 bp, Artificial Sequence
  Description of Artificial Sequence: Synthetic oligonucleotide
  Target: ATXN1; (+) strand; PAM type: NRG; PAM sequence: GGG
attttcaatgaaccaccaga

SEQ ID NO: 101840 - DNA, 20 bp, Artificial Sequence
  Description of Artificial Sequence: Synthetic oligonucleotide
  Target: ATXN1; (+) strand; PAM type: NRG; PAM sequence: CAG
tgaaccaccagagggcgccc

SEQ ID NO: 101841 - DNA, 20 bp, Artificial Sequence
  Description of Artificial Sequence: Synthetic oligonucleotide
  Target: ATXN1; (+) strand; PAM type: NRG; PAM sequence: AGG
gaaccaccagagggcgcccc

SEQ ID NO: 101842 - DNA, 20 bp, Artificial Sequence
  Description of Artificial Sequence: Synthetic oligonucleotide
  Target: ATXN1; (+) strand; PAM type: NRG; PAM sequence: TGG
caccagagggcgccccagga

SEQ ID NO: 101843 - DNA, 20 bp, Artificial Sequence
  Description of Artificial Sequence: Synthetic oligonucleotide
  Target: ATXN1; (+) strand; PAM type: NRG; PAM sequence: TGG
ccaggatggcaccacattcc

SEQ ID NO: 101844 - DNA, 20 bp, Artificial Sequence
  Description of Artificial Sequence: Synthetic oligonucleotide
  Target: ATXN1; (+) strand; PAM type: NRG; PAM sequence: CGG
gcaccacattcctggtctat

SEQ ID NO: 101845 - DNA, 20 bp, Artificial Sequence
  Description of Artificial Sequence: Synthetic oligonucleotide
  Target: ATXN1; (+) strand; PAM type: NRG; PAM sequence: GGG
caccacattcctggtctatc

SEQ ID NO: 101846 - DNA, 20 bp, Artificial Sequence
  Description of Artificial Sequence: Synthetic oligonucleotide
  Target: ATXN1; (+) strand; PAM type: NRG; PAM sequence: TGG
cctggtctatcgggtgatca

SEQ ID NO: 101847 - DNA, 20 bp, Artificial Sequence
  Description of Artificial Sequence: Synthetic oligonucleotide
  Target: ATXN1; (+) strand; PAM type: NRG; PAM sequence: GGG
ctggtctatcgggtgatcat

SEQ ID NO: 101848 - DNA, 20 bp, Artificial Sequence
  Description of Artificial Sequence: Synthetic oligonucleotide
  Target: ATXN1; (+) strand; PAM type: NRG; PAM sequence: AAG
gatcatgggactaaacaaca

SEQ ID NO: 101849 - DNA, 20 bp, Artificial Sequence
  Description of Artificial Sequence: Synthetic oligonucleotide
  Target: ATXN1; (+) strand; PAM type: NRG; PAM sequence: AAG
catgggactaaacaacaaag

SEQ ID NO: 101850 - DNA, 20 bp, Artificial Sequence
  Description of Artificial Sequence: Synthetic oligonucleotide
  Target: ATXN1; (+) strand; PAM type: NRG; PAM sequence: AAG
caacaaagaagtaacttatg

SEQ ID NO: 101851 - DNA, 20 bp, Artificial Sequence
  Description of Artificial Sequence: Synthetic oligonucleotide
  Target: ATXN1; (+) strand; PAM type: NRG; PAM sequence: AGG
aacaaagaagtaacttatga

SEQ ID NO: 101852 - DNA, 20 bp, Artificial Sequence
  Description of Artificial Sequence: Synthetic oligonucleotide
  Target: ATXN1; (+) strand; PAM type: NRG; PAM sequence: TGG
aaagaagtaacttatgaagg

SEQ ID NO: 101853 - DNA, 20 bp, Artificial Sequence
  Description of Artificial Sequence: Synthetic oligonucleotide
  Target: ATXN1; (+) strand; PAM type: NRG; PAM sequence: AAG
agtaacttatgaaggtggaa

SEQ ID NO: 101854 - DNA, 20 bp, Artificial Sequence
  Description of Artificial Sequence: Synthetic oligonucleotide
  Target: ATXN1; (+) strand; PAM type: NRG; PAM sequence: TAG
aacttatgaaggtggaaaag

SEQ ID NO: 101855 - DNA, 20 bp, Artificial Sequence
  Description of Artificial Sequence: Synthetic oligonucleotide
  Target: ATXN1; (+) strand; PAM type: NRG; PAM sequence: TGG
tgaaggtggaaaagtagatt

SEQ ID NO: 101856 - DNA, 20 bp, Artificial Sequence
  Description of Artificial Sequence: Synthetic oligonucleotide
  Target: ATXN1; (+) strand; PAM type: NRG; PAM sequence: AAG
gaaaagtagatttggaaaat

SEQ ID NO: 101857 - DNA, 20 bp, Artificial Sequence
  Description of Artificial Sequence: Synthetic oligonucleotide
  Target: ATXN1; (+) strand; PAM type: NRG; PAM sequence: AGG
aaaagtagatttggaaaata

SEQ ID NO: 101858 - DNA, 20 bp, Artificial Sequence
  Description of Artificial Sequence: Synthetic oligonucleotide
  Target: ATXN1; (+) strand; PAM type: NRG; PAM sequence: AAG
agtagatttggaaaataagg

SEQ ID NO: 101859 - DNA, 20 bp, Artificial Sequence
  Description of Artificial Sequence: Synthetic oligonucleotide
  Target: ATXN1; (+) strand; PAM type: NRG; PAM sequence: GAG
tagatttggaaaataaggaa

SEQ ID NO: 101860 - DNA, 20 bp, Artificial Sequence
  Description of Artificial Sequence: Synthetic oligonucleotide
  Target: ATXN1; (+) strand; PAM type: NRG; PAM sequence: GAG
gatttggaaaataaggaaga

SEQ ID NO: 101861 - DNA, 20 bp, Artificial Sequence
  Description of Artificial Sequence: Synthetic oligonucleotide
  Target: ATXN1; (+) strand; PAM type: NRG; PAM sequence: AAG
gaaaataaggaagagagaaa

SEQ ID NO: 101862 - DNA, 20 bp, Artificial Sequence
  Description of Artificial Sequence: Synthetic oligonucleotide
  Target: ATXN1; (+) strand; PAM type: NRG; PAM sequence: AAG
gaagagagaaaaagaaacga

SEQ ID NO: 101863 - DNA, 20 bp, Artificial Sequence
  Description of Artificial Sequence: Synthetic oligonucleotide
  Target: ATXN1; (+) strand; PAM type: NRG; PAM sequence: AAG
gagagaaaaagaaacgaaag

SEQ ID NO: 101864 - DNA, 20 bp, Artificial Sequence
  Description of Artificial Sequence: Synthetic oligonucleotide
  Target: ATXN1; (+) strand; PAM type: NRG; PAM sequence: AAG
aaagaaacgaaagaagaaaa

SEQ ID NO: 101865 - DNA, 20 bp, Artificial Sequence
  Description of Artificial Sequence: Synthetic oligonucleotide
  Target: ATXN1; (+) strand; PAM type: NRG; PAM sequence: AAG
cgaaagaagaaaaaagaaaa

SEQ ID NO: 101866 - DNA, 20 bp, Artificial Sequence
  Description of Artificial Sequence: Synthetic oligonucleotide
  Target: ATXN1; (+) strand; PAM type: NRG; PAM sequence: AGG
gaaagaagaaaaaagaaaaa

SEQ ID NO: 101867 - DNA, 20 bp, Artificial Sequence
  Description of Artificial Sequence: Synthetic oligonucleotide
  Target: ATXN1; (+) strand; PAM type: NRG; PAM sequence: GAG
aagaagaaaaaagaaaaaag

SEQ ID NO: 101868 - DNA, 20 bp, Artificial Sequence
  Description of Artificial Sequence: Synthetic oligonucleotide
  Target: ATXN1; (+) strand; PAM type: NRG; PAM sequence: GAG
gaagaaaaaagaaaaaagga

SEQ ID NO: 101869 - DNA, 20 bp, Artificial Sequence
  Description of Artificial Sequence: Synthetic oligonucleotide
  Target: ATXN1; (+) strand; PAM type: NRG; PAM sequence: TGG
gaaaaaagaaaaaaggagag

SEQ ID NO: 101870 - DNA, 20 bp, Artificial Sequence
  Description of Artificial Sequence: Synthetic oligonucleotide
  Target: ATXN1; (+) strand; PAM type: NRG; PAM sequence: GGG
aaaaaagaaaaaaggagagt

SEQ ID NO: 101871 - DNA, 20 bp, Artificial Sequence
  Description of Artificial Sequence: Synthetic oligonucleotide
  Target: ATXN1; (+) strand; PAM type: NRG; PAM sequence: TAG
gagagtgggatttctgctct

SEQ ID NO: 101872 - DNA, 20 bp, Artificial Sequence
  Description of Artificial Sequence: Synthetic oligonucleotide
  Target: ATXN1; (+) strand; PAM type: NRG; PAM sequence: GAG
gagtgggatttctgctctta

SEQ ID NO: 101873 - DNA, 20 bp, Artificial Sequence
  Description of Artificial Sequence: Synthetic oligonucleotide
  Target: ATXN1; (+) strand; PAM type: NRG; PAM sequence: TAG
atttctgctcttagagtctc

SEQ ID NO: 101874 - DNA, 20 bp, Artificial Sequence
  Description of Artificial Sequence: Synthetic oligonucleotide
  Target: ATXN1; (+) strand; PAM type: NRG; PAM sequence: CAG
gctcttagagtctctagttg

SEQ ID NO: 101875 - DNA, 20 bp, Artificial Sequence
  Description of Artificial Sequence: Synthetic oligonucleotide
  Target: ATXN1; (+) strand; PAM type: NRG; PAM sequence: TGG
agtctctagttgcagacaac

SEQ ID NO: 101876 - DNA, 20 bp, Artificial Sequence
  Description of Artificial Sequence: Synthetic oligonucleotide
  Target: ATXN1; (+) strand; PAM type: NRG; PAM sequence: CAG
tgtgtcctgaattgccctcc

SEQ ID NO: 101877 - DNA, 20 bp, Artificial Sequence
  Description of Artificial Sequence: Synthetic oligonucleotide
  Target: ATXN1; (+) strand; PAM type: NRG; PAM sequence: AGG
gtgtcctgaattgccctccc

SEQ ID NO: 101878 - DNA, 20 bp, Artificial Sequence
  Description of Artificial Sequence: Synthetic oligonucleotide
  Target: ATXN1; (+) strand; PAM type: NRG; PAM sequence: GGG
tgtcctgaattgccctccca

SEQ ID NO: 101879 - DNA, 20 bp, Artificial Sequence
  Description of Artificial Sequence: Synthetic oligonucleotide
  Target: ATXN1; (+) strand; PAM type: NRG; PAM sequence: GGG
gtcctgaattgccctcccag

SEQ ID NO: 101880 - DNA, 20 bp, Artificial Sequence
  Description of Artificial Sequence: Synthetic oligonucleotide
  Target: ATXN1; (+) strand; PAM type: NRG; PAM sequence: GAG
tgccctcccaggggaccccc

SEQ ID NO: 101881 - DNA, 20 bp, Artificial Sequence
  Description of Artificial Sequence: Synthetic oligonucleotide
  Target: ATXN1; (+) strand; PAM type: NRG; PAM sequence: AGG
gccctcccaggggacccccg

SEQ ID NO: 101882 - DNA, 20 bp, Artificial Sequence
  Description of Artificial Sequence: Synthetic oligonucleotide
  Target: ATXN1; (+) strand; PAM type: NRG; PAM sequence: GAG
cctcccaggggacccccgag

SEQ ID NO: 101883 - DNA, 20 bp, Artificial Sequence
  Description of Artificial Sequence: Synthetic oligonucleotide
  Target: ATXN1; (+) strand; PAM type: NRG; PAM sequence: TGG
acccccgaggagtttatctc

SEQ ID NO: 101884 - DNA, 20 bp, Artificial Sequence
  Description of Artificial Sequence: Synthetic oligonucleotide
  Target: ATXN1; (+) strand; PAM type: NRG; PAM sequence: AAG
cccgaggagtttatctctgg

SEQ ID NO: 101885 - DNA, 20 bp, Artificial Sequence
  Description of Artificial Sequence: Synthetic oligonucleotide
  Target: ATXN1; (+) strand; PAM type: NRG; PAM sequence: AAG
gaagcacctgccacaacaaa

SEQ ID NO: 101886 - DNA, 20 bp, Artificial Sequence
  Description of Artificial Sequence: Synthetic oligonucleotide
  Target: ATXN1; (+) strand; PAM type: NRG; PAM sequence: TGG
aaaaagatttcttccaaaca

SEQ ID NO: 101887 - DNA, 20 bp, Artificial Sequence
  Description of Artificial Sequence: Synthetic oligonucleotide
  Target: ATXN1; (+) strand; PAM type: NRG; PAM sequence: GGG
aaaagatttcttccaaacat

SEQ ID NO: 101888 - DNA, 20 bp, Artificial Sequence
  Description of Artificial Sequence: Synthetic oligonucleotide
  Target: ATXN1; (+) strand; PAM type: NRG; PAM sequence: GGG
aaagatttcttccaaacatg

SEQ ID NO: 101889 - DNA, 20 bp, Artificial Sequence
  Description of Artificial Sequence: Synthetic oligonucleotide
  Target: ATXN1; (+) strand; PAM type: NRG; PAM sequence: CAG
ttatatcaatgccaaattac

SEQ ID NO: 101890 - DNA, 20 bp, Artificial Sequence
  Description of Artificial Sequence: Synthetic oligonucleotide
  Target: ATXN1; (+) strand; PAM type: NRG; PAM sequence: GAG
atatcaatgccaaattacca

SEQ ID NO: 101891 - DNA, 20 bp, Artificial Sequence
  Description of Artificial Sequence: Synthetic oligonucleotide
  Target: ATXN1; (+) strand; PAM type: NRG; PAM sequence: GAG
atcaatgccaaattaccaga

SEQ ID NO: 101892 - DNA, 20 bp, Artificial Sequence
  Description of Artificial Sequence: Synthetic oligonucleotide
  Target: ATXN1; (+) strand; PAM type: NRG; PAM sequence: CAG
ttaccagagagccacatatg

SEQ ID NO: 101893 - DNA, 20 bp, Artificial Sequence
  Description of Artificial Sequence: Synthetic oligonucleotide
  Target: ATXN1; (+) strand; PAM type: NRG; PAM sequence: TGG
cactgtttaaacattcctat

SEQ ID NO: 101894 - DNA, 20 bp, Artificial Sequence
  Description of Artificial Sequence: Synthetic oligonucleotide
  Target: ATXN1; (+) strand; PAM type: NRG; PAM sequence: AAG
tttaaacattcctattggaa

SEQ ID NO: 101895 - DNA, 20 bp, Artificial Sequence
  Description of Artificial Sequence: Synthetic oligonucleotide
  Target: ATXN1; (+) strand; PAM type: NRG; PAM sequence: AGG
ttaaacattcctattggaaa

SEQ ID NO: 101896 - DNA, 20 bp, Artificial Sequence
  Description of Artificial Sequence: Synthetic oligonucleotide
  Target: ATXN1; (+) strand; PAM type: NRG; PAM sequence: GGG
taaacattcctattggaaaa

SEQ ID NO: 101897 - DNA, 20 bp, Artificial Sequence
  Description of Artificial Sequence: Synthetic oligonucleotide
  Target: ATXN1; (+) strand; PAM type: NRG; PAM sequence: TGG
tcctattggaaaagggaaat

SEQ ID NO: 101898 - DNA, 20 bp, Artificial Sequence
  Description of Artificial Sequence: Synthetic oligonucleotide
  Target: ATXN1; (+) strand; PAM type: NRG; PAM sequence: GAG
ctattggaaaagggaaattg

SEQ ID NO: 101899 - DNA, 20 bp, Artificial Sequence
  Description of Artificial Sequence: Synthetic oligonucleotide
  Target: ATXN1; (+) strand; PAM type: NRG; PAM sequence: AGG
tattggaaaagggaaattgg

SEQ ID NO: 101900 - DNA, 20 bp, Artificial Sequence
  Description of Artificial Sequence: Synthetic oligonucleotide
  Target: ATXN1; (+) strand; PAM type: NRG; PAM sequence: GGG
attggaaaagggaaattgga

SEQ ID NO: 101901 - DNA, 20 bp, Artificial Sequence
  Description of Artificial Sequence: Synthetic oligonucleotide
  Target: ATXN1; (+) strand; PAM type: NRG; PAM sequence: GAG
tggaaaagggaaattggagg

SEQ ID NO: 101902 - DNA, 20 bp, Artificial Sequence
  Description of Artificial Sequence: Synthetic oligonucleotide
  Target: ATXN1; (+) strand; PAM type: NRG; PAM sequence: GAG
gaaaagggaaattggaggga

SEQ ID NO: 101903 - DNA, 20 bp, Artificial Sequence
  Description of Artificial Sequence: Synthetic oligonucleotide
  Target: ATXN1; (+) strand; PAM type: NRG; PAM sequence: TAG
gaaattggagggagagttaa

SEQ ID NO: 101904 - DNA, 20 bp, Artificial Sequence
  Description of Artificial Sequence: Synthetic oligonucleotide
  Target: ATXN1; (+) strand; PAM type: NRG; PAM sequence: AAG
ggagagttaatagatgaatc

SEQ ID NO: 101905 - DNA, 20 bp, Artificial Sequence
  Description of Artificial Sequence: Synthetic oligonucleotide
  Target: ATXN1; (+) strand; PAM type: NRG; PAM sequence: TAG
tgaatcaagacaaatgtatt

SEQ ID NO: 101906 - DNA, 20 bp, Artificial Sequence
  Description of Artificial Sequence: Synthetic oligonucleotide
  Target: ATXN1; (+) strand; PAM type: NRG; PAM sequence: GAG
aatcaagacaaatgtattta

SEQ ID NO: 101907 - DNA, 20 bp, Artificial Sequence
  Description of Artificial Sequence: Synthetic oligonucleotide
  Target: ATXN1; (+) strand; PAM type: NRG; PAM sequence: TGG
tatttagagtttgctaccca

SEQ ID NO: 101908 - DNA, 20 bp, Artificial Sequence
  Description of Artificial Sequence: Synthetic oligonucleotide
  Target: ATXN1; (+) strand; PAM type: NRG; PAM sequence: AAG
gttctgaatacattcatctt

SEQ ID NO: 101909 - DNA, 20 bp, Artificial Sequence
  Description of Artificial Sequence: Synthetic oligonucleotide
  Target: ATXN1; (+) strand; PAM type: NRG; PAM sequence: TAG
acattcatcttaagccgctt

SEQ ID NO: 101910 - DNA, 20 bp, Artificial Sequence
  Description of Artificial Sequence: Synthetic oligonucleotide
  Target: ATXN1; (+) strand; PAM type: NRG; PAM sequence: GAG
attcatcttaagccgcttta

SEQ ID NO: 101911 - DNA, 20 bp, Artificial Sequence
  Description of Artificial Sequence: Synthetic oligonucleotide
  Target: ATXN1; (+) strand; PAM type: NRG; PAM sequence: TAG
tctatcataatttctaaatt

SEQ ID NO: 101912 - DNA, 20 bp, Artificial Sequence
  Description of Artificial Sequence: Synthetic oligonucleotide
  Target: ATXN1; (+) strand; PAM type: NRG; PAM sequence: CAG
cataatttctaaatttagcc

SEQ ID NO: 101913 - DNA, 20 bp, Artificial Sequence
  Description of Artificial Sequence: Synthetic oligonucleotide
  Target: ATXN1; (+) strand; PAM type: NRG; PAM sequence: TGG
aatttctaaatttagcccag

SEQ ID NO: 101914 - DNA, 20 bp, Artificial Sequence
  Description of Artificial Sequence: Synthetic oligonucleotide
  Target: ATXN1; (+) strand; PAM type: NRG; PAM sequence: AAG
taaatttagcccagtggtat

SEQ ID NO: 101915 - DNA, 20 bp, Artificial Sequence
  Description of Artificial Sequence: Synthetic oligonucleotide
  Target: ATXN1; (+) strand; PAM type: NRG; PAM sequence: AGG
aaatttagcccagtggtata

SEQ ID NO: 101916 - DNA, 20 bp, Artificial Sequence
  Description of Artificial Sequence: Synthetic oligonucleotide
  Target: ATXN1; (+) strand; PAM type: NRG; PAM sequence: TAG
ccagtggtataaggctttgc

SEQ ID NO: 101917 - DNA, 20 bp, Artificial Sequence
  Description of Artificial Sequence: Synthetic oligonucleotide
  Target: ATXN1; (+) strand; PAM type: NRG; PAM sequence: AAG
gtataaggctttgctagtcg

SEQ ID NO: 101918 - DNA, 20 bp, Artificial Sequence
  Description of Artificial Sequence: Synthetic oligonucleotide
  Target: ATXN1; (+) strand; PAM type: NRG; PAM sequence: TGG
aggctttgctagtcgaagtg

SEQ ID NO: 101919 - DNA, 20 bp, Artificial Sequence
  Description of Artificial Sequence: Synthetic oligonucleotide
  Target: ATXN1; (+) strand; PAM type: NRG; PAM sequence: CAG
ggtcctccgacccgtgacat

SEQ ID NO: 101920 - DNA, 20 bp, Artificial Sequence
  Description of Artificial Sequence: Synthetic oligonucleotide
  Target: ATXN1; (+) strand; PAM type: NRG; PAM sequence: AAG
gtgacatcagcatcctctgc

SEQ ID NO: 101921 - DNA, 20 bp, Artificial Sequence
  Description of Artificial Sequence: Synthetic oligonucleotide
  Target: ATXN1; (+) strand; PAM type: NRG; PAM sequence: TGG
agcatcctctgcaagtttgc

SEQ ID NO: 101922 - DNA, 20 bp, Artificial Sequence
  Description of Artificial Sequence: Synthetic oligonucleotide
  Target: ATXN1; (+) strand; PAM type: NRG; PAM sequence: CAG
ctgcaagtttgctggaaatg

SEQ ID NO: 101923 - DNA, 20 bp, Artificial Sequence
  Description of Artificial Sequence: Synthetic oligonucleotide
  Target: ATXN1; (+) strand; PAM type: NRG; PAM sequence: CAG
ttgctggaaatgcagactct

SEQ ID NO: 101924 - DNA, 20 bp, Artificial Sequence
  Description of Artificial Sequence: Synthetic oligonucleotide
  Target: ATXN1; (+) strand; PAM type: NRG; PAM sequence: AGG
tgctggaaatgcagactctc

SEQ ID NO: 101925 - DNA, 20 bp, Artificial Sequence
  Description of Artificial Sequence: Synthetic oligonucleotide
  Target: ATXN1; (+) strand; PAM type: NRG; PAM sequence: CAG
gcagactctcaggccccacc

SEQ ID NO: 101926 - DNA, 20 bp, Artificial Sequence
  Description of Artificial Sequence: Synthetic oligonucleotide
  Target: ATXN1; (+) strand; PAM type: NRG; PAM sequence: AAG
acccagtcctgcattttaac

SEQ ID NO: 101927 - DNA, 20 bp, Artificial Sequence
  Description of Artificial Sequence: Synthetic oligonucleotide
  Target: ATXN1; (+) strand; PAM type: NRG; PAM sequence: CAG
ctgcattttaacaagatatc

SEQ ID NO: 101928 - DNA, 20 bp, Artificial Sequence
  Description of Artificial Sequence: Synthetic oligonucleotide
  Target: ATXN1; (+) strand; PAM type: NRG; PAM sequence: CAG
tatccagatgattctatgca

SEQ ID NO: 101929 - DNA, 20 bp, Artificial Sequence
  Description of Artificial Sequence: Synthetic oligonucleotide
  Target: ATXN1; (+) strand; PAM type: NRG; PAM sequence: AAG
cagatgattctatgcacagt

SEQ ID NO: 101930 - DNA, 20 bp, Artificial Sequence
  Description of Artificial Sequence: Synthetic oligonucleotide
  Target: ATXN1; (+) strand; PAM type: NRG; PAM sequence: AGG
agatgattctatgcacagta

SEQ ID NO: 101931 - DNA, 20 bp, Artificial Sequence
  Description of Artificial Sequence: Synthetic oligonucleotide
  Target: ATXN1; (+) strand; PAM type: NRG; PAM sequence: GAG
ttctatgcacagtaaggttt

SEQ ID NO: 101932 - DNA, 20 bp, Artificial Sequence
  Description of Artificial Sequence: Synthetic oligonucleotide
  Target: ATXN1; (+) strand; PAM type: NRG; PAM sequence: TAG
cagtaaggtttgagaaaccc

SEQ ID NO: 101933 - DNA, 20 bp, Artificial Sequence
  Description of Artificial Sequence: Synthetic oligonucleotide
  Target: ATXN1; (+) strand; PAM type: NRG; PAM sequence: CAG
taaggtttgagaaaccctag

SEQ ID NO: 101934 - DNA, 20 bp, Artificial Sequence
  Description of Artificial Sequence: Synthetic oligonucleotide
  Target: ATXN1; (+) strand; PAM type: NRG; PAM sequence: AAG
ttttctactgctaaactctt

SEQ ID NO: 101935 - DNA, 20 bp, Artificial Sequence
  Description of Artificial Sequence: Synthetic oligonucleotide
  Target: ATXN1; (+) strand; PAM type: NRG; PAM sequence: TAG
ttaagcaaattaaacatctc

SEQ ID NO: 101936 - DNA, 20 bp, Artificial Sequence
  Description of Artificial Sequence: Synthetic oligonucleotide
  Target: ATXN1; (+) strand; PAM type: NRG; PAM sequence: TGG
catctctagcctcttcctaa

SEQ ID NO: 101937 - DNA, 20 bp, Artificial Sequence
  Description of Artificial Sequence: Synthetic oligonucleotide
  Target: ATXN1; (+) strand; PAM type: NRG; PAM sequence: GAG
tctctagcctcttcctaatg

SEQ ID NO: 101938 - DNA, 20 bp, Artificial Sequence
  Description of Artificial Sequence: Synthetic oligonucleotide
  Target: ATXN1; (+) strand; PAM type: NRG; PAM sequence: CAG
ctagcctcttcctaatggag

SEQ ID NO: 101939 - DNA, 20 bp, Artificial Sequence
  Description of Artificial Sequence: Synthetic oligonucleotide
  Target: ATXN1; (+) strand; PAM type: NRG; PAM sequence: AGG
tagcctcttcctaatggagc

SEQ ID NO: 101940 - DNA, 20 bp, Artificial Sequence
  Description of Artificial Sequence: Synthetic oligonucleotide
  Target: ATXN1; (+) strand; PAM type: NRG; PAM sequence: TGG
cttcctaatggagcaggcac

SEQ ID NO: 101941 - DNA, 20 bp, Artificial Sequence
  Description of Artificial Sequence: Synthetic oligonucleotide
  Target: ATXN1; (+) strand; PAM type: NRG; PAM sequence: GGG
ttcctaatggagcaggcact

SEQ ID NO: 101942 - DNA, 20 bp, Artificial Sequence
  Description of Artificial Sequence: Synthetic oligonucleotide
  Target: ATXN1; (+) strand; PAM type: NRG; PAM sequence: TAG
caggcactgggaaaccaaac

SEQ ID NO: 101943 - DNA, 20 bp, Artificial Sequence
  Description of Artificial Sequence: Synthetic oligonucleotide
  Target: ATXN1; (+) strand; PAM type: NRG; PAM sequence: AGG
aggcactgggaaaccaaact

SEQ ID NO: 101944 - DNA, 20 bp, Artificial Sequence
  Description of Artificial Sequence: Synthetic oligonucleotide
  Target: ATXN1; (+) strand; PAM type: NRG; PAM sequence: CAG
ctaggtgttgtacgtaaaca

SEQ ID NO: 101945 - DNA, 20 bp, Artificial Sequence
  Description of Artificial Sequence: Synthetic oligonucleotide
  Target: ATXN1; (+) strand; PAM type: NRG; PAM sequence: GAG
aggtgttgtacgtaaacaca

SEQ ID NO: 101946 - DNA, 20 bp, Artificial Sequence
  Description of Artificial Sequence: Synthetic oligonucleotide
  Target: ATXN1; (+) strand; PAM type: NRG; PAM sequence: TGG
gtacgtaaacacagagttga

SEQ ID NO: 101947 - DNA, 20 bp, Artificial Sequence
  Description of Artificial Sequence: Synthetic oligonucleotide
  Target: ATXN1; (+) strand; PAM type: NRG; PAM sequence: GAG
acgtaaacacagagttgatg

SEQ ID NO: 101948 - DNA, 20 bp, Artificial Sequence
  Description of Artificial Sequence: Synthetic oligonucleotide
  Target: ATXN1; (+) strand; PAM type: NRG; PAM sequence: CGG
acacagagttgatggagcct

SEQ ID NO: 101949 - DNA, 20 bp, Artificial Sequence
  Description of Artificial Sequence: Synthetic oligonucleotide
  Target: ATXN1; (+) strand; PAM type: NRG; PAM sequence: GAG
acagagttgatggagcctcg

SEQ ID NO: 101950 - DNA, 20 bp, Artificial Sequence
  Description of Artificial Sequence: Synthetic oligonucleotide
  Target: ATXN1; (+) strand; PAM type: NRG; PAM sequence: TAG
ggagataaacatctaatatt

SEQ ID NO: 101951 - DNA, 20 bp, Artificial Sequence
  Description of Artificial Sequence: Synthetic oligonucleotide
  Target: ATXN1; (+) strand; PAM type: NRG; PAM sequence: AGG
gagataaacatctaatattt

SEQ ID NO: 101952 - DNA, 20 bp, Artificial Sequence
  Description of Artificial Sequence: Synthetic oligonucleotide
  Target: ATXN1; (+) strand; PAM type: NRG; PAM sequence: TGG
tgatgctccactgcttcctc

SEQ ID NO: 101953 - DNA, 20 bp, Artificial Sequence
  Description of Artificial Sequence: Synthetic oligonucleotide
  Target: ATXN1; (+) strand; PAM type: NRG; PAM sequence: GGG
gatgctccactgcttcctct

SEQ ID NO: 101954 - DNA, 20 bp, Artificial Sequence
  Description of Artificial Sequence: Synthetic oligonucleotide
  Target: ATXN1; (+) strand; PAM type: NRG; PAM sequence: GGG
atgctccactgcttcctctg

SEQ ID NO: 101955 - DNA, 20 bp, Artificial Sequence
  Description of Artificial Sequence: Synthetic oligonucleotide
  Target: ATXN1; (+) strand; PAM type: NRG; PAM sequence: CGG
ggggtcatctaaacctaata

SEQ ID NO: 101956 - DNA, 20 bp, Artificial Sequence
  Description of Artificial Sequence: Synthetic oligonucleotide
  Target: ATXN1; (+) strand; PAM type: NRG; PAM sequence: TGG
aacaaatgctgcttttcttc

SEQ ID NO: 101957 - DNA, 20 bp, Artificial Sequence
  Description of Artificial Sequence: Synthetic oligonucleotide
  Target: ATXN1; (+) strand; PAM type: NRG; PAM sequence: CAG
tctggttctttacacaactg

SEQ ID NO: 101958 - DNA, 20 bp, Artificial Sequence
  Description of Artificial Sequence: Synthetic oligonucleotide
  Target: ATXN1; (+) strand; PAM type: NRG; PAM sequence: GAG
tggttctttacacaactgca

SEQ ID NO: 101959 - DNA, 20 bp, Artificial Sequence
  Description of Artificial Sequence: Synthetic oligonucleotide
  Target: ATXN1; (+) strand; PAM type: NRG; PAM sequence: AAG
gcagagaaatatactttaaa

SEQ ID NO: 101960 - DNA, 20 bp, Artificial Sequence
  Description of Artificial Sequence: Synthetic oligonucleotide
  Target: ATXN1; (+) strand; PAM type: NRG; PAM sequence: AGG
cagagaaatatactttaaaa

SEQ ID NO: 101961 - DNA, 20 bp, Artificial Sequence
  Description of Artificial Sequence: Synthetic oligonucleotide
  Target: ATXN1; (+) strand; PAM type: NRG; PAM sequence: CAG
atacacaactcaatcattcc

SEQ ID NO: 101962 - DNA, 20 bp, Artificial Sequence
  Description of Artificial Sequence: Synthetic oligonucleotide
  Target: ATXN1; (+) strand; PAM type: NRG; PAM sequence: AGG
tacacaactcaatcattccc

SEQ ID NO: 101963 - DNA, 20 bp, Artificial Sequence
  Description of Artificial Sequence: Synthetic oligonucleotide
  Target: ATXN1; (+) strand; PAM type: NRG; PAM sequence: AAG
acaactcaatcattcccagg

SEQ ID NO: 101964 - DNA, 20 bp, Artificial Sequence
  Description of Artificial Sequence: Synthetic oligonucleotide
  Target: ATXN1; (+) strand; PAM type: NRG; PAM sequence: AAG
aagaaaaatgaaatttaaca

SEQ ID NO: 101965 - DNA, 20 bp, Artificial Sequence
  Description of Artificial Sequence: Synthetic oligonucleotide
  Target: ATXN1; (+) strand; PAM type: NRG; PAM sequence: AGG
agaaaaatgaaatttaacaa

SEQ ID NO: 101966 - DNA, 20 bp, Artificial Sequence
  Description of Artificial Sequence: Synthetic oligonucleotide
  Target: ATXN1; (+) strand; PAM type: NRG; PAM sequence: AAG
aaaatgaaatttaacaaagg

SEQ ID NO: 101967 - DNA, 20 bp, Artificial Sequence
  Description of Artificial Sequence: Synthetic oligonucleotide
  Target: ATXN1; (+) strand; PAM type: NRG; PAM sequence: GAG
ctttgctataatttcatttc

SEQ ID NO: 101968 - DNA, 20 bp, Artificial Sequence
  Description of Artificial Sequence: Synthetic oligonucleotide
  Target: ATXN1; (+) strand; PAM type: NRG; PAM sequence: TGG
gaaattttttgctattacca

SEQ ID NO: 101969 - DNA, 20 bp, Artificial Sequence
  Description of Artificial Sequence: Synthetic oligonucleotide
  Target: ATXN1; (+) strand; PAM type: NRG; PAM sequence: CAG
ttttgctattaccatggatt

SEQ ID NO: 101970 - DNA, 20 bp, Artificial Sequence
  Description of Artificial Sequence: Synthetic oligonucleotide
  Target: ATXN1; (+) strand; PAM type: NRG; PAM sequence: TGG
taccatggattcagactgct

SEQ ID NO: 101971 - DNA, 20 bp, Artificial Sequence
  Description of Artificial Sequence: Synthetic oligonucleotide
  Target: ATXN1; (+) strand; PAM type: NRG; PAM sequence: GGG
accatggattcagactgctt

SEQ ID NO: 101972 - DNA, 20 bp, Artificial Sequence
  Description of Artificial Sequence: Synthetic oligonucleotide
  Target: ATXN1; (+) strand; PAM type: NRG; PAM sequence: AAG
atggattcagactgcttggg

SEQ ID NO: 101973 - DNA, 20 bp, Artificial Sequence
  Description of Artificial Sequence: Synthetic oligonucleotide
  Target: ATXN1; (+) strand; PAM type: NRG; PAM sequence: TAG
tcagactgcttgggaagtga

SEQ ID NO: 101974 - DNA, 20 bp, Artificial Sequence
  Description of Artificial Sequence: Synthetic oligonucleotide
  Target: ATXN1; (+) strand; PAM type: NRG; PAM sequence: AGG
cagactgcttgggaagtgat

SEQ ID NO: 101975 - DNA, 20 bp, Artificial Sequence
  Description of Artificial Sequence: Synthetic oligonucleotide
  Target: ATXN1; (+) strand; PAM type: NRG; PAM sequence: GAG
ttgggaagtgataggaaaat

SEQ ID NO: 101976 - DNA, 20 bp, Artificial Sequence
  Description of Artificial Sequence: Synthetic oligonucleotide
  Target: ATXN1; (+) strand; PAM type: NRG; PAM sequence: TAG
aaaatgagatgcttctgtgc

SEQ ID NO: 101977 - DNA, 20 bp, Artificial Sequence
  Description of Artificial Sequence: Synthetic oligonucleotide
  Target: ATXN1; (+) strand; PAM type: NRG; PAM sequence: AGG
aaatgagatgcttctgtgct

SEQ ID NO: 101978 - DNA, 20 bp, Artificial Sequence
  Description of Artificial Sequence: Synthetic oligonucleotide
  Target: ATXN1; (+) strand; PAM type: NRG; PAM sequence: GGG
aatgagatgcttctgtgcta

SEQ ID NO: 101979 - DNA, 20 bp, Artificial Sequence
  Description of Artificial Sequence: Synthetic oligonucleotide
  Target: ATXN1; (+) strand; PAM type: NRG; PAM sequence: TGG
atgcttctgtgctagggatg

SEQ ID NO: 101980 - DNA, 20 bp, Artificial Sequence
  Description of Artificial Sequence: Synthetic oligonucleotide
  Target: ATXN1; (+) strand; PAM type: NRG; PAM sequence: GGG
tgcttctgtgctagggatgt

SEQ ID NO: 101981 - DNA, 20 bp, Artificial Sequence
  Description of Artificial Sequence: Synthetic oligonucleotide
  Target: ATXN1; (+) strand; PAM type: NRG; PAM sequence: GGG
gcttctgtgctagggatgtg

SEQ ID NO: 101982 - DNA, 20 bp, Artificial Sequence
  Description of Artificial Sequence: Synthetic oligonucleotide
  Target: ATXN1; (+) strand; PAM type: NRG; PAM sequence: AAG
aatatatgcccactgactgc

SEQ ID NO: 101983 - DNA, 20 bp, Artificial Sequence
  Description of Artificial Sequence: Synthetic oligonucleotide
  Target: ATXN1; (+) strand; PAM type: NRG; PAM sequence: CAG
atgcccactgactgcaagtc

SEQ ID NO: 101984 - DNA, 20 bp, Artificial Sequence
  Description of Artificial Sequence: Synthetic oligonucleotide
  Target: ATXN1; (+) strand; PAM type: NRG; PAM sequence: TAG
ctgactgcaagtccagtaaa

SEQ ID NO: 101985 - DNA, 20 bp, Artificial Sequence
  Description of Artificial Sequence: Synthetic oligonucleotide
  Target: ATXN1; (+) strand; PAM type: NRG; PAM sequence: CAG
actgcaagtccagtaaatag

SEQ ID NO: 101986 - DNA, 20 bp, Artificial Sequence
  Description of Artificial Sequence: Synthetic oligonucleotide
  Target: ATXN1; (+) strand; PAM type: NRG; PAM sequence: CAG
gtaaatagcagccaactgct

SEQ ID NO: 101987 - DNA, 20 bp, Artificial Sequence
  Description of Artificial Sequence: Synthetic oligonucleotide
  Target: ATXN1; (+) strand; PAM type: NRG; PAM sequence: TGG
tagcagccaactgctcagaa

SEQ ID NO: 101988 - DNA, 20 bp, Artificial Sequence
  Description of Artificial Sequence: Synthetic oligonucleotide
  Target: ATXN1; (+) strand; PAM type: NRG; PAM sequence: AAG
cagccaactgctcagaatgg

SEQ ID NO: 101989 - DNA, 20 bp, Artificial Sequence
  Description of Artificial Sequence: Synthetic oligonucleotide
  Target: ATXN1; (+) strand; PAM type: NRG; PAM sequence: TAG
ctcagaatggaagatgctct

SEQ ID NO: 101990 - DNA, 20 bp, Artificial Sequence
  Description of Artificial Sequence: Synthetic oligonucleotide
  Target: ATXN1; (+) strand; PAM type: NRG; PAM sequence: TAG
ctaaaaatacatcttaaacc

SEQ ID NO: 101991 - DNA, 20 bp, Artificial Sequence
  Description of Artificial Sequence: Synthetic oligonucleotide
  Target: ATXN1; (+) strand; PAM type: NRG; PAM sequence: AGG
taaaaatacatcttaaacct

SEQ ID NO: 101992 - DNA, 20 bp, Artificial Sequence
  Description of Artificial Sequence: Synthetic oligonucleotide
  Target: ATXN1; (+) strand; PAM type: NRG; PAM sequence: GGG
aaaaatacatcttaaaccta

SEQ ID NO: 101993 - DNA, 20 bp, Artificial Sequence
  Description of Artificial Sequence: Synthetic oligonucleotide
  Target: ATXN1; (+) strand; PAM type: NRG; PAM sequence: AAG
atacatcttaaacctagggc

SEQ ID NO: 101994 - DNA, 20 bp, Artificial Sequence
  Description of Artificial Sequence: Synthetic oligonucleotide
  Target: ATXN1; (+) strand; PAM type: NRG; PAM sequence: TGG
ttaaacctagggcaagaaaa

SEQ ID NO: 101995 - DNA, 20 bp, Artificial Sequence
  Description of Artificial Sequence: Synthetic oligonucleotide
  Target: ATXN1; (+) strand; PAM type: NRG; PAM sequence: GGG
taaacctagggcaagaaaat

SEQ ID NO: 101996 - DNA, 20 bp, Artificial Sequence
  Description of Artificial Sequence: Synthetic oligonucleotide
  Target: ATXN1; (+) strand; PAM type: NRG; PAM sequence: CAG
acccccaatcctgtgcttct

SEQ ID NO: 101997 - DNA, 20 bp, Artificial Sequence
  Description of Artificial Sequence: Synthetic oligonucleotide
  Target: ATXN1; (+) strand; PAM type: NRG; PAM sequence: TGG
tctcagtttgaatgaaccca

SEQ ID NO: 101998 - DNA, 20 bp, Artificial Sequence
  Description of Artificial Sequence: Synthetic oligonucleotide
  Target: ATXN1; (+) strand; PAM type: NRG; PAM sequence: TGG
tgaatgaacccatggctgcc

SEQ ID NO: 101999 - DNA, 20 bp, Artificial Sequence
  Description of Artificial Sequence: Synthetic oligonucleotide
  Target: ATXN1; (+) strand; PAM type: NRG; PAM sequence: TGG
ctgcctggcctgtatatcta

SEQ ID NO: 102000 - DNA, 20 bp, Artificial Sequence
  Description of Artificial Sequence: Synthetic oligonucleotide
  Target: ATXN1; (+) strand; PAM type: NRG; PAM sequence: CAG
cctgtatatctatggacaaa

SEQ ID NO: 102001 - DNA, 20 bp, Artificial Sequence
  Description of Artificial Sequence: Synthetic oligonucleotide
  Target: ATXN1; (+) strand; PAM type: NRG; PAM sequence: AGG
ctgtatatctatggacaaac

SEQ ID NO: 102002 - DNA, 20 bp, Artificial Sequence
  Description of Artificial Sequence: Synthetic oligonucleotide
  Target: ATXN1; (+) strand; PAM type: NRG; PAM sequence: GGG
tgtatatctatggacaaaca

SEQ ID NO: 102003 - DNA, 20 bp, Artificial Sequence
  Description of Artificial Sequence: Synthetic oligonucleotide
  Target: ATXN1; (+) strand; PAM type: NRG; PAM sequence: CGG
atctatggacaaacagggca

SEQ ID NO: 102004 - DNA, 20 bp, Artificial Sequence
  Description of Artificial Sequence: Synthetic oligonucleotide
  Target: ATXN1; (+) strand; PAM type: NRG; PAM sequence: CAG
ggacaaacagggcacggttt

SEQ ID NO: 102005 - DNA, 20 bp, Artificial Sequence
  Description of Artificial Sequence: Synthetic oligonucleotide
  Target: ATXN1; (+) strand; PAM type: NRG; PAM sequence: AAG
agggcacggtttcagcttta

SEQ ID NO: 102006 - DNA, 20 bp, Artificial Sequence
  Description of Artificial Sequence: Synthetic oligonucleotide
  Target: ATXN1; (+) strand; PAM type: NRG; PAM sequence: AAG
gcacggtttcagctttaaag

SEQ ID NO: 102007 - DNA, 20 bp, Artificial Sequence
  Description of Artificial Sequence: Synthetic oligonucleotide
  Target: ATXN1; (+) strand; PAM type: NRG; PAM sequence: GAG
acggtttcagctttaaagaa

SEQ ID NO: 102008 - DNA, 20 bp, Artificial Sequence
  Description of Artificial Sequence: Synthetic oligonucleotide
  Target: ATXN1; (+) strand; PAM type: NRG; PAM sequence: AGG
cggtttcagctttaaagaag

SEQ ID NO: 102009 - DNA, 20 bp, Artificial Sequence
  Description of Artificial Sequence: Synthetic oligonucleotide
  Target: ATXN1; (+) strand; PAM type: NRG; PAM sequence: AAG
tttcagctttaaagaagagg

SEQ ID NO: 102010 - DNA, 20 bp, Artificial Sequence
  Description of Artificial Sequence: Synthetic oligonucleotide
  Target: ATXN1; (+) strand; PAM type: NRG; PAM sequence: GAG
tcagctttaaagaagaggaa

SEQ ID NO: 102011 - DNA, 20 bp, Artificial Sequence
  Description of Artificial Sequence: Synthetic oligonucleotide
  Target: ATXN1; (+) strand; PAM type: NRG; PAM sequence: CAG
gctttaaagaagaggaagag

SEQ ID NO: 102012 - DNA, 20 bp, Artificial Sequence
  Description of Artificial Sequence: Synthetic oligonucleotide
  Target: ATXN1; (+) strand; PAM type: NRG; PAM sequence: AGG
ctttaaagaagaggaagagc

SEQ ID NO: 102013 - DNA, 20 bp, Artificial Sequence
  Description of Artificial Sequence: Synthetic oligonucleotide
  Target: ATXN1; (+) strand; PAM type: NRG; PAM sequence: GAG
aagaggaagagcaggctgat

SEQ ID NO: 102014 - DNA, 20 bp, Artificial Sequence
  Description of Artificial Sequence: Synthetic oligonucleotide
  Target: ATXN1; (+) strand; PAM type: NRG; PAM sequence: CAG
gcaggctgatgagcttgtgc

SEQ ID NO: 102015 - DNA, 20 bp, Artificial Sequence
  Description of Artificial Sequence: Synthetic oligonucleotide
  Target: ATXN1; (+) strand; PAM type: NRG; PAM sequence: AGG
caggctgatgagcttgtgcc

SEQ ID NO: 102016 - DNA, 20 bp, Artificial Sequence
  Description of Artificial Sequence: Synthetic oligonucleotide
  Target: ATXN1; (+) strand; PAM type: NRG; PAM sequence: TGG
tgatgagcttgtgccaggac

SEQ ID NO: 102017 - DNA, 20 bp, Artificial Sequence
  Description of Artificial Sequence: Synthetic oligonucleotide
  Target: ATXN1; (+) strand; PAM type: NRG; PAM sequence: AAG
aactacgtatgcaaacactg

SEQ ID NO: 102018 - DNA, 20 bp, Artificial Sequence
  Description of Artificial Sequence: Synthetic oligonucleotide
  Target: ATXN1; (+) strand; PAM type: NRG; PAM sequence: GAG
ctacgtatgcaaacactgaa

SEQ ID NO: 102019 - DNA, 20 bp, Artificial Sequence
  Description of Artificial Sequence: Synthetic oligonucleotide
  Target: ATXN1; (+) strand; PAM type: NRG; PAM sequence: AGG
tacgtatgcaaacactgaag

SEQ ID NO: 102020 - DNA, 20 bp, Artificial Sequence
  Description of Artificial Sequence: Synthetic oligonucleotide
  Target: ATXN1; (+) strand; PAM type: NRG; PAM sequence: GGG
acgtatgcaaacactgaaga

SEQ ID NO: 102021 - DNA, 20 bp, Artificial Sequence
  Description of Artificial Sequence: Synthetic oligonucleotide
  Target: ATXN1; (+) strand; PAM type: NRG; PAM sequence: CAG
tatgcaaacactgaagaggg

SEQ ID NO: 102022 - DNA, 20 bp, Artificial Sequence
  Description of Artificial Sequence: Synthetic oligonucleotide
  Target: ATXN1; (+) strand; PAM type: NRG; PAM sequence: TGG
actgaagagggcagaatacc

SEQ ID NO: 102023 - DNA, 20 bp, Artificial Sequence
  Description of Artificial Sequence: Synthetic oligonucleotide
  Target: ATXN1; (+) strand; PAM type: NRG; PAM sequence: GGG
ctgaagagggcagaatacct

SEQ ID NO: 102024 - DNA, 20 bp, Artificial Sequence
  Description of Artificial Sequence: Synthetic oligonucleotide
  Target: ATXN1; (+) strand; PAM type: NRG; PAM sequence: GAG
agggcagaatacctgggtgt

SEQ ID NO: 102025 - DNA, 20 bp, Artificial Sequence
  Description of Artificial Sequence: Synthetic oligonucleotide
  Target: ATXN1; (+) strand; PAM type: NRG; PAM sequence: AGG
gggcagaatacctgggtgtg

SEQ ID NO: 102026 - DNA, 20 bp, Artificial Sequence
  Description of Artificial Sequence: Synthetic oligonucleotide
  Target: ATXN1; (+) strand; PAM type: NRG; PAM sequence: CAG
agaatacctgggtgtgagga

SEQ ID NO: 102027 - DNA, 20 bp, Artificial Sequence
  Description of Artificial Sequence: Synthetic oligonucleotide
  Target: ATXN1; (+) strand; PAM type: NRG; PAM sequence: GAG
aatacctgggtgtgaggaca

SEQ ID NO: 102028 - DNA, 20 bp, Artificial Sequence
  Description of Artificial Sequence: Synthetic oligonucleotide
  Target: ATXN1; (+) strand; PAM type: NRG; PAM sequence: AGG
atacctgggtgtgaggacag

SEQ ID NO: 102029 - DNA, 20 bp, Artificial Sequence
  Description of Artificial Sequence: Synthetic oligonucleotide
  Target: ATXN1; (+) strand; PAM type: NRG; PAM sequence: TGG
gtgtgaggacagaggttact

SEQ ID NO: 102030 - DNA, 20 bp, Artificial Sequence
  Description of Artificial Sequence: Synthetic oligonucleotide
  Target: ATXN1; (+) strand; PAM type: NRG; PAM sequence: GGG
tgtgaggacagaggttactt

SEQ ID NO: 102031 - DNA, 20 bp, Artificial Sequence
  Description of Artificial Sequence: Synthetic oligonucleotide
  Target: ATXN1; (+) strand; PAM type: NRG; PAM sequence: AAG
agaggttacttgggcatgtc

SEQ ID NO: 102032 - DNA, 20 bp, Artificial Sequence
  Description of Artificial Sequence: Synthetic oligonucleotide
  Target: ATXN1; (+) strand; PAM type: NRG; PAM sequence: AGG
gaggttacttgggcatgtca

SEQ ID NO: 102033 - DNA, 20 bp, Artificial Sequence
  Description of Artificial Sequence: Synthetic oligonucleotide
  Target: ATXN1; (+) strand; PAM type: NRG; PAM sequence: AAG
gggcatgtcaaggattctca

SEQ ID NO: 102034 - DNA, 20 bp, Artificial Sequence
  Description of Artificial Sequence: Synthetic oligonucleotide
  Target: ATXN1; (+) strand; PAM type: NRG; PAM sequence: CAG
ctgactcaccaatctccttc

SEQ ID NO: 102035 - DNA, 20 bp, Artificial Sequence
  Description of Artificial Sequence: Synthetic oligonucleotide
  Target: ATXN1; (+) strand; PAM type: NRG; PAM sequence: TGG
gctttattacatcactaaac

SEQ ID NO: 102036 - DNA, 20 bp, Artificial Sequence
  Description of Artificial Sequence: Synthetic oligonucleotide
  Target: ATXN1; (+) strand; PAM type: NRG; PAM sequence: AAG
ttattacatcactaaactgg

SEQ ID NO: 102037 - DNA, 20 bp, Artificial Sequence
  Description of Artificial Sequence: Synthetic oligonucleotide
  Target: ATXN1; (+) strand; PAM type: NRG; PAM sequence: AGG
tattacatcactaaactgga

SEQ ID NO: 102038 - DNA, 20 bp, Artificial Sequence
  Description of Artificial Sequence: Synthetic oligonucleotide
  Target: ATXN1; (+) strand; PAM type: NRG; PAM sequence: TGG
actaaactggaaggcctgtg

SEQ ID NO: 102039 - DNA, 20 bp, Artificial Sequence
  Description of Artificial Sequence: Synthetic oligonucleotide
  Target: ATXN1; (+) strand; PAM type: NRG; PAM sequence: TGG
ggaaggcctgtgtggtgcac

SEQ ID NO: 102040 - DNA, 20 bp, Artificial Sequence
  Description of Artificial Sequence: Synthetic oligonucleotide
  Target: ATXN1; (+) strand; PAM type: NRG; PAM sequence: CAG
aggcctgtgtggtgcactgg

SEQ ID NO: 102041 - DNA, 20 bp, Artificial Sequence
  Description of Artificial Sequence: Synthetic oligonucleotide
  Target: ATXN1; (+) strand; PAM type: NRG; PAM sequence: AAG
ctgtgtggtgcactggcaga

SEQ ID NO: 102042 - DNA, 20 bp, Artificial Sequence
  Description of Artificial Sequence: Synthetic oligonucleotide
  Target: ATXN1; (+) strand; PAM type: NRG; PAM sequence: TGG
tggcagaaagcacttcattt

SEQ ID NO: 102043 - DNA, 20 bp, Artificial Sequence
  Description of Artificial Sequence: Synthetic oligonucleotide
  Target: ATXN1; (+) strand; PAM type: NRG; PAM sequence: AAG
gaaagcacttcattttggcc

SEQ ID NO: 102044 - DNA, 20 bp, Artificial Sequence
  Description of Artificial Sequence: Synthetic oligonucleotide
  Target: ATXN1; (+) strand; PAM type: NRG; PAM sequence: CAG
ttttggccaagcattaaaaa

SEQ ID NO: 102045 - DNA, 20 bp, Artificial Sequence
  Description of Artificial Sequence: Synthetic oligonucleotide
  Target: ATXN1; (+) strand; PAM type: NRG; PAM sequence: AGG
tttggccaagcattaaaaac

SEQ ID NO: 102046 - DNA, 20 bp, Artificial Sequence
  Description of Artificial Sequence: Synthetic oligonucleotide
  Target: ATXN1; (+) strand; PAM type: NRG; PAM sequence: TGG
aggtccaaacccgacatgct

SEQ ID NO: 102047 - DNA, 20 bp, Artificial Sequence
  Description of Artificial Sequence: Synthetic oligonucleotide
  Target: ATXN1; (+) strand; PAM type: NRG; PAM sequence: GAG
gtccaaacccgacatgcttg

SEQ ID NO: 102048 - DNA, 20 bp, Artificial Sequence
  Description of Artificial Sequence: Synthetic oligonucleotide
  Target: ATXN1; (+) strand; PAM type: NRG; PAM sequence: TAG
cccgacatgcttggagtatc

SEQ ID NO: 102049 - DNA, 20 bp, Artificial Sequence
  Description of Artificial Sequence: Synthetic oligonucleotide
  Target: ATXN1; (+) strand; PAM type: NRG; PAM sequence: TGG
catgcttggagtatctagaa

SEQ ID NO: 102050 - DNA, 20 bp, Artificial Sequence
  Description of Artificial Sequence: Synthetic oligonucleotide
  Target: ATXN1; (+) strand; PAM type: NRG; PAM sequence: GAG
tgcttggagtatctagaatg

SEQ ID NO: 102051 - DNA, 20 bp, Artificial Sequence
  Description of Artificial Sequence: Synthetic oligonucleotide
  Target: ATXN1; (+) strand; PAM type: NRG; PAM sequence: AAG
tggagtatctagaatggaga

SEQ ID NO: 102052 - DNA, 20 bp, Artificial Sequence
  Description of Artificial Sequence: Synthetic oligonucleotide
  Target: ATXN1; (+) strand; PAM type: NRG; PAM sequence: AGG
ggagtatctagaatggagaa

SEQ ID NO: 102053 - DNA, 20 bp, Artificial Sequence
  Description of Artificial Sequence: Synthetic oligonucleotide
  Target: ATXN1; (+) strand; PAM type: NRG; PAM sequence: TGG
gtatctagaatggagaaagg

SEQ ID NO: 102054 - DNA, 20 bp, Artificial Sequence
  Description of Artificial Sequence: Synthetic oligonucleotide
  Target: ATXN1; (+) strand; PAM type: NRG; PAM sequence: TGG
tagaatggagaaaggtggat

SEQ ID NO: 102055 - DNA, 20 bp, Artificial Sequence
  Description of Artificial Sequence: Synthetic oligonucleotide
  Target: ATXN1; (+) strand; PAM type: NRG; PAM sequence: TAG
gagaaaggtggattggatga

SEQ ID NO: 102056 - DNA, 20 bp, Artificial Sequence
  Description of Artificial Sequence: Synthetic oligonucleotide
  Target: ATXN1; (+) strand; PAM type: NRG; PAM sequence: TAG
gattggatgatagctataat

SEQ ID NO: 102057 - DNA, 20 bp, Artificial Sequence
  Description of Artificial Sequence: Synthetic oligonucleotide
  Target: ATXN1; (+) strand; PAM type: NRG; PAM sequence: TGG
gctataattagatgccttta

SEQ ID NO: 102058 - DNA, 20 bp, Artificial Sequence
  Description of Artificial Sequence: Synthetic oligonucleotide
  Target: ATXN1; (+) strand; PAM type: NRG; PAM sequence: CAG
tgcctttatggttgactgaa

SEQ ID NO: 102059 - DNA, 20 bp, Artificial Sequence
  Description of Artificial Sequence: Synthetic oligonucleotide
  Target: ATXN1; (+) strand; PAM type: NRG; PAM sequence: AGG
gcctttatggttgactgaac

SEQ ID NO: 102060 - DNA, 20 bp, Artificial Sequence
  Description of Artificial Sequence: Synthetic oligonucleotide
  Target: ATXN1; (+) strand; PAM type: NRG; PAM sequence: AAG
actgaacaggcatgccccca

SEQ ID NO: 102061 - DNA, 20 bp, Artificial Sequence
  Description of Artificial Sequence: Synthetic oligonucleotide
  Target: ATXN1; (+) strand; PAM type: NRG; PAM sequence: TGG
gaacaggcatgcccccaaag

SEQ ID NO: 102062 - DNA, 20 bp, Artificial Sequence
  Description of Artificial Sequence: Synthetic oligonucleotide
  Target: ATXN1; (+) strand; PAM type: NRG; PAM sequence: TAG
tcaaacactcattccgtttc

SEQ ID NO: 102063 - DNA, 20 bp, Artificial Sequence
  Description of Artificial Sequence: Synthetic oligonucleotide
  Target: ATXN1; (+) strand; PAM type: NRG; PAM sequence: CGG
tccgtttctagtatgtatga

SEQ ID NO: 102064 - DNA, 20 bp, Artificial Sequence
  Description of Artificial Sequence: Synthetic oligonucleotide
  Target: ATXN1; (+) strand; PAM type: NRG; PAM sequence: GGG
ccgtttctagtatgtatgac

SEQ ID NO: 102065 - DNA, 20 bp, Artificial Sequence
  Description of Artificial Sequence: Synthetic oligonucleotide
  Target: ATXN1; (+) strand; PAM type: NRG; PAM sequence: GGG
cgtttctagtatgtatgacg

SEQ ID NO: 102066 - DNA, 20 bp, Artificial Sequence
  Description of Artificial Sequence: Synthetic oligonucleotide
  Target: ATXN1; (+) strand; PAM type: NRG; PAM sequence: CAG
ggacctcaattgttcaatgt

SEQ ID NO: 102067 - DNA, 20 bp, Artificial Sequence
  Description of Artificial Sequence: Synthetic oligonucleotide
  Target: ATXN1; (+) strand; PAM type: NRG; PAM sequence: AAG
aattgttcaatgtcagtgtg

SEQ ID NO: 102068 - DNA, 20 bp, Artificial Sequence
  Description of Artificial Sequence: Synthetic oligonucleotide
  Target: ATXN1; (+) strand; PAM type: NRG; PAM sequence: TGG
caatgtcagtgtgaagcaaa

SEQ ID NO: 102069 - DNA, 20 bp, Artificial Sequence
  Description of Artificial Sequence: Synthetic oligonucleotide
  Target: ATXN1; (+) strand; PAM type: NRG; PAM sequence: CAG
gtgtgaagcaaatggtatgc

SEQ ID NO: 102070 - DNA, 20 bp, Artificial Sequence
  Description of Artificial Sequence: Synthetic oligonucleotide
  Target: ATXN1; (+) strand; PAM type: NRG; PAM sequence: TAG
gtatgccagaactctatttt

SEQ ID NO: 102071 - DNA, 20 bp, Artificial Sequence
  Description of Artificial Sequence: Synthetic oligonucleotide
  Target: ATXN1; (+) strand; PAM type: NRG; PAM sequence: CAG
tgttctattcaatactaata

SEQ ID NO: 102072 - DNA, 20 bp, Artificial Sequence
  Description of Artificial Sequence: Synthetic oligonucleotide
  Target: ATXN1; (+) strand; PAM type: NRG; PAM sequence: TGG
tcaatactaatacagtgttt

SEQ ID NO: 102073 - DNA, 20 bp, Artificial Sequence
  Description of Artificial Sequence: Synthetic oligonucleotide
  Target: ATXN1; (+) strand; PAM type: NRG; PAM sequence: AAG
gttttggttatcatatttcg

SEQ ID NO: 102074 - DNA, 20 bp, Artificial Sequence
  Description of Artificial Sequence: Synthetic oligonucleotide
  Target: ATXN1; (+) strand; PAM type: NRG; PAM sequence: CAG
gttatcatatttcgaagtaa

SEQ ID NO: 102075 - DNA, 20 bp, Artificial Sequence
  Description of Artificial Sequence: Synthetic oligonucleotide
  Target: ATXN1; (+) strand; PAM type: NRG; PAM sequence: AAG
atcatatttcgaagtaacag

SEQ ID NO: 102076 - DNA, 20 bp, Artificial Sequence
  Description of Artificial Sequence: Synthetic oligonucleotide
  Target: ATXN1; (+) strand; PAM type: NRG; PAM sequence: AGG
tcatatttcgaagtaacaga

SEQ ID NO: 102077 - DNA, 20 bp, Artificial Sequence
  Description of Artificial Sequence: Synthetic oligonucleotide
  Target: ATXN1; (+) strand; PAM type: NRG; PAM sequence: TAG
atttcgaagtaacagaaggc

SEQ ID NO: 102078 - DNA, 20 bp, Artificial Sequence
  Description of Artificial Sequence: Synthetic oligonucleotide
  Target: ATXN1; (+) strand; PAM type: NRG; PAM sequence: AAG
tcgaagtaacagaaggctag

SEQ ID NO: 102079 - DNA, 20 bp, Artificial Sequence
  Description of Artificial Sequence: Synthetic oligonucleotide
  Target: ATXN1; (+) strand; PAM type: NRG; PAM sequence: AGG
cgaagtaacagaaggctaga

SEQ ID NO: 102080 - DNA, 20 bp, Artificial Sequence
  Description of Artificial Sequence: Synthetic oligonucleotide
  Target: ATXN1; (+) strand; PAM type: NRG; PAM sequence: GGG
gaagtaacagaaggctagaa

SEQ ID NO: 102081 - DNA, 20 bp, Artificial Sequence
  Description of Artificial Sequence: Synthetic oligonucleotide
  Target: ATXN1; (+) strand; PAM type: NRG; PAM sequence: AAG
aagggatatatgttgcgaat

SEQ ID NO: 102082 - DNA, 20 bp, Artificial Sequence
  Description of Artificial Sequence: Synthetic oligonucleotide
  Target: ATXN1; (+) strand; PAM type: NRG; PAM sequence: AAG
ataagattcaaatatatctt

SEQ ID NO: 102083 - DNA, 20 bp, Artificial Sequence
  Description of Artificial Sequence: Synthetic oligonucleotide
  Target: ATXN1; (+) strand; PAM type: NRG; PAM sequence: AAG
agattcaaatatatcttaag

SEQ ID NO: 102084 - DNA, 20 bp, Artificial Sequence
  Description of Artificial Sequence: Synthetic oligonucleotide
  Target: ATXN1; (+) strand; PAM type: NRG; PAM sequence: CGG
tcaaatatatcttaagaagc

SEQ ID NO: 102085 - DNA, 20 bp, Artificial Sequence
  Description of Artificial Sequence: Synthetic oligonucleotide
  Target: ATXN1; (+) strand; PAM type: NRG; PAM sequence: AAG
aatatatcttaagaagccgg

SEQ ID NO: 102086 - DNA, 20 bp, Artificial Sequence
  Description of Artificial Sequence: Synthetic oligonucleotide
  Target: ATXN1; (+) strand; PAM type: NRG; PAM sequence: TGG
tcttaagaagccggaagtga

SEQ ID NO: 102087 - DNA, 20 bp, Artificial Sequence
  Description of Artificial Sequence: Synthetic oligonucleotide
  Target: ATXN1; (+) strand; PAM type: NRG; PAM sequence: CAG
cggaagtgatggtaccaaac

SEQ ID NO: 102088 - DNA, 20 bp, Artificial Sequence
  Description of Artificial Sequence: Synthetic oligonucleotide
  Target: ATXN1; (+) strand; PAM type: NRG; PAM sequence: AGG
ggaagtgatggtaccaaacc

SEQ ID NO: 102089 - DNA, 20 bp, Artificial Sequence
  Description of Artificial Sequence: Synthetic oligonucleotide
  Target: ATXN1; (+) strand; PAM type: NRG; PAM sequence: AAG
ggtaccaaaccaggaaaatt

SEQ ID NO: 102090 - DNA, 20 bp, Artificial Sequence
  Description of Artificial Sequence: Synthetic oligonucleotide
  Target: ATXN1; (+) strand; PAM type: NRG; PAM sequence: GAG
ccaggaaaattaagatcaat

SEQ ID NO: 102091 - DNA, 20 bp, Artificial Sequence
  Description of Artificial Sequence: Synthetic oligonucleotide
  Target: ATXN1; (+) strand; PAM type: NRG; PAM sequence: TGG
taaatgtaaatgcctgccct

SEQ ID NO: 102092 - DNA, 20 bp, Artificial Sequence
  Description of Artificial Sequence: Synthetic oligonucleotide
  Target: ATXN1; (+) strand; PAM type: NRG; PAM sequence: CAG
atgcctgcccttggtttcaa

SEQ ID NO: 102093 - DNA, 20 bp, Artificial Sequence
  Description of Artificial Sequence: Synthetic oligonucleotide
  Target: ATXN1; (+) strand; PAM type: NRG; PAM sequence: TAG
cttggtttcaacagctcaat

SEQ ID NO: 102094 - DNA, 20 bp, Artificial Sequence
  Description of Artificial Sequence: Synthetic oligonucleotide
  Target: ATXN1; (+) strand; PAM type: NRG; PAM sequence: TAG
caacagctcaattagcctac

SEQ ID NO: 102095 - DNA, 20 bp, Artificial Sequence
  Description of Artificial Sequence: Synthetic oligonucleotide
  Target: ATXN1; (+) strand; PAM type: NRG; PAM sequence: CAG
cagctcaattagcctactag

SEQ ID NO: 102096 - DNA, 20 bp, Artificial Sequence
  Description of Artificial Sequence: Synthetic oligonucleotide
  Target: ATXN1; (+) strand; PAM type: NRG; PAM sequence: AGG
agctcaattagcctactagc

SEQ ID NO: 102097 - DNA, 20 bp, Artificial Sequence
  Description of Artificial Sequence: Synthetic oligonucleotide
  Target: ATXN1; (+) strand; PAM type: NRG; PAM sequence: GGG
gctcaattagcctactagca

SEQ ID NO: 102098 - DNA, 20 bp, Artificial Sequence
  Description of Artificial Sequence: Synthetic oligonucleotide
  Target: ATXN1; (+) strand; PAM type: NRG; PAM sequence: AAG
ttagcctactagcagggttg

SEQ ID NO: 102099 - DNA, 20 bp, Artificial Sequence
  Description of Artificial Sequence: Synthetic oligonucleotide
  Target: ATXN1; (+) strand; PAM type: NRG; PAM sequence: GAG
agcctactagcagggttgaa

SEQ ID NO: 102100 - DNA, 20 bp, Artificial Sequence
  Description of Artificial Sequence: Synthetic oligonucleotide
  Target: ATXN1; (+) strand; PAM type: NRG; PAM sequence: TGG
ctagcagggttgaagagatc

SEQ ID NO: 102101 - DNA, 20 bp, Artificial Sequence
  Description of Artificial Sequence: Synthetic oligonucleotide
  Target: ATXN1; (+) strand; PAM type: NRG; PAM sequence: TGG
gaagagatctggtttaataa

SEQ ID NO: 102102 - DNA, 20 bp, Artificial Sequence
  Description of Artificial Sequence: Synthetic oligonucleotide
  Target: ATXN1; (+) strand; PAM type: NRG; PAM sequence: AAG
tttaataatggtttcaatga

SEQ ID NO: 102103 - DNA, 20 bp, Artificial Sequence
  Description of Artificial Sequence: Synthetic oligonucleotide
  Target: ATXN1; (+) strand; PAM type: NRG; PAM sequence: GAG
taataatggtttcaatgaaa

SEQ ID NO: 102104 - DNA, 20 bp, Artificial Sequence
  Description of Artificial Sequence: Synthetic oligonucleotide
  Target: ATXN1; (+) strand; PAM type: NRG; PAM sequence: CAG
atggtttcaatgaaagagcc

SEQ ID NO: 102105 - DNA, 20 bp, Artificial Sequence
  Description of Artificial Sequence: Synthetic oligonucleotide
  Target: ATXN1; (+) strand; PAM type: NRG; PAM sequence: AAG
tttcaatgaaagagcccaga

SEQ ID NO: 102106 - DNA, 20 bp, Artificial Sequence
  Description of Artificial Sequence: Synthetic oligonucleotide
  Target: ATXN1; (+) strand; PAM type: NRG; PAM sequence: TGG
actcaatatgaacaaccatt

SEQ ID NO: 102107 - DNA, 20 bp, Artificial Sequence
  Description of Artificial Sequence: Synthetic oligonucleotide
  Target: ATXN1; (+) strand; PAM type: NRG; PAM sequence: TAG
caatatgaacaaccatttgg

SEQ ID NO: 102108 - DNA, 20 bp, Artificial Sequence
  Description of Artificial Sequence: Synthetic oligonucleotide
  Target: ATXN1; (+) strand; PAM type: NRG; PAM sequence: AGG
aatatgaacaaccatttggt

SEQ ID NO: 102109 - DNA, 20 bp, Artificial Sequence
  Description of Artificial Sequence: Synthetic oligonucleotide
  Target: ATXN1; (+) strand; PAM type: NRG; PAM sequence: GGG
atatgaacaaccatttggta

SEQ ID NO: 102110 - DNA, 20 bp, Artificial Sequence
  Description of Artificial Sequence: Synthetic oligonucleotide
  Target: ATXN1; (+) strand; PAM type: NRG; PAM sequence: AAG
catttggtagggttcttaaa

SEQ ID NO: 102111 - DNA, 20 bp, Artificial Sequence
  Description of Artificial Sequence: Synthetic oligonucleotide
  Target: ATXN1; (+) strand; PAM type: NRG; PAM sequence: TAG
ggtagggttcttaaaaagta

SEQ ID NO: 102112 - DNA, 20 bp, Artificial Sequence
  Description of Artificial Sequence: Synthetic oligonucleotide
  Target: ATXN1; (+) strand; PAM type: NRG; PAM sequence: CAG
attaaaaaaaatataatgtt

SEQ ID NO: 102113 - DNA, 20 bp, Artificial Sequence
  Description of Artificial Sequence: Synthetic oligonucleotide
  Target: ATXN1; (+) strand; PAM type: NRG; PAM sequence: AGG
ttaaaaaaaatataatgttc

SEQ ID NO: 102114 - DNA, 20 bp, Artificial Sequence
  Description of Artificial Sequence: Synthetic oligonucleotide
  Target: ATXN1; (+) strand; PAM type: NRG; PAM sequence: TGG
aaaaaatataatgttcaggc

SEQ ID NO: 102115 - DNA, 20 bp, Artificial Sequence
  Description of Artificial Sequence: Synthetic oligonucleotide
  Target: ATXN1; (+) strand; PAM type: NRG; PAM sequence: GGG
aaaaatataatgttcaggct

SEQ ID NO: 102116 - DNA, 20 bp, Artificial Sequence
  Description of Artificial Sequence: Synthetic oligonucleotide
  Target: ATXN1; (+) strand; PAM type: NRG; PAM sequence: CAG
tataatgttcaggctgggtt

SEQ ID NO: 102117 - DNA, 20 bp, Artificial Sequence
  Description of Artificial Sequence: Synthetic oligonucleotide
  Target: ATXN1; (+) strand; PAM type: NRG; PAM sequence: TGG
aatgttcaggctgggttcag

SEQ ID NO: 102118 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatcc

SEQ ID NO: 102119 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcactt

SEQ ID NO: 102120 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcacttt

SEQ ID NO: 102121 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 102122 - DNA, 20 bp, Artificial Sequence
  Description of Artificial Sequence: Synthetic oligonucleotide
  Target: ATXN1; (+) strand; PAM type: NRG; PAM sequence: CAG
atcccagcactttgggagcc

SEQ ID NO: 102123 - DNA, 20 bp, Artificial Sequence
  Description of Artificial Sequence: Synthetic oligonucleotide
  Target: ATXN1; (+) strand; PAM type: NRG; PAM sequence: AGG
tcccagcactttgggagccc

SEQ ID NO: 102124 - DNA, 20 bp, Artificial Sequence
  Description of Artificial Sequence: Synthetic oligonucleotide
  Target: ATXN1; (+) strand; PAM type: NRG; PAM sequence: GAG
ccagcactttgggagcccag

SEQ ID NO: 102125 - DNA, 20 bp, Artificial Sequence
  Description of Artificial Sequence: Synthetic oligonucleotide
  Target: ATXN1; (+) strand; PAM type: NRG; PAM sequence: AAG
ctttgggagcccaggagctc

SEQ ID NO: 102126 - DNA, 20 bp, Artificial Sequence
  Description of Artificial Sequence: Synthetic oligonucleotide
  Target: ATXN1; (+) strand; PAM type: NRG; PAM sequence: AGG
tttgggagcccaggagctca

SEQ ID NO: 102127 - DNA, 20 bp, Artificial Sequence
  Description of Artificial Sequence: Synthetic oligonucleotide
  Target: ATXN1; (+) strand; PAM type: NRG; PAM sequence: CAG
ggagcccaggagctcaaggc

SEQ ID NO: 102128 - DNA, 20 bp, Artificial Sequence
  Description of Artificial Sequence: Synthetic oligonucleotide
  Target: ATXN1; (+) strand; PAM type: NRG; PAM sequence: TGG
ccaggagctcaaggccagcc

SEQ ID NO: 102129 - DNA, 20 bp, Artificial Sequence
  Description of Artificial Sequence: Synthetic oligonucleotide
  Target: ATXN1; (+) strand; PAM type: NRG; PAM sequence: GAG
gccagcctggacaacatatc

SEQ ID NO: 102130 - DNA, 20 bp, Artificial Sequence
  Description of Artificial Sequence: Synthetic oligonucleotide
  Target: ATXN1; (+) strand; PAM type: NRG; PAM sequence: TAG
ctacaaaaaataaaaaaaat

SEQ ID NO: 102131 - DNA, 20 bp, Artificial Sequence
  Description of Artificial Sequence: Synthetic oligonucleotide
  Target: ATXN1; (+) strand; PAM type: NRG; PAM sequence: TAG
aaaaaataaaaaaaattagc

SEQ ID NO: 102132 - DNA, 20 bp, Artificial Sequence
  Description of Artificial Sequence: Synthetic oligonucleotide
  Target: ATXN1; (+) strand; PAM type: NRG; PAM sequence: AGG
aaaaataaaaaaaattagct

SEQ ID NO: 102133 - DNA, 20 bp, Artificial Sequence
  Description of Artificial Sequence: Synthetic oligonucleotide
  Target: ATXN1; (+) strand; PAM type: NRG; PAM sequence: TGG
taaaaaaaattagctaggca

SEQ ID NO: 102134 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagctaggcatgg

SEQ ID NO: 102135 - DNA, 20 bp, Artificial Sequence
  Description of Artificial Sequence: Synthetic oligonucleotide
  Target: ATXN1; (+) strand; PAM type: NRG; PAM sequence: TGG
ggcatggtggtttgcatctg

SEQ ID NO: 102136 - DNA, 20 bp, Artificial Sequence
  Description of Artificial Sequence: Synthetic oligonucleotide
  Target: ATXN1; (+) strand; PAM type: NRG; PAM sequence: TAG
gtggtttgcatctgtggtcc

SEQ ID NO: 102137 - DNA, 20 bp, Artificial Sequence
  Description of Artificial Sequence: Synthetic oligonucleotide
  Target: ATXN1; (+) strand; PAM type: NRG; PAM sequence: CAG
catctgtggtcctagctacc

SEQ ID NO: 102138 - DNA, 20 bp, Artificial Sequence
  Description of Artificial Sequence: Synthetic oligonucleotide
  Target: ATXN1; (+) strand; PAM type: NRG; PAM sequence: AGG
atctgtggtcctagctaccc

SEQ ID NO: 102139 - DNA, 20 bp, Artificial Sequence
  Description of Artificial Sequence: Synthetic oligonucleotide
  Target: ATXN1; (+) strand; PAM type: NRG; PAM sequence: GAG
ctgtggtcctagctacccag

SEQ ID NO: 102140 - DNA, 20 bp, Artificial Sequence
  Description of Artificial Sequence: Synthetic oligonucleotide
  Target: ATXN1; (+) strand; PAM type: NRG; PAM sequence: AGG
tgtggtcctagctacccagg

SEQ ID NO: 102141 - DNA, 20 bp, Artificial Sequence
  Description of Artificial Sequence: Synthetic oligonucleotide
  Target: ATXN1; (+) strand; PAM type: NRG; PAM sequence: AAG
tcctagctacccaggaggct

SEQ ID NO: 102142 - DNA, 20 bp, Artificial Sequence
  Description of Artificial Sequence: Synthetic oligonucleotide
  Target: ATXN1; (+) strand; PAM type: NRG; PAM sequence: AGG
cctagctacccaggaggcta

SEQ ID NO: 102143 - DNA, 20 bp, Artificial Sequence
  Description of Artificial Sequence: Synthetic oligonucleotide
  Target: ATXN1; (+) strand; PAM type: NRG; PAM sequence: CAG
agctacccaggaggctaagg

SEQ ID NO: 102144 - DNA, 20 bp, Artificial Sequence
  Description of Artificial Sequence: Synthetic oligonucleotide
  Target: ATXN1; (+) strand; PAM type: NRG; PAM sequence: AGG
gctacccaggaggctaaggc

SEQ ID NO: 102145 - DNA, 20 bp, Artificial Sequence
  Description of Artificial Sequence: Synthetic oligonucleotide
  Target: ATXN1; (+) strand; PAM type: NRG; PAM sequence: GAG
tacccaggaggctaaggcag

SEQ ID NO: 102146 - DNA, 20 bp, Artificial Sequence
  Description of Artificial Sequence: Synthetic oligonucleotide
  Target: ATXN1; (+) strand; PAM type: NRG; PAM sequence: AGG
acccaggaggctaaggcagg

SEQ ID NO: 102147 - DNA, 20 bp, Artificial Sequence
  Description of Artificial Sequence: Synthetic oligonucleotide
  Target: ATXN1; (+) strand; PAM type: NRG; PAM sequence: GAG
ctaaggcaggaggattgctt

SEQ ID NO: 102148 - DNA, 20 bp, Artificial Sequence
  Description of Artificial Sequence: Synthetic oligonucleotide
  Target: ATXN1; (+) strand; PAM type: NRG; PAM sequence: CAG
gcaggaggattgcttgagcc

SEQ ID NO: 102149 - DNA, 20 bp, Artificial Sequence
  Description of Artificial Sequence: Synthetic oligonucleotide
  Target: ATXN1; (+) strand; PAM type: NRG; PAM sequence: AGG
caggaggattgcttgagccc

SEQ ID NO: 102150 - DNA, 20 bp, Artificial Sequence
  Description of Artificial Sequence: Synthetic oligonucleotide
  Target: ATXN1; (+) strand; PAM type: NRG; PAM sequence: GAG
ggaggattgcttgagcccag

SEQ ID NO: 102151 - DNA, 20 bp, Artificial Sequence
  Description of Artificial Sequence: Synthetic oligonucleotide
  Target: ATXN1; (+) strand; PAM type: NRG; PAM sequence: AGG
gaggattgcttgagcccagg

SEQ ID NO: 102152 - DNA, 20 bp, Artificial Sequence
  Description of Artificial Sequence: Synthetic oligonucleotide
  Target: ATXN1; (+) strand; PAM type: NRG; PAM sequence: GAG
ttgcttgagcccaggaggtt

SEQ ID NO: 102153 - DNA, 20 bp, Artificial Sequence
  Description of Artificial Sequence: Synthetic oligonucleotide
  Target: ATXN1; (+) strand; PAM type: NRG; PAM sequence: AGG
tgcttgagcccaggaggttg

SEQ ID NO: 102154 - DNA, 20 bp, Artificial Sequence
  Description of Artificial Sequence: Synthetic oligonucleotide
  Target: ATXN1; (+) strand; PAM type: NRG; PAM sequence: CAG
agcccaggaggttgaggctg

SEQ ID NO: 102155 - DNA, 20 bp, Artificial Sequence
  Description of Artificial Sequence: Synthetic oligonucleotide
  Target: ATXN1; (+) strand; PAM type: NRG; PAM sequence: GAG
caggaggttgaggctgcagt

SEQ ID NO: 102156 - DNA, 20 bp, Artificial Sequence
  Description of Artificial Sequence: Synthetic oligonucleotide
  Target: ATXN1; (+) strand; PAM type: NRG; PAM sequence: CAG
atgattgctccactgcactc

SEQ ID NO: 102157 - DNA, 20 bp, Artificial Sequence
  Description of Artificial Sequence: Synthetic oligonucleotide
  Target: ATXN1; (+) strand; PAM type: NRG; PAM sequence: TAG
tgctccactgcactccagcc

SEQ ID NO: 102158 - DNA, 20 bp, Artificial Sequence
  Description of Artificial Sequence: Synthetic oligonucleotide
  Target: ATXN1; (+) strand; PAM type: NRG; PAM sequence: AGG
gctccactgcactccagcct

SEQ ID NO: 102159 - DNA, 20 bp, Artificial Sequence
  Description of Artificial Sequence: Synthetic oligonucleotide
  Target: ATXN1; (+) strand; PAM type: NRG; PAM sequence: AAG
gcactccagcctaggtgata

SEQ ID NO: 102160 - DNA, 20 bp, Artificial Sequence
  Description of Artificial Sequence: Synthetic oligonucleotide
  Target: ATXN1; (+) strand; PAM type: NRG; PAM sequence: AAG
tccagcctaggtgataaagc

SEQ ID NO: 102161 - DNA, 20 bp, Artificial Sequence
  Description of Artificial Sequence: Synthetic oligonucleotide
  Target: ATXN1; (+) strand; PAM type: NRG; PAM sequence: AAG
ataaagcaagaccctgtctc

SEQ ID NO: 102162 - DNA, 20 bp, Artificial Sequence
  Description of Artificial Sequence: Synthetic oligonucleotide
  Target: ATXN1; (+) strand; PAM type: NRG; PAM sequence: AAG
gcaagaccctgtctcaagaa

SEQ ID NO: 102163 - DNA, 20 bp, Artificial Sequence
  Description of Artificial Sequence: Synthetic oligonucleotide
  Target: ATXN1; (+) strand; PAM type: NRG; PAM sequence: GAG
aagaccctgtctcaagaaaa

SEQ ID NO: 102164 - DNA, 20 bp, Artificial Sequence
  Description of Artificial Sequence: Synthetic oligonucleotide
  Target: ATXN1; (+) strand; PAM type: NRG; PAM sequence: AAG
ccctgtctcaagaaaagaga

SEQ ID NO: 102165 - DNA, 20 bp, Artificial Sequence
  Description of Artificial Sequence: Synthetic oligonucleotide
  Target: ATXN1; (+) strand; PAM type: NRG; PAM sequence: CAG
aagagaaagaaaacaatgtt

SEQ ID NO: 102166 - DNA, 20 bp, Artificial Sequence
  Description of Artificial Sequence: Synthetic oligonucleotide
  Target: ATXN1; (+) strand; PAM type: NRG; PAM sequence: AAG
aagaaaacaatgttcagaat

SEQ ID NO: 102167 - DNA, 20 bp, Artificial Sequence
  Description of Artificial Sequence: Synthetic oligonucleotide
  Target: ATXN1; (+) strand; PAM type: NRG; PAM sequence: AGG
agaaaacaatgttcagaata

SEQ ID NO: 102168 - DNA, 20 bp, Artificial Sequence
  Description of Artificial Sequence: Synthetic oligonucleotide
  Target: ATXN1; (+) strand; PAM type: NRG; PAM sequence: GGG
gaaaacaatgttcagaataa

SEQ ID NO: 102169 - DNA, 20 bp, Artificial Sequence
  Description of Artificial Sequence: Synthetic oligonucleotide
  Target: ATXN1; (+) strand; PAM type: NRG; PAM sequence: TAG
gggaataaatactgcaacca

SEQ ID NO: 102170 - DNA, 20 bp, Artificial Sequence
  Description of Artificial Sequence: Synthetic oligonucleotide
  Target: ATXN1; (+) strand; PAM type: NRG; PAM sequence: TGG
ataaatactgcaaccataga

SEQ ID NO: 102171 - DNA, 20 bp, Artificial Sequence
  Description of Artificial Sequence: Synthetic oligonucleotide
  Target: ATXN1; (+) strand; PAM type: NRG; PAM sequence: CGG
tactgcaaccatagatggca

SEQ ID NO: 102172 - DNA, 20 bp, Artificial Sequence
  Description of Artificial Sequence: Synthetic oligonucleotide
  Target: ATXN1; (+) strand; PAM type: NRG; PAM sequence: GGG
actgcaaccatagatggcac

SEQ ID NO: 102173 - DNA, 20 bp, Artificial Sequence
  Description of Artificial Sequence: Synthetic oligonucleotide
  Target: ATXN1; (+) strand; PAM type: NRG; PAM sequence: AAG
aaccatagatggcacgggta

SEQ ID NO: 102174 - DNA, 20 bp, Artificial Sequence
  Description of Artificial Sequence: Synthetic oligonucleotide
  Target: ATXN1; (+) strand; PAM type: NRG; PAM sequence: CAG
agatggcacgggtaaagcca

SEQ ID NO: 102175 - DNA, 20 bp, Artificial Sequence
  Description of Artificial Sequence: Synthetic oligonucleotide
  Target: ATXN1; (+) strand; PAM type: NRG; PAM sequence: AAG
acagttgaaatcctgctgca

SEQ ID NO: 102176 - DNA, 20 bp, Artificial Sequence
  Description of Artificial Sequence: Synthetic oligonucleotide
  Target: ATXN1; (+) strand; PAM type: NRG; PAM sequence: AGG
cagttgaaatcctgctgcaa

SEQ ID NO: 102177 - DNA, 20 bp, Artificial Sequence
  Description of Artificial Sequence: Synthetic oligonucleotide
  Target: ATXN1; (+) strand; PAM type: NRG; PAM sequence: TGG
aatcctgctgcaaaggcacg

SEQ ID NO: 102178 - DNA, 20 bp, Artificial Sequence
  Description of Artificial Sequence: Synthetic oligonucleotide
  Target: ATXN1; (+) strand; PAM type: NRG; PAM sequence: GGG
atcctgctgcaaaggcacgt

SEQ ID NO: 102179 - DNA, 20 bp, Artificial Sequence
  Description of Artificial Sequence: Synthetic oligonucleotide
  Target: ATXN1; (+) strand; PAM type: NRG; PAM sequence: AAG
ctgctgcaaaggcacgtggg

SEQ ID NO: 102180 - DNA, 20 bp, Artificial Sequence
  Description of Artificial Sequence: Synthetic oligonucleotide
  Target: ATXN1; (+) strand; PAM type: NRG; PAM sequence: AGG
tgctgcaaaggcacgtggga

SEQ ID NO: 102181 - DNA, 20 bp, Artificial Sequence
  Description of Artificial Sequence: Synthetic oligonucleotide
  Target: ATXN1; (+) strand; PAM type: NRG; PAM sequence: TGG
gcaaaggcacgtgggaagga

SEQ ID NO: 102182 - DNA, 20 bp, Artificial Sequence
  Description of Artificial Sequence: Synthetic oligonucleotide
  Target: ATXN1; (+) strand; PAM type: NRG; PAM sequence: GGG
caaaggcacgtgggaaggat

SEQ ID NO: 102183 - DNA, 20 bp, Artificial Sequence
  Description of Artificial Sequence: Synthetic oligonucleotide
  Target: ATXN1; (+) strand; PAM type: NRG; PAM sequence: GGG
aaaggcacgtgggaaggatg

SEQ ID NO: 102184 - DNA, 20 bp, Artificial Sequence
  Description of Artificial Sequence: Synthetic oligonucleotide
  Target: ATXN1; (+) strand; PAM type: NRG; PAM sequence: TAG
tgggaaggatggggcatgtc

SEQ ID NO: 102185 - DNA, 20 bp, Artificial Sequence
  Description of Artificial Sequence: Synthetic oligonucleotide
  Target: ATXN1; (+) strand; PAM type: NRG; PAM sequence: AGG
gggaaggatggggcatgtct

SEQ ID NO: 102186 - DNA, 20 bp, Artificial Sequence
  Description of Artificial Sequence: Synthetic oligonucleotide
  Target: ATXN1; (+) strand; PAM type: NRG; PAM sequence: GGG
ggaaggatggggcatgtcta

SEQ ID NO: 102187 - DNA, 20 bp, Artificial Sequence
  Description of Artificial Sequence: Synthetic oligonucleotide
  Target: ATXN1; (+) strand; PAM type: NRG; PAM sequence: GGG
gaaggatggggcatgtctag

SEQ ID NO: 102188 - DNA, 20 bp, Artificial Sequence
  Description of Artificial Sequence: Synthetic oligonucleotide
  Target: ATXN1; (+) strand; PAM type: NRG; PAM sequence: GGG
aaggatggggcatgtctagg

SEQ ID NO: 102189 - DNA, 20 bp, Artificial Sequence
  Description of Artificial Sequence: Synthetic oligonucleotide
  Target: ATXN1; (+) strand; PAM type: NRG; PAM sequence: GAG
ggatggggcatgtctagggg

SEQ ID NO: 102190 - DNA, 20 bp, Artificial Sequence
  Description of Artificial Sequence: Synthetic oligonucleotide
  Target: ATXN1; (+) strand; PAM type: NRG; PAM sequence: CAG
gcatgtctagggggagtgat

SEQ ID NO: 102191 - DNA, 20 bp, Artificial Sequence
  Description of Artificial Sequence: Synthetic oligonucleotide
  Target: ATXN1; (+) strand; PAM type: NRG; PAM sequence: AAG
gggggagtgatcagttgcgc

SEQ ID NO: 102192 - DNA, 20 bp, Artificial Sequence
  Description of Artificial Sequence: Synthetic oligonucleotide
  Target: ATXN1; (+) strand; PAM type: NRG; PAM sequence: GAG
gggagtgatcagttgcgcaa

SEQ ID NO: 102193 - DNA, 20 bp, Artificial Sequence
  Description of Artificial Sequence: Synthetic oligonucleotide
  Target: ATXN1; (+) strand; PAM type: NRG; PAM sequence: AGG
ggagtgatcagttgcgcaag

SEQ ID NO: 102194 - DNA, 20 bp, Artificial Sequence
  Description of Artificial Sequence: Synthetic oligonucleotide
  Target: ATXN1; (+) strand; PAM type: NRG; PAM sequence: TGG
gatcagttgcgcaagaggtc

SEQ ID NO: 102195 - DNA, 20 bp, Artificial Sequence
  Description of Artificial Sequence: Synthetic oligonucleotide
  Target: ATXN1; (+) strand; PAM type: NRG; PAM sequence: GAG
tcagttgcgcaagaggtctg

SEQ ID NO: 102196 - DNA, 20 bp, Artificial Sequence
  Description of Artificial Sequence: Synthetic oligonucleotide
  Target: ATXN1; (+) strand; PAM type: NRG; PAM sequence: AGG
cagttgcgcaagaggtctgg

SEQ ID NO: 102197 - DNA, 20 bp, Artificial Sequence
  Description of Artificial Sequence: Synthetic oligonucleotide
  Target: ATXN1; (+) strand; PAM type: NRG; PAM sequence: AAG
tgcgcaagaggtctggaggc

SEQ ID NO: 102198 - DNA, 20 bp, Artificial Sequence
  Description of Artificial Sequence: Synthetic oligonucleotide
  Target: ATXN1; (+) strand; PAM type: NRG; PAM sequence: CAG
gcaagaggtctggaggcaag

SEQ ID NO: 102199 - DNA, 20 bp, Artificial Sequence
  Description of Artificial Sequence: Synthetic oligonucleotide
  Target: ATXN1; (+) strand; PAM type: NRG; PAM sequence: GAG
aggtctggaggcaagcagat

SEQ ID NO: 102200 - DNA, 20 bp, Artificial Sequence
  Description of Artificial Sequence: Synthetic oligonucleotide
  Target: ATXN1; (+) strand; PAM type: NRG; PAM sequence: CAG
ggaggcaagcagatgagtaa

SEQ ID NO: 102201 - DNA, 20 bp, Artificial Sequence
  Description of Artificial Sequence: Synthetic oligonucleotide
  Target: ATXN1; (+) strand; PAM type: NRG; PAM sequence: GAG
caagcagatgagtaacagct

SEQ ID NO: 102202 - DNA, 20 bp, Artificial Sequence
  Description of Artificial Sequence: Synthetic oligonucleotide
  Target: ATXN1; (+) strand; PAM type: NRG; PAM sequence: TGG
tgagtaacagctgagacaac

SEQ ID NO: 102203 - DNA, 20 bp, Artificial Sequence
  Description of Artificial Sequence: Synthetic oligonucleotide
  Target: ATXN1; (+) strand; PAM type: NRG; PAM sequence: GGG
gagtaacagctgagacaact

SEQ ID NO: 102204 - DNA, 20 bp, Artificial Sequence
  Description of Artificial Sequence: Synthetic oligonucleotide
  Target: ATXN1; (+) strand; PAM type: NRG; PAM sequence: GAG
cagctgagacaactgggaat

SEQ ID NO: 102205 - DNA, 20 bp, Artificial Sequence
  Description of Artificial Sequence: Synthetic oligonucleotide
  Target: ATXN1; (+) strand; PAM type: NRG; PAM sequence: TGG
acaactgggaatgagtgccc

SEQ ID NO: 102206 - DNA, 20 bp, Artificial Sequence
  Description of Artificial Sequence: Synthetic oligonucleotide
  Target: ATXN1; (+) strand; PAM type: NRG; PAM sequence: GGG
caactgggaatgagtgccct

SEQ ID NO: 102207 - DNA, 20 bp, Artificial Sequence
  Description of Artificial Sequence: Synthetic oligonucleotide
  Target: ATXN1; (+) strand; PAM type: NRG; PAM sequence: GGG
aactgggaatgagtgccctg

SEQ ID NO: 102208 - DNA, 20 bp, Artificial Sequence
  Description of Artificial Sequence: Synthetic oligonucleotide
  Target: ATXN1; (+) strand; PAM type: NRG; PAM sequence: AAG
tgggaatgagtgccctgggg

SEQ ID NO: 102209 - DNA, 20 bp, Artificial Sequence
  Description of Artificial Sequence: Synthetic oligonucleotide
  Target: ATXN1; (+) strand; PAM type: NRG; PAM sequence: CAG
atgagtgccctggggaagaa

SEQ ID NO: 102210 - DNA, 20 bp, Artificial Sequence
  Description of Artificial Sequence: Synthetic oligonucleotide
  Target: ATXN1; (+) strand; PAM type: NRG; PAM sequence: AAG
gccctggggaagaacagaaa

SEQ ID NO: 102211 - DNA, 20 bp, Artificial Sequence
  Description of Artificial Sequence: Synthetic oligonucleotide
  Target: ATXN1; (+) strand; PAM type: NRG; PAM sequence: CAG
gggaagaacagaaaaagctg

SEQ ID NO: 102212 - DNA, 20 bp, Artificial Sequence
  Description of Artificial Sequence: Synthetic oligonucleotide
  Target: ATXN1; (+) strand; PAM type: NRG; PAM sequence: TAG
aacagaaaaagctgcagcat

SEQ ID NO: 102213 - DNA, 20 bp, Artificial Sequence
  Description of Artificial Sequence: Synthetic oligonucleotide
  Target: ATXN1; (+) strand; PAM type: NRG; PAM sequence: AGG
acagaaaaagctgcagcatt

SEQ ID NO: 102214 - DNA, 20 bp, Artificial Sequence
  Description of Artificial Sequence: Synthetic oligonucleotide
  Target: ATXN1; (+) strand; PAM type: NRG; PAM sequence: AAG
gaaaaagctgcagcattagg

SEQ ID NO: 102215 - DNA, 20 bp, Artificial Sequence
  Description of Artificial Sequence: Synthetic oligonucleotide
  Target: ATXN1; (+) strand; PAM type: NRG; PAM sequence: GAG
ctgcagcattaggaagcaat

SEQ ID NO: 102216 - DNA, 20 bp, Artificial Sequence
  Description of Artificial Sequence: Synthetic oligonucleotide
  Target: ATXN1; (+) strand; PAM type: NRG; PAM sequence: TGG
gcattaggaagcaatgagaa

SEQ ID NO: 102217 - DNA, 20 bp, Artificial Sequence
  Description of Artificial Sequence: Synthetic oligonucleotide
  Target: ATXN1; (+) strand; PAM type: NRG; PAM sequence: TGG
gcaatgagaatggttaaaaa

SEQ ID NO: 102218 - DNA, 20 bp, Artificial Sequence
  Description of Artificial Sequence: Synthetic oligonucleotide
  Target: ATXN1; (+) strand; PAM type: NRG; PAM sequence: TGG
gagaatggttaaaaatggac

SEQ ID NO: 102219 - DNA, 20 bp, Artificial Sequence
  Description of Artificial Sequence: Synthetic oligonucleotide
  Target: ATXN1; (+) strand; PAM type: NRG; PAM sequence: GGG
agaatggttaaaaatggact

SEQ ID NO: 102220 - DNA, 20 bp, Artificial Sequence
  Description of Artificial Sequence: Synthetic oligonucleotide
  Target: ATXN1; (+) strand; PAM type: NRG; PAM sequence: GAG
aatggactgggctgcctcat

SEQ ID NO: 102221 - DNA, 20 bp, Artificial Sequence
  Description of Artificial Sequence: Synthetic oligonucleotide
  Target: ATXN1; (+) strand; PAM type: NRG; PAM sequence: CAG
gactgggctgcctcatgagt

SEQ ID NO: 102222 - DNA, 20 bp, Artificial Sequence
  Description of Artificial Sequence: Synthetic oligonucleotide
  Target: ATXN1; (+) strand; PAM type: NRG; PAM sequence: AGG
actgggctgcctcatgagtc

SEQ ID NO: 102223 - DNA, 20 bp, Artificial Sequence
  Description of Artificial Sequence: Synthetic oligonucleotide
  Target: ATXN1; (+) strand; PAM type: NRG; PAM sequence: GGG
ctgggctgcctcatgagtca

SEQ ID NO: 102224 - DNA, 20 bp, Artificial Sequence
  Description of Artificial Sequence: Synthetic oligonucleotide
  Target: ATXN1; (+) strand; PAM type: NRG; PAM sequence: TGG
cctcatgagtcagggatctc

SEQ ID NO: 102225 - DNA, 20 bp, Artificial Sequence
  Description of Artificial Sequence: Synthetic oligonucleotide
  Target: ATXN1; (+) strand; PAM type: NRG; PAM sequence: GGG
ctcatgagtcagggatctct

SEQ ID NO: 102226 - DNA, 20 bp, Artificial Sequence
  Description of Artificial Sequence: Synthetic oligonucleotide
  Target: ATXN1; (+) strand; PAM type: NRG; PAM sequence: AAG
agggatctctgggtcacccc

SEQ ID NO: 102227 - DNA, 20 bp, Artificial Sequence
  Description of Artificial Sequence: Synthetic oligonucleotide
  Target: ATXN1; (+) strand; PAM type: NRG; PAM sequence: AGG
gggatctctgggtcacccca

SEQ ID NO: 102228 - DNA, 20 bp, Artificial Sequence
  Description of Artificial Sequence: Synthetic oligonucleotide
  Target: ATXN1; (+) strand; PAM type: NRG; PAM sequence: GGG
ggatctctgggtcaccccaa

SEQ ID NO: 102229 - DNA, 20 bp, Artificial Sequence
  Description of Artificial Sequence: Synthetic oligonucleotide
  Target: ATXN1; (+) strand; PAM type: NRG; PAM sequence: CAG
ctctgggtcaccccaagggt

SEQ ID NO: 102230 - DNA, 20 bp, Artificial Sequence
  Description of Artificial Sequence: Synthetic oligonucleotide
  Target: ATXN1; (+) strand; PAM type: NRG; PAM sequence: AGG
tctgggtcaccccaagggtc

SEQ ID NO: 102231 - DNA, 20 bp, Artificial Sequence
  Description of Artificial Sequence: Synthetic oligonucleotide
  Target: ATXN1; (+) strand; PAM type: NRG; PAM sequence: TAG
ggtcaccccaagggtcagga

SEQ ID NO: 102232 - DNA, 20 bp, Artificial Sequence
  Description of Artificial Sequence: Synthetic oligonucleotide
  Target: ATXN1; (+) strand; PAM type: NRG; PAM sequence: CAG
caagggtcaggatagaaact

SEQ ID NO: 102233 - DNA, 20 bp, Artificial Sequence
  Description of Artificial Sequence: Synthetic oligonucleotide
  Target: ATXN1; (+) strand; PAM type: NRG; PAM sequence: AGG
aagggtcaggatagaaactc

SEQ ID NO: 102234 - DNA, 20 bp, Artificial Sequence
  Description of Artificial Sequence: Synthetic oligonucleotide
  Target: ATXN1; (+) strand; PAM type: NRG; PAM sequence: GGG
agggtcaggatagaaactca

SEQ ID NO: 102235 - DNA, 20 bp, Artificial Sequence
  Description of Artificial Sequence: Synthetic oligonucleotide
  Target: ATXN1; (+) strand; PAM type: NRG; PAM sequence: TGG
aggatagaaactcagggata

SEQ ID NO: 102236 - DNA, 20 bp, Artificial Sequence
  Description of Artificial Sequence: Synthetic oligonucleotide
  Target: ATXN1; (+) strand; PAM type: NRG; PAM sequence: GGG
ggatagaaactcagggatat

SEQ ID NO: 102237 - DNA, 20 bp, Artificial Sequence
  Description of Artificial Sequence: Synthetic oligonucleotide
  Target: ATXN1; (+) strand; PAM type: NRG; PAM sequence: GGG
gatagaaactcagggatatg

SEQ ID NO: 102238 - DNA, 20 bp, Artificial Sequence
  Description of Artificial Sequence: Synthetic oligonucleotide
  Target: ATXN1; (+) strand; PAM type: NRG; PAM sequence: TAG
agaaactcagggatatgggg

SEQ ID NO: 102239 - DNA, 20 bp, Artificial Sequence
  Description of Artificial Sequence: Synthetic oligonucleotide
  Target: ATXN1; (+) strand; PAM type: NRG; PAM sequence: AGG
gaaactcagggatatggggt

SEQ ID NO: 102240 - DNA, 20 bp, Artificial Sequence
  Description of Artificial Sequence: Synthetic oligonucleotide
  Target: ATXN1; (+) strand; PAM type: NRG; PAM sequence: GGG
aaactcagggatatggggta

SEQ ID NO: 102241 - DNA, 20 bp, Artificial Sequence
  Description of Artificial Sequence: Synthetic oligonucleotide
  Target: ATXN1; (+) strand; PAM type: NRG; PAM sequence: GGG
aactcagggatatggggtag

SEQ ID NO: 102242 - DNA, 20 bp, Artificial Sequence
  Description of Artificial Sequence: Synthetic oligonucleotide
  Target: ATXN1; (+) strand; PAM type: NRG; PAM sequence: TGG
tggggtaggggtccctgccc

SEQ ID NO: 102243 - DNA, 20 bp, Artificial Sequence
  Description of Artificial Sequence: Synthetic oligonucleotide
  Target: ATXN1; (+) strand; PAM type: NRG; PAM sequence: TGG
gtaggggtccctgccctggt

SEQ ID NO: 102244 - DNA, 20 bp, Artificial Sequence
  Description of Artificial Sequence: Synthetic oligonucleotide
  Target: ATXN1; (+) strand; PAM type: NRG; PAM sequence: GGG
taggggtccctgccctggtt

SEQ ID NO: 102245 - DNA, 20 bp, Artificial Sequence
  Description of Artificial Sequence: Synthetic oligonucleotide
  Target: ATXN1; (+) strand; PAM type: NRG; PAM sequence: TAG
actctacatttttttgccat

SEQ ID NO: 102246 - DNA, 20 bp, Artificial Sequence
  Description of Artificial Sequence: Synthetic oligonucleotide
  Target: ATXN1; (+) strand; PAM type: NRG; PAM sequence: AGG
ctctacatttttttgccatt

SEQ ID NO: 102247 - DNA, 20 bp, Artificial Sequence
  Description of Artificial Sequence: Synthetic oligonucleotide
  Target: ATXN1; (+) strand; PAM type: NRG; PAM sequence: GAG
tttgccattaggaacattct

SEQ ID NO: 102248 - DNA, 20 bp, Artificial Sequence
  Description of Artificial Sequence: Synthetic oligonucleotide
  Target: ATXN1; (+) strand; PAM type: NRG; PAM sequence: AAG
ctgtgattccactctgtgtc

SEQ ID NO: 102249 - DNA, 20 bp, Artificial Sequence
  Description of Artificial Sequence: Synthetic oligonucleotide
  Target: ATXN1; (+) strand; PAM type: NRG; PAM sequence: AGG
tgtgattccactctgtgtca

SEQ ID NO: 102250 - DNA, 20 bp, Artificial Sequence
  Description of Artificial Sequence: Synthetic oligonucleotide
  Target: ATXN1; (+) strand; PAM type: NRG; PAM sequence: TGG
gattccactctgtgtcaagg

SEQ ID NO: 102251 - DNA, 20 bp, Artificial Sequence
  Description of Artificial Sequence: Synthetic oligonucleotide
  Target: ATXN1; (+) strand; PAM type: NRG; PAM sequence: TGG
ccactctgtgtcaaggtggc

SEQ ID NO: 102252 - DNA, 20 bp, Artificial Sequence
  Description of Artificial Sequence: Synthetic oligonucleotide
  Target: ATXN1; (+) strand; PAM type: NRG; PAM sequence: CAG
aggtggctggcttgtcatcc

SEQ ID NO: 102253 - DNA, 20 bp, Artificial Sequence
  Description of Artificial Sequence: Synthetic oligonucleotide
  Target: ATXN1; (+) strand; PAM type: NRG; PAM sequence: CAG
atttcttcttgctgtgtcct

SEQ ID NO: 102254 - DNA, 20 bp, Artificial Sequence
  Description of Artificial Sequence: Synthetic oligonucleotide
  Target: ATXN1; (+) strand; PAM type: NRG; PAM sequence: TGG
tcttcttgctgtgtcctcag

SEQ ID NO: 102255 - DNA, 20 bp, Artificial Sequence
  Description of Artificial Sequence: Synthetic oligonucleotide
  Target: ATXN1; (+) strand; PAM type: NRG; PAM sequence: AAG
cttctcttccatgtctatct

SEQ ID NO: 102256 - DNA, 20 bp, Artificial Sequence
  Description of Artificial Sequence: Synthetic oligonucleotide
  Target: ATXN1; (+) strand; PAM type: NRG; PAM sequence: TGG
cttccatgtctatctaagcg

SEQ ID NO: 102257 - DNA, 20 bp, Artificial Sequence
  Description of Artificial Sequence: Synthetic oligonucleotide
  Target: ATXN1; (+) strand; PAM type: NRG; PAM sequence: GAG
tccatgtctatctaagcgtg

SEQ ID NO: 102258 - DNA, 20 bp, Artificial Sequence
  Description of Artificial Sequence: Synthetic oligonucleotide
  Target: ATXN1; (+) strand; PAM type: NRG; PAM sequence: TGG
tatctaagcgtggagcttca

SEQ ID NO: 102259 - DNA, 20 bp, Artificial Sequence
  Description of Artificial Sequence: Synthetic oligonucleotide
  Target: ATXN1; (+) strand; PAM type: NRG; PAM sequence: GGG
atctaagcgtggagcttcat

SEQ ID NO: 102260 - DNA, 20 bp, Artificial Sequence
  Description of Artificial Sequence: Synthetic oligonucleotide
  Target: ATXN1; (+) strand; PAM type: NRG; PAM sequence: GGG
tctaagcgtggagcttcatg

SEQ ID NO: 102261 - DNA, 20 bp, Artificial Sequence
  Description of Artificial Sequence: Synthetic oligonucleotide
  Target: ATXN1; (+) strand; PAM type: NRG; PAM sequence: CAG
aagcgtggagcttcatgggg

SEQ ID NO: 102262 - DNA, 20 bp, Artificial Sequence
  Description of Artificial Sequence: Synthetic oligonucleotide
  Target: ATXN1; (+) strand; PAM type: NRG; PAM sequence: AGG
agcgtggagcttcatggggc

SEQ ID NO: 102263 - DNA, 20 bp, Artificial Sequence
  Description of Artificial Sequence: Synthetic oligonucleotide
  Target: ATXN1; (+) strand; PAM type: NRG; PAM sequence: TGG
gcttcatggggcaggcctct

SEQ ID NO: 102264 - DNA, 20 bp, Artificial Sequence
  Description of Artificial Sequence: Synthetic oligonucleotide
  Target: ATXN1; (+) strand; PAM type: NRG; PAM sequence: GAG
caggcctcttggcccaaaat

SEQ ID NO: 102265 - DNA, 20 bp, Artificial Sequence
  Description of Artificial Sequence: Synthetic oligonucleotide
  Target: ATXN1; (+) strand; PAM type: NRG; PAM sequence: AGG
aggcctcttggcccaaaatg

SEQ ID NO: 102266 - DNA, 20 bp, Artificial Sequence
  Description of Artificial Sequence: Synthetic oligonucleotide
  Target: ATXN1; (+) strand; PAM type: NRG; PAM sequence: GAG
gcctcttggcccaaaatgag

SEQ ID NO: 102267 - DNA, 20 bp, Artificial Sequence
  Description of Artificial Sequence: Synthetic oligonucleotide
  Target: ATXN1; (+) strand; PAM type: NRG; PAM sequence: AGG
cctcttggcccaaaatgagg

SEQ ID NO: 102268 - DNA, 20 bp, Artificial Sequence
  Description of Artificial Sequence: Synthetic oligonucleotide
  Target: ATXN1; (+) strand; PAM type: NRG; PAM sequence: AAG
ccaaaatgaggaggctcctg

SEQ ID NO: 102269 - DNA, 20 bp, Artificial Sequence
  Description of Artificial Sequence: Synthetic oligonucleotide
  Target: ATXN1; (+) strand; PAM type: NRG; PAM sequence: AGG
caaaatgaggaggctcctga

SEQ ID NO: 102270 - DNA, 20 bp, Artificial Sequence
  Description of Artificial Sequence: Synthetic oligonucleotide
  Target: ATXN1; (+) strand; PAM type: NRG; PAM sequence: GGG
aaaatgaggaggctcctgaa

SEQ ID NO: 102271 - DNA, 20 bp, Artificial Sequence
  Description of Artificial Sequence: Synthetic oligonucleotide
  Target: ATXN1; (+) strand; PAM type: NRG; PAM sequence: GGG
aaatgaggaggctcctgaag

SEQ ID NO: 102272 - DNA, 20 bp, Artificial Sequence
  Description of Artificial Sequence: Synthetic oligonucleotide
  Target: ATXN1; (+) strand; PAM type: NRG; PAM sequence: AAG
gaggctcctgaaggggactg

SEQ ID NO: 102273 - DNA, 20 bp, Artificial Sequence
  Description of Artificial Sequence: Synthetic oligonucleotide
  Target: ATXN1; (+) strand; PAM type: NRG; PAM sequence: AGG
aggctcctgaaggggactga

SEQ ID NO: 102274 - DNA, 20 bp, Artificial Sequence
  Description of Artificial Sequence: Synthetic oligonucleotide
  Target: ATXN1; (+) strand; PAM type: NRG; PAM sequence: TAG
aggggactgaaggccctgtc

SEQ ID NO: 102275 - DNA, 20 bp, Artificial Sequence
  Description of Artificial Sequence: Synthetic oligonucleotide
  Target: ATXN1; (+) strand; PAM type: NRG; PAM sequence: GAG
gggactgaaggccctgtcta

SEQ ID NO: 102276 - DNA, 20 bp, Artificial Sequence
  Description of Artificial Sequence: Synthetic oligonucleotide
  Target: ATXN1; (+) strand; PAM type: NRG; PAM sequence: CAG
aggccctgtctagagacatc

SEQ ID NO: 102277 - DNA, 20 bp, Artificial Sequence
  Description of Artificial Sequence: Synthetic oligonucleotide
  Target: ATXN1; (+) strand; PAM type: NRG; PAM sequence: AGG
ggccctgtctagagacatcc

SEQ ID NO: 102278 - DNA, 20 bp, Artificial Sequence
  Description of Artificial Sequence: Synthetic oligonucleotide
  Target: ATXN1; (+) strand; PAM type: NRG; PAM sequence: CAG
ctgtctagagacatccaggc

SEQ ID NO: 102279 - DNA, 20 bp, Artificial Sequence
  Description of Artificial Sequence: Synthetic oligonucleotide
  Target: ATXN1; (+) strand; PAM type: NRG; PAM sequence: CAG
acatccaggccagaaaccac

SEQ ID NO: 102280 - DNA, 20 bp, Artificial Sequence
  Description of Artificial Sequence: Synthetic oligonucleotide
  Target: ATXN1; (+) strand; PAM type: NRG; PAM sequence: GAG
atccaggccagaaaccacca

SEQ ID NO: 102281 - DNA, 20 bp, Artificial Sequence
  Description of Artificial Sequence: Synthetic oligonucleotide
  Target: ATXN1; (+) strand; PAM type: NRG; PAM sequence: GAG
ccaggccagaaaccaccaga

SEQ ID NO: 102282 - DNA, 20 bp, Artificial Sequence
  Description of Artificial Sequence: Synthetic oligonucleotide
  Target: ATXN1; (+) strand; PAM type: NRG; PAM sequence: AGG
caggccagaaaccaccagag

SEQ ID NO: 102283 - DNA, 20 bp, Artificial Sequence
  Description of Artificial Sequence: Synthetic oligonucleotide
  Target: ATXN1; (+) strand; PAM type: NRG; PAM sequence: GAG
ccagaaaccaccagagaggc

SEQ ID NO: 102284 - DNA, 20 bp, Artificial Sequence
  Description of Artificial Sequence: Synthetic oligonucleotide
  Target: ATXN1; (+) strand; PAM type: NRG; PAM sequence: TGG
aaaccaccagagaggcgagc

SEQ ID NO: 102285 - DNA, 20 bp, Artificial Sequence
  Description of Artificial Sequence: Synthetic oligonucleotide
  Target: ATXN1; (+) strand; PAM type: NRG; PAM sequence: GGG
aaccaccagagaggcgagct

SEQ ID NO: 102286 - DNA, 20 bp, Artificial Sequence
  Description of Artificial Sequence: Synthetic oligonucleotide
  Target: ATXN1; (+) strand; PAM type: NRG; PAM sequence: TGG
cagagaggcgagctgggacc

SEQ ID NO: 102287 - DNA, 20 bp, Artificial Sequence
  Description of Artificial Sequence: Synthetic oligonucleotide
  Target: ATXN1; (+) strand; PAM type: NRG; PAM sequence: TAG
tgggacctggcacaactttg

SEQ ID NO: 102288 - DNA, 20 bp, Artificial Sequence
  Description of Artificial Sequence: Synthetic oligonucleotide
  Target: ATXN1; (+) strand; PAM type: NRG; PAM sequence: AAG
gacctggcacaactttgtag

SEQ ID NO: 102289 - DNA, 20 bp, Artificial Sequence
  Description of Artificial Sequence: Synthetic oligonucleotide
  Target: ATXN1; (+) strand; PAM type: NRG; PAM sequence: GAG
ctttgtagaagatgctgtct

SEQ ID NO: 102290 - DNA, 20 bp, Artificial Sequence
  Description of Artificial Sequence: Synthetic oligonucleotide
  Target: ATXN1; (+) strand; PAM type: NRG; PAM sequence: GAG
ttgtagaagatgctgtctga

SEQ ID NO: 102291 - DNA, 20 bp, Artificial Sequence
  Description of Artificial Sequence: Synthetic oligonucleotide
  Target: ATXN1; (+) strand; PAM type: NRG; PAM sequence: CGG
gagcctcgccccaacgcgct

SEQ ID NO: 102292 - DNA, 20 bp, Artificial Sequence
  Description of Artificial Sequence: Synthetic oligonucleotide
  Target: ATXN1; (+) strand; PAM type: NRG; PAM sequence: GGG
agcctcgccccaacgcgctc

SEQ ID NO: 102293 - DNA, 20 bp, Artificial Sequence
  Description of Artificial Sequence: Synthetic oligonucleotide
  Target: ATXN1; (+) strand; PAM type: NRG; PAM sequence: CGG
cgcgctcgggtttcccttct

SEQ ID NO: 102294 - DNA, 20 bp, Artificial Sequence
  Description of Artificial Sequence: Synthetic oligonucleotide
  Target: ATXN1; (+) strand; PAM type: NRG; PAM sequence: TGG
ccttctcggctctgcacccc

SEQ ID NO: 102295 - DNA, 20 bp, Artificial Sequence
  Description of Artificial Sequence: Synthetic oligonucleotide
  Target: ATXN1; (+) strand; PAM type: NRG; PAM sequence: GGG
cttctcggctctgcacccct

SEQ ID NO: 102296 - DNA, 20 bp, Artificial Sequence
  Description of Artificial Sequence: Synthetic oligonucleotide
  Target: ATXN1; (+) strand; PAM type: NRG; PAM sequence: TGG
ggctctgcacccctgggaca

SEQ ID NO: 102297 - DNA, 20 bp, Artificial Sequence
  Description of Artificial Sequence: Synthetic oligonucleotide
  Target: ATXN1; (+) strand; PAM type: NRG; PAM sequence: GGG
gctctgcacccctgggacat

SEQ ID NO: 102298 - DNA, 20 bp, Artificial Sequence
  Description of Artificial Sequence: Synthetic oligonucleotide
  Target: ATXN1; (+) strand; PAM type: NRG; PAM sequence: CGG
acatgggatcttgctcttca

SEQ ID NO: 102299 - DNA, 20 bp, Artificial Sequence
  Description of Artificial Sequence: Synthetic oligonucleotide
  Target: ATXN1; (+) strand; PAM type: NRG; PAM sequence: AAG
tgggatcttgctcttcacgg

SEQ ID NO: 102300 - DNA, 20 bp, Artificial Sequence
  Description of Artificial Sequence: Synthetic oligonucleotide
  Target: ATXN1; (+) strand; PAM type: NRG; PAM sequence: TAG
tcttgctcttcacggaagtg

SEQ ID NO: 102301 - DNA, 20 bp, Artificial Sequence
  Description of Artificial Sequence: Synthetic oligonucleotide
  Target: ATXN1; (+) strand; PAM type: NRG; PAM sequence: GAG
gctcttcacggaagtgtagt

SEQ ID NO: 102302 - DNA, 20 bp, Artificial Sequence
  Description of Artificial Sequence: Synthetic oligonucleotide
  Target: ATXN1; (+) strand; PAM type: NRG; PAM sequence: GAG
ttcacggaagtgtagtgagt

SEQ ID NO: 102303 - DNA, 20 bp, Artificial Sequence
  Description of Artificial Sequence: Synthetic oligonucleotide
  Target: ATXN1; (+) strand; PAM type: NRG; PAM sequence: AAG
acggaagtgtagtgagtgag

SEQ ID NO: 102304 - DNA, 20 bp, Artificial Sequence
  Description of Artificial Sequence: Synthetic oligonucleotide
  Target: ATXN1; (+) strand; PAM type: NRG; PAM sequence: GAG
ggaagtgtagtgagtgagaa

SEQ ID NO: 102305 - DNA, 20 bp, Artificial Sequence
  Description of Artificial Sequence: Synthetic oligonucleotide
  Target: ATXN1; (+) strand; PAM type: NRG; PAM sequence: AAG
gtagtgagtgagaagagaaa

SEQ ID NO: 102306 - DNA, 20 bp, Artificial Sequence
  Description of Artificial Sequence: Synthetic oligonucleotide
  Target: ATXN1; (+) strand; PAM type: NRG; PAM sequence: AAG
tgagtgagaagagaaaaagc

SEQ ID NO: 102307 - DNA, 20 bp, Artificial Sequence
  Description of Artificial Sequence: Synthetic oligonucleotide
  Target: ATXN1; (+) strand; PAM type: NRG; PAM sequence: AAG
agagaaaaagcaagaaatga

SEQ ID NO: 102308 - DNA, 20 bp, Artificial Sequence
  Description of Artificial Sequence: Synthetic oligonucleotide
  Target: ATXN1; (+) strand; PAM type: NRG; PAM sequence: AAG
gaaatgaaagctcgtaatcc

SEQ ID NO: 102309 - DNA, 20 bp, Artificial Sequence
  Description of Artificial Sequence: Synthetic oligonucleotide
  Target: ATXN1; (+) strand; PAM type: NRG; PAM sequence: TAG
tgaaagctcgtaatccaagc

SEQ ID NO: 102310 - DNA, 20 bp, Artificial Sequence
  Description of Artificial Sequence: Synthetic oligonucleotide
  Target: ATXN1; (+) strand; PAM type: NRG; PAM sequence: AAG
aagctcgtaatccaagctag

SEQ ID NO: 102311 - DNA, 20 bp, Artificial Sequence
  Description of Artificial Sequence: Synthetic oligonucleotide
  Target: ATXN1; (+) strand; PAM type: NRG; PAM sequence: AGG
agctcgtaatccaagctaga

SEQ ID NO: 102312 - DNA, 20 bp, Artificial Sequence
  Description of Artificial Sequence: Synthetic oligonucleotide
  Target: ATXN1; (+) strand; PAM type: NRG; PAM sequence: GAG
ctcgtaatccaagctagaag

SEQ ID NO: 102313 - DNA, 20 bp, Artificial Sequence
  Description of Artificial Sequence: Synthetic oligonucleotide
  Target: ATXN1; (+) strand; PAM type: NRG; PAM sequence: GAG
aagctagaaggagtccacac

SEQ ID NO: 102314 - DNA, 20 bp, Artificial Sequence
  Description of Artificial Sequence: Synthetic oligonucleotide
  Target: ATXN1; (+) strand; PAM type: NRG; PAM sequence: AGG
agctagaaggagtccacacg

SEQ ID NO: 102315 - DNA, 20 bp, Artificial Sequence
  Description of Artificial Sequence: Synthetic oligonucleotide
  Target: ATXN1; (+) strand; PAM type: NRG; PAM sequence: GGG
gctagaaggagtccacacga

SEQ ID NO: 102316 - DNA, 20 bp, Artificial Sequence
  Description of Artificial Sequence: Synthetic oligonucleotide
  Target: ATXN1; (+) strand; PAM type: NRG; PAM sequence: AAG
aggagtccacacgagggcct

SEQ ID NO: 102317 - DNA, 20 bp, Artificial Sequence
  Description of Artificial Sequence: Synthetic oligonucleotide
  Target: ATXN1; (+) strand; PAM type: NRG; PAM sequence: AGG
ggagtccacacgagggccta

SEQ ID NO: 102318 - DNA, 20 bp, Artificial Sequence
  Description of Artificial Sequence: Synthetic oligonucleotide
  Target: ATXN1; (+) strand; PAM type: NRG; PAM sequence: AAG
tcttaatttttatcatgaat

SEQ ID NO: 102319 - DNA, 20 bp, Artificial Sequence
  Description of Artificial Sequence: Synthetic oligonucleotide
  Target: ATXN1; (+) strand; PAM type: NRG; PAM sequence: AGG
cttaatttttatcatgaata

SEQ ID NO: 102320 - DNA, 20 bp, Artificial Sequence
  Description of Artificial Sequence: Synthetic oligonucleotide
  Target: ATXN1; (+) strand; PAM type: NRG; PAM sequence: AAG
aatttttatcatgaataagg

SEQ ID NO: 102321 - DNA, 20 bp, Artificial Sequence
  Description of Artificial Sequence: Synthetic oligonucleotide
  Target: ATXN1; (+) strand; PAM type: NRG; PAM sequence: AGG
atttttatcatgaataagga

SEQ ID NO: 102322 - DNA, 20 bp, Artificial Sequence
  Description of Artificial Sequence: Synthetic oligonucleotide
  Target: ATXN1; (+) strand; PAM type: NRG; PAM sequence: CAG
ttatcatgaataaggaagga

SEQ ID NO: 102323 - DNA, 20 bp, Artificial Sequence
  Description of Artificial Sequence: Synthetic oligonucleotide
  Target: ATXN1; (+) strand; PAM type: NRG; PAM sequence: TGG
tcatgaataaggaaggacag

SEQ ID NO: 102324 - DNA, 20 bp, Artificial Sequence
  Description of Artificial Sequence: Synthetic oligonucleotide
  Target: ATXN1; (+) strand; PAM type: NRG; PAM sequence: GGG
catgaataaggaaggacagt

SEQ ID NO: 102325 - DNA, 20 bp, Artificial Sequence
  Description of Artificial Sequence: Synthetic oligonucleotide
  Target: ATXN1; (+) strand; PAM type: NRG; PAM sequence: TGG
aggaaggacagtgggttgaa

SEQ ID NO: 102326 - DNA, 20 bp, Artificial Sequence
  Description of Artificial Sequence: Synthetic oligonucleotide
  Target: ATXN1; (+) strand; PAM type: NRG; PAM sequence: TAG
aaggacagtgggttgaatgg

SEQ ID NO: 102327 - DNA, 20 bp, Artificial Sequence
  Description of Artificial Sequence: Synthetic oligonucleotide
  Target: ATXN1; (+) strand; PAM type: NRG; PAM sequence: AAG
gttgaatggtagatccctaa

SEQ ID NO: 102328 - DNA, 20 bp, Artificial Sequence
  Description of Artificial Sequence: Synthetic oligonucleotide
  Target: ATXN1; (+) strand; PAM type: NRG; PAM sequence: CAG
ccctaaaagttatgcccact

SEQ ID NO: 102329 - DNA, 20 bp, Artificial Sequence
  Description of Artificial Sequence: Synthetic oligonucleotide
  Target: ATXN1; (+) strand; PAM type: NRG; PAM sequence: TGG
agttatgcccactcagaacc

SEQ ID NO: 102330 - DNA, 20 bp, Artificial Sequence
  Description of Artificial Sequence: Synthetic oligonucleotide
  Target: ATXN1; (+) strand; PAM type: NRG; PAM sequence: GGG
gttatgcccactcagaacct

SEQ ID NO: 102331 - DNA, 20 bp, Artificial Sequence
  Description of Artificial Sequence: Synthetic oligonucleotide
  Target: ATXN1; (+) strand; PAM type: NRG; PAM sequence: TGG
gcccactcagaacctgggaa

SEQ ID NO: 102332 - DNA, 20 bp, Artificial Sequence
  Description of Artificial Sequence: Synthetic oligonucleotide
  Target: ATXN1; (+) strand; PAM type: NRG; PAM sequence: TGG
aacctgggaatggctttatt

SEQ ID NO: 102333 - DNA, 20 bp, Artificial Sequence
  Description of Artificial Sequence: Synthetic oligonucleotide
  Target: ATXN1; (+) strand; PAM type: NRG; PAM sequence: AAG
ggaatggctttatttggaaa

SEQ ID NO: 102334 - DNA, 20 bp, Artificial Sequence
  Description of Artificial Sequence: Synthetic oligonucleotide
  Target: ATXN1; (+) strand; PAM type: NRG; PAM sequence: AGG
gaatggctttatttggaaaa

SEQ ID NO: 102335 - DNA, 20 bp, Artificial Sequence
  Description of Artificial Sequence: Synthetic oligonucleotide
  Target: ATXN1; (+) strand; PAM type: NRG; PAM sequence: GGG
aatggctttatttggaaaaa

SEQ ID NO: 102336 - DNA, 20 bp, Artificial Sequence
  Description of Artificial Sequence: Synthetic oligonucleotide
  Target: ATXN1; (+) strand; PAM type: NRG; PAM sequence: CAG
atttggaaaaagggtctttg

SEQ ID NO: 102337 - DNA, 20 bp, Artificial Sequence
  Description of Artificial Sequence: Synthetic oligonucleotide
  Target: ATXN1; (+) strand; PAM type: NRG; PAM sequence: TGG
ggtctttgcagatgtaatta

SEQ ID NO: 102338 - DNA, 20 bp, Artificial Sequence
  Description of Artificial Sequence: Synthetic oligonucleotide
  Target: ATXN1; (+) strand; PAM type: NRG; PAM sequence: TGG
tgcagatgtaattatggatt

SEQ ID NO: 102339 - DNA, 20 bp, Artificial Sequence
  Description of Artificial Sequence: Synthetic oligonucleotide
  Target: ATXN1; (+) strand; PAM type: NRG; PAM sequence: GAG
gtaattatggatttggaaat

SEQ ID NO: 102340 - DNA, 20 bp, Artificial Sequence
  Description of Artificial Sequence: Synthetic oligonucleotide
  Target: ATXN1; (+) strand; PAM type: NRG; PAM sequence: TGG
atttggaaatgagatcatgc

SEQ ID NO: 102341 - DNA, 20 bp, Artificial Sequence
  Description of Artificial Sequence: Synthetic oligonucleotide
  Target: ATXN1; (+) strand; PAM type: NRG; PAM sequence: CAG
tgagatcatgctggatgatc

SEQ ID NO: 102342 - DNA, 20 bp, Artificial Sequence
  Description of Artificial Sequence: Synthetic oligonucleotide
  Target: ATXN1; (+) strand; PAM type: NRG; PAM sequence: AGG
gagatcatgctggatgatcc

SEQ ID NO: 102343 - DNA, 20 bp, Artificial Sequence
  Description of Artificial Sequence: Synthetic oligonucleotide
  Target: ATXN1; (+) strand; PAM type: NRG; PAM sequence: TGG
atcatgctggatgatccagg

SEQ ID NO: 102344 - DNA, 20 bp, Artificial Sequence
  Description of Artificial Sequence: Synthetic oligonucleotide
  Target: ATXN1; (+) strand; PAM type: NRG; PAM sequence: GGG
tcatgctggatgatccaggt

SEQ ID NO: 102345 - DNA, 20 bp, Artificial Sequence
  Description of Artificial Sequence: Synthetic oligonucleotide
  Target: ATXN1; (+) strand; PAM type: NRG; PAM sequence: AAG
ccaggtgggccctcaattca

SEQ ID NO: 102346 - DNA, 20 bp, Artificial Sequence
  Description of Artificial Sequence: Synthetic oligonucleotide
  Target: ATXN1; (+) strand; PAM type: NRG; PAM sequence: AAG
tcaaagacaaatgtccttat

SEQ ID NO: 102347 - DNA, 20 bp, Artificial Sequence
  Description of Artificial Sequence: Synthetic oligonucleotide
  Target: ATXN1; (+) strand; PAM type: NRG; PAM sequence: GAG
aaagacaaatgtccttataa

SEQ ID NO: 102348 - DNA, 20 bp, Artificial Sequence
  Description of Artificial Sequence: Synthetic oligonucleotide
  Target: ATXN1; (+) strand; PAM type: NRG; PAM sequence: AAG
acaaatgtccttataagaga

SEQ ID NO: 102349 - DNA, 20 bp, Artificial Sequence
  Description of Artificial Sequence: Synthetic oligonucleotide
  Target: ATXN1; (+) strand; PAM type: NRG; PAM sequence: AGG
caaatgtccttataagagaa

SEQ ID NO: 102350 - DNA, 20 bp, Artificial Sequence
  Description of Artificial Sequence: Synthetic oligonucleotide
  Target: ATXN1; (+) strand; PAM type: NRG; PAM sequence: CAG
atgtccttataagagaaagg

SEQ ID NO: 102351 - DNA, 20 bp, Artificial Sequence
  Description of Artificial Sequence: Synthetic oligonucleotide
  Target: ATXN1; (+) strand; PAM type: NRG; PAM sequence: GAG
gtccttataagagaaaggca

SEQ ID NO: 102352 - DNA, 20 bp, Artificial Sequence
  Description of Artificial Sequence: Synthetic oligonucleotide
  Target: ATXN1; (+) strand; PAM type: NRG; PAM sequence: AAG
ttataagagaaaggcagaga

SEQ ID NO: 102353 - DNA, 20 bp, Artificial Sequence
  Description of Artificial Sequence: Synthetic oligonucleotide
  Target: ATXN1; (+) strand; PAM type: NRG; PAM sequence: GAG
agaaaggcagagaaagatgt

SEQ ID NO: 102354 - DNA, 20 bp, Artificial Sequence
  Description of Artificial Sequence: Synthetic oligonucleotide
  Target: ATXN1; (+) strand; PAM type: NRG; PAM sequence: CAG
agagaaagatgtgagatgta

SEQ ID NO: 102355 - DNA, 20 bp, Artificial Sequence
  Description of Artificial Sequence: Synthetic oligonucleotide
  Target: ATXN1; (+) strand; PAM type: NRG; PAM sequence: GAG
agaaagatgtgagatgtaca

SEQ ID NO: 102356 - DNA, 20 bp, Artificial Sequence
  Description of Artificial Sequence: Synthetic oligonucleotide
  Target: ATXN1; (+) strand; PAM type: NRG; PAM sequence: AGG
gaaagatgtgagatgtacag

SEQ ID NO: 102357 - DNA, 20 bp, Artificial Sequence
  Description of Artificial Sequence: Synthetic oligonucleotide
  Target: ATXN1; (+) strand; PAM type: NRG; PAM sequence: AAG
atgtgagatgtacagaggca

SEQ ID NO: 102358 - DNA, 20 bp, Artificial Sequence
  Description of Artificial Sequence: Synthetic oligonucleotide
  Target: ATXN1; (+) strand; PAM type: NRG; PAM sequence: AGG
tgtgagatgtacagaggcaa

SEQ ID NO: 102359 - DNA, 20 bp, Artificial Sequence
  Description of Artificial Sequence: Synthetic oligonucleotide
  Target: ATXN1; (+) strand; PAM type: NRG; PAM sequence: TGG
gtacagaggcaaaggccctg

SEQ ID NO: 102360 - DNA, 20 bp, Artificial Sequence
  Description of Artificial Sequence: Synthetic oligonucleotide
  Target: ATXN1; (+) strand; PAM type: NRG; PAM sequence: GAG
acagaggcaaaggccctgtg

SEQ ID NO: 102361 - DNA, 20 bp, Artificial Sequence
  Description of Artificial Sequence: Synthetic oligonucleotide
  Target: ATXN1; (+) strand; PAM type: NRG; PAM sequence: AGG
cagaggcaaaggccctgtgg

SEQ ID NO: 102362 - DNA, 20 bp, Artificial Sequence
  Description of Artificial Sequence: Synthetic oligonucleotide
  Target: ATXN1; (+) strand; PAM type: NRG; PAM sequence: CAG
aggcaaaggccctgtggagg

SEQ ID NO: 102363 - DNA, 20 bp, Artificial Sequence
  Description of Artificial Sequence: Synthetic oligonucleotide
  Target: ATXN1; (+) strand; PAM type: NRG; PAM sequence: GAG
gcaaaggccctgtggaggca

SEQ ID NO: 102364 - DNA, 20 bp, Artificial Sequence
  Description of Artificial Sequence: Synthetic oligonucleotide
  Target: ATXN1; (+) strand; PAM type: NRG; PAM sequence: AGG
caaaggccctgtggaggcag

SEQ ID NO: 102365 - DNA, 20 bp, Artificial Sequence
  Description of Artificial Sequence: Synthetic oligonucleotide
  Target: ATXN1; (+) strand; PAM type: NRG; PAM sequence: CAG
aggccctgtggaggcagagg

SEQ ID NO: 102366 - DNA, 20 bp, Artificial Sequence
  Description of Artificial Sequence: Synthetic oligonucleotide
  Target: ATXN1; (+) strand; PAM type: NRG; PAM sequence: GAG
gccctgtggaggcagaggca

SEQ ID NO: 102367 - DNA, 20 bp, Artificial Sequence
  Description of Artificial Sequence: Synthetic oligonucleotide
  Target: ATXN1; (+) strand; PAM type: NRG; PAM sequence: GAG
cctgtggaggcagaggcaga

SEQ ID NO: 102368 - DNA, 20 bp, Artificial Sequence
  Description of Artificial Sequence: Synthetic oligonucleotide
  Target: ATXN1; (+) strand; PAM type: NRG; PAM sequence: TGG
ggaggcagaggcagagagac

SEQ ID NO: 102369 - DNA, 20 bp, Artificial Sequence
  Description of Artificial Sequence: Synthetic oligonucleotide
  Target: ATXN1; (+) strand; PAM type: NRG; PAM sequence: CAG
gcagagagactggaatgacg

SEQ ID NO: 102370 - DNA, 20 bp, Artificial Sequence
  Description of Artificial Sequence: Synthetic oligonucleotide
  Target: ATXN1; (+) strand; PAM type: NRG; PAM sequence: AAG
gactggaatgacgcagtccc

SEQ ID NO: 102371 - DNA, 20 bp, Artificial Sequence
  Description of Artificial Sequence: Synthetic oligonucleotide
  Target: ATXN1; (+) strand; PAM type: NRG; PAM sequence: AAG
gaatgacgcagtcccaagcc

SEQ ID NO: 102372 - DNA, 20 bp, Artificial Sequence
  Description of Artificial Sequence: Synthetic oligonucleotide
  Target: ATXN1; (+) strand; PAM type: NRG; PAM sequence: AGG
aatgacgcagtcccaagcca

SEQ ID NO: 102373 - DNA, 20 bp, Artificial Sequence
  Description of Artificial Sequence: Synthetic oligonucleotide
  Target: ATXN1; (+) strand; PAM type: NRG; PAM sequence: AAG
cccaagccaaggatcacccg

SEQ ID NO: 102374 - DNA, 20 bp, Artificial Sequence
  Description of Artificial Sequence: Synthetic oligonucleotide
  Target: ATXN1; (+) strand; PAM type: NRG; PAM sequence: TAG
caaggatcacccgaagctac

SEQ ID NO: 102375 - DNA, 20 bp, Artificial Sequence
  Description of Artificial Sequence: Synthetic oligonucleotide
  Target: ATXN1; (+) strand; PAM type: NRG; PAM sequence: AAG
ggatcacccgaagctactag

SEQ ID NO: 102376 - DNA, 20 bp, Artificial Sequence
  Description of Artificial Sequence: Synthetic oligonucleotide
  Target: ATXN1; (+) strand; PAM type: NRG; PAM sequence: CAG
tcacccgaagctactagaag

SEQ ID NO: 102377 - DNA, 20 bp, Artificial Sequence
  Description of Artificial Sequence: Synthetic oligonucleotide
  Target: ATXN1; (+) strand; PAM type: NRG; PAM sequence: AAG
ccgaagctactagaagcagc

SEQ ID NO: 102378 - DNA, 20 bp, Artificial Sequence
  Description of Artificial Sequence: Synthetic oligonucleotide
  Target: ATXN1; (+) strand; PAM type: NRG; PAM sequence: AAG
aagctactagaagcagcaag

SEQ ID NO: 102379 - DNA, 20 bp, Artificial Sequence
  Description of Artificial Sequence: Synthetic oligonucleotide
  Target: ATXN1; (+) strand; PAM type: NRG; PAM sequence: AAG
tactagaagcagcaagaagc

SEQ ID NO: 102380 - DNA, 20 bp, Artificial Sequence
  Description of Artificial Sequence: Synthetic oligonucleotide
  Target: ATXN1; (+) strand; PAM type: NRG; PAM sequence: AGG
actagaagcagcaagaagca

SEQ ID NO: 102381 - DNA, 20 bp, Artificial Sequence
  Description of Artificial Sequence: Synthetic oligonucleotide
  Target: ATXN1; (+) strand; PAM type: NRG; PAM sequence: AAG
gaagcagcaagaagcaagga

SEQ ID NO: 102382 - DNA, 20 bp, Artificial Sequence
  Description of Artificial Sequence: Synthetic oligonucleotide
  Target: ATXN1; (+) strand; PAM type: NRG; PAM sequence: TAG
agcaaggaaagattatcccc

SEQ ID NO: 102383 - DNA, 20 bp, Artificial Sequence
  Description of Artificial Sequence: Synthetic oligonucleotide
  Target: ATXN1; (+) strand; PAM type: NRG; PAM sequence: GAG
caaggaaagattatccccta

SEQ ID NO: 102384 - DNA, 20 bp, Artificial Sequence
  Description of Artificial Sequence: Synthetic oligonucleotide
  Target: ATXN1; (+) strand; PAM type: NRG; PAM sequence: AAG
attatcccctagagcctatg

SEQ ID NO: 102385 - DNA, 20 bp, Artificial Sequence
  Description of Artificial Sequence: Synthetic oligonucleotide
  Target: ATXN1; (+) strand; PAM type: NRG; PAM sequence: AGG
ttatcccctagagcctatga

SEQ ID NO: 102386 - DNA, 20 bp, Artificial Sequence
  Description of Artificial Sequence: Synthetic oligonucleotide
  Target: ATXN1; (+) strand; PAM type: NRG; PAM sequence: GGG
tatcccctagagcctatgaa

SEQ ID NO: 102387 - DNA, 20 bp, Artificial Sequence
  Description of Artificial Sequence: Synthetic oligonucleotide
  Target: ATXN1; (+) strand; PAM type: NRG; PAM sequence: TGG
tagagcctatgaagggaaca

SEQ ID NO: 102388 - DNA, 20 bp, Artificial Sequence
  Description of Artificial Sequence: Synthetic oligonucleotide
  Target: ATXN1; (+) strand; PAM type: NRG; PAM sequence: CAG
tgaagggaacatggctccac

SEQ ID NO: 102389 - DNA, 20 bp, Artificial Sequence
  Description of Artificial Sequence: Synthetic oligonucleotide
  Target: ATXN1; (+) strand; PAM type: NRG; PAM sequence: TAG
ctccaccagcaccttaattt

SEQ ID NO: 102390 - DNA, 20 bp, Artificial Sequence
  Description of Artificial Sequence: Synthetic oligonucleotide
  Target: ATXN1; (+) strand; PAM type: NRG; PAM sequence: AAG
gcaccttaattttagacttc

SEQ ID NO: 102391 - DNA, 20 bp, Artificial Sequence
  Description of Artificial Sequence: Synthetic oligonucleotide
  Target: ATXN1; (+) strand; PAM type: NRG; PAM sequence: CAG
aattttagacttcaagcctc

SEQ ID NO: 102392 - DNA, 20 bp, Artificial Sequence
  Description of Artificial Sequence: Synthetic oligonucleotide
  Target: ATXN1; (+) strand; PAM type: NRG; PAM sequence: AGG
attttagacttcaagcctcc

SEQ ID NO: 102393 - DNA, 20 bp, Artificial Sequence
  Description of Artificial Sequence: Synthetic oligonucleotide
  Target: ATXN1; (+) strand; PAM type: NRG; PAM sequence: GAG
tttagacttcaagcctccag

SEQ ID NO: 102394 - DNA, 20 bp, Artificial Sequence
  Description of Artificial Sequence: Synthetic oligonucleotide
  Target: ATXN1; (+) strand; PAM type: NRG; PAM sequence: TAG
cttcaagcctccaggagtgt

SEQ ID NO: 102395 - DNA, 20 bp, Artificial Sequence
  Description of Artificial Sequence: Synthetic oligonucleotide
  Target: ATXN1; (+) strand; PAM type: NRG; PAM sequence: GAG
tcaagcctccaggagtgtta

SEQ ID NO: 102396 - DNA, 20 bp, Artificial Sequence
  Description of Artificial Sequence: Synthetic oligonucleotide
  Target: ATXN1; (+) strand; PAM type: NRG; PAM sequence: AAG
gaatacttttctgttgtttt

SEQ ID NO: 102397 - DNA, 20 bp, Artificial Sequence
  Description of Artificial Sequence: Synthetic oligonucleotide
  Target: ATXN1; (+) strand; PAM type: NRG; PAM sequence: TGG
ttttaagccacgatatgttt

SEQ ID NO: 102398 - DNA, 20 bp, Artificial Sequence
  Description of Artificial Sequence: Synthetic oligonucleotide
  Target: ATXN1; (+) strand; PAM type: NRG; PAM sequence: TGG
tatgttttggtaatttatta

SEQ ID NO: 102399 - DNA, 20 bp, Artificial Sequence
  Description of Artificial Sequence: Synthetic oligonucleotide
  Target: ATXN1; (+) strand; PAM type: NRG; PAM sequence: CAG
gttttggtaatttattatgg

SEQ ID NO: 102400 - DNA, 20 bp, Artificial Sequence
  Description of Artificial Sequence: Synthetic oligonucleotide
  Target: ATXN1; (+) strand; PAM type: NRG; PAM sequence: AAG
taatttattatggcagccct

SEQ ID NO: 102401 - DNA, 20 bp, Artificial Sequence
  Description of Artificial Sequence: Synthetic oligonucleotide
  Target: ATXN1; (+) strand; PAM type: NRG; PAM sequence: AAG
gattacttattatacatgcc

SEQ ID NO: 102402 - DNA, 20 bp, Artificial Sequence
  Description of Artificial Sequence: Synthetic oligonucleotide
  Target: ATXN1; (+) strand; PAM type: NRG; PAM sequence: GAG
actcttcataacaaatttgt

SEQ ID NO: 102403 - DNA, 20 bp, Artificial Sequence
  Description of Artificial Sequence: Synthetic oligonucleotide
  Target: ATXN1; (+) strand; PAM type: NRG; PAM sequence: AGG
ctcttcataacaaatttgtg

SEQ ID NO: 102404 - DNA, 20 bp, Artificial Sequence
  Description of Artificial Sequence: Synthetic oligonucleotide
  Target: ATXN1; (+) strand; PAM type: NRG; PAM sequence: CAG
gtattattatctccattttc

SEQ ID NO: 102405 - DNA, 20 bp, Artificial Sequence
  Description of Artificial Sequence: Synthetic oligonucleotide
  Target: ATXN1; (+) strand; PAM type: NRG; PAM sequence: AAG
attatctccattttccagat

SEQ ID NO: 102406 - DNA, 20 bp, Artificial Sequence
  Description of Artificial Sequence: Synthetic oligonucleotide
  Target: ATXN1; (+) strand; PAM type: NRG; PAM sequence: AGG
ttatctccattttccagata

SEQ ID NO: 102407 - DNA, 20 bp, Artificial Sequence
  Description of Artificial Sequence: Synthetic oligonucleotide
  Target: ATXN1; (+) strand; PAM type: NRG; PAM sequence: GAG
attttccagataaggacact

SEQ ID NO: 102408 - DNA, 20 bp, Artificial Sequence
  Description of Artificial Sequence: Synthetic oligonucleotide
  Target: ATXN1; (+) strand; PAM type: NRG; PAM sequence: AGG
ttttccagataaggacactg

SEQ ID NO: 102409 - DNA, 20 bp, Artificial Sequence
  Description of Artificial Sequence: Synthetic oligonucleotide
  Target: ATXN1; (+) strand; PAM type: NRG; PAM sequence: AAG
aaggacactgaggttttccc

SEQ ID NO: 102410 - DNA, 20 bp, Artificial Sequence
  Description of Artificial Sequence: Synthetic oligonucleotide
  Target: ATXN1; (+) strand; PAM type: NRG; PAM sequence: AGG
aggacactgaggttttccca

SEQ ID NO: 102411 - DNA, 20 bp, Artificial Sequence
  Description of Artificial Sequence: Synthetic oligonucleotide
  Target: ATXN1; (+) strand; PAM type: NRG; PAM sequence: CAG
gaggttttcccaaggccata

SEQ ID NO: 102412 - DNA, 20 bp, Artificial Sequence
  Description of Artificial Sequence: Synthetic oligonucleotide
  Target: ATXN1; (+) strand; PAM type: NRG; PAM sequence: CAG
ttttcccaaggccatacagt

SEQ ID NO: 102413 - DNA, 20 bp, Artificial Sequence
  Description of Artificial Sequence: Synthetic oligonucleotide
  Target: ATXN1; (+) strand; PAM type: NRG; PAM sequence: GAG
ttcccaaggccatacagtca

SEQ ID NO: 102414 - DNA, 20 bp, Artificial Sequence
  Description of Artificial Sequence: Synthetic oligonucleotide
  Target: ATXN1; (+) strand; PAM type: NRG; PAM sequence: AGG
tcccaaggccatacagtcag

SEQ ID NO: 102415 - DNA, 20 bp, Artificial Sequence
  Description of Artificial Sequence: Synthetic oligonucleotide
  Target: ATXN1; (+) strand; PAM type: NRG; PAM sequence: TAG
caaggccatacagtcagagg

SEQ ID NO: 102416 - DNA, 20 bp, Artificial Sequence
  Description of Artificial Sequence: Synthetic oligonucleotide
  Target: ATXN1; (+) strand; PAM type: NRG; PAM sequence: TAG
catacagtcagaggtagaac

SEQ ID NO: 102417 - DNA, 20 bp, Artificial Sequence
  Description of Artificial Sequence: Synthetic oligonucleotide
  Target: ATXN1; (+) strand; PAM type: NRG; PAM sequence: TGG
gtcagaggtagaactagcac

SEQ ID NO: 102418 - DNA, 20 bp, Artificial Sequence
  Description of Artificial Sequence: Synthetic oligonucleotide
  Target: ATXN1; (+) strand; PAM type: NRG; PAM sequence: TAG
agcactggaaatcactttct

SEQ ID NO: 102419 - DNA, 20 bp, Artificial Sequence
  Description of Artificial Sequence: Synthetic oligonucleotide
  Target: ATXN1; (+) strand; PAM type: NRG; PAM sequence: CGG
tagtctacccaaccatgatg

SEQ ID NO: 102420 - DNA, 20 bp, Artificial Sequence
  Description of Artificial Sequence: Synthetic oligonucleotide
  Target: ATXN1; (+) strand; PAM type: NRG; PAM sequence: GGG
agtctacccaaccatgatgc

SEQ ID NO: 102421 - DNA, 20 bp, Artificial Sequence
  Description of Artificial Sequence: Synthetic oligonucleotide
  Target: ATXN1; (+) strand; PAM type: NRG; PAM sequence: TGG
tgcgggttacactcacctcc

SEQ ID NO: 102422 - DNA, 20 bp, Artificial Sequence
  Description of Artificial Sequence: Synthetic oligonucleotide
  Target: ATXN1; (+) strand; PAM type: NRG; PAM sequence: TGG
ttacactcacctcctggcta

SEQ ID NO: 102423 - DNA, 20 bp, Artificial Sequence
  Description of Artificial Sequence: Synthetic oligonucleotide
  Target: ATXN1; (+) strand; PAM type: NRG; PAM sequence: TGG
tcacctcctggctatggcga

SEQ ID NO: 102424 - DNA, 20 bp, Artificial Sequence
  Description of Artificial Sequence: Synthetic oligonucleotide
  Target: ATXN1; (+) strand; PAM type: NRG; PAM sequence: CAG
cctcctggctatggcgatgg

SEQ ID NO: 102425 - DNA, 20 bp, Artificial Sequence
  Description of Artificial Sequence: Synthetic oligonucleotide
  Target: ATXN1; (+) strand; PAM type: NRG; PAM sequence: TAG
ctatggcgatggcagcctca

SEQ ID NO: 102426 - DNA, 20 bp, Artificial Sequence
  Description of Artificial Sequence: Synthetic oligonucleotide
  Target: ATXN1; (+) strand; PAM type: NRG; PAM sequence: TAG
atgcctatttatttttcatg

SEQ ID NO: 102427 - DNA, 20 bp, Artificial Sequence
  Description of Artificial Sequence: Synthetic oligonucleotide
  Target: ATXN1; (+) strand; PAM type: NRG; PAM sequence: AAG
tatttatttttcatgtagaa

SEQ ID NO: 102428 - DNA, 20 bp, Artificial Sequence
  Description of Artificial Sequence: Synthetic oligonucleotide
  Target: ATXN1; (+) strand; PAM type: NRG; PAM sequence: AGG
atttatttttcatgtagaaa

SEQ ID NO: 102429 - DNA, 20 bp, Artificial Sequence
  Description of Artificial Sequence: Synthetic oligonucleotide
  Target: ATXN1; (+) strand; PAM type: NRG; PAM sequence: GGG
tttatttttcatgtagaaaa

SEQ ID NO: 102430 - DNA, 20 bp, Artificial Sequence
  Description of Artificial Sequence: Synthetic oligonucleotide
  Target: ATXN1; (+) strand; PAM type: NRG; PAM sequence: CAG
tttttcatgtagaaaaggga

SEQ ID NO: 102431 - DNA, 20 bp, Artificial Sequence
  Description of Artificial Sequence: Synthetic oligonucleotide
  Target: ATXN1; (+) strand; PAM type: NRG; PAM sequence: CAG
tagaaaagggacagaatgca

SEQ ID NO: 102432 - DNA, 20 bp, Artificial Sequence
  Description of Artificial Sequence: Synthetic oligonucleotide
  Target: ATXN1; (+) strand; PAM type: NRG; PAM sequence: AGG
agaaaagggacagaatgcac

SEQ ID NO: 102433 - DNA, 20 bp, Artificial Sequence
  Description of Artificial Sequence: Synthetic oligonucleotide
  Target: ATXN1; (+) strand; PAM type: NRG; PAM sequence: GGG
gaaaagggacagaatgcaca

SEQ ID NO: 102434 - DNA, 20 bp, Artificial Sequence
  Description of Artificial Sequence: Synthetic oligonucleotide
  Target: ATXN1; (+) strand; PAM type: NRG; PAM sequence: AAG
gggacagaatgcacagggat

SEQ ID NO: 102435 - DNA, 20 bp, Artificial Sequence
  Description of Artificial Sequence: Synthetic oligonucleotide
  Target: ATXN1; (+) strand; PAM type: NRG; PAM sequence: TAG
acagaatgcacagggataag

SEQ ID NO: 102436 - DNA, 20 bp, Artificial Sequence
  Description of Artificial Sequence: Synthetic oligonucleotide
  Target: ATXN1; (+) strand; PAM type: NRG; PAM sequence: AGG
cagaatgcacagggataagt

SEQ ID NO: 102437 - DNA, 20 bp, Artificial Sequence
  Description of Artificial Sequence: Synthetic oligonucleotide
  Target: ATXN1; (+) strand; PAM type: NRG; PAM sequence: GGG
agaatgcacagggataagta

SEQ ID NO: 102438 - DNA, 20 bp, Artificial Sequence
  Description of Artificial Sequence: Synthetic oligonucleotide
  Target: ATXN1; (+) strand; PAM type: NRG; PAM sequence: GGG
gaatgcacagggataagtag

SEQ ID NO: 102439 - DNA, 20 bp, Artificial Sequence
  Description of Artificial Sequence: Synthetic oligonucleotide
  Target: ATXN1; (+) strand; PAM type: NRG; PAM sequence: AAG
cacagggataagtaggggaa

SEQ ID NO: 102440 - DNA, 20 bp, Artificial Sequence
  Description of Artificial Sequence: Synthetic oligonucleotide
  Target: ATXN1; (+) strand; PAM type: NRG; PAM sequence: TAG
taagtaggggaaaagatgtc

SEQ ID NO: 102441 - DNA, 20 bp, Artificial Sequence
  Description of Artificial Sequence: Synthetic oligonucleotide
  Target: ATXN1; (+) strand; PAM type: NRG; PAM sequence: AGG
aagtaggggaaaagatgtct

SEQ ID NO: 102442 - DNA, 20 bp, Artificial Sequence
  Description of Artificial Sequence: Synthetic oligonucleotide
  Target: ATXN1; (+) strand; PAM type: NRG; PAM sequence: GGG
agtaggggaaaagatgtcta

SEQ ID NO: 102443 - DNA, 20 bp, Artificial Sequence
  Description of Artificial Sequence: Synthetic oligonucleotide
  Target: ATXN1; (+) strand; PAM type: NRG; PAM sequence: GGG
gtaggggaaaagatgtctag

SEQ ID NO: 102444 - DNA, 20 bp, Artificial Sequence
  Description of Artificial Sequence: Synthetic oligonucleotide
  Target: ATXN1; (+) strand; PAM type: NRG; PAM sequence: AAG
ctgcaccatgttgactaatc

SEQ ID NO: 102445 - DNA, 20 bp, Artificial Sequence
  Description of Artificial Sequence: Synthetic oligonucleotide
  Target: ATXN1; (+) strand; PAM type: NRG; PAM sequence: CAG
tgttgactaatcaagaactg

SEQ ID NO: 102446 - DNA, 20 bp, Artificial Sequence
  Description of Artificial Sequence: Synthetic oligonucleotide
  Target: ATXN1; (+) strand; PAM type: NRG; PAM sequence: TGG
gactaatcaagaactgcagc

SEQ ID NO: 102447 - DNA, 20 bp, Artificial Sequence
  Description of Artificial Sequence: Synthetic oligonucleotide
  Target: ATXN1; (+) strand; PAM type: NRG; PAM sequence: GAG
aatcaagaactgcagctggt

SEQ ID NO: 102448 - DNA, 20 bp, Artificial Sequence
  Description of Artificial Sequence: Synthetic oligonucleotide
  Target: ATXN1; (+) strand; PAM type: NRG; PAM sequence: CAG
actgcagctggtgagacgtt

SEQ ID NO: 102449 - DNA, 20 bp, Artificial Sequence
  Description of Artificial Sequence: Synthetic oligonucleotide
  Target: ATXN1; (+) strand; PAM type: NRG; PAM sequence: AAG
cagctggtgagacgttcagt

SEQ ID NO: 102450 - DNA, 20 bp, Artificial Sequence
  Description of Artificial Sequence: Synthetic oligonucleotide
  Target: ATXN1; (+) strand; PAM type: NRG; PAM sequence: AGG
agctggtgagacgttcagta

SEQ ID NO: 102451 - DNA, 20 bp, Artificial Sequence
  Description of Artificial Sequence: Synthetic oligonucleotide
  Target: ATXN1; (+) strand; PAM type: NRG; PAM sequence: AAG
tggtgagacgttcagtaagg

SEQ ID NO: 102452 - DNA, 20 bp, Artificial Sequence
  Description of Artificial Sequence: Synthetic oligonucleotide
  Target: ATXN1; (+) strand; PAM type: NRG; PAM sequence: GAG
gtgagacgttcagtaaggaa

SEQ ID NO: 102453 - DNA, 20 bp, Artificial Sequence
  Description of Artificial Sequence: Synthetic oligonucleotide
  Target: ATXN1; (+) strand; PAM type: NRG; PAM sequence: CAG
tcagtaaggaagagactgat

SEQ ID NO: 102454 - DNA, 20 bp, Artificial Sequence
  Description of Artificial Sequence: Synthetic oligonucleotide
  Target: ATXN1; (+) strand; PAM type: NRG; PAM sequence: AAG
gaagagactgatcagtgacc

SEQ ID NO: 102455 - DNA, 20 bp, Artificial Sequence
  Description of Artificial Sequence: Synthetic oligonucleotide
  Target: ATXN1; (+) strand; PAM type: NRG; PAM sequence: AGG
aagagactgatcagtgacca

SEQ ID NO: 102456 - DNA, 20 bp, Artificial Sequence
  Description of Artificial Sequence: Synthetic oligonucleotide
  Target: ATXN1; (+) strand; PAM type: NRG; PAM sequence: AAG
agactgatcagtgaccaagg

SEQ ID NO: 102457 - DNA, 20 bp, Artificial Sequence
  Description of Artificial Sequence: Synthetic oligonucleotide
  Target: ATXN1; (+) strand; PAM type: NRG; PAM sequence: GAG
actgatcagtgaccaaggaa

SEQ ID NO: 102458 - DNA, 20 bp, Artificial Sequence
  Description of Artificial Sequence: Synthetic oligonucleotide
  Target: ATXN1; (+) strand; PAM type: NRG; PAM sequence: GAG
tgatcagtgaccaaggaaga

SEQ ID NO: 102459 - DNA, 20 bp, Artificial Sequence
  Description of Artificial Sequence: Synthetic oligonucleotide
  Target: ATXN1; (+) strand; PAM type: NRG; PAM sequence: AGG
gatcagtgaccaaggaagag

SEQ ID NO: 102460 - DNA, 20 bp, Artificial Sequence
  Description of Artificial Sequence: Synthetic oligonucleotide
  Target: ATXN1; (+) strand; PAM type: NRG; PAM sequence: CAG
agtgaccaaggaagagaggt

SEQ ID NO: 102461 - DNA, 20 bp, Artificial Sequence
  Description of Artificial Sequence: Synthetic oligonucleotide
  Target: ATXN1; (+) strand; PAM type: NRG; PAM sequence: AGG
gtgaccaaggaagagaggtc

SEQ ID NO: 102462 - DNA, 20 bp, Artificial Sequence
  Description of Artificial Sequence: Synthetic oligonucleotide
  Target: ATXN1; (+) strand; PAM type: NRG; PAM sequence: CAG
gtcaggatgtttgtatttcc

SEQ ID NO: 102463 - DNA, 20 bp, Artificial Sequence
  Description of Artificial Sequence: Synthetic oligonucleotide
  Target: ATXN1; (+) strand; PAM type: NRG; PAM sequence: AGG
tcaggatgtttgtatttccc

SEQ ID NO: 102464 - DNA, 20 bp, Artificial Sequence
  Description of Artificial Sequence: Synthetic oligonucleotide
  Target: ATXN1; (+) strand; PAM type: NRG; PAM sequence: AAG
gatgtttgtatttcccaggc

SEQ ID NO: 102465 - DNA, 20 bp, Artificial Sequence
  Description of Artificial Sequence: Synthetic oligonucleotide
  Target: ATXN1; (+) strand; PAM type: NRG; PAM sequence: AAG
tttgtatttcccaggcaagc

SEQ ID NO: 102466 - DNA, 20 bp, Artificial Sequence
  Description of Artificial Sequence: Synthetic oligonucleotide
  Target: ATXN1; (+) strand; PAM type: NRG; PAM sequence: CAG
gtatttcccaggcaagcaag

SEQ ID NO: 102467 - DNA, 20 bp, Artificial Sequence
  Description of Artificial Sequence: Synthetic oligonucleotide
  Target: ATXN1; (+) strand; PAM type: NRG; PAM sequence: AGG
tatttcccaggcaagcaagc

SEQ ID NO: 102468 - DNA, 20 bp, Artificial Sequence
  Description of Artificial Sequence: Synthetic oligonucleotide
  Target: ATXN1; (+) strand; PAM type: NRG; PAM sequence: GGG
atttcccaggcaagcaagca

SEQ ID NO: 102469 - DNA, 20 bp, Artificial Sequence
  Description of Artificial Sequence: Synthetic oligonucleotide
  Target: ATXN1; (+) strand; PAM type: NRG; PAM sequence: GGG
tttcccaggcaagcaagcag

SEQ ID NO: 102470 - DNA, 20 bp, Artificial Sequence
  Description of Artificial Sequence: Synthetic oligonucleotide
  Target: ATXN1; (+) strand; PAM type: NRG; PAM sequence: CAG
ggcaagcaagcaggggacct

SEQ ID NO: 102471 - DNA, 20 bp, Artificial Sequence
  Description of Artificial Sequence: Synthetic oligonucleotide
  Target: ATXN1; (+) strand; PAM type: NRG; PAM sequence: AGG
gcaagcaagcaggggacctc

SEQ ID NO: 102472 - DNA, 20 bp, Artificial Sequence
  Description of Artificial Sequence: Synthetic oligonucleotide
  Target: ATXN1; (+) strand; PAM type: NRG; PAM sequence: CAG
caagcaggggacctcaggct

SEQ ID NO: 102473 - DNA, 20 bp, Artificial Sequence
  Description of Artificial Sequence: Synthetic oligonucleotide
  Target: ATXN1; (+) strand; PAM type: NRG; PAM sequence: CAG
gcaggggacctcaggctcag

SEQ ID NO: 102474 - DNA, 20 bp, Artificial Sequence
  Description of Artificial Sequence: Synthetic oligonucleotide
  Target: ATXN1; (+) strand; PAM type: NRG; PAM sequence: AAG
ggacctcaggctcagcagcc

SEQ ID NO: 102475 - DNA, 20 bp, Artificial Sequence
  Description of Artificial Sequence: Synthetic oligonucleotide
  Target: ATXN1; (+) strand; PAM type: NRG; PAM sequence: AAG
caggctcagcagccaagttc

SEQ ID NO: 102476 - DNA, 20 bp, Artificial Sequence
  Description of Artificial Sequence: Synthetic oligonucleotide
  Target: ATXN1; (+) strand; PAM type: NRG; PAM sequence: CAG
ccacccacccaattgtgatc

SEQ ID NO: 102477 - DNA, 20 bp, Artificial Sequence
  Description of Artificial Sequence: Synthetic oligonucleotide
  Target: ATXN1; (+) strand; PAM type: NRG; PAM sequence: AGG
cacccacccaattgtgatcc

SEQ ID NO: 102478 - DNA, 20 bp, Artificial Sequence
  Description of Artificial Sequence: Synthetic oligonucleotide
  Target: ATXN1; (+) strand; PAM type: NRG; PAM sequence: TAG
cccaattgtgatccaggcca

SEQ ID NO: 102479 - DNA, 20 bp, Artificial Sequence
  Description of Artificial Sequence: Synthetic oligonucleotide
  Target: ATXN1; (+) strand; PAM type: NRG; PAM sequence: AGG
ccaattgtgatccaggccat

SEQ ID NO: 102480 - DNA, 20 bp, Artificial Sequence
  Description of Artificial Sequence: Synthetic oligonucleotide
  Target: ATXN1; (+) strand; PAM type: NRG; PAM sequence: GAG
aattgtgatccaggccatag

SEQ ID NO: 102481 - DNA, 20 bp, Artificial Sequence
  Description of Artificial Sequence: Synthetic oligonucleotide
  Target: ATXN1; (+) strand; PAM type: NRG; PAM sequence: TGG
tgtgatccaggccataggag

SEQ ID NO: 102482 - DNA, 20 bp, Artificial Sequence
  Description of Artificial Sequence: Synthetic oligonucleotide
  Target: ATXN1; (+) strand; PAM type: NRG; PAM sequence: GAG
atccaggccataggagtggt

SEQ ID NO: 102483 - DNA, 20 bp, Artificial Sequence
  Description of Artificial Sequence: Synthetic oligonucleotide
  Target: ATXN1; (+) strand; PAM type: NRG; PAM sequence: CAG
ccataggagtggtgagactg

SEQ ID NO: 102484 - DNA, 20 bp, Artificial Sequence
  Description of Artificial Sequence: Synthetic oligonucleotide
  Target: ATXN1; (+) strand; PAM type: NRG; PAM sequence: AAG
taggagtggtgagactgcag

SEQ ID NO: 102485 - DNA, 20 bp, Artificial Sequence
  Description of Artificial Sequence: Synthetic oligonucleotide
  Target: ATXN1; (+) strand; PAM type: NRG; PAM sequence: AGG
aggagtggtgagactgcaga

SEQ ID NO: 102486 - DNA, 20 bp, Artificial Sequence
  Description of Artificial Sequence: Synthetic oligonucleotide
  Target: ATXN1; (+) strand; PAM type: NRG; PAM sequence: GAG
gagtggtgagactgcagaag

SEQ ID NO: 102487 - DNA, 20 bp, Artificial Sequence
  Description of Artificial Sequence: Synthetic oligonucleotide
  Target: ATXN1; (+) strand; PAM type: NRG; PAM sequence: TGG
gagactgcagaaggagcctc

SEQ ID NO: 102488 - DNA, 20 bp, Artificial Sequence
  Description of Artificial Sequence: Synthetic oligonucleotide
  Target: ATXN1; (+) strand; PAM type: NRG; PAM sequence: CAG
tgcagaaggagcctctggca

SEQ ID NO: 102489 - DNA, 20 bp, Artificial Sequence
  Description of Artificial Sequence: Synthetic oligonucleotide
  Target: ATXN1; (+) strand; PAM type: NRG; PAM sequence: AGG
gcagaaggagcctctggcac

SEQ ID NO: 102490 - DNA, 20 bp, Artificial Sequence
  Description of Artificial Sequence: Synthetic oligonucleotide
  Target: ATXN1; (+) strand; PAM type: NRG; PAM sequence: CGG
aaggagcctctggcacaggt

SEQ ID NO: 102491 - DNA, 20 bp, Artificial Sequence
  Description of Artificial Sequence: Synthetic oligonucleotide
  Target: ATXN1; (+) strand; PAM type: NRG; PAM sequence: GAG
ctctggcacaggtcggacgt

SEQ ID NO: 102492 - DNA, 20 bp, Artificial Sequence
  Description of Artificial Sequence: Synthetic oligonucleotide
  Target: ATXN1; (+) strand; PAM type: NRG; PAM sequence: AGG
tctggcacaggtcggacgtg

SEQ ID NO: 102493 - DNA, 20 bp, Artificial Sequence
  Description of Artificial Sequence: Synthetic oligonucleotide
  Target: ATXN1; (+) strand; PAM type: NRG; PAM sequence: GAG
caggtcggacgtgaggaact

SEQ ID NO: 102494 - DNA, 20 bp, Artificial Sequence
  Description of Artificial Sequence: Synthetic oligonucleotide
  Target: ATXN1; (+) strand; PAM type: NRG; PAM sequence: GAG
ggtcggacgtgaggaactga

SEQ ID NO: 102495 - DNA, 20 bp, Artificial Sequence
  Description of Artificial Sequence: Synthetic oligonucleotide
  Target: ATXN1; (+) strand; PAM type: NRG; PAM sequence: AAG
cactaacatgcttttgaaac

SEQ ID NO: 102496 - DNA, 20 bp, Artificial Sequence
  Description of Artificial Sequence: Synthetic oligonucleotide
  Target: ATXN1; (+) strand; PAM type: NRG; PAM sequence: TAG
tgaaacaagctctctccctc

SEQ ID NO: 102497 - DNA, 20 bp, Artificial Sequence
  Description of Artificial Sequence: Synthetic oligonucleotide
  Target: ATXN1; (+) strand; PAM type: NRG; PAM sequence: AAG
ctctctccctctagtgtcac

SEQ ID NO: 102498 - DNA, 20 bp, Artificial Sequence
  Description of Artificial Sequence: Synthetic oligonucleotide
  Target: ATXN1; (+) strand; PAM type: NRG; PAM sequence: AAG
tctccctctagtgtcacaag

SEQ ID NO: 102499 - DNA, 20 bp, Artificial Sequence
  Description of Artificial Sequence: Synthetic oligonucleotide
  Target: ATXN1; (+) strand; PAM type: NRG; PAM sequence: AAG
cctctagtgtcacaagaagc

SEQ ID NO: 102500 - DNA, 20 bp, Artificial Sequence
  Description of Artificial Sequence: Synthetic oligonucleotide
  Target: ATXN1; (+) strand; PAM type: NRG; PAM sequence: AAG
gtgtcacaagaagcaagttc

SEQ ID NO: 102501 - DNA, 20 bp, Artificial Sequence
  Description of Artificial Sequence: Synthetic oligonucleotide
  Target: ATXN1; (+) strand; PAM type: NRG; PAM sequence: TGG
gcaagttcaagcctgcaacc

SEQ ID NO: 102502 - DNA, 20 bp, Artificial Sequence
  Description of Artificial Sequence: Synthetic oligonucleotide
  Target: ATXN1; (+) strand; PAM type: NRG; PAM sequence: CAG
ttcaagcctgcaacctggca

SEQ ID NO: 102503 - DNA, 20 bp, Artificial Sequence
  Description of Artificial Sequence: Synthetic oligonucleotide
  Target: ATXN1; (+) strand; PAM type: NRG; PAM sequence: AGG
tcaagcctgcaacctggcac

SEQ ID NO: 102504 - DNA, 20 bp, Artificial Sequence
  Description of Artificial Sequence: Synthetic oligonucleotide
  Target: ATXN1; (+) strand; PAM type: NRG; PAM sequence: GAG
aacctggcacaggctcccct

SEQ ID NO: 102505 - DNA, 20 bp, Artificial Sequence
  Description of Artificial Sequence: Synthetic oligonucleotide
  Target: ATXN1; (+) strand; PAM type: NRG; PAM sequence: TGG
cacaggctcccctgagtccg

SEQ ID NO: 102506 - DNA, 20 bp, Artificial Sequence
  Description of Artificial Sequence: Synthetic oligonucleotide
  Target: ATXN1; (+) strand; PAM type: NRG; PAM sequence: CAG
aggctcccctgagtccgtgg

SEQ ID NO: 102507 - DNA, 20 bp, Artificial Sequence
  Description of Artificial Sequence: Synthetic oligonucleotide
  Target: ATXN1; (+) strand; PAM type: NRG; PAM sequence: CAG
tcccctgagtccgtggcagc

SEQ ID NO: 102508 - DNA, 20 bp, Artificial Sequence
  Description of Artificial Sequence: Synthetic oligonucleotide
  Target: ATXN1; (+) strand; PAM type: NRG; PAM sequence: CAG
cctgagtccgtggcagccag

SEQ ID NO: 102509 - DNA, 20 bp, Artificial Sequence
  Description of Artificial Sequence: Synthetic oligonucleotide
  Target: ATXN1; (+) strand; PAM type: NRG; PAM sequence: GAG
accacattttccttttcttt

SEQ ID NO: 102510 - DNA, 20 bp, Artificial Sequence
  Description of Artificial Sequence: Synthetic oligonucleotide
  Target: ATXN1; (+) strand; PAM type: NRG; PAM sequence: AGG
ccacattttccttttctttg

SEQ ID NO: 102511 - DNA, 20 bp, Artificial Sequence
  Description of Artificial Sequence: Synthetic oligonucleotide
  Target: ATXN1; (+) strand; PAM type: NRG; PAM sequence: AAG
attttccttttctttgaggc

SEQ ID NO: 102512 - DNA, 20 bp, Artificial Sequence
  Description of Artificial Sequence: Synthetic oligonucleotide
  Target: ATXN1; (+) strand; PAM type: NRG; PAM sequence: TGG
tctttgaggcaagaccttcc

SEQ ID NO: 102513 - DNA, 20 bp, Artificial Sequence
  Description of Artificial Sequence: Synthetic oligonucleotide
  Target: ATXN1; (+) strand; PAM type: NRG; PAM sequence: GGG
ctttgaggcaagaccttcct

SEQ ID NO: 102514 - DNA, 20 bp, Artificial Sequence
  Description of Artificial Sequence: Synthetic oligonucleotide
  Target: ATXN1; (+) strand; PAM type: NRG; PAM sequence: GGG
tttgaggcaagaccttcctg

SEQ ID NO: 102515 - DNA, 20 bp, Artificial Sequence
  Description of Artificial Sequence: Synthetic oligonucleotide
  Target: ATXN1; (+) strand; PAM type: NRG; PAM sequence: GGG
ttgaggcaagaccttcctgg

SEQ ID NO: 102516 - DNA, 20 bp, Artificial Sequence
  Description of Artificial Sequence: Synthetic oligonucleotide
  Target: ATXN1; (+) strand; PAM type: NRG; PAM sequence: TGG
aggcaagaccttcctggggg

SEQ ID NO: 102517 - DNA, 20 bp, Artificial Sequence
  Description of Artificial Sequence: Synthetic oligonucleotide
  Target: ATXN1; (+) strand; PAM type: NRG; PAM sequence: TGG
aagaccttcctgggggtggt

SEQ ID NO: 102518 - DNA, 20 bp, Artificial Sequence
  Description of Artificial Sequence: Synthetic oligonucleotide
  Target: ATXN1; (+) strand; PAM type: NRG; PAM sequence: GGG
agaccttcctgggggtggtt

SEQ ID NO: 102519 - DNA, 20 bp, Artificial Sequence
  Description of Artificial Sequence: Synthetic oligonucleotide
  Target: ATXN1; (+) strand; PAM type: NRG; PAM sequence: CAG
cttcctgggggtggttgggt

SEQ ID NO: 102520 - DNA, 20 bp, Artificial Sequence
  Description of Artificial Sequence: Synthetic oligonucleotide
  Target: ATXN1; (+) strand; PAM type: NRG; PAM sequence: AGG
ttcctgggggtggttgggtc

SEQ ID NO: 102521 - DNA, 20 bp, Artificial Sequence
  Description of Artificial Sequence: Synthetic oligonucleotide
  Target: ATXN1; (+) strand; PAM type: NRG; PAM sequence: GGG
tcctgggggtggttgggtca

SEQ ID NO: 102522 - DNA, 20 bp, Artificial Sequence
  Description of Artificial Sequence: Synthetic oligonucleotide
  Target: ATXN1; (+) strand; PAM type: NRG; PAM sequence: GGG
cctgggggtggttgggtcag

SEQ ID NO: 102523 - DNA, 20 bp, Artificial Sequence
  Description of Artificial Sequence: Synthetic oligonucleotide
  Target: ATXN1; (+) strand; PAM type: NRG; PAM sequence: CAG
gaatctgccactaccactgc

SEQ ID NO: 102524 - DNA, 20 bp, Artificial Sequence
  Description of Artificial Sequence: Synthetic oligonucleotide
  Target: ATXN1; (+) strand; PAM type: NRG; PAM sequence: TGG
ctgccactaccactgccagc

SEQ ID NO: 102525 - DNA, 20 bp, Artificial Sequence
  Description of Artificial Sequence: Synthetic oligonucleotide
  Target: ATXN1; (+) strand; PAM type: NRG; PAM sequence: GGG
tgccactaccactgccagct

SEQ ID NO: 102526 - DNA, 20 bp, Artificial Sequence
  Description of Artificial Sequence: Synthetic oligonucleotide
  Target: ATXN1; (+) strand; PAM type: NRG; PAM sequence: CAG
accactgccagctgggactg

SEQ ID NO: 102527 - DNA, 20 bp, Artificial Sequence
  Description of Artificial Sequence: Synthetic oligonucleotide
  Target: ATXN1; (+) strand; PAM type: NRG; PAM sequence: TGG
actgccagctgggactgcag

SEQ ID NO: 102528 - DNA, 20 bp, Artificial Sequence
  Description of Artificial Sequence: Synthetic oligonucleotide
  Target: ATXN1; (+) strand; PAM type: NRG; PAM sequence: GGG
ctgccagctgggactgcagt

SEQ ID NO: 102529 - DNA, 20 bp, Artificial Sequence
  Description of Artificial Sequence: Synthetic oligonucleotide
  Target: ATXN1; (+) strand; PAM type: NRG; PAM sequence: AAG
agctgggactgcagtgggtc

SEQ ID NO: 102530 - DNA, 20 bp, Artificial Sequence
  Description of Artificial Sequence: Synthetic oligonucleotide
  Target: ATXN1; (+) strand; PAM type: NRG; PAM sequence: AAG
ggactgcagtgggtcaagca

SEQ ID NO: 102531 - DNA, 20 bp, Artificial Sequence
  Description of Artificial Sequence: Synthetic oligonucleotide
  Target: ATXN1; (+) strand; PAM type: NRG; PAM sequence: AGG
gactgcagtgggtcaagcaa

SEQ ID NO: 102532 - DNA, 20 bp, Artificial Sequence
  Description of Artificial Sequence: Synthetic oligonucleotide
  Target: ATXN1; (+) strand; PAM type: NRG; PAM sequence: CAG
tgcagtgggtcaagcaaagg

SEQ ID NO: 102533 - DNA, 20 bp, Artificial Sequence
  Description of Artificial Sequence: Synthetic oligonucleotide
  Target: ATXN1; (+) strand; PAM type: NRG; PAM sequence: AGG
gcagtgggtcaagcaaaggc

SEQ ID NO: 102534 - DNA, 20 bp, Artificial Sequence
  Description of Artificial Sequence: Synthetic oligonucleotide
  Target: ATXN1; (+) strand; PAM type: NRG; PAM sequence: GAG
agtgggtcaagcaaaggcag

SEQ ID NO: 102535 - DNA, 20 bp, Artificial Sequence
  Description of Artificial Sequence: Synthetic oligonucleotide
  Target: ATXN1; (+) strand; PAM type: NRG; PAM sequence: AAG
gtcaagcaaaggcaggagaa

SEQ ID NO: 102536 - DNA, 20 bp, Artificial Sequence
  Description of Artificial Sequence: Synthetic oligonucleotide
  Target: ATXN1; (+) strand; PAM type: NRG; PAM sequence: CAG
aagcaaaggcaggagaaaag

SEQ ID NO: 102537 - DNA, 20 bp, Artificial Sequence
  Description of Artificial Sequence: Synthetic oligonucleotide
  Target: ATXN1; (+) strand; PAM type: NRG; PAM sequence: CAG
agccccactacttatattat

SEQ ID NO: 102538 - DNA, 20 bp, Artificial Sequence
  Description of Artificial Sequence: Synthetic oligonucleotide
  Target: ATXN1; (+) strand; PAM type: NRG; PAM sequence: TAG
tatattatcagcaccacgaa

SEQ ID NO: 102539 - DNA, 20 bp, Artificial Sequence
  Description of Artificial Sequence: Synthetic oligonucleotide
  Target: ATXN1; (+) strand; PAM type: NRG; PAM sequence: TAG
attatcagcaccacgaatag

SEQ ID NO: 102540 - DNA, 20 bp, Artificial Sequence
  Description of Artificial Sequence: Synthetic oligonucleotide
  Target: ATXN1; (+) strand; PAM type: NRG; PAM sequence: TAG
tttttgaccccatgcatcta

SEQ ID NO: 102541 - DNA, 20 bp, Artificial Sequence
  Description of Artificial Sequence: Synthetic oligonucleotide
  Target: ATXN1; (+) strand; PAM type: NRG; PAM sequence: TGG
ccatgcatctatagactttt

SEQ ID NO: 102542 - DNA, 20 bp, Artificial Sequence
  Description of Artificial Sequence: Synthetic oligonucleotide
  Target: ATXN1; (+) strand; PAM type: NRG; PAM sequence: GGG
catgcatctatagacttttt

SEQ ID NO: 102543 - DNA, 20 bp, Artificial Sequence
  Description of Artificial Sequence: Synthetic oligonucleotide
  Target: ATXN1; (+) strand; PAM type: NRG; PAM sequence: TGG
tctatagactttttgggcaa

SEQ ID NO: 102544 - DNA, 20 bp, Artificial Sequence
  Description of Artificial Sequence: Synthetic oligonucleotide
  Target: ATXN1; (+) strand; PAM type: NRG; PAM sequence: AAG
aatggatacgactatacttg

SEQ ID NO: 102545 - DNA, 20 bp, Artificial Sequence
  Description of Artificial Sequence: Synthetic oligonucleotide
  Target: ATXN1; (+) strand; PAM type: NRG; PAM sequence: TAG
tttaaatccacccaaaataa

SEQ ID NO: 102546 - DNA, 20 bp, Artificial Sequence
  Description of Artificial Sequence: Synthetic oligonucleotide
  Target: ATXN1; (+) strand; PAM type: NRG; PAM sequence: CGG
cccaaaataatagtctcatt

SEQ ID NO: 102547 - DNA, 20 bp, Artificial Sequence
  Description of Artificial Sequence: Synthetic oligonucleotide
  Target: ATXN1; (+) strand; PAM type: NRG; PAM sequence: GGG
ccaaaataatagtctcattc

SEQ ID NO: 102548 - DNA, 20 bp, Artificial Sequence
  Description of Artificial Sequence: Synthetic oligonucleotide
  Target: ATXN1; (+) strand; PAM type: NRG; PAM sequence: TGG
aaataatagtctcattcggg

SEQ ID NO: 102549 - DNA, 20 bp, Artificial Sequence
  Description of Artificial Sequence: Synthetic oligonucleotide
  Target: ATXN1; (+) strand; PAM type: NRG; PAM sequence: TGG
agtctcattcgggtggtcgc

SEQ ID NO: 102550 - DNA, 20 bp, Artificial Sequence
  Description of Artificial Sequence: Synthetic oligonucleotide
  Target: ATXN1; (+) strand; PAM type: NRG; PAM sequence: TGG
cattcgggtggtcgctggct

SEQ ID NO: 102551 - DNA, 20 bp, Artificial Sequence
  Description of Artificial Sequence: Synthetic oligonucleotide
  Target: ATXN1; (+) strand; PAM type: NRG; PAM sequence: GGG
attcgggtggtcgctggctt

SEQ ID NO: 102552 - DNA, 20 bp, Artificial Sequence
  Description of Artificial Sequence: Synthetic oligonucleotide
  Target: ATXN1; (+) strand; PAM type: NRG; PAM sequence: TAG
cgggtggtcgctggcttggg

SEQ ID NO: 102553 - DNA, 20 bp, Artificial Sequence
  Description of Artificial Sequence: Synthetic oligonucleotide
  Target: ATXN1; (+) strand; PAM type: NRG; PAM sequence: CAG
ggcttgggtagctctgcgtc

SEQ ID NO: 102554 - DNA, 20 bp, Artificial Sequence
  Description of Artificial Sequence: Synthetic oligonucleotide
  Target: ATXN1; (+) strand; PAM type: NRG; PAM sequence: TGG
ttgggtagctctgcgtccag

SEQ ID NO: 102555 - DNA, 20 bp, Artificial Sequence
  Description of Artificial Sequence: Synthetic oligonucleotide
  Target: ATXN1; (+) strand; PAM type: NRG; PAM sequence: GGG
tgggtagctctgcgtccagt

SEQ ID NO: 102556 - DNA, 20 bp, Artificial Sequence
  Description of Artificial Sequence: Synthetic oligonucleotide
  Target: ATXN1; (+) strand; PAM type: NRG; PAM sequence: GGG
gggtagctctgcgtccagtg

SEQ ID NO: 102557 - DNA, 20 bp, Artificial Sequence
  Description of Artificial Sequence: Synthetic oligonucleotide
  Target: ATXN1; (+) strand; PAM type: NRG; PAM sequence: GAG
gtagctctgcgtccagtggg

SEQ ID NO: 102558 - DNA, 20 bp, Artificial Sequence
  Description of Artificial Sequence: Synthetic oligonucleotide
  Target: ATXN1; (+) strand; PAM type: NRG; PAM sequence: AAG
tggggagttgttctttgatt

SEQ ID NO: 102559 - DNA, 20 bp, Artificial Sequence
  Description of Artificial Sequence: Synthetic oligonucleotide
  Target: ATXN1; (+) strand; PAM type: NRG; PAM sequence: AGG
ggggagttgttctttgatta

SEQ ID NO: 102560 - DNA, 20 bp, Artificial Sequence
  Description of Artificial Sequence: Synthetic oligonucleotide
  Target: ATXN1; (+) strand; PAM type: NRG; PAM sequence: GGG
gggagttgttctttgattaa

SEQ ID NO: 102561 - DNA, 20 bp, Artificial Sequence
  Description of Artificial Sequence: Synthetic oligonucleotide
  Target: ATXN1; (+) strand; PAM type: NRG; PAM sequence: AAG
ttctttgattaagggccttg

SEQ ID NO: 102562 - DNA, 20 bp, Artificial Sequence
  Description of Artificial Sequence: Synthetic oligonucleotide
  Target: ATXN1; (+) strand; PAM type: NRG; PAM sequence: AGG
tctttgattaagggccttga

SEQ ID NO: 102563 - DNA, 20 bp, Artificial Sequence
  Description of Artificial Sequence: Synthetic oligonucleotide
  Target: ATXN1; (+) strand; PAM type: NRG; PAM sequence: GGG
ctttgattaagggccttgaa

SEQ ID NO: 102564 - DNA, 20 bp, Artificial Sequence
  Description of Artificial Sequence: Synthetic oligonucleotide
  Target: ATXN1; (+) strand; PAM type: NRG; PAM sequence: GGG
tttgattaagggccttgaag

SEQ ID NO: 102565 - DNA, 20 bp, Artificial Sequence
  Description of Artificial Sequence: Synthetic oligonucleotide
  Target: ATXN1; (+) strand; PAM type: NRG; PAM sequence: GAG
tgattaagggccttgaaggg

SEQ ID NO: 102566 - DNA, 20 bp, Artificial Sequence
  Description of Artificial Sequence: Synthetic oligonucleotide
  Target: ATXN1; (+) strand; PAM type: NRG; PAM sequence: AGG
gattaagggccttgaagggg

SEQ ID NO: 102567 - DNA, 20 bp, Artificial Sequence
  Description of Artificial Sequence: Synthetic oligonucleotide
  Target: ATXN1; (+) strand; PAM type: NRG; PAM sequence: TGG
aagggccttgaaggggaggc

SEQ ID NO: 102568 - DNA, 20 bp, Artificial Sequence
  Description of Artificial Sequence: Synthetic oligonucleotide
  Target: ATXN1; (+) strand; PAM type: NRG; PAM sequence: AAG
gccttgaaggggaggctgga

SEQ ID NO: 102569 - DNA, 20 bp, Artificial Sequence
  Description of Artificial Sequence: Synthetic oligonucleotide
  Target: ATXN1; (+) strand; PAM type: NRG; PAM sequence: AAG
gaggctggaaagaattcctc

SEQ ID NO: 102570 - DNA, 20 bp, Artificial Sequence
  Description of Artificial Sequence: Synthetic oligonucleotide
  Target: ATXN1; (+) strand; PAM type: NRG; PAM sequence: CAG
aaagaattcctcaagacaca

SEQ ID NO: 102571 - DNA, 20 bp, Artificial Sequence
  Description of Artificial Sequence: Synthetic oligonucleotide
  Target: ATXN1; (+) strand; PAM type: NRG; PAM sequence: TGG
ctcaagacacacagctgcac

SEQ ID NO: 102572 - DNA, 20 bp, Artificial Sequence
  Description of Artificial Sequence: Synthetic oligonucleotide
  Target: ATXN1; (+) strand; PAM type: NRG; PAM sequence: TGG
ttctgctgaacttgtctgct

SEQ ID NO: 102573 - DNA, 20 bp, Artificial Sequence
  Description of Artificial Sequence: Synthetic oligonucleotide
  Target: ATXN1; (+) strand; PAM type: NRG; PAM sequence: TGG
gaacttgtctgcttggcacg

SEQ ID NO: 102574 - DNA, 20 bp, Artificial Sequence
  Description of Artificial Sequence: Synthetic oligonucleotide
  Target: ATXN1; (+) strand; PAM type: NRG; PAM sequence: AAG
tgtctgcttggcacgtggtt

SEQ ID NO: 102575 - DNA, 20 bp, Artificial Sequence
  Description of Artificial Sequence: Synthetic oligonucleotide
  Target: ATXN1; (+) strand; PAM type: NRG; PAM sequence: AAG
ttgctgtctcccttatccct

SEQ ID NO: 102576 - DNA, 20 bp, Artificial Sequence
  Description of Artificial Sequence: Synthetic oligonucleotide
  Target: ATXN1; (+) strand; PAM type: NRG; PAM sequence: TGG
ctgtctcccttatccctaag

SEQ ID NO: 102577 - DNA, 20 bp, Artificial Sequence
  Description of Artificial Sequence: Synthetic oligonucleotide
  Target: ATXN1; (+) strand; PAM type: NRG; PAM sequence: GGG
tgtctcccttatccctaagt

SEQ ID NO: 102578 - DNA, 20 bp, Artificial Sequence
  Description of Artificial Sequence: Synthetic oligonucleotide
  Target: ATXN1; (+) strand; PAM type: NRG; PAM sequence: GGG
gtctcccttatccctaagtg

SEQ ID NO: 102579 - DNA, 20 bp, Artificial Sequence
  Description of Artificial Sequence: Synthetic oligonucleotide
  Target: ATXN1; (+) strand; PAM type: NRG; PAM sequence: GAG
ccttatccctaagtggggct

SEQ ID NO: 102580 - DNA, 20 bp, Artificial Sequence
  Description of Artificial Sequence: Synthetic oligonucleotide
  Target: ATXN1; (+) strand; PAM type: NRG; PAM sequence: TGG
gctactacctgtccacataa

SEQ ID NO: 102581 - DNA, 20 bp, Artificial Sequence
  Description of Artificial Sequence: Synthetic oligonucleotide
  Target: ATXN1; (+) strand; PAM type: NRG; PAM sequence: GAG
tactacctgtccacataatg

SEQ ID NO: 102582 - DNA, 20 bp, Artificial Sequence
  Description of Artificial Sequence: Synthetic oligonucleotide
  Target: ATXN1; (+) strand; PAM type: NRG; PAM sequence: AGG
actacctgtccacataatgg

SEQ ID NO: 102583 - DNA, 20 bp, Artificial Sequence
  Description of Artificial Sequence: Synthetic oligonucleotide
  Target: ATXN1; (+) strand; PAM type: NRG; PAM sequence: GGG
ctacctgtccacataatgga

SEQ ID NO: 102584 - DNA, 20 bp, Artificial Sequence
  Description of Artificial Sequence: Synthetic oligonucleotide
  Target: ATXN1; (+) strand; PAM type: NRG; PAM sequence: CAG
ctgtccacataatggagggc

SEQ ID NO: 102585 - DNA, 20 bp, Artificial Sequence
  Description of Artificial Sequence: Synthetic oligonucleotide
  Target: ATXN1; (+) strand; PAM type: NRG; PAM sequence: AGG
tgtccacataatggagggcc

SEQ ID NO: 102586 - DNA, 20 bp, Artificial Sequence
  Description of Artificial Sequence: Synthetic oligonucleotide
  Target: ATXN1; (+) strand; PAM type: NRG; PAM sequence: TAG
ggccaggcttcatcaattct

SEQ ID NO: 102587 - DNA, 20 bp, Artificial Sequence
  Description of Artificial Sequence: Synthetic oligonucleotide
  Target: ATXN1; (+) strand; PAM type: NRG; PAM sequence: TGG
ttcatcaattcttagattcc

SEQ ID NO: 102588 - DNA, 20 bp, Artificial Sequence
  Description of Artificial Sequence: Synthetic oligonucleotide
  Target: ATXN1; (+) strand; PAM type: NRG; PAM sequence: TAG
gcttctgccattgctattcg

SEQ ID NO: 102589 - DNA, 20 bp, Artificial Sequence
  Description of Artificial Sequence: Synthetic oligonucleotide
  Target: ATXN1; (+) strand; PAM type: NRG; PAM sequence: GAG
ctgccattgctattcgtagt

SEQ ID NO: 102590 - DNA, 20 bp, Artificial Sequence
  Description of Artificial Sequence: Synthetic oligonucleotide
  Target: ATXN1; (+) strand; PAM type: NRG; PAM sequence: CAG
ccattgctattcgtagtgag

SEQ ID NO: 102591 - DNA, 20 bp, Artificial Sequence
  Description of Artificial Sequence: Synthetic oligonucleotide
  Target: ATXN1; (+) strand; PAM type: NRG; PAM sequence: CAG
tattcgtagtgagcagatga

SEQ ID NO: 102592 - DNA, 20 bp, Artificial Sequence
  Description of Artificial Sequence: Synthetic oligonucleotide
  Target: ATXN1; (+) strand; PAM type: NRG; PAM sequence: TGG
tagtgagcagatgacagttc

SEQ ID NO: 102593 - DNA, 20 bp, Artificial Sequence
  Description of Artificial Sequence: Synthetic oligonucleotide
  Target: ATXN1; (+) strand; PAM type: NRG; PAM sequence: GGG
agtgagcagatgacagttct

SEQ ID NO: 102594 - DNA, 20 bp, Artificial Sequence
  Description of Artificial Sequence: Synthetic oligonucleotide
  Target: ATXN1; (+) strand; PAM type: NRG; PAM sequence: GGG
gtgagcagatgacagttctg

SEQ ID NO: 102595 - DNA, 20 bp, Artificial Sequence
  Description of Artificial Sequence: Synthetic oligonucleotide
  Target: ATXN1; (+) strand; PAM type: NRG; PAM sequence: GGG
tgagcagatgacagttctgg

SEQ ID NO: 102596 - DNA, 20 bp, Artificial Sequence
  Description of Artificial Sequence: Synthetic oligonucleotide
  Target: ATXN1; (+) strand; PAM type: NRG; PAM sequence: CAG
agatgacagttctgggggtg

SEQ ID NO: 102597 - DNA, 20 bp, Artificial Sequence
  Description of Artificial Sequence: Synthetic oligonucleotide
  Target: ATXN1; (+) strand; PAM type: NRG; PAM sequence: TAG
gacagttctgggggtgcagt

SEQ ID NO: 102598 - DNA, 20 bp, Artificial Sequence
  Description of Artificial Sequence: Synthetic oligonucleotide
  Target: ATXN1; (+) strand; PAM type: NRG; PAM sequence: GAG
gttctgggggtgcagttagt

SEQ ID NO: 102599 - DNA, 20 bp, Artificial Sequence
  Description of Artificial Sequence: Synthetic oligonucleotide
  Target: ATXN1; (+) strand; PAM type: NRG; PAM sequence: TGG
ttagtgagctctgccacccc

SEQ ID NO: 102600 - DNA, 20 bp, Artificial Sequence
  Description of Artificial Sequence: Synthetic oligonucleotide
  Target: ATXN1; (+) strand; PAM type: NRG; PAM sequence: CAG
tctgccacccctggaaacat

SEQ ID NO: 102601 - DNA, 20 bp, Artificial Sequence
  Description of Artificial Sequence: Synthetic oligonucleotide
  Target: ATXN1; (+) strand; PAM type: NRG; PAM sequence: AGG
ctgccacccctggaaacatc

SEQ ID NO: 102602 - DNA, 20 bp, Artificial Sequence
  Description of Artificial Sequence: Synthetic oligonucleotide
  Target: ATXN1; (+) strand; PAM type: NRG; PAM sequence: CGG
ccctggaaacatcaggacat

SEQ ID NO: 102603 - DNA, 20 bp, Artificial Sequence
  Description of Artificial Sequence: Synthetic oligonucleotide
  Target: ATXN1; (+) strand; PAM type: NRG; PAM sequence: TGG
acatcaggacatcggccatg

SEQ ID NO: 102604 - DNA, 20 bp, Artificial Sequence
  Description of Artificial Sequence: Synthetic oligonucleotide
  Target: ATXN1; (+) strand; PAM type: NRG; PAM sequence: TGG
caggacatcggccatgtggc

SEQ ID NO: 102605 - DNA, 20 bp, Artificial Sequence
  Description of Artificial Sequence: Synthetic oligonucleotide
  Target: ATXN1; (+) strand; PAM type: NRG; PAM sequence: GGG
aggacatcggccatgtggct

SEQ ID NO: 102606 - DNA, 20 bp, Artificial Sequence
  Description of Artificial Sequence: Synthetic oligonucleotide
  Target: ATXN1; (+) strand; PAM type: NRG; PAM sequence: GGG
ggacatcggccatgtggctg

SEQ ID NO: 102607 - DNA, 20 bp, Artificial Sequence
  Description of Artificial Sequence: Synthetic oligonucleotide
  Target: ATXN1; (+) strand; PAM type: NRG; PAM sequence: TGG
gtggctggggtccccctgcg

SEQ ID NO: 102608 - DNA, 20 bp, Artificial Sequence
  Description of Artificial Sequence: Synthetic oligonucleotide
  Target: ATXN1; (+) strand; PAM type: NRG; PAM sequence: TGG
gggtccccctgcgtggctca

SEQ ID NO: 102609 - DNA, 20 bp, Artificial Sequence
  Description of Artificial Sequence: Synthetic oligonucleotide
  Target: ATXN1; (+) strand; PAM type: NRG; PAM sequence: GAG
ggctcatggcacatgtccgt

SEQ ID NO: 102610 - DNA, 20 bp, Artificial Sequence
  Description of Artificial Sequence: Synthetic oligonucleotide
  Target: ATXN1; (+) strand; PAM type: NRG; PAM sequence: GAG
ctcatggcacatgtccgtga

SEQ ID NO: 102611 - DNA, 20 bp, Artificial Sequence
  Description of Artificial Sequence: Synthetic oligonucleotide
  Target: ATXN1; (+) strand; PAM type: NRG; PAM sequence: TGG
tggcacatgtccgtgagagc

SEQ ID NO: 102612 - DNA, 20 bp, Artificial Sequence
  Description of Artificial Sequence: Synthetic oligonucleotide
  Target: ATXN1; (+) strand; PAM type: NRG; PAM sequence: GAG
gcacatgtccgtgagagctg

SEQ ID NO: 102613 - DNA, 20 bp, Artificial Sequence
  Description of Artificial Sequence: Synthetic oligonucleotide
  Target: ATXN1; (+) strand; PAM type: NRG; PAM sequence: AGG
cacatgtccgtgagagctgg

SEQ ID NO: 102614 - DNA, 20 bp, Artificial Sequence
  Description of Artificial Sequence: Synthetic oligonucleotide
  Target: ATXN1; (+) strand; PAM type: NRG; PAM sequence: CAG
gtccgtgagagctggaggat

SEQ ID NO: 102615 - DNA, 20 bp, Artificial Sequence
  Description of Artificial Sequence: Synthetic oligonucleotide
  Target: ATXN1; (+) strand; PAM type: NRG; PAM sequence: TGG
tgagagctggaggatcagcc

SEQ ID NO: 102616 - DNA, 20 bp, Artificial Sequence
  Description of Artificial Sequence: Synthetic oligonucleotide
  Target: ATXN1; (+) strand; PAM type: NRG; PAM sequence: GAG
gctggaggatcagcctggat

SEQ ID NO: 102617 - DNA, 20 bp, Artificial Sequence
  Description of Artificial Sequence: Synthetic oligonucleotide
  Target: ATXN1; (+) strand; PAM type: NRG; PAM sequence: AGG
ctggaggatcagcctggatg

SEQ ID NO: 102618 - DNA, 20 bp, Artificial Sequence
  Description of Artificial Sequence: Synthetic oligonucleotide
  Target: ATXN1; (+) strand; PAM type: NRG; PAM sequence: AAG
gaggatcagcctggatgagg

SEQ ID NO: 102619 - DNA, 20 bp, Artificial Sequence
  Description of Artificial Sequence: Synthetic oligonucleotide
  Target: ATXN1; (+) strand; PAM type: NRG; PAM sequence: AGG
aggatcagcctggatgagga

SEQ ID NO: 102620 - DNA, 20 bp, Artificial Sequence
  Description of Artificial Sequence: Synthetic oligonucleotide
  Target: ATXN1; (+) strand; PAM type: NRG; PAM sequence: GAG
gatcagcctggatgaggaag

SEQ ID NO: 102621 - DNA, 20 bp, Artificial Sequence
  Description of Artificial Sequence: Synthetic oligonucleotide
  Target: ATXN1; (+) strand; PAM type: NRG; PAM sequence: AGG
atcagcctggatgaggaagg

SEQ ID NO: 102622 - DNA, 20 bp, Artificial Sequence
  Description of Artificial Sequence: Synthetic oligonucleotide
  Target: ATXN1; (+) strand; PAM type: NRG; PAM sequence: GAG
cagcctggatgaggaaggag

SEQ ID NO: 102623 - DNA, 20 bp, Artificial Sequence
  Description of Artificial Sequence: Synthetic oligonucleotide
  Target: ATXN1; (+) strand; PAM type: NRG; PAM sequence: AGG
agcctggatgaggaaggagg

SEQ ID NO: 102624 - DNA, 20 bp, Artificial Sequence
  Description of Artificial Sequence: Synthetic oligonucleotide
  Target: ATXN1; (+) strand; PAM type: NRG; PAM sequence: GGG
gcctggatgaggaaggagga

SEQ ID NO: 102625 - DNA, 20 bp, Artificial Sequence
  Description of Artificial Sequence: Synthetic oligonucleotide
  Target: ATXN1; (+) strand; PAM type: NRG; PAM sequence: GGG
cctggatgaggaaggaggag

SEQ ID NO: 102626 - DNA, 20 bp, Artificial Sequence
  Description of Artificial Sequence: Synthetic oligonucleotide
  Target: ATXN1; (+) strand; PAM type: NRG; PAM sequence: CGG
ggatgaggaaggaggagggg

SEQ ID NO: 102627 - DNA, 20 bp, Artificial Sequence
  Description of Artificial Sequence: Synthetic oligonucleotide
  Target: ATXN1; (+) strand; PAM type: NRG; PAM sequence: GGG
gatgaggaaggaggaggggc

SEQ ID NO: 102628 - DNA, 20 bp, Artificial Sequence
  Description of Artificial Sequence: Synthetic oligonucleotide
  Target: ATXN1; (+) strand; PAM type: NRG; PAM sequence: GGG
atgaggaaggaggaggggcg

SEQ ID NO: 102629 - DNA, 20 bp, Artificial Sequence
  Description of Artificial Sequence: Synthetic oligonucleotide
  Target: ATXN1; (+) strand; PAM type: NRG; PAM sequence: CAG
aaggaggaggggcggggcca

SEQ ID NO: 102630 - DNA, 20 bp, Artificial Sequence
  Description of Artificial Sequence: Synthetic oligonucleotide
  Target: ATXN1; (+) strand; PAM type: NRG; PAM sequence: TGG
ggaggggcggggccacagct

SEQ ID NO: 102631 - DNA, 20 bp, Artificial Sequence
  Description of Artificial Sequence: Synthetic oligonucleotide
  Target: ATXN1; (+) strand; PAM type: NRG; PAM sequence: TGG
gggcggggccacagcttggc

SEQ ID NO: 102632 - DNA, 20 bp, Artificial Sequence
  Description of Artificial Sequence: Synthetic oligonucleotide
  Target: ATXN1; (+) strand; PAM type: NRG; PAM sequence: GGG
ggcggggccacagcttggct

SEQ ID NO: 102633 - DNA, 20 bp, Artificial Sequence
  Description of Artificial Sequence: Synthetic oligonucleotide
  Target: ATXN1; (+) strand; PAM type: NRG; PAM sequence: TAG
cagcttggctgggccatccc

SEQ ID NO: 102634 - DNA, 20 bp, Artificial Sequence
  Description of Artificial Sequence: Synthetic oligonucleotide
  Target: ATXN1; (+) strand; PAM type: NRG; PAM sequence: AAG
cttggctgggccatccctag

SEQ ID NO: 102635 - DNA, 20 bp, Artificial Sequence
  Description of Artificial Sequence: Synthetic oligonucleotide
  Target: ATXN1; (+) strand; PAM type: NRG; PAM sequence: CGG
gctgggccatccctagaagc

SEQ ID NO: 102636 - DNA, 20 bp, Artificial Sequence
  Description of Artificial Sequence: Synthetic oligonucleotide
  Target: ATXN1; (+) strand; PAM type: NRG; PAM sequence: TGG
tccctagaagccggctcaca

SEQ ID NO: 102637 - DNA, 20 bp, Artificial Sequence
  Description of Artificial Sequence: Synthetic oligonucleotide
  Target: ATXN1; (+) strand; PAM type: NRG; PAM sequence: CAG
ctcacatggaaaacgcgctg

SEQ ID NO: 102638 - DNA, 20 bp, Artificial Sequence
  Description of Artificial Sequence: Synthetic oligonucleotide
  Target: ATXN1; (+) strand; PAM type: NRG; PAM sequence: TGG
acatggaaaacgcgctgcag

SEQ ID NO: 102639 - DNA, 20 bp, Artificial Sequence
  Description of Artificial Sequence: Synthetic oligonucleotide
  Target: ATXN1; (+) strand; PAM type: NRG; PAM sequence: TAG
aacgcgctgcagtggctgtg

SEQ ID NO: 102640 - DNA, 20 bp, Artificial Sequence
  Description of Artificial Sequence: Synthetic oligonucleotide
  Target: ATXN1; (+) strand; PAM type: NRG; PAM sequence: CAG
cgctgcagtggctgtgtagc

SEQ ID NO: 102641 - DNA, 20 bp, Artificial Sequence
  Description of Artificial Sequence: Synthetic oligonucleotide
  Target: ATXN1; (+) strand; PAM type: NRG; PAM sequence: TGG
ggctgtgtagccagtgtctc

SEQ ID NO: 102642 - DNA, 20 bp, Artificial Sequence
  Description of Artificial Sequence: Synthetic oligonucleotide
  Target: ATXN1; (+) strand; PAM type: NRG; PAM sequence: CGG
tgtgtagccagtgtctctgg

SEQ ID NO: 102643 - DNA, 20 bp, Artificial Sequence
  Description of Artificial Sequence: Synthetic oligonucleotide
  Target: ATXN1; (+) strand; PAM type: NRG; PAM sequence: CGG
ctctggcggcctgcccatgc

SEQ ID NO: 102644 - DNA, 20 bp, Artificial Sequence
  Description of Artificial Sequence: Synthetic oligonucleotide
  Target: ATXN1; (+) strand; PAM type: NRG; PAM sequence: TGG
cctgcccatgccggaattcc

SEQ ID NO: 102645 - DNA, 20 bp, Artificial Sequence
  Description of Artificial Sequence: Synthetic oligonucleotide
  Target: ATXN1; (+) strand; PAM type: NRG; PAM sequence: AAG
cccatgccggaattcctgga

SEQ ID NO: 102646 - DNA, 20 bp, Artificial Sequence
  Description of Artificial Sequence: Synthetic oligonucleotide
  Target: ATXN1; (+) strand; PAM type: NRG; PAM sequence: AGG
ccatgccggaattcctggaa

SEQ ID NO: 102647 - DNA, 20 bp, Artificial Sequence
  Description of Artificial Sequence: Synthetic oligonucleotide
  Target: ATXN1; (+) strand; PAM type: NRG; PAM sequence: AAG
cggaattcctggaaaggctc

SEQ ID NO: 102648 - DNA, 20 bp, Artificial Sequence
  Description of Artificial Sequence: Synthetic oligonucleotide
  Target: ATXN1; (+) strand; PAM type: NRG; PAM sequence: TGG
attcctggaaaggctcaaga

SEQ ID NO: 102649 - DNA, 20 bp, Artificial Sequence
  Description of Artificial Sequence: Synthetic oligonucleotide
  Target: ATXN1; (+) strand; PAM type: NRG; PAM sequence: TGG
aagatggaaaaataaccatc

SEQ ID NO: 102650 - DNA, 20 bp, Artificial Sequence
  Description of Artificial Sequence: Synthetic oligonucleotide
  Target: ATXN1; (+) strand; PAM type: NRG; PAM sequence: AAG
aaaaataaccatctggatcc

SEQ ID NO: 102651 - DNA, 20 bp, Artificial Sequence
  Description of Artificial Sequence: Synthetic oligonucleotide
  Target: ATXN1; (+) strand; PAM type: NRG; PAM sequence: TGG
ataaccatctggatccaagc

SEQ ID NO: 102652 - DNA, 20 bp, Artificial Sequence
  Description of Artificial Sequence: Synthetic oligonucleotide
  Target: ATXN1; (+) strand; PAM type: NRG; PAM sequence: CAG
gtcccaaatgaattgtctga

SEQ ID NO: 102653 - DNA, 20 bp, Artificial Sequence
  Description of Artificial Sequence: Synthetic oligonucleotide
  Target: ATXN1; (+) strand; PAM type: NRG; PAM sequence: GAG
cccaaatgaattgtctgaca

SEQ ID NO: 102654 - DNA, 20 bp, Artificial Sequence
  Description of Artificial Sequence: Synthetic oligonucleotide
  Target: ATXN1; (+) strand; PAM type: NRG; PAM sequence: AGG
ccaaatgaattgtctgacag

SEQ ID NO: 102655 - DNA, 20 bp, Artificial Sequence
  Description of Artificial Sequence: Synthetic oligonucleotide
  Target: ATXN1; (+) strand; PAM type: NRG; PAM sequence: GAG
tgaattgtctgacagaggtt

SEQ ID NO: 102656 - DNA, 20 bp, Artificial Sequence
  Description of Artificial Sequence: Synthetic oligonucleotide
  Target: ATXN1; (+) strand; PAM type: NRG; PAM sequence: TGG
ttgtctgacagaggttgagt

SEQ ID NO: 102657 - DNA, 20 bp, Artificial Sequence
  Description of Artificial Sequence: Synthetic oligonucleotide
  Target: ATXN1; (+) strand; PAM type: NRG; PAM sequence: GAG
gtctgacagaggttgagttg

SEQ ID NO: 102658 - DNA, 20 bp, Artificial Sequence
  Description of Artificial Sequence: Synthetic oligonucleotide
  Target: ATXN1; (+) strand; PAM type: NRG; PAM sequence: AAG
gaggttgagttggagttttt

SEQ ID NO: 102659 - DNA, 20 bp, Artificial Sequence
  Description of Artificial Sequence: Synthetic oligonucleotide
  Target: ATXN1; (+) strand; PAM type: NRG; PAM sequence: AAG
tgagttggagtttttaagaa

SEQ ID NO: 102660 - DNA, 20 bp, Artificial Sequence
  Description of Artificial Sequence: Synthetic oligonucleotide
  Target: ATXN1; (+) strand; PAM type: NRG; PAM sequence: TGG
ttggagtttttaagaaaagc

SEQ ID NO: 102661 - DNA, 20 bp, Artificial Sequence
  Description of Artificial Sequence: Synthetic oligonucleotide
  Target: ATXN1; (+) strand; PAM type: NRG; PAM sequence: AAG
gctggaaatgcctttctgtc

SEQ ID NO: 102662 - DNA, 20 bp, Artificial Sequence
  Description of Artificial Sequence: Synthetic oligonucleotide
  Target: ATXN1; (+) strand; PAM type: NRG; PAM sequence: CAG
agacctttcctgattcaata

SEQ ID NO: 102663 - DNA, 20 bp, Artificial Sequence
  Description of Artificial Sequence: Synthetic oligonucleotide
  Target: ATXN1; (+) strand; PAM type: NRG; PAM sequence: AAG
cctttcctgattcaatacag

SEQ ID NO: 102664 - DNA, 20 bp, Artificial Sequence
  Description of Artificial Sequence: Synthetic oligonucleotide
  Target: ATXN1; (+) strand; PAM type: NRG; PAM sequence: AAG
gcaaatacttttttgcttta

SEQ ID NO: 102665 - DNA, 20 bp, Artificial Sequence
  Description of Artificial Sequence: Synthetic oligonucleotide
  Target: ATXN1; (+) strand; PAM type: NRG; PAM sequence: TAG
tacttttttgctttaaagcg

SEQ ID NO: 102666 - DNA, 20 bp, Artificial Sequence
  Description of Artificial Sequence: Synthetic oligonucleotide
  Target: ATXN1; (+) strand; PAM type: NRG; PAM sequence: CAG
ctttaaagcgtagtgcattc

SEQ ID NO: 102667 - DNA, 20 bp, Artificial Sequence
  Description of Artificial Sequence: Synthetic oligonucleotide
  Target: ATXN1; (+) strand; PAM type: NRG; PAM sequence: AGG
tttaaagcgtagtgcattcc

SEQ ID NO: 102668 - DNA, 20 bp, Artificial Sequence
  Description of Artificial Sequence: Synthetic oligonucleotide
  Target: ATXN1; (+) strand; PAM type: NRG; PAM sequence: TAG
aagcgtagtgcattccaggt

SEQ ID NO: 102669 - DNA, 20 bp, Artificial Sequence
  Description of Artificial Sequence: Synthetic oligonucleotide
  Target: ATXN1; (+) strand; PAM type: NRG; PAM sequence: CGG
tgcattccaggttagctacc

SEQ ID NO: 102670 - DNA, 20 bp, Artificial Sequence
  Description of Artificial Sequence: Synthetic oligonucleotide
  Target: ATXN1; (+) strand; PAM type: NRG; PAM sequence: GGG
gcattccaggttagctaccc

SEQ ID NO: 102671 - DNA, 20 bp, Artificial Sequence
  Description of Artificial Sequence: Synthetic oligonucleotide
  Target: ATXN1; (+) strand; PAM type: NRG; PAM sequence: GGG
cattccaggttagctacccg

SEQ ID NO: 102672 - DNA, 20 bp, Artificial Sequence
  Description of Artificial Sequence: Synthetic oligonucleotide
  Target: ATXN1; (+) strand; PAM type: NRG; PAM sequence: GGG
attccaggttagctacccgg

SEQ ID NO: 102673 - DNA, 20 bp, Artificial Sequence
  Description of Artificial Sequence: Synthetic oligonucleotide
  Target: ATXN1; (+) strand; PAM type: NRG; PAM sequence: TGG
tttctgtttatccaccactc

SEQ ID NO: 102674 - DNA, 20 bp, Artificial Sequence
  Description of Artificial Sequence: Synthetic oligonucleotide
  Target: ATXN1; (+) strand; PAM type: NRG; PAM sequence: AAG
tttatccaccactctggttg

SEQ ID NO: 102675 - DNA, 20 bp, Artificial Sequence
  Description of Artificial Sequence: Synthetic oligonucleotide
  Target: ATXN1; (+) strand; PAM type: NRG; PAM sequence: AGG
ttatccaccactctggttga

SEQ ID NO: 102676 - DNA, 20 bp, Artificial Sequence
  Description of Artificial Sequence: Synthetic oligonucleotide
  Target: ATXN1; (+) strand; PAM type: NRG; PAM sequence: TGG
ccaccactctggttgaaggc

SEQ ID NO: 102677 - DNA, 20 bp, Artificial Sequence
  Description of Artificial Sequence: Synthetic oligonucleotide
  Target: ATXN1; (+) strand; PAM type: NRG; PAM sequence: GGG
caccactctggttgaaggct

SEQ ID NO: 102678 - DNA, 20 bp, Artificial Sequence
  Description of Artificial Sequence: Synthetic oligonucleotide
  Target: ATXN1; (+) strand; PAM type: NRG; PAM sequence: CAG
ctctggttgaaggctgggaa

SEQ ID NO: 102679 - DNA, 20 bp, Artificial Sequence
  Description of Artificial Sequence: Synthetic oligonucleotide
  Target: ATXN1; (+) strand; PAM type: NRG; PAM sequence: CAG
gaaggctgggaacagttaca

SEQ ID NO: 102680 - DNA, 20 bp, Artificial Sequence
  Description of Artificial Sequence: Synthetic oligonucleotide
  Target: ATXN1; (+) strand; PAM type: NRG; PAM sequence: TGG
cagatgctttccacgctgcc

SEQ ID NO: 102681 - DNA, 20 bp, Artificial Sequence
  Description of Artificial Sequence: Synthetic oligonucleotide
  Target: ATXN1; (+) strand; PAM type: NRG; PAM sequence: GAG
gatgctttccacgctgcctg

SEQ ID NO: 102682 - DNA, 20 bp, Artificial Sequence
  Description of Artificial Sequence: Synthetic oligonucleotide
  Target: ATXN1; (+) strand; PAM type: NRG; PAM sequence: TAG
ctttccacgctgcctggagt

SEQ ID NO: 102683 - DNA, 20 bp, Artificial Sequence
  Description of Artificial Sequence: Synthetic oligonucleotide
  Target: ATXN1; (+) strand; PAM type: NRG; PAM sequence: TGG
tccacgctgcctggagttag

SEQ ID NO: 102684 - DNA, 20 bp, Artificial Sequence
  Description of Artificial Sequence: Synthetic oligonucleotide
  Target: ATXN1; (+) strand; PAM type: NRG; PAM sequence: CAG
ggagttagtggttctcatcc

SEQ ID NO: 102685 - DNA, 20 bp, Artificial Sequence
  Description of Artificial Sequence: Synthetic oligonucleotide
  Target: ATXN1; (+) strand; PAM type: NRG; PAM sequence: CAG
tagtggttctcatcccagtc

SEQ ID NO: 102686 - DNA, 20 bp, Artificial Sequence
  Description of Artificial Sequence: Synthetic oligonucleotide
  Target: ATXN1; (+) strand; PAM type: NRG; PAM sequence: AAG
gtccagactaacttgtttca

SEQ ID NO: 102687 - DNA, 20 bp, Artificial Sequence
  Description of Artificial Sequence: Synthetic oligonucleotide
  Target: ATXN1; (+) strand; PAM type: NRG; PAM sequence: GAG
agactaacttgtttcaaagt

SEQ ID NO: 102688 - DNA, 20 bp, Artificial Sequence
  Description of Artificial Sequence: Synthetic oligonucleotide
  Target: ATXN1; (+) strand; PAM type: NRG; PAM sequence: GAG
actaacttgtttcaaagtga

SEQ ID NO: 102689 - DNA, 20 bp, Artificial Sequence
  Description of Artificial Sequence: Synthetic oligonucleotide
  Target: ATXN1; (+) strand; PAM type: NRG; PAM sequence: AGG
ctaacttgtttcaaagtgag

SEQ ID NO: 102690 - DNA, 20 bp, Artificial Sequence
  Description of Artificial Sequence: Synthetic oligonucleotide
  Target: ATXN1; (+) strand; PAM type: NRG; PAM sequence: AAG
acttgtttcaaagtgagagg

SEQ ID NO: 102691 - DNA, 20 bp, Artificial Sequence
  Description of Artificial Sequence: Synthetic oligonucleotide
  Target: ATXN1; (+) strand; PAM type: NRG; PAM sequence: GAG
gtttcaaagtgagaggaagt

SEQ ID NO: 102692 - DNA, 20 bp, Artificial Sequence
  Description of Artificial Sequence: Synthetic oligonucleotide
  Target: ATXN1; (+) strand; PAM type: NRG; PAM sequence: AAG
cctcttcattatcttatttc

SEQ ID NO: 102693 - DNA, 20 bp, Artificial Sequence
  Description of Artificial Sequence: Synthetic oligonucleotide
  Target: ATXN1; (+) strand; PAM type: NRG; PAM sequence: AGG
ctcttcattatcttatttca

SEQ ID NO: 102694 - DNA, 20 bp, Artificial Sequence
  Description of Artificial Sequence: Synthetic oligonucleotide
  Target: ATXN1; (+) strand; PAM type: NRG; PAM sequence: AAG
cttatttcaaggactgatgc

SEQ ID NO: 102695 - DNA, 20 bp, Artificial Sequence
  Description of Artificial Sequence: Synthetic oligonucleotide
  Target: ATXN1; (+) strand; PAM type: NRG; PAM sequence: AAG
atttcaaggactgatgcaag

SEQ ID NO: 102696 - DNA, 20 bp, Artificial Sequence
  Description of Artificial Sequence: Synthetic oligonucleotide
  Target: ATXN1; (+) strand; PAM type: NRG; PAM sequence: AAG
gactgatgcaagaagatgaa

SEQ ID NO: 102697 - DNA, 20 bp, Artificial Sequence
  Description of Artificial Sequence: Synthetic oligonucleotide
  Target: ATXN1; (+) strand; PAM type: NRG; PAM sequence: TGG
tgcaagaagatgaaaagtat

SEQ ID NO: 102698 - DNA, 20 bp, Artificial Sequence
  Description of Artificial Sequence: Synthetic oligonucleotide
  Target: ATXN1; (+) strand; PAM type: NRG; PAM sequence: AAG
gaagatgaaaagtattggcc

SEQ ID NO: 102699 - DNA, 20 bp, Artificial Sequence
  Description of Artificial Sequence: Synthetic oligonucleotide
  Target: ATXN1; (+) strand; PAM type: NRG; PAM sequence: AGG
aagatgaaaagtattggcca

SEQ ID NO: 102700 - DNA, 20 bp, Artificial Sequence
  Description of Artificial Sequence: Synthetic oligonucleotide
  Target: ATXN1; (+) strand; PAM type: NRG; PAM sequence: CAG
aagtattggccaaggtaaca

SEQ ID NO: 102701 - DNA, 20 bp, Artificial Sequence
  Description of Artificial Sequence: Synthetic oligonucleotide
  Target: ATXN1; (+) strand; PAM type: NRG; PAM sequence: AAG
attggccaaggtaacacagt

SEQ ID NO: 102702 - DNA, 20 bp, Artificial Sequence
  Description of Artificial Sequence: Synthetic oligonucleotide
  Target: ATXN1; (+) strand; PAM type: NRG; PAM sequence: TGG
caaggtaacacagtaagaac

SEQ ID NO: 102703 - DNA, 20 bp, Artificial Sequence
  Description of Artificial Sequence: Synthetic oligonucleotide
  Target: ATXN1; (+) strand; PAM type: NRG; PAM sequence: GGG
aaggtaacacagtaagaact

SEQ ID NO: 102704 - DNA, 20 bp, Artificial Sequence
  Description of Artificial Sequence: Synthetic oligonucleotide
  Target: ATXN1; (+) strand; PAM type: NRG; PAM sequence: GGG
aggtaacacagtaagaactg

SEQ ID NO: 102705 - DNA, 20 bp, Artificial Sequence
  Description of Artificial Sequence: Synthetic oligonucleotide
  Target: ATXN1; (+) strand; PAM type: NRG; PAM sequence: CAG
aacacagtaagaactggggt

SEQ ID NO: 102706 - DNA, 20 bp, Artificial Sequence
  Description of Artificial Sequence: Synthetic oligonucleotide
  Target: ATXN1; (+) strand; PAM type: NRG; PAM sequence: AGG
acacagtaagaactggggtc

SEQ ID NO: 102707 - DNA, 20 bp, Artificial Sequence
  Description of Artificial Sequence: Synthetic oligonucleotide
  Target: ATXN1; (+) strand; PAM type: NRG; PAM sequence: GAG
acagtaagaactggggtcag

SEQ ID NO: 102708 - DNA, 20 bp, Artificial Sequence
  Description of Artificial Sequence: Synthetic oligonucleotide
  Target: ATXN1; (+) strand; PAM type: NRG; PAM sequence: AGG
cagtaagaactggggtcagg

SEQ ID NO: 102709 - DNA, 20 bp, Artificial Sequence
  Description of Artificial Sequence: Synthetic oligonucleotide
  Target: ATXN1; (+) strand; PAM type: NRG; PAM sequence: GAG
agaactggggtcaggaggat

SEQ ID NO: 102710 - DNA, 20 bp, Artificial Sequence
  Description of Artificial Sequence: Synthetic oligonucleotide
  Target: ATXN1; (+) strand; PAM type: NRG; PAM sequence: TAG
gtttcttaccaccactgtga

SEQ ID NO: 102711 - DNA, 20 bp, Artificial Sequence
  Description of Artificial Sequence: Synthetic oligonucleotide
  Target: ATXN1; (+) strand; PAM type: NRG; PAM sequence: AAG
atctcactacccgatgcatg

SEQ ID NO: 102712 - DNA, 20 bp, Artificial Sequence
  Description of Artificial Sequence: Synthetic oligonucleotide
  Target: ATXN1; (+) strand; PAM type: NRG; PAM sequence: TAG
ttcacatccactgtcctatt

SEQ ID NO: 102713 - DNA, 20 bp, Artificial Sequence
  Description of Artificial Sequence: Synthetic oligonucleotide
  Target: ATXN1; (+) strand; PAM type: NRG; PAM sequence: AAG
actgtcctatttagaatatc

SEQ ID NO: 102714 - DNA, 20 bp, Artificial Sequence
  Description of Artificial Sequence: Synthetic oligonucleotide
  Target: ATXN1; (+) strand; PAM type: NRG; PAM sequence: TAG
attactaacaatgatgataa

SEQ ID NO: 102715 - DNA, 20 bp, Artificial Sequence
  Description of Artificial Sequence: Synthetic oligonucleotide
  Target: ATXN1; (+) strand; PAM type: NRG; PAM sequence: AAG
attccactgctattactact

SEQ ID NO: 102716 - DNA, 20 bp, Artificial Sequence
  Description of Artificial Sequence: Synthetic oligonucleotide
  Target: ATXN1; (+) strand; PAM type: NRG; PAM sequence: AGG
ttccactgctattactacta

SEQ ID NO: 102717 - DNA, 20 bp, Artificial Sequence
  Description of Artificial Sequence: Synthetic oligonucleotide
  Target: ATXN1; (+) strand; PAM type: NRG; PAM sequence: CAG
ctattactactaaggacaca

SEQ ID NO: 102718 - DNA, 20 bp, Artificial Sequence
  Description of Artificial Sequence: Synthetic oligonucleotide
  Target: ATXN1; (+) strand; PAM type: NRG; PAM sequence: TAG
actaaggacacacagaattg

SEQ ID NO: 102719 - DNA, 20 bp, Artificial Sequence
  Description of Artificial Sequence: Synthetic oligonucleotide
  Target: ATXN1; (+) strand; PAM type: NRG; PAM sequence: TAG
aggacacacagaattgtagt

SEQ ID NO: 102720 - DNA, 20 bp, Artificial Sequence
  Description of Artificial Sequence: Synthetic oligonucleotide
  Target: ATXN1; (+) strand; PAM type: NRG; PAM sequence: GAG
gacacacagaattgtagtta

SEQ ID NO: 102721 - DNA, 20 bp, Artificial Sequence
  Description of Artificial Sequence: Synthetic oligonucleotide
  Target: ATXN1; (+) strand; PAM type: NRG; PAM sequence: TGG
acacagaattgtagttagag

SEQ ID NO: 102722 - DNA, 20 bp, Artificial Sequence
  Description of Artificial Sequence: Synthetic oligonucleotide
  Target: ATXN1; (+) strand; PAM type: NRG; PAM sequence: GGG
cacagaattgtagttagagt

SEQ ID NO: 102723 - DNA, 20 bp, Artificial Sequence
  Description of Artificial Sequence: Synthetic oligonucleotide
  Target: ATXN1; (+) strand; PAM type: NRG; PAM sequence: AAG
gttagagtgggctacgccgt

SEQ ID NO: 102724 - DNA, 20 bp, Artificial Sequence
  Description of Artificial Sequence: Synthetic oligonucleotide
  Target: ATXN1; (+) strand; PAM type: NRG; PAM sequence: AGG
ttagagtgggctacgccgta

SEQ ID NO: 102725 - DNA, 20 bp, Artificial Sequence
  Description of Artificial Sequence: Synthetic oligonucleotide
  Target: ATXN1; (+) strand; PAM type: NRG; PAM sequence: TAG
gagtgggctacgccgtaagg

SEQ ID NO: 102726 - DNA, 20 bp, Artificial Sequence
  Description of Artificial Sequence: Synthetic oligonucleotide
  Target: ATXN1; (+) strand; PAM type: NRG; PAM sequence: GAG
gtgggctacgccgtaaggta

SEQ ID NO: 102727 - DNA, 20 bp, Artificial Sequence
  Description of Artificial Sequence: Synthetic oligonucleotide
  Target: ATXN1; (+) strand; PAM type: NRG; PAM sequence: CAG
ctacgccgtaaggtagagaa

SEQ ID NO: 102728 - DNA, 20 bp, Artificial Sequence
  Description of Artificial Sequence: Synthetic oligonucleotide
  Target: ATXN1; (+) strand; PAM type: NRG; PAM sequence: AGG
tacgccgtaaggtagagaac

SEQ ID NO: 102729 - DNA, 20 bp, Artificial Sequence
  Description of Artificial Sequence: Synthetic oligonucleotide
  Target: ATXN1; (+) strand; PAM type: NRG; PAM sequence: TGG
tagagaacaggttcaaacct

SEQ ID NO: 102730 - DNA, 20 bp, Artificial Sequence
  Description of Artificial Sequence: Synthetic oligonucleotide
  Target: ATXN1; (+) strand; PAM type: NRG; PAM sequence: TGG
catttttaaaaatataattt

SEQ ID NO: 102731 - DNA, 20 bp, Artificial Sequence
  Description of Artificial Sequence: Synthetic oligonucleotide
  Target: ATXN1; (+) strand; PAM type: NRG; PAM sequence: CGG
tttaaaaatataattttggc

SEQ ID NO: 102732 - DNA, 20 bp, Artificial Sequence
  Description of Artificial Sequence: Synthetic oligonucleotide
  Target: ATXN1; (+) strand; PAM type: NRG; PAM sequence: GGG
ttaaaaatataattttggcc

SEQ ID NO: 102733 - DNA, 20 bp, Artificial Sequence
  Description of Artificial Sequence: Synthetic oligonucleotide
  Target: ATXN1; (+) strand; PAM type: NRG; PAM sequence: TGG
aatataattttggccgggcg

SEQ ID NO: 102734 - DNA, 20 bp, Artificial Sequence
  Description of Artificial Sequence: Synthetic oligonucleotide
  Target: ATXN1; (+) strand; PAM type: NRG; PAM sequence: TGG
ataattttggccgggcgtgg

SEQ ID NO: 102735 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgcaaacc

SEQ ID NO: 102736 - DNA, 20 bp, Artificial Sequence
  Description of Artificial Sequence: Synthetic oligonucleotide
  Target: ATXN1; (+) strand; PAM type: NRG; PAM sequence: TAG
tgcctgcaaacccagcactt

SEQ ID NO: 102737 - DNA, 20 bp, Artificial Sequence
  Description of Artificial Sequence: Synthetic oligonucleotide
  Target: ATXN1; (+) strand; PAM type: NRG; PAM sequence: AGG
gcctgcaaacccagcacttt

SEQ ID NO: 102738 - DNA, 20 bp, Artificial Sequence
  Description of Artificial Sequence: Synthetic oligonucleotide
  Target: ATXN1; (+) strand; PAM type: NRG; PAM sequence: GAG
ctgcaaacccagcactttag

SEQ ID NO: 102739 - DNA, 20 bp, Artificial Sequence
  Description of Artificial Sequence: Synthetic oligonucleotide
  Target: ATXN1; (+) strand; PAM type: NRG; PAM sequence: AGG
tgcaaacccagcactttagg

SEQ ID NO: 102740 - DNA, 20 bp, Artificial Sequence
  Description of Artificial Sequence: Synthetic oligonucleotide
  Target: ATXN1; (+) strand; PAM type: NRG; PAM sequence: GAG
acccagcactttaggaggct

SEQ ID NO: 102741 - DNA, 20 bp, Artificial Sequence
  Description of Artificial Sequence: Synthetic oligonucleotide
  Target: ATXN1; (+) strand; PAM type: NRG; PAM sequence: AGG
cccagcactttaggaggctg

SEQ ID NO: 102742 - DNA, 20 bp, Artificial Sequence
  Description of Artificial Sequence: Synthetic oligonucleotide
  Target: ATXN1; (+) strand; PAM type: NRG; PAM sequence: CGG
agcactttaggaggctgagg

SEQ ID NO: 102743 - DNA, 20 bp, Artificial Sequence
  Description of Artificial Sequence: Synthetic oligonucleotide
  Target: ATXN1; (+) strand; PAM type: NRG; PAM sequence: GGG
gcactttaggaggctgaggc

SEQ ID NO: 102744 - DNA, 20 bp, Artificial Sequence
  Description of Artificial Sequence: Synthetic oligonucleotide
  Target: ATXN1; (+) strand; PAM type: NRG; PAM sequence: CGG
ctttaggaggctgaggcggg

SEQ ID NO: 102745 - DNA, 20 bp, Artificial Sequence
  Description of Artificial Sequence: Synthetic oligonucleotide
  Target: ATXN1; (+) strand; PAM type: NRG; PAM sequence: GAG
ggctgaggcgggcggattgc

SEQ ID NO: 102746 - DNA, 20 bp, Artificial Sequence
  Description of Artificial Sequence: Synthetic oligonucleotide
  Target: ATXN1; (+) strand; PAM type: NRG; PAM sequence: AGG
gctgaggcgggcggattgcg

SEQ ID NO: 102747 - DNA, 20 bp, Artificial Sequence
  Description of Artificial Sequence: Synthetic oligonucleotide
  Target: ATXN1; (+) strand; PAM type: NRG; PAM sequence: CAG
aggcgggcggattgcgaggt

SEQ ID NO: 102748 - DNA, 20 bp, Artificial Sequence
  Description of Artificial Sequence: Synthetic oligonucleotide
  Target: ATXN1; (+) strand; PAM type: NRG; PAM sequence: AGG
ggcgggcggattgcgaggtc

SEQ ID NO: 102749 - DNA, 20 bp, Artificial Sequence
  Description of Artificial Sequence: Synthetic oligonucleotide
  Target: ATXN1; (+) strand; PAM type: NRG; PAM sequence: GAG
cgggcggattgcgaggtcag

SEQ ID NO: 102750 - DNA, 20 bp, Artificial Sequence
  Description of Artificial Sequence: Synthetic oligonucleotide
  Target: ATXN1; (+) strand; PAM type: NRG; PAM sequence: GAG
gattgcgaggtcaggagatt

SEQ ID NO: 102751 - DNA, 20 bp, Artificial Sequence
  Description of Artificial Sequence: Synthetic oligonucleotide
  Target: ATXN1; (+) strand; PAM type: NRG; PAM sequence: TGG
tcaggagattgagaccatcc

SEQ ID NO: 102752 - DNA, 20 bp, Artificial Sequence
  Description of Artificial Sequence: Synthetic oligonucleotide
  Target: ATXN1; (+) strand; PAM type: NRG; PAM sequence: CAG
tgagaccatcctggataaca

SEQ ID NO: 102753 - DNA, 20 bp, Artificial Sequence
  Description of Artificial Sequence: Synthetic oligonucleotide
  Target: ATXN1; (+) strand; PAM type: NRG; PAM sequence: GAG
ctactaaaaatacaaaaaat

SEQ ID NO: 102754 - DNA, 20 bp, Artificial Sequence
  Description of Artificial Sequence: Synthetic oligonucleotide
  Target: ATXN1; (+) strand; PAM type: NRG; PAM sequence: CAG
taaaaatacaaaaaatgagc

SEQ ID NO: 102755 - DNA, 20 bp, Artificial Sequence
  Description of Artificial Sequence: Synthetic oligonucleotide
  Target: ATXN1; (+) strand; PAM type: NRG; PAM sequence: AGG
aaaaatacaaaaaatgagcc

SEQ ID NO: 102756 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaatgagccaggcg

SEQ ID NO: 102757 - DNA, 20 bp, Artificial Sequence
  Description of Artificial Sequence: Synthetic oligonucleotide
  Target: ATXN1; (+) strand; PAM type: NRG; PAM sequence: TGG
aaaaaatgagccaggcgtgg

SEQ ID NO: 102758 - DNA, 20 bp, Artificial Sequence
  Description of Artificial Sequence: Synthetic oligonucleotide
  Target: ATXN1; (+) strand; PAM type: NRG; PAM sequence: CAG
aaatgagccaggcgtggtgg

SEQ ID NO: 102759 - DNA, 20 bp, Artificial Sequence
  Description of Artificial Sequence: Synthetic oligonucleotide
  Target: ATXN1; (+) strand; PAM type: NRG; PAM sequence: AGG
aatgagccaggcgtggtggc

SEQ ID NO: 102760 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggcaggcgcctg

SEQ ID NO: 102761 - DNA, 20 bp, Artificial Sequence
  Description of Artificial Sequence: Synthetic oligonucleotide
  Target: ATXN1; (+) strand; PAM type: NRG; PAM sequence: CAG
gtggcaggcgcctgtagtcc

SEQ ID NO: 102762 - DNA, 20 bp, Artificial Sequence
  Description of Artificial Sequence: Synthetic oligonucleotide
  Target: ATXN1; (+) strand; PAM type: NRG; PAM sequence: GAG
gcgcctgtagtcccagctac

SEQ ID NO: 102763 - DNA, 20 bp, Artificial Sequence
  Description of Artificial Sequence: Synthetic oligonucleotide
  Target: ATXN1; (+) strand; PAM type: NRG; PAM sequence: AGG
cgcctgtagtcccagctacg

SEQ ID NO: 102764 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtcccagctacga

SEQ ID NO: 102765 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctacgagg

SEQ ID NO: 102766 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctacgaggg

SEQ ID NO: 102767 - DNA, 20 bp, Artificial Sequence
  Description of Artificial Sequence: Synthetic oligonucleotide
  Target: ATXN1; (+) strand; PAM type: NRG; PAM sequence: AAG
tcccagctacgagggaggct

SEQ ID NO: 102768 - DNA, 20 bp, Artificial Sequence
  Description of Artificial Sequence: Synthetic oligonucleotide
  Target: ATXN1; (+) strand; PAM type: NRG; PAM sequence: AGG
cccagctacgagggaggcta

SEQ ID NO: 102769 - DNA, 20 bp, Artificial Sequence
  Description of Artificial Sequence: Synthetic oligonucleotide
  Target: ATXN1; (+) strand; PAM type: NRG; PAM sequence: CAG
agctacgagggaggctaagg

SEQ ID NO: 102770 - DNA, 20 bp, Artificial Sequence
  Description of Artificial Sequence: Synthetic oligonucleotide
  Target: ATXN1; (+) strand; PAM type: NRG; PAM sequence: AGG
gctacgagggaggctaaggc

SEQ ID NO: 102771 - DNA, 20 bp, Artificial Sequence
  Description of Artificial Sequence: Synthetic oligonucleotide
  Target: ATXN1; (+) strand; PAM type: NRG; PAM sequence: GAG
tacgagggaggctaaggcag

SEQ ID NO: 102772 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcgcttgaacc

SEQ ID NO: 102773 - DNA, 20 bp, Artificial Sequence
  Description of Artificial Sequence: Synthetic oligonucleotide
  Target: ATXN1; (+) strand; PAM type: NRG; PAM sequence: AGG
caggagaatcgcttgaaccc

SEQ ID NO: 102774 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccag

SEQ ID NO: 102775 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccagg

SEQ ID NO: 102776 - DNA, 20 bp, Artificial Sequence
  Description of Artificial Sequence: Synthetic oligonucleotide
  Target: ATXN1; (+) strand; PAM type: NRG; PAM sequence: CGG
aatcgcttgaacccaggagg

SEQ ID NO: 102777 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccaggaggcg

SEQ ID NO: 102778 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccaggaggcgg

SEQ ID NO: 102779 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggaggttg

SEQ ID NO: 102780 - DNA, 20 bp, Artificial Sequence
  Description of Artificial Sequence: Synthetic oligonucleotide
  Target: ATXN1; (+) strand; PAM type: NRG; PAM sequence: GAG
caggaggcggaggttgcagt

SEQ ID NO: 102781 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcagtgagcc

SEQ ID NO: 102782 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccactgcactc

SEQ ID NO: 102783 - DNA, 20 bp, Artificial Sequence
  Description of Artificial Sequence: Synthetic oligonucleotide
  Target: ATXN1; (+) strand; PAM type: NRG; PAM sequence: TGG
cacaccactgcactccagcc

SEQ ID NO: 102784 - DNA, 20 bp, Artificial Sequence
  Description of Artificial Sequence: Synthetic oligonucleotide
  Target: ATXN1; (+) strand; PAM type: NRG; PAM sequence: GGG
acaccactgcactccagcct

SEQ ID NO: 102785 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcga

SEQ ID NO: 102786 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcgaca

SEQ ID NO: 102787 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagagc

SEQ ID NO: 102788 - DNA, 20 bp, Artificial Sequence
  Description of Artificial Sequence: Synthetic oligonucleotide
  Target: ATXN1; (+) strand; PAM type: NRG; PAM sequence: AAG
ttgcgattatacatgtgccc

SEQ ID NO: 102789 - DNA, 20 bp, Artificial Sequence
  Description of Artificial Sequence: Synthetic oligonucleotide
  Target: ATXN1; (+) strand; PAM type: NRG; PAM sequence: GAG
tacatgtgcccaagtttaat

SEQ ID NO: 102790 - DNA, 20 bp, Artificial Sequence
  Description of Artificial Sequence: Synthetic oligonucleotide
  Target: ATXN1; (+) strand; PAM type: NRG; PAM sequence: AGG
acatgtgcccaagtttaatg

SEQ ID NO: 102791 - DNA, 20 bp, Artificial Sequence
  Description of Artificial Sequence: Synthetic oligonucleotide
  Target: ATXN1; (+) strand; PAM type: NRG; PAM sequence: AAG
tttcatttcaacaatgtgta

SEQ ID NO: 102792 - DNA, 20 bp, Artificial Sequence
  Description of Artificial Sequence: Synthetic oligonucleotide
  Target: ATXN1; (+) strand; PAM type: NRG; PAM sequence: TGG
tgtaatctctgcctttaaaa

SEQ ID NO: 102793 - DNA, 20 bp, Artificial Sequence
  Description of Artificial Sequence: Synthetic oligonucleotide
  Target: ATXN1; (+) strand; PAM type: NRG; PAM sequence: GGG
gtaatctctgcctttaaaat

SEQ ID NO: 102794 - DNA, 20 bp, Artificial Sequence
  Description of Artificial Sequence: Synthetic oligonucleotide
  Target: ATXN1; (+) strand; PAM type: NRG; PAM sequence: GGG
taatctctgcctttaaaatg

SEQ ID NO: 102795 - DNA, 20 bp, Artificial Sequence
  Description of Artificial Sequence: Synthetic oligonucleotide
  Target: ATXN1; (+) strand; PAM type: NRG; PAM sequence: AAG
tctctgcctttaaaatgggg

SEQ ID NO: 102796 - DNA, 20 bp, Artificial Sequence
  Description of Artificial Sequence: Synthetic oligonucleotide
  Target: ATXN1; (+) strand; PAM type: NRG; PAM sequence: CAG
tggggaagaattaacatgca

SEQ ID NO: 102797 - DNA, 20 bp, Artificial Sequence
  Description of Artificial Sequence: Synthetic oligonucleotide
  Target: ATXN1; (+) strand; PAM type: NRG; PAM sequence: TAG
gaattaacatgcacagtgcc

SEQ ID NO: 102798 - DNA, 20 bp, Artificial Sequence
  Description of Artificial Sequence: Synthetic oligonucleotide
  Target: ATXN1; (+) strand; PAM type: NRG; PAM sequence: CAG
tgcctagtataacacacact

SEQ ID NO: 102799 - DNA, 20 bp, Artificial Sequence
  Description of Artificial Sequence: Synthetic oligonucleotide
  Target: ATXN1; (+) strand; PAM type: NRG; PAM sequence: TGG
tataacacacactcagtaca

SEQ ID NO: 102800 - DNA, 20 bp, Artificial Sequence
  Description of Artificial Sequence: Synthetic oligonucleotide
  Target: ATXN1; (+) strand; PAM type: NRG; PAM sequence: TAG
tcagtacatggtcgccatcg

SEQ ID NO: 102801 - DNA, 20 bp, Artificial Sequence
  Description of Artificial Sequence: Synthetic oligonucleotide
  Target: ATXN1; (+) strand; PAM type: NRG; PAM sequence: CAG
aacatttcctcatgaattct

SEQ ID NO: 102802 - DNA, 20 bp, Artificial Sequence
  Description of Artificial Sequence: Synthetic oligonucleotide
  Target: ATXN1; (+) strand; PAM type: NRG; PAM sequence: TGG
tatctgttgctcatctctcc

SEQ ID NO: 102803 - DNA, 20 bp, Artificial Sequence
  Description of Artificial Sequence: Synthetic oligonucleotide
  Target: ATXN1; (+) strand; PAM type: NRG; PAM sequence: TAG
ttttttcctcacatctgtga

SEQ ID NO: 102804 - DNA, 20 bp, Artificial Sequence
  Description of Artificial Sequence: Synthetic oligonucleotide
  Target: ATXN1; (+) strand; PAM type: NRG; PAM sequence: AAG
cctcacatctgtgatagaaa

SEQ ID NO: 102805 - DNA, 20 bp, Artificial Sequence
  Description of Artificial Sequence: Synthetic oligonucleotide
  Target: ATXN1; (+) strand; PAM type: NRG; PAM sequence: GAG
tcacatctgtgatagaaaaa

SEQ ID NO: 102806 - DNA, 20 bp, Artificial Sequence
  Description of Artificial Sequence: Synthetic oligonucleotide
  Target: ATXN1; (+) strand; PAM type: NRG; PAM sequence: AGG
cacatctgtgatagaaaaag

SEQ ID NO: 102807 - DNA, 20 bp, Artificial Sequence
  Description of Artificial Sequence: Synthetic oligonucleotide
  Target: ATXN1; (+) strand; PAM type: NRG; PAM sequence: AAG
atctgtgatagaaaaagagg

SEQ ID NO: 102808 - DNA, 20 bp, Artificial Sequence
  Description of Artificial Sequence: Synthetic oligonucleotide
  Target: ATXN1; (+) strand; PAM type: NRG; PAM sequence: TGG
gatagaaaaagaggaagtga

SEQ ID NO: 102809 - DNA, 20 bp, Artificial Sequence
  Description of Artificial Sequence: Synthetic oligonucleotide
  Target: ATXN1; (+) strand; PAM type: NRG; PAM sequence: GGG
atagaaaaagaggaagtgat

SEQ ID NO: 102810 - DNA, 20 bp, Artificial Sequence
  Description of Artificial Sequence: Synthetic oligonucleotide
  Target: ATXN1; (+) strand; PAM type: NRG; PAM sequence: GAG
agaggaagtgatgggtgttt

SEQ ID NO: 102811 - DNA, 20 bp, Artificial Sequence
  Description of Artificial Sequence: Synthetic oligonucleotide
  Target: ATXN1; (+) strand; PAM type: NRG; PAM sequence: GAG
aggaagtgatgggtgtttga

SEQ ID NO: 102812 - DNA, 20 bp, Artificial Sequence
  Description of Artificial Sequence: Synthetic oligonucleotide
  Target: ATXN1; (+) strand; PAM type: NRG; PAM sequence: TAG
tcatttttttcttcacttga

SEQ ID NO: 102813 - DNA, 20 bp, Artificial Sequence
  Description of Artificial Sequence: Synthetic oligonucleotide
  Target: ATXN1; (+) strand; PAM type: NRG; PAM sequence: AGG
catttttttcttcacttgat

SEQ ID NO: 102814 - DNA, 20 bp, Artificial Sequence
  Description of Artificial Sequence: Synthetic oligonucleotide
  Target: ATXN1; (+) strand; PAM type: NRG; PAM sequence: TGG
ttttttcttcacttgatagg

SEQ ID NO: 102815 - DNA, 20 bp, Artificial Sequence
  Description of Artificial Sequence: Synthetic oligonucleotide
  Target: ATXN1; (+) strand; PAM type: NRG; PAM sequence: GGG
tttttcttcacttgataggt

SEQ ID NO: 102816 - DNA, 20 bp, Artificial Sequence
  Description of Artificial Sequence: Synthetic oligonucleotide
  Target: ATXN1; (+) strand; PAM type: NRG; PAM sequence: AAG
ataggtgggataatatttat

SEQ ID NO: 102817 - DNA, 20 bp, Artificial Sequence
  Description of Artificial Sequence: Synthetic oligonucleotide
  Target: ATXN1; (+) strand; PAM type: NRG; PAM sequence: CAG
atttataagtgcccaatgtg

SEQ ID NO: 102818 - DNA, 20 bp, Artificial Sequence
  Description of Artificial Sequence: Synthetic oligonucleotide
  Target: ATXN1; (+) strand; PAM type: NRG; PAM sequence: AAG
agacccctatgcacaccaac

SEQ ID NO: 102819 - DNA, 20 bp, Artificial Sequence
  Description of Artificial Sequence: Synthetic oligonucleotide
  Target: ATXN1; (+) strand; PAM type: NRG; PAM sequence: AAG
cccctatgcacaccaacaag

SEQ ID NO: 102820 - DNA, 20 bp, Artificial Sequence
  Description of Artificial Sequence: Synthetic oligonucleotide
  Target: ATXN1; (+) strand; PAM type: NRG; PAM sequence: AGG
ccctatgcacaccaacaaga

SEQ ID NO: 102821 - DNA, 20 bp, Artificial Sequence
  Description of Artificial Sequence: Synthetic oligonucleotide
  Target: ATXN1; (+) strand; PAM type: NRG; PAM sequence: AAG
tatgcacaccaacaagaagg

SEQ ID NO: 102822 - DNA, 20 bp, Artificial Sequence
  Description of Artificial Sequence: Synthetic oligonucleotide
  Target: ATXN1; (+) strand; PAM type: NRG; PAM sequence: AGG
atgcacaccaacaagaagga

SEQ ID NO: 102823 - DNA, 20 bp, Artificial Sequence
  Description of Artificial Sequence: Synthetic oligonucleotide
  Target: ATXN1; (+) strand; PAM type: NRG; PAM sequence: CAG
caacaagaaggaaggcaatt

SEQ ID NO: 102824 - DNA, 20 bp, Artificial Sequence
  Description of Artificial Sequence: Synthetic oligonucleotide
  Target: ATXN1; (+) strand; PAM type: NRG; PAM sequence: AAG
aggaaggcaattcagcacac

SEQ ID NO: 102825 - DNA, 20 bp, Artificial Sequence
  Description of Artificial Sequence: Synthetic oligonucleotide
  Target: ATXN1; (+) strand; PAM type: NRG; PAM sequence: CAG
aaggcaattcagcacacaag

SEQ ID NO: 102826 - DNA, 20 bp, Artificial Sequence
  Description of Artificial Sequence: Synthetic oligonucleotide
  Target: ATXN1; (+) strand; PAM type: NRG; PAM sequence: CAG
cagcacacaagcagaataaa

SEQ ID NO: 102827 - DNA, 20 bp, Artificial Sequence
  Description of Artificial Sequence: Synthetic oligonucleotide
  Target: ATXN1; (+) strand; PAM type: NRG; PAM sequence: AAG
acacaagcagaataaacaga

SEQ ID NO: 102828 - DNA, 20 bp, Artificial Sequence
  Description of Artificial Sequence: Synthetic oligonucleotide
  Target: ATXN1; (+) strand; PAM type: NRG; PAM sequence: CAG
agcagaataaacagaaagct

SEQ ID NO: 102829 - DNA, 20 bp, Artificial Sequence
  Description of Artificial Sequence: Synthetic oligonucleotide
  Target: ATXN1; (+) strand; PAM type: NRG; PAM sequence: AAG
aaagctcagacgctaaactc

SEQ ID NO: 102830 - DNA, 20 bp, Artificial Sequence
  Description of Artificial Sequence: Synthetic oligonucleotide
  Target: ATXN1; (+) strand; PAM type: NRG; PAM sequence: AGG
aagctcagacgctaaactca

SEQ ID NO: 102831 - DNA, 20 bp, Artificial Sequence
  Description of Artificial Sequence: Synthetic oligonucleotide
  Target: ATXN1; (+) strand; PAM type: NRG; PAM sequence: TGG
tcagacgctaaactcaagga

SEQ ID NO: 102832 - DNA, 20 bp, Artificial Sequence
  Description of Artificial Sequence: Synthetic oligonucleotide
  Target: ATXN1; (+) strand; PAM type: NRG; PAM sequence: CAG
aaactcaaggatggcatttc

SEQ ID NO: 102833 - DNA, 20 bp, Artificial Sequence
  Description of Artificial Sequence: Synthetic oligonucleotide
  Target: ATXN1; (+) strand; PAM type: NRG; PAM sequence: AGG
aactcaaggatggcatttcc

SEQ ID NO: 102834 - DNA, 20 bp, Artificial Sequence
  Description of Artificial Sequence: Synthetic oligonucleotide
  Target: ATXN1; (+) strand; PAM type: NRG; PAM sequence: GGG
actcaaggatggcatttcca

SEQ ID NO: 102835 - DNA, 20 bp, Artificial Sequence
  Description of Artificial Sequence: Synthetic oligonucleotide
  Target: ATXN1; (+) strand; PAM type: NRG; PAM sequence: AAG
caaggatggcatttccaggg

SEQ ID NO: 102836 - DNA, 20 bp, Artificial Sequence
  Description of Artificial Sequence: Synthetic oligonucleotide
  Target: ATXN1; (+) strand; PAM type: NRG; PAM sequence: AGG
aaggatggcatttccaggga

SEQ ID NO: 102837 - DNA, 20 bp, Artificial Sequence
  Description of Artificial Sequence: Synthetic oligonucleotide
  Target: ATXN1; (+) strand; PAM type: NRG; PAM sequence: GGG
aggatggcatttccagggaa

SEQ ID NO: 102838 - DNA, 20 bp, Artificial Sequence
  Description of Artificial Sequence: Synthetic oligonucleotide
  Target: ATXN1; (+) strand; PAM type: NRG; PAM sequence: AAG
ggcatttccagggaagggtt

SEQ ID NO: 102839 - DNA, 20 bp, Artificial Sequence
  Description of Artificial Sequence: Synthetic oligonucleotide
  Target: ATXN1; (+) strand; PAM type: NRG; PAM sequence: TGG
tgcttttccacaatactttt

SEQ ID NO: 102840 - DNA, 20 bp, Artificial Sequence
  Description of Artificial Sequence: Synthetic oligonucleotide
  Target: ATXN1; (+) strand; PAM type: NRG; PAM sequence: GAG
ttccacaatactttttggat

SEQ ID NO: 102841 - DNA, 20 bp, Artificial Sequence
  Description of Artificial Sequence: Synthetic oligonucleotide
  Target: ATXN1; (+) strand; PAM type: NRG; PAM sequence: AAG
tttttggatgagtaattccc

SEQ ID NO: 102842 - DNA, 20 bp, Artificial Sequence
  Description of Artificial Sequence: Synthetic oligonucleotide
  Target: ATXN1; (+) strand; PAM type: NRG; PAM sequence: TGG
tgagtaattcccaagacgca

SEQ ID NO: 102843 - DNA, 20 bp, Artificial Sequence
  Description of Artificial Sequence: Synthetic oligonucleotide
  Target: ATXN1; (+) strand; PAM type: NRG; PAM sequence: TGG
gtaattcccaagacgcatgg

SEQ ID NO: 102844 - DNA, 20 bp, Artificial Sequence
  Description of Artificial Sequence: Synthetic oligonucleotide
  Target: ATXN1; (+) strand; PAM type: NRG; PAM sequence: GGG
taattcccaagacgcatggt

SEQ ID NO: 102845 - DNA, 20 bp, Artificial Sequence
  Description of Artificial Sequence: Synthetic oligonucleotide
  Target: ATXN1; (+) strand; PAM type: NRG; PAM sequence: GGG
aattcccaagacgcatggtg

SEQ ID NO: 102846 - DNA, 20 bp, Artificial Sequence
  Description of Artificial Sequence: Synthetic oligonucleotide
  Target: ATXN1; (+) strand; PAM type: NRG; PAM sequence: CAG
agacgcatggtggggaaatg

SEQ ID NO: 102847 - DNA, 20 bp, Artificial Sequence
  Description of Artificial Sequence: Synthetic oligonucleotide
  Target: ATXN1; (+) strand; PAM type: NRG; PAM sequence: CAG
aatcctccttccacatcccg

SEQ ID NO: 102848 - DNA, 20 bp, Artificial Sequence
  Description of Artificial Sequence: Synthetic oligonucleotide
  Target: ATXN1; (+) strand; PAM type: NRG; PAM sequence: AGG
atcctccttccacatcccgc

SEQ ID NO: 102849 - DNA, 20 bp, Artificial Sequence
  Description of Artificial Sequence: Synthetic oligonucleotide
  Target: ATXN1; (+) strand; PAM type: NRG; PAM sequence: GGG
tcctccttccacatcccgca

SEQ ID NO: 102850 - DNA, 20 bp, Artificial Sequence
  Description of Artificial Sequence: Synthetic oligonucleotide
  Target: ATXN1; (+) strand; PAM type: NRG; PAM sequence: AAG
tccttccacatcccgcaggg

SEQ ID NO: 102851 - DNA, 20 bp, Artificial Sequence
  Description of Artificial Sequence: Synthetic oligonucleotide
  Target: ATXN1; (+) strand; PAM type: NRG; PAM sequence: AGG
ccttccacatcccgcaggga

SEQ ID NO: 102852 - DNA, 20 bp, Artificial Sequence
  Description of Artificial Sequence: Synthetic oligonucleotide
  Target: ATXN1; (+) strand; PAM type: NRG; PAM sequence: CAG
catcccgcagggaaggctgc

SEQ ID NO: 102853 - DNA, 20 bp, Artificial Sequence
  Description of Artificial Sequence: Synthetic oligonucleotide
  Target: ATXN1; (+) strand; PAM type: NRG; PAM sequence: GAG
ctacccgcacacacactcac

SEQ ID NO: 102854 - DNA, 20 bp, Artificial Sequence
  Description of Artificial Sequence: Synthetic oligonucleotide
  Target: ATXN1; (+) strand; PAM type: NRG; PAM sequence: AAG
tcaccacacaacacgatgca

SEQ ID NO: 102855 - DNA, 20 bp, Artificial Sequence
  Description of Artificial Sequence: Synthetic oligonucleotide
  Target: ATXN1; (+) strand; PAM type: NRG; PAM sequence: CAG
cacaacacgatgcaaagcgc

SEQ ID NO: 102856 - DNA, 20 bp, Artificial Sequence
  Description of Artificial Sequence: Synthetic oligonucleotide
  Target: ATXN1; (+) strand; PAM type: NRG; PAM sequence: CAG
caaagcgccagcaactgctc

SEQ ID NO: 102857 - DNA, 20 bp, Artificial Sequence
  Description of Artificial Sequence: Synthetic oligonucleotide
  Target: ATXN1; (+) strand; PAM type: NRG; PAM sequence: AGG
aaagcgccagcaactgctcc

SEQ ID NO: 102858 - DNA, 20 bp, Artificial Sequence
  Description of Artificial Sequence: Synthetic oligonucleotide
  Target: ATXN1; (+) strand; PAM type: NRG; PAM sequence: GAG
agcgccagcaactgctccag

SEQ ID NO: 102859 - DNA, 20 bp, Artificial Sequence
  Description of Artificial Sequence: Synthetic oligonucleotide
  Target: ATXN1; (+) strand; PAM type: NRG; PAM sequence: AGG
gcgccagcaactgctccagg

SEQ ID NO: 102860 - DNA, 20 bp, Artificial Sequence
  Description of Artificial Sequence: Synthetic oligonucleotide
  Target: ATXN1; (+) strand; PAM type: NRG; PAM sequence: TAG
agcaactgctccaggaggcc

SEQ ID NO: 102861 - DNA, 20 bp, Artificial Sequence
  Description of Artificial Sequence: Synthetic oligonucleotide
  Target: ATXN1; (+) strand; PAM type: NRG; PAM sequence: AGG
gcaactgctccaggaggcct

SEQ ID NO: 102862 - DNA, 20 bp, Artificial Sequence
  Description of Artificial Sequence: Synthetic oligonucleotide
  Target: ATXN1; (+) strand; PAM type: NRG; PAM sequence: TGG
ctgctccaggaggcctaggc

SEQ ID NO: 102863 - DNA, 20 bp, Artificial Sequence
  Description of Artificial Sequence: Synthetic oligonucleotide
  Target: ATXN1; (+) strand; PAM type: NRG; PAM sequence: CAG
aggcctaggctggatcctgc

SEQ ID NO: 102864 - DNA, 20 bp, Artificial Sequence
  Description of Artificial Sequence: Synthetic oligonucleotide
  Target: ATXN1; (+) strand; PAM type: NRG; PAM sequence: CAG
ggctggatcctgccagccac

SEQ ID NO: 102865 - DNA, 20 bp, Artificial Sequence
  Description of Artificial Sequence: Synthetic oligonucleotide
  Target: ATXN1; (+) strand; PAM type: NRG; PAM sequence: AGG
gctggatcctgccagccacc

SEQ ID NO: 102866 - DNA, 20 bp, Artificial Sequence
  Description of Artificial Sequence: Synthetic oligonucleotide
  Target: ATXN1; (+) strand; PAM type: NRG; PAM sequence: GGG
ctggatcctgccagccacca

SEQ ID NO: 102867 - DNA, 20 bp, Artificial Sequence
  Description of Artificial Sequence: Synthetic oligonucleotide
  Target: ATXN1; (+) strand; PAM type: NRG; PAM sequence: GGG
tggatcctgccagccaccag

SEQ ID NO: 102868 - DNA, 20 bp, Artificial Sequence
  Description of Artificial Sequence: Synthetic oligonucleotide
  Target: ATXN1; (+) strand; PAM type: NRG; PAM sequence: GGG
ggatcctgccagccaccagg

SEQ ID NO: 102869 - DNA, 20 bp, Artificial Sequence
  Description of Artificial Sequence: Synthetic oligonucleotide
  Target: ATXN1; (+) strand; PAM type: NRG; PAM sequence: TGG
cctgccagccaccagggggc

SEQ ID NO: 102870 - DNA, 20 bp, Artificial Sequence
  Description of Artificial Sequence: Synthetic oligonucleotide
  Target: ATXN1; (+) strand; PAM type: NRG; PAM sequence: GGG
ctgccagccaccagggggct

SEQ ID NO: 102871 - DNA, 20 bp, Artificial Sequence
  Description of Artificial Sequence: Synthetic oligonucleotide
  Target: ATXN1; (+) strand; PAM type: NRG; PAM sequence: CAG
ccaccagggggctgggtttc

SEQ ID NO: 102872 - DNA, 20 bp, Artificial Sequence
  Description of Artificial Sequence: Synthetic oligonucleotide
  Target: ATXN1; (+) strand; PAM type: NRG; PAM sequence: AGG
caccagggggctgggtttcc

SEQ ID NO: 102873 - DNA, 20 bp, Artificial Sequence
  Description of Artificial Sequence: Synthetic oligonucleotide
  Target: ATXN1; (+) strand; PAM type: NRG; PAM sequence: TAG
gggctgggtttccaggacat

SEQ ID NO: 102874 - DNA, 20 bp, Artificial Sequence
  Description of Artificial Sequence: Synthetic oligonucleotide
  Target: ATXN1; (+) strand; PAM type: NRG; PAM sequence: CAG
tgggtttccaggacattaga

SEQ ID NO: 102875 - DNA, 20 bp, Artificial Sequence
  Description of Artificial Sequence: Synthetic oligonucleotide
  Target: ATXN1; (+) strand; PAM type: NRG; PAM sequence: CAG
tccaggacattagacagccc

SEQ ID NO: 102876 - DNA, 20 bp, Artificial Sequence
  Description of Artificial Sequence: Synthetic oligonucleotide
  Target: ATXN1; (+) strand; PAM type: NRG; PAM sequence: CAG
tagacagccccagtctacaa

SEQ ID NO: 102877 - DNA, 20 bp, Artificial Sequence
  Description of Artificial Sequence: Synthetic oligonucleotide
  Target: ATXN1; (+) strand; PAM type: NRG; PAM sequence: GAG
gacagccccagtctacaaca

SEQ ID NO: 102878 - DNA, 20 bp, Artificial Sequence
  Description of Artificial Sequence: Synthetic oligonucleotide
  Target: ATXN1; (+) strand; PAM type: NRG; PAM sequence: AAG
agaacataaaactctccatc

SEQ ID NO: 102879 - DNA, 20 bp, Artificial Sequence
  Description of Artificial Sequence: Synthetic oligonucleotide
  Target: ATXN1; (+) strand; PAM type: NRG; PAM sequence: CAG
cataaaactctccatcaagt

SEQ ID NO: 102880 - DNA, 20 bp, Artificial Sequence
  Description of Artificial Sequence: Synthetic oligonucleotide
  Target: ATXN1; (+) strand; PAM type: NRG; PAM sequence: AGG
ataaaactctccatcaagtc

SEQ ID NO: 102881 - DNA, 20 bp, Artificial Sequence
  Description of Artificial Sequence: Synthetic oligonucleotide
  Target: ATXN1; (+) strand; PAM type: NRG; PAM sequence: AAG
ctctccatcaagtcaggaaa

SEQ ID NO: 102882 - DNA, 20 bp, Artificial Sequence
  Description of Artificial Sequence: Synthetic oligonucleotide
  Target: ATXN1; (+) strand; PAM type: NRG; PAM sequence: AGG
tctccatcaagtcaggaaaa

SEQ ID NO: 102883 - DNA, 20 bp, Artificial Sequence
  Description of Artificial Sequence: Synthetic oligonucleotide
  Target: ATXN1; (+) strand; PAM type: NRG; PAM sequence: TGG
aagtcaggaaaaaggtctcg

SEQ ID NO: 102884 - DNA, 20 bp, Artificial Sequence
  Description of Artificial Sequence: Synthetic oligonucleotide
  Target: ATXN1; (+) strand; PAM type: NRG; PAM sequence: GGG
agtcaggaaaaaggtctcgt

SEQ ID NO: 102885 - DNA, 20 bp, Artificial Sequence
  Description of Artificial Sequence: Synthetic oligonucleotide
  Target: ATXN1; (+) strand; PAM type: NRG; PAM sequence: GAG
aaaaaggtctcgtgggaact

SEQ ID NO: 102886 - DNA, 20 bp, Artificial Sequence
  Description of Artificial Sequence: Synthetic oligonucleotide
  Target: ATXN1; (+) strand; PAM type: NRG; PAM sequence: AGG
aaaaggtctcgtgggaactg

SEQ ID NO: 102887 - DNA, 20 bp, Artificial Sequence
  Description of Artificial Sequence: Synthetic oligonucleotide
  Target: ATXN1; (+) strand; PAM type: NRG; PAM sequence: TGG
tcgtgggaactgaggtactc

SEQ ID NO: 102888 - DNA, 20 bp, Artificial Sequence
  Description of Artificial Sequence: Synthetic oligonucleotide
  Target: ATXN1; (+) strand; PAM type: NRG; PAM sequence: GGG
cgtgggaactgaggtactct

SEQ ID NO: 102889 - DNA, 20 bp, Artificial Sequence
  Description of Artificial Sequence: Synthetic oligonucleotide
  Target: ATXN1; (+) strand; PAM type: NRG; PAM sequence: GAG
tgggaactgaggtactctgg

SEQ ID NO: 102890 - DNA, 20 bp, Artificial Sequence
  Description of Artificial Sequence: Synthetic oligonucleotide
  Target: ATXN1; (+) strand; PAM type: NRG; PAM sequence: GAG
ggaactgaggtactctggga

SEQ ID NO: 102891 - DNA, 20 bp, Artificial Sequence
  Description of Artificial Sequence: Synthetic oligonucleotide
  Target: ATXN1; (+) strand; PAM type: NRG; PAM sequence: TGG
ttaaaactattcactgtcct

SEQ ID NO: 102892 - DNA, 20 bp, Artificial Sequence
  Description of Artificial Sequence: Synthetic oligonucleotide
  Target: ATXN1; (+) strand; PAM type: NRG; PAM sequence: TGG
actattcactgtccttggtg

SEQ ID NO: 102893 - DNA, 20 bp, Artificial Sequence
  Description of Artificial Sequence: Synthetic oligonucleotide
  Target: ATXN1; (+) strand; PAM type: NRG; PAM sequence: AAG
tccttggtgtggctgaatga

SEQ ID NO: 102894 - DNA, 20 bp, Artificial Sequence
  Description of Artificial Sequence: Synthetic oligonucleotide
  Target: ATXN1; (+) strand; PAM type: NRG; PAM sequence: AAG
ggtgtggctgaatgaaagca

SEQ ID NO: 102895 - DNA, 20 bp, Artificial Sequence
  Description of Artificial Sequence: Synthetic oligonucleotide
  Target: ATXN1; (+) strand; PAM type: NRG; PAM sequence: CAG
gaaagcaaagccaatgcctc

SEQ ID NO: 102896 - DNA, 20 bp, Artificial Sequence
  Description of Artificial Sequence: Synthetic oligonucleotide
  Target: ATXN1; (+) strand; PAM type: NRG; PAM sequence: CAG
cagataattcataaactaac

SEQ ID NO: 102897 - DNA, 20 bp, Artificial Sequence
  Description of Artificial Sequence: Synthetic oligonucleotide
  Target: ATXN1; (+) strand; PAM type: NRG; PAM sequence: CAG
aaactaaccagctgttcctc

SEQ ID NO: 102898 - DNA, 20 bp, Artificial Sequence
  Description of Artificial Sequence: Synthetic oligonucleotide
  Target: ATXN1; (+) strand; PAM type: NRG; PAM sequence: AGG
aactaaccagctgttcctcc

SEQ ID NO: 102899 - DNA, 20 bp, Artificial Sequence
  Description of Artificial Sequence: Synthetic oligonucleotide
  Target: ATXN1; (+) strand; PAM type: NRG; PAM sequence: TGG
ttcctccaggtgtcacacac

SEQ ID NO: 102900 - DNA, 20 bp, Artificial Sequence
  Description of Artificial Sequence: Synthetic oligonucleotide
  Target: ATXN1; (+) strand; PAM type: NRG; PAM sequence: TGG
acacactggcttaccttcta

SEQ ID NO: 102901 - DNA, 20 bp, Artificial Sequence
  Description of Artificial Sequence: Synthetic oligonucleotide
  Target: ATXN1; (+) strand; PAM type: NRG; PAM sequence: TGG
cactggcttaccttctatgg

SEQ ID NO: 102902 - DNA, 20 bp, Artificial Sequence
  Description of Artificial Sequence: Synthetic oligonucleotide
  Target: ATXN1; (+) strand; PAM type: NRG; PAM sequence: CAG
cttaccttctatggtggttt

SEQ ID NO: 102903 - DNA, 20 bp, Artificial Sequence
  Description of Artificial Sequence: Synthetic oligonucleotide
  Target: ATXN1; (+) strand; PAM type: NRG; PAM sequence: GAG
ctatggtggtttcagtcact

SEQ ID NO: 102904 - DNA, 20 bp, Artificial Sequence
  Description of Artificial Sequence: Synthetic oligonucleotide
  Target: ATXN1; (+) strand; PAM type: NRG; PAM sequence: AAG
attcaatgctctcaactgca

SEQ ID NO: 102905 - DNA, 20 bp, Artificial Sequence
  Description of Artificial Sequence: Synthetic oligonucleotide
  Target: ATXN1; (+) strand; PAM type: NRG; PAM sequence: AAG
ctctcaactgcaaagacccc

SEQ ID NO: 102906 - DNA, 20 bp, Artificial Sequence
  Description of Artificial Sequence: Synthetic oligonucleotide
  Target: ATXN1; (+) strand; PAM type: NRG; PAM sequence: CGG
gcaaagaccccaagacctcc

SEQ ID NO: 102907 - DNA, 20 bp, Artificial Sequence
  Description of Artificial Sequence: Synthetic oligonucleotide
  Target: ATXN1; (+) strand; PAM type: NRG; PAM sequence: GGG
caaagaccccaagacctccc

SEQ ID NO: 102908 - DNA, 20 bp, Artificial Sequence
  Description of Artificial Sequence: Synthetic oligonucleotide
  Target: ATXN1; (+) strand; PAM type: NRG; PAM sequence: CAG
ccccaagacctcccgggacc

SEQ ID NO: 102909 - DNA, 20 bp, Artificial Sequence
  Description of Artificial Sequence: Synthetic oligonucleotide
  Target: ATXN1; (+) strand; PAM type: NRG; PAM sequence: AGG
cccaagacctcccgggaccc

SEQ ID NO: 102910 - DNA, 20 bp, Artificial Sequence
  Description of Artificial Sequence: Synthetic oligonucleotide
  Target: ATXN1; (+) strand; PAM type: NRG; PAM sequence: AAG
tcccgggacccaggctctct

SEQ ID NO: 102911 - DNA, 20 bp, Artificial Sequence
  Description of Artificial Sequence: Synthetic oligonucleotide
  Target: ATXN1; (+) strand; PAM type: NRG; PAM sequence: AGG
cccgggacccaggctctcta

SEQ ID NO: 102912 - DNA, 20 bp, Artificial Sequence
  Description of Artificial Sequence: Synthetic oligonucleotide
  Target: ATXN1; (+) strand; PAM type: NRG; PAM sequence: CAG
gacccaggctctctaaggca

SEQ ID NO: 102913 - DNA, 20 bp, Artificial Sequence
  Description of Artificial Sequence: Synthetic oligonucleotide
  Target: ATXN1; (+) strand; PAM type: NRG; PAM sequence: CAG
ccaggctctctaaggcacag

SEQ ID NO: 102914 - DNA, 20 bp, Artificial Sequence
  Description of Artificial Sequence: Synthetic oligonucleotide
  Target: ATXN1; (+) strand; PAM type: NRG; PAM sequence: AGG
caggctctctaaggcacagc

SEQ ID NO: 102915 - DNA, 20 bp, Artificial Sequence
  Description of Artificial Sequence: Synthetic oligonucleotide
  Target: ATXN1; (+) strand; PAM type: NRG; PAM sequence: CAG
gctctctaaggcacagcagg

SEQ ID NO: 102916 - DNA, 20 bp, Artificial Sequence
  Description of Artificial Sequence: Synthetic oligonucleotide
  Target: ATXN1; (+) strand; PAM type: NRG; PAM sequence: AGG
ctctctaaggcacagcaggc

SEQ ID NO: 102917 - DNA, 20 bp, Artificial Sequence
  Description of Artificial Sequence: Synthetic oligonucleotide
  Target: ATXN1; (+) strand; PAM type: NRG; PAM sequence: AAG
taaggcacagcaggcaggac

SEQ ID NO: 102918 - DNA, 20 bp, Artificial Sequence
  Description of Artificial Sequence: Synthetic oligonucleotide
  Target: ATXN1; (+) strand; PAM type: NRG; PAM sequence: CAG
gtcacgatgcttaatttgtg

SEQ ID NO: 102919 - DNA, 20 bp, Artificial Sequence
  Description of Artificial Sequence: Synthetic oligonucleotide
  Target: ATXN1; (+) strand; PAM type: NRG; PAM sequence: AGG
tcacgatgcttaatttgtgc

SEQ ID NO: 102920 - DNA, 20 bp, Artificial Sequence
  Description of Artificial Sequence: Synthetic oligonucleotide
  Target: ATXN1; (+) strand; PAM type: NRG; PAM sequence: CAG
tgcttaatttgtgcaggcta

SEQ ID NO: 102921 - DNA, 20 bp, Artificial Sequence
  Description of Artificial Sequence: Synthetic oligonucleotide
  Target: ATXN1; (+) strand; PAM type: NRG; PAM sequence: TAG
ctttacatataaataacaac

SEQ ID NO: 102922 - DNA, 20 bp, Artificial Sequence
  Description of Artificial Sequence: Synthetic oligonucleotide
  Target: ATXN1; (+) strand; PAM type: NRG; PAM sequence: AAG
catatgatcaccccatttca

SEQ ID NO: 102923 - DNA, 20 bp, Artificial Sequence
  Description of Artificial Sequence: Synthetic oligonucleotide
  Target: ATXN1; (+) strand; PAM type: NRG; PAM sequence: AAG
gatcaccccatttcaaagac

SEQ ID NO: 102924 - DNA, 20 bp, Artificial Sequence
  Description of Artificial Sequence: Synthetic oligonucleotide
  Target: ATXN1; (+) strand; PAM type: NRG; PAM sequence: AGG
atcaccccatttcaaagaca

SEQ ID NO: 102925 - DNA, 20 bp, Artificial Sequence
  Description of Artificial Sequence: Synthetic oligonucleotide
  Target: ATXN1; (+) strand; PAM type: NRG; PAM sequence: AAG
tttcaaagacaaggacattg

SEQ ID NO: 102926 - DNA, 20 bp, Artificial Sequence
  Description of Artificial Sequence: Synthetic oligonucleotide
  Target: ATXN1; (+) strand; PAM type: NRG; PAM sequence: CAG
aagacaaggacattgaagct

SEQ ID NO: 102927 - DNA, 20 bp, Artificial Sequence
  Description of Artificial Sequence: Synthetic oligonucleotide
  Target: ATXN1; (+) strand; PAM type: NRG; PAM sequence: GAG
gacaaggacattgaagctca

SEQ ID NO: 102928 - DNA, 20 bp, Artificial Sequence
  Description of Artificial Sequence: Synthetic oligonucleotide
  Target: ATXN1; (+) strand; PAM type: NRG; PAM sequence: AAG
gacattgaagctcagagtgt

SEQ ID NO: 102929 - DNA, 20 bp, Artificial Sequence
  Description of Artificial Sequence: Synthetic oligonucleotide
  Target: ATXN1; (+) strand; PAM type: NRG; PAM sequence: AAG
agagtgtaagtcacttgcct

SEQ ID NO: 102930 - DNA, 20 bp, Artificial Sequence
  Description of Artificial Sequence: Synthetic oligonucleotide
  Target: ATXN1; (+) strand; PAM type: NRG; PAM sequence: TGG
gtcacttgcctaagattaca

SEQ ID NO: 102931 - DNA, 20 bp, Artificial Sequence
  Description of Artificial Sequence: Synthetic oligonucleotide
  Target: ATXN1; (+) strand; PAM type: NRG; PAM sequence: AAG
ctaagattacatggctaaaa

SEQ ID NO: 102932 - DNA, 20 bp, Artificial Sequence
  Description of Artificial Sequence: Synthetic oligonucleotide
  Target: ATXN1; (+) strand; PAM type: NRG; PAM sequence: AGG
taagattacatggctaaaaa

SEQ ID NO: 102933 - DNA, 20 bp, Artificial Sequence
  Description of Artificial Sequence: Synthetic oligonucleotide
  Target: ATXN1; (+) strand; PAM type: NRG; PAM sequence: GGG
aagattacatggctaaaaaa

SEQ ID NO: 102934 - DNA, 20 bp, Artificial Sequence
  Description of Artificial Sequence: Synthetic oligonucleotide
  Target: ATXN1; (+) strand; PAM type: NRG; PAM sequence: CAG
attacatggctaaaaaaggg

SEQ ID NO: 102935 - DNA, 20 bp, Artificial Sequence
  Description of Artificial Sequence: Synthetic oligonucleotide
  Target: ATXN1; (+) strand; PAM type: NRG; PAM sequence: TGG
aaaatcctaatatgaaaact

SEQ ID NO: 102936 - DNA, 20 bp, Artificial Sequence
  Description of Artificial Sequence: Synthetic oligonucleotide
  Target: ATXN1; (+) strand; PAM type: NRG; PAM sequence: GGG
aaatcctaatatgaaaactt

SEQ ID NO: 102937 - DNA, 20 bp, Artificial Sequence
  Description of Artificial Sequence: Synthetic oligonucleotide
  Target: ATXN1; (+) strand; PAM type: NRG; PAM sequence: TAG
taatatgaaaacttgggatc

SEQ ID NO: 102938 - DNA, 20 bp, Artificial Sequence
  Description of Artificial Sequence: Synthetic oligonucleotide
  Target: ATXN1; (+) strand; PAM type: NRG; PAM sequence: TGG
aaaacttgggatctagttct

SEQ ID NO: 102939 - DNA, 20 bp, Artificial Sequence
  Description of Artificial Sequence: Synthetic oligonucleotide
  Target: ATXN1; (+) strand; PAM type: NRG; PAM sequence: GGG
aaacttgggatctagttctt

SEQ ID NO: 102940 - DNA, 20 bp, Artificial Sequence
  Description of Artificial Sequence: Synthetic oligonucleotide
  Target: ATXN1; (+) strand; PAM type: NRG; PAM sequence: TAG
gatctagttcttgggttgtg

SEQ ID NO: 102941 - DNA, 20 bp, Artificial Sequence
  Description of Artificial Sequence: Synthetic oligonucleotide
  Target: ATXN1; (+) strand; PAM type: NRG; PAM sequence: TGG
ctagttcttgggttgtgtag

SEQ ID NO: 102942 - DNA, 20 bp, Artificial Sequence
  Description of Artificial Sequence: Synthetic oligonucleotide
  Target: ATXN1; (+) strand; PAM type: NRG; PAM sequence: GGG
tagttcttgggttgtgtagt

SEQ ID NO: 102943 - DNA, 20 bp, Artificial Sequence
  Description of Artificial Sequence: Synthetic oligonucleotide
  Target: ATXN1; (+) strand; PAM type: NRG; PAM sequence: TAG
tgggttgtgtagtgggtcat

SEQ ID NO: 102944 - DNA, 20 bp, Artificial Sequence
  Description of Artificial Sequence: Synthetic oligonucleotide
  Target: ATXN1; (+) strand; PAM type: NRG; PAM sequence: TAG
tgtagtgggtcattagtgtg

SEQ ID NO: 102945 - DNA, 20 bp, Artificial Sequence
  Description of Artificial Sequence: Synthetic oligonucleotide
  Target: ATXN1; (+) strand; PAM type: NRG; PAM sequence: AAG
tgggtcattagtgtgtagtg

SEQ ID NO: 102946 - DNA, 20 bp, Artificial Sequence
  Description of Artificial Sequence: Synthetic oligonucleotide
  Target: ATXN1; (+) strand; PAM type: NRG; PAM sequence: GAG
aagaattttttttctttttt

SEQ ID NO: 102947 - DNA, 20 bp, Artificial Sequence
  Description of Artificial Sequence: Synthetic oligonucleotide
  Target: ATXN1; (+) strand; PAM type: NRG; PAM sequence: CGG
attttttttcttttttgaga

SEQ ID NO: 102948 - DNA, 20 bp, Artificial Sequence
  Description of Artificial Sequence: Synthetic oligonucleotide
  Target: ATXN1; (+) strand; PAM type: NRG; PAM sequence: GAG
tttttttcttttttgagacg

SEQ ID NO: 102949 - DNA, 20 bp, Artificial Sequence
  Description of Artificial Sequence: Synthetic oligonucleotide
  Target: ATXN1; (+) strand; PAM type: NRG; PAM sequence: TAG
ctcactctgtcaccatgctg

SEQ ID NO: 102950 - DNA, 20 bp, Artificial Sequence
  Description of Artificial Sequence: Synthetic oligonucleotide
  Target: ATXN1; (+) strand; PAM type: NRG; PAM sequence: CAG
tctgtcaccatgctgtagtg

SEQ ID NO: 102951 - DNA, 20 bp, Artificial Sequence
  Description of Artificial Sequence: Synthetic oligonucleotide
  Target: ATXN1; (+) strand; PAM type: NRG; PAM sequence: TGG
gtcaccatgctgtagtgcag

SEQ ID NO: 102952 - DNA, 20 bp, Artificial Sequence
  Description of Artificial Sequence: Synthetic oligonucleotide
  Target: ATXN1; (+) strand; PAM type: NRG; PAM sequence: CGG
gtagtgcagtggcgtgatct

SEQ ID NO: 102953 - DNA, 20 bp, Artificial Sequence
  Description of Artificial Sequence: Synthetic oligonucleotide
  Target: ATXN1; (+) strand; PAM type: NRG; PAM sequence: TGG
tcactgcaacctctgcctcc

SEQ ID NO: 102954 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctctgcctcct

SEQ ID NO: 102955 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcctgggttc

SEQ ID NO: 102956 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 102957 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagccttcc

SEQ ID NO: 102958 - DNA, 20 bp, Artificial Sequence
  Description of Artificial Sequence: Synthetic oligonucleotide
  Target: ATXN1; (+) strand; PAM type: NRG; PAM sequence: AAG
tcctgcctcagccttccaag

SEQ ID NO: 102959 - DNA, 20 bp, Artificial Sequence
  Description of Artificial Sequence: Synthetic oligonucleotide
  Target: ATXN1; (+) strand; PAM type: NRG; PAM sequence: TGG
gcctcagccttccaagaagc

SEQ ID NO: 102960 - DNA, 20 bp, Artificial Sequence
  Description of Artificial Sequence: Synthetic oligonucleotide
  Target: ATXN1; (+) strand; PAM type: NRG; PAM sequence: GGG
cctcagccttccaagaagct

SEQ ID NO: 102961 - DNA, 20 bp, Artificial Sequence
  Description of Artificial Sequence: Synthetic oligonucleotide
  Target: ATXN1; (+) strand; PAM type: NRG; PAM sequence: CAG
cttccaagaagctgggacta

SEQ ID NO: 102962 - DNA, 20 bp, Artificial Sequence
  Description of Artificial Sequence: Synthetic oligonucleotide
  Target: ATXN1; (+) strand; PAM type: NRG; PAM sequence: AGG
ttccaagaagctgggactac

SEQ ID NO: 102963 - DNA, 20 bp, Artificial Sequence
  Description of Artificial Sequence: Synthetic oligonucleotide
  Target: ATXN1; (+) strand; PAM type: NRG; PAM sequence: CAG
caggcgcatgccaccatgcc

SEQ ID NO: 102964 - DNA, 20 bp, Artificial Sequence
  Description of Artificial Sequence: Synthetic oligonucleotide
  Target: ATXN1; (+) strand; PAM type: NRG; PAM sequence: TAG
ccagctaatttttgtatttt

SEQ ID NO: 102965 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtatttttag

SEQ ID NO: 102966 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagta

SEQ ID NO: 102967 - DNA, 20 bp, Artificial Sequence
  Description of Artificial Sequence: Synthetic oligonucleotide
  Target: ATXN1; (+) strand; PAM type: NRG; PAM sequence: CAG
ttttgtatttttagtagaga

SEQ ID NO: 102968 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagac

SEQ ID NO: 102969 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagaca

SEQ ID NO: 102970 - DNA, 20 bp, Artificial Sequence
  Description of Artificial Sequence: Synthetic oligonucleotide
  Target: ATXN1; (+) strand; PAM type: NRG; PAM sequence: TGG
gagacagggtttcaccatgt

SEQ ID NO: 102971 - DNA, 20 bp, Artificial Sequence
  Description of Artificial Sequence: Synthetic oligonucleotide
  Target: ATXN1; (+) strand; PAM type: NRG; PAM sequence: CAG
cagggtttcaccatgttggc

SEQ ID NO: 102972 - DNA, 20 bp, Artificial Sequence
  Description of Artificial Sequence: Synthetic oligonucleotide
  Target: ATXN1; (+) strand; PAM type: NRG; PAM sequence: AGG
agggtttcaccatgttggcc

SEQ ID NO: 102973 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccagga

SEQ ID NO: 102974 - DNA, 20 bp, Artificial Sequence
  Description of Artificial Sequence: Synthetic oligonucleotide
  Target: ATXN1; (+) strand; PAM type: NRG; PAM sequence: CGG
gtctcgatctcttgacttcg

SEQ ID NO: 102975 - DNA, 20 bp, Artificial Sequence
  Description of Artificial Sequence: Synthetic oligonucleotide
  Target: ATXN1; (+) strand; PAM type: NRG; PAM sequence: CGG
acttcgcggtctgcccacct

SEQ ID NO: 102976 - DNA, 20 bp, Artificial Sequence
  Description of Artificial Sequence: Synthetic oligonucleotide
  Target: ATXN1; (+) strand; PAM type: NRG; PAM sequence: AAG
ctgcccacctcggcctccca

SEQ ID NO: 102977 - DNA, 20 bp, Artificial Sequence
  Description of Artificial Sequence: Synthetic oligonucleotide
  Target: ATXN1; (+) strand; PAM type: NRG; PAM sequence: TGG
acctcggcctcccaaagtgc

SEQ ID NO: 102978 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 102979 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 102980 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 102981 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtat

SEQ ID NO: 102982 - DNA, 20 bp, Artificial Sequence
  Description of Artificial Sequence: Synthetic oligonucleotide
  Target: ATXN1; (+) strand; PAM type: NRG; PAM sequence: AAG
agccaccgcgcctgaccatg

SEQ ID NO: 102983 - DNA, 20 bp, Artificial Sequence
  Description of Artificial Sequence: Synthetic oligonucleotide
  Target: ATXN1; (+) strand; PAM type: NRG; PAM sequence: CAG
aatttaacctcacccaaact

SEQ ID NO: 102984 - DNA, 20 bp, Artificial Sequence
  Description of Artificial Sequence: Synthetic oligonucleotide
  Target: ATXN1; (+) strand; PAM type: NRG; PAM sequence: AGG
atttaacctcacccaaactc

SEQ ID NO: 102985 - DNA, 20 bp, Artificial Sequence
  Description of Artificial Sequence: Synthetic oligonucleotide
  Target: ATXN1; (+) strand; PAM type: NRG; PAM sequence: TGG
acctcacccaaactcaggtc

SEQ ID NO: 102986 - DNA, 20 bp, Artificial Sequence
  Description of Artificial Sequence: Synthetic oligonucleotide
  Target: ATXN1; (+) strand; PAM type: NRG; PAM sequence: TGG
ctggcctttgcccccacctg

SEQ ID NO: 102987 - DNA, 20 bp, Artificial Sequence
  Description of Artificial Sequence: Synthetic oligonucleotide
  Target: ATXN1; (+) strand; PAM type: NRG; PAM sequence: GGG
tggcctttgcccccacctgt

SEQ ID NO: 102988 - DNA, 20 bp, Artificial Sequence
  Description of Artificial Sequence: Synthetic oligonucleotide
  Target: ATXN1; (+) strand; PAM type: NRG; PAM sequence: GGG
ggcctttgcccccacctgtg

SEQ ID NO: 102989 - DNA, 20 bp, Artificial Sequence
  Description of Artificial Sequence: Synthetic oligonucleotide
  Target: ATXN1; (+) strand; PAM type: NRG; PAM sequence: GAG
cctttgcccccacctgtggg

SEQ ID NO: 102990 - DNA, 20 bp, Artificial Sequence
  Description of Artificial Sequence: Synthetic oligonucleotide
  Target: ATXN1; (+) strand; PAM type: NRG; PAM sequence: AGG
ctttgcccccacctgtgggg

SEQ ID NO: 102991 - DNA, 20 bp, Artificial Sequence
  Description of Artificial Sequence: Synthetic oligonucleotide
  Target: ATXN1; (+) strand; PAM type: NRG; PAM sequence: CGG
cctgtggggaggtgatctct

SEQ ID NO: 102992 - DNA, 20 bp, Artificial Sequence
  Description of Artificial Sequence: Synthetic oligonucleotide
  Target: ATXN1; (+) strand; PAM type: NRG; PAM sequence: TGG
ggaggtgatctctcggcctc

SEQ ID NO: 102993 - DNA, 20 bp, Artificial Sequence
  Description of Artificial Sequence: Synthetic oligonucleotide
  Target: ATXN1; (+) strand; PAM type: NRG; PAM sequence: CAG
ctctggaatgtcctgcctca

SEQ ID NO: 102994 - DNA, 20 bp, Artificial Sequence
  Description of Artificial Sequence: Synthetic oligonucleotide
  Target: ATXN1; (+) strand; PAM type: NRG; PAM sequence: AAG
tggaatgtcctgcctcacag

SEQ ID NO: 102995 - DNA, 20 bp, Artificial Sequence
  Description of Artificial Sequence: Synthetic oligonucleotide
  Target: ATXN1; (+) strand; PAM type: NRG; PAM sequence: TGG
cctcacagaagtatgtttat

SEQ ID NO: 102996 - DNA, 20 bp, Artificial Sequence
  Description of Artificial Sequence: Synthetic oligonucleotide
  Target: ATXN1; (+) strand; PAM type: NRG; PAM sequence: TGG
gaagtatgtttattggccac

SEQ ID NO: 102997 - DNA, 20 bp, Artificial Sequence
  Description of Artificial Sequence: Synthetic oligonucleotide
  Target: ATXN1; (+) strand; PAM type: NRG; PAM sequence: TGG
tatgtttattggccactgga

SEQ ID NO: 102998 - DNA, 20 bp, Artificial Sequence
  Description of Artificial Sequence: Synthetic oligonucleotide
  Target: ATXN1; (+) strand; PAM type: NRG; PAM sequence: GAG
tgtttattggccactggatg

SEQ ID NO: 102999 - DNA, 20 bp, Artificial Sequence
  Description of Artificial Sequence: Synthetic oligonucleotide
  Target: ATXN1; (+) strand; PAM type: NRG; PAM sequence: TGG
agtaacaatgtgatttatga

SEQ ID NO: 103000 - DNA, 20 bp, Artificial Sequence
  Description of Artificial Sequence: Synthetic oligonucleotide
  Target: ATXN1; (+) strand; PAM type: NRG; PAM sequence: GGG
gtaacaatgtgatttatgat

SEQ ID NO: 103001 - DNA, 20 bp, Artificial Sequence
  Description of Artificial Sequence: Synthetic oligonucleotide
  Target: ATXN1; (+) strand; PAM type: NRG; PAM sequence: GGG
taacaatgtgatttatgatg

SEQ ID NO: 103002 - DNA, 20 bp, Artificial Sequence
  Description of Artificial Sequence: Synthetic oligonucleotide
  Target: ATXN1; (+) strand; PAM type: NRG; PAM sequence: GGG
aacaatgtgatttatgatgg

SEQ ID NO: 103003 - DNA, 20 bp, Artificial Sequence
  Description of Artificial Sequence: Synthetic oligonucleotide
  Target: ATXN1; (+) strand; PAM type: NRG; PAM sequence: TGG
gtgatttatgatgggggctt

SEQ ID NO: 103004 - DNA, 20 bp, Artificial Sequence
  Description of Artificial Sequence: Synthetic oligonucleotide
  Target: ATXN1; (+) strand; PAM type: NRG; PAM sequence: GGG
tgatttatgatgggggcttt

SEQ ID NO: 103005 - DNA, 20 bp, Artificial Sequence
  Description of Artificial Sequence: Synthetic oligonucleotide
  Target: ATXN1; (+) strand; PAM type: NRG; PAM sequence: GAG
tgatgggggctttgggccat

SEQ ID NO: 103006 - DNA, 20 bp, Artificial Sequence
  Description of Artificial Sequence: Synthetic oligonucleotide
  Target: ATXN1; (+) strand; PAM type: NRG; PAM sequence: AGG
gatgggggctttgggccatg

SEQ ID NO: 103007 - DNA, 20 bp, Artificial Sequence
  Description of Artificial Sequence: Synthetic oligonucleotide
  Target: ATXN1; (+) strand; PAM type: NRG; PAM sequence: CAG
tgaggtatacgttccaacct

SEQ ID NO: 103008 - DNA, 20 bp, Artificial Sequence
  Description of Artificial Sequence: Synthetic oligonucleotide
  Target: ATXN1; (+) strand; PAM type: NRG; PAM sequence: GAG
aggtatacgttccaacctca

SEQ ID NO: 103009 - DNA, 20 bp, Artificial Sequence
  Description of Artificial Sequence: Synthetic oligonucleotide
  Target: ATXN1; (+) strand; PAM type: NRG; PAM sequence: AGG
ggtatacgttccaacctcag

SEQ ID NO: 103010 - DNA, 20 bp, Artificial Sequence
  Description of Artificial Sequence: Synthetic oligonucleotide
  Target: ATXN1; (+) strand; PAM type: NRG; PAM sequence: AAG
ctcagaggaactaataatga

SEQ ID NO: 103011 - DNA, 20 bp, Artificial Sequence
  Description of Artificial Sequence: Synthetic oligonucleotide
  Target: ATXN1; (+) strand; PAM type: NRG; PAM sequence: CAG
aaagatatttgcctgatctc

SEQ ID NO: 103012 - DNA, 20 bp, Artificial Sequence
  Description of Artificial Sequence: Synthetic oligonucleotide
  Target: ATXN1; (+) strand; PAM type: NRG; PAM sequence: AGG
aagatatttgcctgatctcc

SEQ ID NO: 103013 - DNA, 20 bp, Artificial Sequence
  Description of Artificial Sequence: Synthetic oligonucleotide
  Target: ATXN1; (+) strand; PAM type: NRG; PAM sequence: GAG
gatatttgcctgatctccag

SEQ ID NO: 103014 - DNA, 20 bp, Artificial Sequence
  Description of Artificial Sequence: Synthetic oligonucleotide
  Target: ATXN1; (+) strand; PAM type: NRG; PAM sequence: AGG
atatttgcctgatctccagg

SEQ ID NO: 103015 - DNA, 20 bp, Artificial Sequence
  Description of Artificial Sequence: Synthetic oligonucleotide
  Target: ATXN1; (+) strand; PAM type: NRG; PAM sequence: GGG
tatttgcctgatctccagga

SEQ ID NO: 103016 - DNA, 20 bp, Artificial Sequence
  Description of Artificial Sequence: Synthetic oligonucleotide
  Target: ATXN1; (+) strand; PAM type: NRG; PAM sequence: TAG
gcctgatctccaggagggcc

SEQ ID NO: 103017 - DNA, 20 bp, Artificial Sequence
  Description of Artificial Sequence: Synthetic oligonucleotide
  Target: ATXN1; (+) strand; PAM type: NRG; PAM sequence: AGG
cctgatctccaggagggcct

SEQ ID NO: 103018 - DNA, 20 bp, Artificial Sequence
  Description of Artificial Sequence: Synthetic oligonucleotide
  Target: ATXN1; (+) strand; PAM type: NRG; PAM sequence: GGG
ctgatctccaggagggccta

SEQ ID NO: 103019 - DNA, 20 bp, Artificial Sequence
  Description of Artificial Sequence: Synthetic oligonucleotide
  Target: ATXN1; (+) strand; PAM type: NRG; PAM sequence: TAG
ctccaggagggcctagggac

SEQ ID NO: 103020 - DNA, 20 bp, Artificial Sequence
  Description of Artificial Sequence: Synthetic oligonucleotide
  Target: ATXN1; (+) strand; PAM type: NRG; PAM sequence: GAG
ccaggagggcctagggacta

SEQ ID NO: 103021 - DNA, 20 bp, Artificial Sequence
  Description of Artificial Sequence: Synthetic oligonucleotide
  Target: ATXN1; (+) strand; PAM type: NRG; PAM sequence: AGG
caggagggcctagggactag

SEQ ID NO: 103022 - DNA, 20 bp, Artificial Sequence
  Description of Artificial Sequence: Synthetic oligonucleotide
  Target: ATXN1; (+) strand; PAM type: NRG; PAM sequence: CAG
agggcctagggactagaggt

SEQ ID NO: 103023 - DNA, 20 bp, Artificial Sequence
  Description of Artificial Sequence: Synthetic oligonucleotide
  Target: ATXN1; (+) strand; PAM type: NRG; PAM sequence: GAG
agggactagaggtcagtcat

SEQ ID NO: 103024 - DNA, 20 bp, Artificial Sequence
  Description of Artificial Sequence: Synthetic oligonucleotide
  Target: ATXN1; (+) strand; PAM type: NRG; PAM sequence: AGG
gggactagaggtcagtcatg

SEQ ID NO: 103025 - DNA, 20 bp, Artificial Sequence
  Description of Artificial Sequence: Synthetic oligonucleotide
  Target: ATXN1; (+) strand; PAM type: NRG; PAM sequence: CAG
ctagaggtcagtcatgagga

SEQ ID NO: 103026 - DNA, 20 bp, Artificial Sequence
  Description of Artificial Sequence: Synthetic oligonucleotide
  Target: ATXN1; (+) strand; PAM type: NRG; PAM sequence: TAG
gaggtcagtcatgaggacag

SEQ ID NO: 103027 - DNA, 20 bp, Artificial Sequence
  Description of Artificial Sequence: Synthetic oligonucleotide
  Target: ATXN1; (+) strand; PAM type: NRG; PAM sequence: GAG
tcatgaggacagtagcaatt

SEQ ID NO: 103028 - DNA, 20 bp, Artificial Sequence
  Description of Artificial Sequence: Synthetic oligonucleotide
  Target: ATXN1; (+) strand; PAM type: NRG; PAM sequence: TAG
ttgagctccaataaaaactc

SEQ ID NO: 103029 - DNA, 20 bp, Artificial Sequence
  Description of Artificial Sequence: Synthetic oligonucleotide
  Target: ATXN1; (+) strand; PAM type: NRG; PAM sequence: GAG
caataaaaactctagatgct

SEQ ID NO: 103030 - DNA, 20 bp, Artificial Sequence
  Description of Artificial Sequence: Synthetic oligonucleotide
  Target: ATXN1; (+) strand; PAM type: NRG; PAM sequence: AGG
aataaaaactctagatgctg

SEQ ID NO: 103031 - DNA, 20 bp, Artificial Sequence
  Description of Artificial Sequence: Synthetic oligonucleotide
  Target: ATXN1; (+) strand; PAM type: NRG; PAM sequence: GAG
ctagatgctgaggttcgcgt

SEQ ID NO: 103032 - DNA, 20 bp, Artificial Sequence
  Description of Artificial Sequence: Synthetic oligonucleotide
  Target: ATXN1; (+) strand; PAM type: NRG; PAM sequence: TGG
gaggttcgcgtgagcttccc

SEQ ID NO: 103033 - DNA, 20 bp, Artificial Sequence
  Description of Artificial Sequence: Synthetic oligonucleotide
  Target: ATXN1; (+) strand; PAM type: NRG; PAM sequence: TGG
ttcgcgtgagcttccctggt

SEQ ID NO: 103034 - DNA, 20 bp, Artificial Sequence
  Description of Artificial Sequence: Synthetic oligonucleotide
  Target: ATXN1; (+) strand; PAM type: NRG; PAM sequence: TGG
gttggtgattcttcacatca

SEQ ID NO: 103035 - DNA, 20 bp, Artificial Sequence
  Description of Artificial Sequence: Synthetic oligonucleotide
  Target: ATXN1; (+) strand; PAM type: NRG; PAM sequence: TGG
gtgattcttcacatcatggc

SEQ ID NO: 103036 - DNA, 20 bp, Artificial Sequence
  Description of Artificial Sequence: Synthetic oligonucleotide
  Target: ATXN1; (+) strand; PAM type: NRG; PAM sequence: GGG
tgattcttcacatcatggct

SEQ ID NO: 103037 - DNA, 20 bp, Artificial Sequence
  Description of Artificial Sequence: Synthetic oligonucleotide
  Target: ATXN1; (+) strand; PAM type: NRG; PAM sequence: GAG
attcttcacatcatggctgg

SEQ ID NO: 103038 - DNA, 20 bp, Artificial Sequence
  Description of Artificial Sequence: Synthetic oligonucleotide
  Target: ATXN1; (+) strand; PAM type: NRG; PAM sequence: AGG
ttcttcacatcatggctggg

SEQ ID NO: 103039 - DNA, 20 bp, Artificial Sequence
  Description of Artificial Sequence: Synthetic oligonucleotide
  Target: ATXN1; (+) strand; PAM type: NRG; PAM sequence: GAG
cttcacatcatggctgggag

SEQ ID NO: 103040 - DNA, 20 bp, Artificial Sequence
  Description of Artificial Sequence: Synthetic oligonucleotide
  Target: ATXN1; (+) strand; PAM type: NRG; PAM sequence: AGG
ttcacatcatggctgggagg

SEQ ID NO: 103041 - DNA, 20 bp, Artificial Sequence
  Description of Artificial Sequence: Synthetic oligonucleotide
  Target: ATXN1; (+) strand; PAM type: NRG; PAM sequence: TGG
taatgctgttcatcacttca

SEQ ID NO: 103042 - DNA, 20 bp, Artificial Sequence
  Description of Artificial Sequence: Synthetic oligonucleotide
  Target: ATXN1; (+) strand; PAM type: NRG; PAM sequence: GGG
aatgctgttcatcacttcat

SEQ ID NO: 103043 - DNA, 20 bp, Artificial Sequence
  Description of Artificial Sequence: Synthetic oligonucleotide
  Target: ATXN1; (+) strand; PAM type: NRG; PAM sequence: CAG
gctgttcatcacttcatggg

SEQ ID NO: 103044 - DNA, 20 bp, Artificial Sequence
  Description of Artificial Sequence: Synthetic oligonucleotide
  Target: ATXN1; (+) strand; PAM type: NRG; PAM sequence: GAG
tgttcatcacttcatgggca

SEQ ID NO: 103045 - DNA, 20 bp, Artificial Sequence
  Description of Artificial Sequence: Synthetic oligonucleotide
  Target: ATXN1; (+) strand; PAM type: NRG; PAM sequence: AGG
gttcatcacttcatgggcag

SEQ ID NO: 103046 - DNA, 20 bp, Artificial Sequence
  Description of Artificial Sequence: Synthetic oligonucleotide
  Target: ATXN1; (+) strand; PAM type: NRG; PAM sequence: GGG
ttcatcacttcatgggcaga

SEQ ID NO: 103047 - DNA, 20 bp, Artificial Sequence
  Description of Artificial Sequence: Synthetic oligonucleotide
  Target: ATXN1; (+) strand; PAM type: NRG; PAM sequence: CAG
acttcatgggcagagggcaa

SEQ ID NO: 103048 - DNA, 20 bp, Artificial Sequence
  Description of Artificial Sequence: Synthetic oligonucleotide
  Target: ATXN1; (+) strand; PAM type: NRG; PAM sequence: AAG
tcatgggcagagggcaacag

SEQ ID NO: 103049 - DNA, 20 bp, Artificial Sequence
  Description of Artificial Sequence: Synthetic oligonucleotide
  Target: ATXN1; (+) strand; PAM type: NRG; PAM sequence: TGG
ggcaacagaagccccatgtc

SEQ ID NO: 103050 - DNA, 20 bp, Artificial Sequence
  Description of Artificial Sequence: Synthetic oligonucleotide
  Target: ATXN1; (+) strand; PAM type: NRG; PAM sequence: TAG
gccccatgtctggacccctc

SEQ ID NO: 103051 - DNA, 20 bp, Artificial Sequence
  Description of Artificial Sequence: Synthetic oligonucleotide
  Target: ATXN1; (+) strand; PAM type: NRG; PAM sequence: TGG
ctcctatatgcctcttaccc

SEQ ID NO: 103052 - DNA, 20 bp, Artificial Sequence
  Description of Artificial Sequence: Synthetic oligonucleotide
  Target: ATXN1; (+) strand; PAM type: NRG; PAM sequence: AAG
atatgcctcttaccctggct

SEQ ID NO: 103053 - DNA, 20 bp, Artificial Sequence
  Description of Artificial Sequence: Synthetic oligonucleotide
  Target: ATXN1; (+) strand; PAM type: NRG; PAM sequence: AAG
ttgtatcctttccctgtaat

SEQ ID NO: 103054 - DNA, 20 bp, Artificial Sequence
  Description of Artificial Sequence: Synthetic oligonucleotide
  Target: ATXN1; (+) strand; PAM type: NRG; PAM sequence: GAG
cctttccctgtaataagtat

SEQ ID NO: 103055 - DNA, 20 bp, Artificial Sequence
  Description of Artificial Sequence: Synthetic oligonucleotide
  Target: ATXN1; (+) strand; PAM type: NRG; PAM sequence: TAG
ttccctgtaataagtatgag

SEQ ID NO: 103056 - DNA, 20 bp, Artificial Sequence
  Description of Artificial Sequence: Synthetic oligonucleotide
  Target: ATXN1; (+) strand; PAM type: NRG; PAM sequence: CAG
tgtaataagtatgagtagaa

SEQ ID NO: 103057 - DNA, 20 bp, Artificial Sequence
  Description of Artificial Sequence: Synthetic oligonucleotide
  Target: ATXN1; (+) strand; PAM type: NRG; PAM sequence: CAG
agtatgagtagaacagcttt

SEQ ID NO: 103058 - DNA, 20 bp, Artificial Sequence
  Description of Artificial Sequence: Synthetic oligonucleotide
  Target: ATXN1; (+) strand; PAM type: NRG; PAM sequence: GAG
tgagtagaacagctttcagt

SEQ ID NO: 103059 - DNA, 20 bp, Artificial Sequence
  Description of Artificial Sequence: Synthetic oligonucleotide
  Target: ATXN1; (+) strand; PAM type: NRG; PAM sequence: GAG
cagctttcagtgagttctgt

SEQ ID NO: 103060 - DNA, 20 bp, Artificial Sequence
  Description of Artificial Sequence: Synthetic oligonucleotide
  Target: ATXN1; (+) strand; PAM type: NRG; PAM sequence: CGG
cttttactgaattatcaaaa

SEQ ID NO: 103061 - DNA, 20 bp, Artificial Sequence
  Description of Artificial Sequence: Synthetic oligonucleotide
  Target: ATXN1; (+) strand; PAM type: NRG; PAM sequence: GAG
tttactgaattatcaaaacg

SEQ ID NO: 103062 - DNA, 20 bp, Artificial Sequence
  Description of Artificial Sequence: Synthetic oligonucleotide
  Target: ATXN1; (+) strand; PAM type: NRG; PAM sequence: AGG
ttactgaattatcaaaacgg

SEQ ID NO: 103063 - DNA, 20 bp, Artificial Sequence
  Description of Artificial Sequence: Synthetic oligonucleotide
  Target: ATXN1; (+) strand; PAM type: NRG; PAM sequence: GGG
tactgaattatcaaaacgga

SEQ ID NO: 103064 - DNA, 20 bp, Artificial Sequence
  Description of Artificial Sequence: Synthetic oligonucleotide
  Target: ATXN1; (+) strand; PAM type: NRG; PAM sequence: TGG
tgaattatcaaaacggaggg

SEQ ID NO: 103065 - DNA, 20 bp, Artificial Sequence
  Description of Artificial Sequence: Synthetic oligonucleotide
  Target: ATXN1; (+) strand; PAM type: NRG; PAM sequence: TGG
tatcaaaacggagggtggtc

SEQ ID NO: 103066 - DNA, 20 bp, Artificial Sequence
  Description of Artificial Sequence: Synthetic oligonucleotide
  Target: ATXN1; (+) strand; PAM type: NRG; PAM sequence: GGG
atcaaaacggagggtggtct

SEQ ID NO: 103067 - DNA, 20 bp, Artificial Sequence
  Description of Artificial Sequence: Synthetic oligonucleotide
  Target: ATXN1; (+) strand; PAM type: NRG; PAM sequence: TGG
ccccctgaacttgcaattcg

SEQ ID NO: 103068 - DNA, 20 bp, Artificial Sequence
  Description of Artificial Sequence: Synthetic oligonucleotide
  Target: ATXN1; (+) strand; PAM type: NRG; PAM sequence: CAG
tgaacttgcaattcgtggtg

SEQ ID NO: 103069 - DNA, 20 bp, Artificial Sequence
  Description of Artificial Sequence: Synthetic oligonucleotide
  Target: ATXN1; (+) strand; PAM type: NRG; PAM sequence: AGG
gaacttgcaattcgtggtgc

SEQ ID NO: 103070 - DNA, 20 bp, Artificial Sequence
  Description of Artificial Sequence: Synthetic oligonucleotide
  Target: ATXN1; (+) strand; PAM type: NRG; PAM sequence: TAG
cactgctctctctaacgttg

SEQ ID NO: 103071 - DNA, 20 bp, Artificial Sequence
  Description of Artificial Sequence: Synthetic oligonucleotide
  Target: ATXN1; (+) strand; PAM type: NRG; PAM sequence: TGG
gctctctctaacgttgtagt

SEQ ID NO: 103072 - DNA, 20 bp, Artificial Sequence
  Description of Artificial Sequence: Synthetic oligonucleotide
  Target: ATXN1; (+) strand; PAM type: NRG; PAM sequence: TAG
tgtagttggtcaccttctta

SEQ ID NO: 103073 - DNA, 20 bp, Artificial Sequence
  Description of Artificial Sequence: Synthetic oligonucleotide
  Target: ATXN1; (+) strand; PAM type: NRG; PAM sequence: TAG
gttggtcaccttcttatagc

SEQ ID NO: 103074 - DNA, 20 bp, Artificial Sequence
  Description of Artificial Sequence: Synthetic oligonucleotide
  Target: ATXN1; (+) strand; PAM type: NRG; PAM sequence: TGG
caccttcttatagctagtga

SEQ ID NO: 103075 - DNA, 20 bp, Artificial Sequence
  Description of Artificial Sequence: Synthetic oligonucleotide
  Target: ATXN1; (+) strand; PAM type: NRG; PAM sequence: TAG
gtgatggttatacacttaaa

SEQ ID NO: 103076 - DNA, 20 bp, Artificial Sequence
  Description of Artificial Sequence: Synthetic oligonucleotide
  Target: ATXN1; (+) strand; PAM type: NRG; PAM sequence: AGG
tgatggttatacacttaaat

SEQ ID NO: 103077 - DNA, 20 bp, Artificial Sequence
  Description of Artificial Sequence: Synthetic oligonucleotide
  Target: ATXN1; (+) strand; PAM type: NRG; PAM sequence: AAG
gttatacacttaaataggcc

SEQ ID NO: 103078 - DNA, 20 bp, Artificial Sequence
  Description of Artificial Sequence: Synthetic oligonucleotide
  Target: ATXN1; (+) strand; PAM type: NRG; PAM sequence: AAG
aataaaatataacaacgttg

SEQ ID NO: 103079 - DNA, 20 bp, Artificial Sequence
  Description of Artificial Sequence: Synthetic oligonucleotide
  Target: ATXN1; (+) strand; PAM type: NRG; PAM sequence: CAG
aacgttgaagtaacatccat

SEQ ID NO: 103080 - DNA, 20 bp, Artificial Sequence
  Description of Artificial Sequence: Synthetic oligonucleotide
  Target: ATXN1; (+) strand; PAM type: NRG; PAM sequence: CAG
aagtaacatccatcagcgtt

SEQ ID NO: 103081 - DNA, 20 bp, Artificial Sequence
  Description of Artificial Sequence: Synthetic oligonucleotide
  Target: ATXN1; (+) strand; PAM type: NRG; PAM sequence: AAG
atccatcagcgttcagtgat

SEQ ID NO: 103082 - DNA, 20 bp, Artificial Sequence
  Description of Artificial Sequence: Synthetic oligonucleotide
  Target: ATXN1; (+) strand; PAM type: NRG; PAM sequence: TAG
atgccttgtgaaacaataat

SEQ ID NO: 103083 - DNA, 20 bp, Artificial Sequence
  Description of Artificial Sequence: Synthetic oligonucleotide
  Target: ATXN1; (+) strand; PAM type: NRG; PAM sequence: AGG
tgccttgtgaaacaataatt

SEQ ID NO: 103084 - DNA, 20 bp, Artificial Sequence
  Description of Artificial Sequence: Synthetic oligonucleotide
  Target: ATXN1; (+) strand; PAM type: NRG; PAM sequence: TGG
ataattaggttaatctaaat

SEQ ID NO: 103085 - DNA, 20 bp, Artificial Sequence
  Description of Artificial Sequence: Synthetic oligonucleotide
  Target: ATXN1; (+) strand; PAM type: NRG; PAM sequence: TGG
aattggtataccccaaactg

SEQ ID NO: 103086 - DNA, 20 bp, Artificial Sequence
  Description of Artificial Sequence: Synthetic oligonucleotide
  Target: ATXN1; (+) strand; PAM type: NRG; PAM sequence: CAG
ggtataccccaaactgtggc

SEQ ID NO: 103087 - DNA, 20 bp, Artificial Sequence
  Description of Artificial Sequence: Synthetic oligonucleotide
  Target: ATXN1; (+) strand; PAM type: NRG; PAM sequence: AGG
gtataccccaaactgtggcc

SEQ ID NO: 103088 - DNA, 20 bp, Artificial Sequence
  Description of Artificial Sequence: Synthetic oligonucleotide
  Target: ATXN1; (+) strand; PAM type: NRG; PAM sequence: GGG
tataccccaaactgtggcca

SEQ ID NO: 103089 - DNA, 20 bp, Artificial Sequence
  Description of Artificial Sequence: Synthetic oligonucleotide
  Target: ATXN1; (+) strand; PAM type: NRG; PAM sequence: CAG
cccaaactgtggccagggaa

SEQ ID NO: 103090 - DNA, 20 bp, Artificial Sequence
  Description of Artificial Sequence: Synthetic oligonucleotide
  Target: ATXN1; (+) strand; PAM type: NRG; PAM sequence: AGG
ccaaactgtggccagggaac

SEQ ID NO: 103091 - DNA, 20 bp, Artificial Sequence
  Description of Artificial Sequence: Synthetic oligonucleotide
  Target: ATXN1; (+) strand; PAM type: NRG; PAM sequence: CAG
aactgtggccagggaacagg

SEQ ID NO: 103092 - DNA, 20 bp, Artificial Sequence
  Description of Artificial Sequence: Synthetic oligonucleotide
  Target: ATXN1; (+) strand; PAM type: NRG; PAM sequence: TGG
gtggccagggaacaggcaga

SEQ ID NO: 103093 - DNA, 20 bp, Artificial Sequence
  Description of Artificial Sequence: Synthetic oligonucleotide
  Target: ATXN1; (+) strand; PAM type: NRG; PAM sequence: GGG
tggccagggaacaggcagat

SEQ ID NO: 103094 - DNA, 20 bp, Artificial Sequence
  Description of Artificial Sequence: Synthetic oligonucleotide
  Target: ATXN1; (+) strand; PAM type: NRG; PAM sequence: TGG
ccagggaacaggcagatggg

SEQ ID NO: 103095 - DNA, 20 bp, Artificial Sequence
  Description of Artificial Sequence: Synthetic oligonucleotide
  Target: ATXN1; (+) strand; PAM type: NRG; PAM sequence: CAG
gaacaggcagatgggtggta

SEQ ID NO: 103096 - DNA, 20 bp, Artificial Sequence
  Description of Artificial Sequence: Synthetic oligonucleotide
  Target: ATXN1; (+) strand; PAM type: NRG; PAM sequence: AAG
aggcagatgggtggtacaga

SEQ ID NO: 103097 - DNA, 20 bp, Artificial Sequence
  Description of Artificial Sequence: Synthetic oligonucleotide
  Target: ATXN1; (+) strand; PAM type: NRG; PAM sequence: AGG
ggcagatgggtggtacagaa

SEQ ID NO: 103098 - DNA, 20 bp, Artificial Sequence
  Description of Artificial Sequence: Synthetic oligonucleotide
  Target: ATXN1; (+) strand; PAM type: NRG; PAM sequence: CAG
atgggtggtacagaaaggaa

SEQ ID NO: 103099 - DNA, 20 bp, Artificial Sequence
  Description of Artificial Sequence: Synthetic oligonucleotide
  Target: ATXN1; (+) strand; PAM type: NRG; PAM sequence: AGG
tgggtggtacagaaaggaac

SEQ ID NO: 103100 - DNA, 20 bp, Artificial Sequence
  Description of Artificial Sequence: Synthetic oligonucleotide
  Target: ATXN1; (+) strand; PAM type: NRG; PAM sequence: GGG
gggtggtacagaaaggaaca

SEQ ID NO: 103101 - DNA, 20 bp, Artificial Sequence
  Description of Artificial Sequence: Synthetic oligonucleotide
  Target: ATXN1; (+) strand; PAM type: NRG; PAM sequence: CAG
gaacagggatatatattact

SEQ ID NO: 103102 - DNA, 20 bp, Artificial Sequence
  Description of Artificial Sequence: Synthetic oligonucleotide
  Target: ATXN1; (+) strand; PAM type: NRG; PAM sequence: CAG
attactcagtgtaatgtcac

SEQ ID NO: 103103 - DNA, 20 bp, Artificial Sequence
  Description of Artificial Sequence: Synthetic oligonucleotide
  Target: ATXN1; (+) strand; PAM type: NRG; PAM sequence: AGG
ttactcagtgtaatgtcacc

SEQ ID NO: 103104 - DNA, 20 bp, Artificial Sequence
  Description of Artificial Sequence: Synthetic oligonucleotide
  Target: ATXN1; (+) strand; PAM type: NRG; PAM sequence: GGG
tactcagtgtaatgtcacca

SEQ ID NO: 103105 - DNA, 20 bp, Artificial Sequence
  Description of Artificial Sequence: Synthetic oligonucleotide
  Target: ATXN1; (+) strand; PAM type: NRG; PAM sequence: AAG
gtgtaatgtcaccagggcca

SEQ ID NO: 103106 - DNA, 20 bp, Artificial Sequence
  Description of Artificial Sequence: Synthetic oligonucleotide
  Target: ATXN1; (+) strand; PAM type: NRG; PAM sequence: AGG
tgtaatgtcaccagggccaa

SEQ ID NO: 103107 - DNA, 20 bp, Artificial Sequence
  Description of Artificial Sequence: Synthetic oligonucleotide
  Target: ATXN1; (+) strand; PAM type: NRG; PAM sequence: CAG
tgtcaccagggccaaaggct

SEQ ID NO: 103108 - DNA, 20 bp, Artificial Sequence
  Description of Artificial Sequence: Synthetic oligonucleotide
  Target: ATXN1; (+) strand; PAM type: NRG; PAM sequence: GAG
tcaccagggccaaaggctca

SEQ ID NO: 103109 - DNA, 20 bp, Artificial Sequence
  Description of Artificial Sequence: Synthetic oligonucleotide
  Target: ATXN1; (+) strand; PAM type: NRG; PAM sequence: AAG
cagggccaaaggctcagaga

SEQ ID NO: 103110 - DNA, 20 bp, Artificial Sequence
  Description of Artificial Sequence: Synthetic oligonucleotide
  Target: ATXN1; (+) strand; PAM type: NRG; PAM sequence: TGG
gctcagagaaagcctccctg

SEQ ID NO: 103111 - DNA, 20 bp, Artificial Sequence
  Description of Artificial Sequence: Synthetic oligonucleotide
  Target: ATXN1; (+) strand; PAM type: NRG; PAM sequence: TGG
ccctgtggaaatctccccaa

SEQ ID NO: 103112 - DNA, 20 bp, Artificial Sequence
  Description of Artificial Sequence: Synthetic oligonucleotide
  Target: ATXN1; (+) strand; PAM type: NRG; PAM sequence: AAG
ccccaatggcacatacatgt

SEQ ID NO: 103113 - DNA, 20 bp, Artificial Sequence
  Description of Artificial Sequence: Synthetic oligonucleotide
  Target: ATXN1; (+) strand; PAM type: NRG; PAM sequence: AAG
caatggcacatacatgtaag

SEQ ID NO: 103114 - DNA, 20 bp, Artificial Sequence
  Description of Artificial Sequence: Synthetic oligonucleotide
  Target: ATXN1; (+) strand; PAM type: NRG; PAM sequence: GAG
acatacatgtaagaagcact

SEQ ID NO: 103115 - DNA, 20 bp, Artificial Sequence
  Description of Artificial Sequence: Synthetic oligonucleotide
  Target: ATXN1; (+) strand; PAM type: NRG; PAM sequence: TGG
tacatgtaagaagcactgag

SEQ ID NO: 103116 - DNA, 20 bp, Artificial Sequence
  Description of Artificial Sequence: Synthetic oligonucleotide
  Target: ATXN1; (+) strand; PAM type: NRG; PAM sequence: TGG
gcactgagtggatcaatttt

SEQ ID NO: 103117 - DNA, 20 bp, Artificial Sequence
  Description of Artificial Sequence: Synthetic oligonucleotide
  Target: ATXN1; (+) strand; PAM type: NRG; PAM sequence: GGG
cactgagtggatcaattttt

SEQ ID NO: 103118 - DNA, 20 bp, Artificial Sequence
  Description of Artificial Sequence: Synthetic oligonucleotide
  Target: ATXN1; (+) strand; PAM type: NRG; PAM sequence: GGG
actgagtggatcaatttttg

SEQ ID NO: 103119 - DNA, 20 bp, Artificial Sequence
  Description of Artificial Sequence: Synthetic oligonucleotide
  Target: ATXN1; (+) strand; PAM type: NRG; PAM sequence: CAG
gtggatcaatttttggggta

SEQ ID NO: 103120 - DNA, 20 bp, Artificial Sequence
  Description of Artificial Sequence: Synthetic oligonucleotide
  Target: ATXN1; (+) strand; PAM type: NRG; PAM sequence: GAG
ggatcaatttttggggtaca

SEQ ID NO: 103121 - DNA, 20 bp, Artificial Sequence
  Description of Artificial Sequence: Synthetic oligonucleotide
  Target: ATXN1; (+) strand; PAM type: NRG; PAM sequence: AAG
tttttggggtacagagttca

SEQ ID NO: 103122 - DNA, 20 bp, Artificial Sequence
  Description of Artificial Sequence: Synthetic oligonucleotide
  Target: ATXN1; (+) strand; PAM type: NRG; PAM sequence: TGG
gggtacagagttcaaagtgt

SEQ ID NO: 103123 - DNA, 20 bp, Artificial Sequence
  Description of Artificial Sequence: Synthetic oligonucleotide
  Target: ATXN1; (+) strand; PAM type: NRG; PAM sequence: GAG
gtacagagttcaaagtgttg

SEQ ID NO: 103124 - DNA, 20 bp, Artificial Sequence
  Description of Artificial Sequence: Synthetic oligonucleotide
  Target: ATXN1; (+) strand; PAM type: NRG; PAM sequence: TGG
agttcaaagtgttggagcaa

SEQ ID NO: 103125 - DNA, 20 bp, Artificial Sequence
  Description of Artificial Sequence: Synthetic oligonucleotide
  Target: ATXN1; (+) strand; PAM type: NRG; PAM sequence: GGG
gttcaaagtgttggagcaat

SEQ ID NO: 103126 - DNA, 20 bp, Artificial Sequence
  Description of Artificial Sequence: Synthetic oligonucleotide
  Target: ATXN1; (+) strand; PAM type: NRG; PAM sequence: GGG
ttcaaagtgttggagcaatg

SEQ ID NO: 103127 - DNA, 20 bp, Artificial Sequence
  Description of Artificial Sequence: Synthetic oligonucleotide
  Target: ATXN1; (+) strand; PAM type: NRG; PAM sequence: GGG
tcaaagtgttggagcaatgg

SEQ ID NO: 103128 - DNA, 20 bp, Artificial Sequence
  Description of Artificial Sequence: Synthetic oligonucleotide
  Target: ATXN1; (+) strand; PAM type: NRG; PAM sequence: CAG
ggagcaatgggggaacacat

SEQ ID NO: 103129 - DNA, 20 bp, Artificial Sequence
  Description of Artificial Sequence: Synthetic oligonucleotide
  Target: ATXN1; (+) strand; PAM type: NRG; PAM sequence: CGG
ggaacacatcagctaacttc

SEQ ID NO: 103130 - DNA, 20 bp, Artificial Sequence
  Description of Artificial Sequence: Synthetic oligonucleotide
  Target: ATXN1; (+) strand; PAM type: NRG; PAM sequence: CAG
ttccggtgtcttaatatcct

SEQ ID NO: 103131 - DNA, 20 bp, Artificial Sequence
  Description of Artificial Sequence: Synthetic oligonucleotide
  Target: ATXN1; (+) strand; PAM type: NRG; PAM sequence: GAG
cttaatatcctcagcccact

SEQ ID NO: 103132 - DNA, 20 bp, Artificial Sequence
  Description of Artificial Sequence: Synthetic oligonucleotide
  Target: ATXN1; (+) strand; PAM type: NRG; PAM sequence: TAG
actgagtgaaattgacttac

SEQ ID NO: 103133 - DNA, 20 bp, Artificial Sequence
  Description of Artificial Sequence: Synthetic oligonucleotide
  Target: ATXN1; (+) strand; PAM type: NRG; PAM sequence: TAG
gacttactagaaatctacca

SEQ ID NO: 103134 - DNA, 20 bp, Artificial Sequence
  Description of Artificial Sequence: Synthetic oligonucleotide
  Target: ATXN1; (+) strand; PAM type: NRG; PAM sequence: CAG
tagaatactgaacatcccaa

SEQ ID NO: 103135 - DNA, 20 bp, Artificial Sequence
  Description of Artificial Sequence: Synthetic oligonucleotide
  Target: ATXN1; (+) strand; PAM type: NRG; PAM sequence: TGG
gaacatcccaacagaccaaa

SEQ ID NO: 103136 - DNA, 20 bp, Artificial Sequence
  Description of Artificial Sequence: Synthetic oligonucleotide
  Target: ATXN1; (+) strand; PAM type: NRG; PAM sequence: GAG
acatcccaacagaccaaatg

SEQ ID NO: 103137 - DNA, 20 bp, Artificial Sequence
  Description of Artificial Sequence: Synthetic oligonucleotide
  Target: ATXN1; (+) strand; PAM type: NRG; PAM sequence: AGG
catcccaacagaccaaatgg

SEQ ID NO: 103138 - DNA, 20 bp, Artificial Sequence
  Description of Artificial Sequence: Synthetic oligonucleotide
  Target: ATXN1; (+) strand; PAM type: NRG; PAM sequence: GAG
tcccaacagaccaaatggag

SEQ ID NO: 103139 - DNA, 20 bp, Artificial Sequence
  Description of Artificial Sequence: Synthetic oligonucleotide
  Target: ATXN1; (+) strand; PAM type: NRG; PAM sequence: TGG
aacagaccaaatggaggagt

SEQ ID NO: 103140 - DNA, 20 bp, Artificial Sequence
  Description of Artificial Sequence: Synthetic oligonucleotide
  Target: ATXN1; (+) strand; PAM type: NRG; PAM sequence: TGG
gaggagttggctcccgcact

SEQ ID NO: 103141 - DNA, 20 bp, Artificial Sequence
  Description of Artificial Sequence: Synthetic oligonucleotide
  Target: ATXN1; (+) strand; PAM type: NRG; PAM sequence: CAG
ggctcccgcacttggctctg

SEQ ID NO: 103142 - DNA, 20 bp, Artificial Sequence
  Description of Artificial Sequence: Synthetic oligonucleotide
  Target: ATXN1; (+) strand; PAM type: NRG; PAM sequence: TGG
gcacttggctctgcagattt

SEQ ID NO: 103143 - DNA, 20 bp, Artificial Sequence
  Description of Artificial Sequence: Synthetic oligonucleotide
  Target: ATXN1; (+) strand; PAM type: NRG; PAM sequence: GGG
cacttggctctgcagatttt

SEQ ID NO: 103144 - DNA, 20 bp, Artificial Sequence
  Description of Artificial Sequence: Synthetic oligonucleotide
  Target: ATXN1; (+) strand; PAM type: NRG; PAM sequence: GGG
acttggctctgcagattttg

SEQ ID NO: 103145 - DNA, 20 bp, Artificial Sequence
  Description of Artificial Sequence: Synthetic oligonucleotide
  Target: ATXN1; (+) strand; PAM type: NRG; PAM sequence: AAG
catatttcctccacaataca

SEQ ID NO: 103146 - DNA, 20 bp, Artificial Sequence
  Description of Artificial Sequence: Synthetic oligonucleotide
  Target: ATXN1; (+) strand; PAM type: NRG; PAM sequence: AGG
atatttcctccacaatacaa

SEQ ID NO: 103147 - DNA, 20 bp, Artificial Sequence
  Description of Artificial Sequence: Synthetic oligonucleotide
  Target: ATXN1; (+) strand; PAM type: NRG; PAM sequence: GAG
atttcctccacaatacaaag

SEQ ID NO: 103148 - DNA, 20 bp, Artificial Sequence
  Description of Artificial Sequence: Synthetic oligonucleotide
  Target: ATXN1; (+) strand; PAM type: NRG; PAM sequence: AGG
tttcctccacaatacaaagg

SEQ ID NO: 103149 - DNA, 20 bp, Artificial Sequence
  Description of Artificial Sequence: Synthetic oligonucleotide
  Target: ATXN1; (+) strand; PAM type: NRG; PAM sequence: TGG
aaggaggatgcacatgtacc

SEQ ID NO: 103150 - DNA, 20 bp, Artificial Sequence
  Description of Artificial Sequence: Synthetic oligonucleotide
  Target: ATXN1; (+) strand; PAM type: NRG; PAM sequence: GGG
aggaggatgcacatgtacct

SEQ ID NO: 103151 - DNA, 20 bp, Artificial Sequence
  Description of Artificial Sequence: Synthetic oligonucleotide
  Target: ATXN1; (+) strand; PAM type: NRG; PAM sequence: TGG
acatgtacctgggacactac

SEQ ID NO: 103152 - DNA, 20 bp, Artificial Sequence
  Description of Artificial Sequence: Synthetic oligonucleotide
  Target: ATXN1; (+) strand; PAM type: NRG; PAM sequence: TGG
tactggtttcactgtgtttg

SEQ ID NO: 103153 - DNA, 20 bp, Artificial Sequence
  Description of Artificial Sequence: Synthetic oligonucleotide
  Target: ATXN1; (+) strand; PAM type: NRG; PAM sequence: TGG
tttgtggtcatgctgaataa

SEQ ID NO: 103154 - DNA, 20 bp, Artificial Sequence
  Description of Artificial Sequence: Synthetic oligonucleotide
  Target: ATXN1; (+) strand; PAM type: NRG; PAM sequence: CAG
catgctgaataatggtgtat

SEQ ID NO: 103155 - DNA, 20 bp, Artificial Sequence
  Description of Artificial Sequence: Synthetic oligonucleotide
  Target: ATXN1; (+) strand; PAM type: NRG; PAM sequence: TGG
gctgaataatggtgtatcag

SEQ ID NO: 103156 - DNA, 20 bp, Artificial Sequence
  Description of Artificial Sequence: Synthetic oligonucleotide
  Target: ATXN1; (+) strand; PAM type: NRG; PAM sequence: CAG
gaataatggtgtatcagtgg

SEQ ID NO: 103157 - DNA, 20 bp, Artificial Sequence
  Description of Artificial Sequence: Synthetic oligonucleotide
  Target: ATXN1; (+) strand; PAM type: NRG; PAM sequence: CAG
taatggtgtatcagtggcag

SEQ ID NO: 103158 - DNA, 20 bp, Artificial Sequence
  Description of Artificial Sequence: Synthetic oligonucleotide
  Target: ATXN1; (+) strand; PAM type: NRG; PAM sequence: TGG
tgtatcagtggcagcagctc

SEQ ID NO: 103159 - DNA, 20 bp, Artificial Sequence
  Description of Artificial Sequence: Synthetic oligonucleotide
  Target: ATXN1; (+) strand; PAM type: NRG; PAM sequence: GAG
cagtggcagcagctctggct

SEQ ID NO: 103160 - DNA, 20 bp, Artificial Sequence
  Description of Artificial Sequence: Synthetic oligonucleotide
  Target: ATXN1; (+) strand; PAM type: NRG; PAM sequence: GAG
gtggcagcagctctggctga

SEQ ID NO: 103161 - DNA, 20 bp, Artificial Sequence
  Description of Artificial Sequence: Synthetic oligonucleotide
  Target: ATXN1; (+) strand; PAM type: NRG; PAM sequence: CAG
agcagctctggctgagagac

SEQ ID NO: 103162 - DNA, 20 bp, Artificial Sequence
  Description of Artificial Sequence: Synthetic oligonucleotide
  Target: ATXN1; (+) strand; PAM type: NRG; PAM sequence: CAG
ctgagagaccagaacccttg

SEQ ID NO: 103163 - DNA, 20 bp, Artificial Sequence
  Description of Artificial Sequence: Synthetic oligonucleotide
  Target: ATXN1; (+) strand; PAM type: NRG; PAM sequence: TAG
gaccagaacccttgcagcct

SEQ ID NO: 103164 - DNA, 20 bp, Artificial Sequence
  Description of Artificial Sequence: Synthetic oligonucleotide
  Target: ATXN1; (+) strand; PAM type: NRG; PAM sequence: TAG
aacccttgcagccttagtac

SEQ ID NO: 103165 - DNA, 20 bp, Artificial Sequence
  Description of Artificial Sequence: Synthetic oligonucleotide
  Target: ATXN1; (+) strand; PAM type: NRG; PAM sequence: AGG
acccttgcagccttagtact

SEQ ID NO: 103166 - DNA, 20 bp, Artificial Sequence
  Description of Artificial Sequence: Synthetic oligonucleotide
  Target: ATXN1; (+) strand; PAM type: NRG; PAM sequence: GGG
cccttgcagccttagtacta

SEQ ID NO: 103167 - DNA, 20 bp, Artificial Sequence
  Description of Artificial Sequence: Synthetic oligonucleotide
  Target: ATXN1; (+) strand; PAM type: NRG; PAM sequence: CAG
gggccatactctctcacctg

SEQ ID NO: 103168 - DNA, 20 bp, Artificial Sequence
  Description of Artificial Sequence: Synthetic oligonucleotide
  Target: ATXN1; (+) strand; PAM type: NRG; PAM sequence: AAG
tactctctcacctgcagaat

SEQ ID NO: 103169 - DNA, 20 bp, Artificial Sequence
  Description of Artificial Sequence: Synthetic oligonucleotide
  Target: ATXN1; (+) strand; PAM type: NRG; PAM sequence: CGG
gaataagaaatcaatgctga

SEQ ID NO: 103170 - DNA, 20 bp, Artificial Sequence
  Description of Artificial Sequence: Synthetic oligonucleotide
  Target: ATXN1; (+) strand; PAM type: NRG; PAM sequence: CAG
aatcaatgctgacggcacat

SEQ ID NO: 103171 - DNA, 20 bp, Artificial Sequence
  Description of Artificial Sequence: Synthetic oligonucleotide
  Target: ATXN1; (+) strand; PAM type: NRG; PAM sequence: CAG
gacggcacatcagactcacc

SEQ ID NO: 103172 - DNA, 20 bp, Artificial Sequence
  Description of Artificial Sequence: Synthetic oligonucleotide
  Target: ATXN1; (+) strand; PAM type: NRG; PAM sequence: AGG
acggcacatcagactcaccc

SEQ ID NO: 103173 - DNA, 20 bp, Artificial Sequence
  Description of Artificial Sequence: Synthetic oligonucleotide
  Target: ATXN1; (+) strand; PAM type: NRG; PAM sequence: GGG
cggcacatcagactcaccca

SEQ ID NO: 103174 - DNA, 20 bp, Artificial Sequence
  Description of Artificial Sequence: Synthetic oligonucleotide
  Target: ATXN1; (+) strand; PAM type: NRG; PAM sequence: GAG
gcacatcagactcacccagg

SEQ ID NO: 103175 - DNA, 20 bp, Artificial Sequence
  Description of Artificial Sequence: Synthetic oligonucleotide
  Target: ATXN1; (+) strand; PAM type: NRG; PAM sequence: CAG
gcttttaaaaacataatgtc

SEQ ID NO: 103176 - DNA, 20 bp, Artificial Sequence
  Description of Artificial Sequence: Synthetic oligonucleotide
  Target: ATXN1; (+) strand; PAM type: NRG; PAM sequence: CAG
cataatgtccagatctaccc

SEQ ID NO: 103177 - DNA, 20 bp, Artificial Sequence
  Description of Artificial Sequence: Synthetic oligonucleotide
  Target: ATXN1; (+) strand; PAM type: NRG; PAM sequence: AAG
ctaccccagaccaactgaat

SEQ ID NO: 103178 - DNA, 20 bp, Artificial Sequence
  Description of Artificial Sequence: Synthetic oligonucleotide
  Target: ATXN1; (+) strand; PAM type: NRG; PAM sequence: TAG
accaactgaataagaatccc

SEQ ID NO: 103179 - DNA, 20 bp, Artificial Sequence
  Description of Artificial Sequence: Synthetic oligonucleotide
  Target: ATXN1; (+) strand; PAM type: NRG; PAM sequence: TGG
gaataagaatccctagatgt

SEQ ID NO: 103180 - DNA, 20 bp, Artificial Sequence
  Description of Artificial Sequence: Synthetic oligonucleotide
  Target: ATXN1; (+) strand; PAM type: NRG; PAM sequence: GGG
aataagaatccctagatgtt

SEQ ID NO: 103181 - DNA, 20 bp, Artificial Sequence
  Description of Artificial Sequence: Synthetic oligonucleotide
  Target: ATXN1; (+) strand; PAM type: NRG; PAM sequence: TGG
ctagatgttgggaccaccac

SEQ ID NO: 103182 - DNA, 20 bp, Artificial Sequence
  Description of Artificial Sequence: Synthetic oligonucleotide
  Target: ATXN1; (+) strand; PAM type: NRG; PAM sequence: TAG
tgggaccaccactggcattt

SEQ ID NO: 103183 - DNA, 20 bp, Artificial Sequence
  Description of Artificial Sequence: Synthetic oligonucleotide
  Target: ATXN1; (+) strand; PAM type: NRG; PAM sequence: AGG
gggaccaccactggcatttt

SEQ ID NO: 103184 - DNA, 20 bp, Artificial Sequence
  Description of Artificial Sequence: Synthetic oligonucleotide
  Target: ATXN1; (+) strand; PAM type: NRG; PAM sequence: CAG
tggcattttaggaaatgcac

SEQ ID NO: 103185 - DNA, 20 bp, Artificial Sequence
  Description of Artificial Sequence: Synthetic oligonucleotide
  Target: ATXN1; (+) strand; PAM type: NRG; PAM sequence: AGG
ggcattttaggaaatgcacc

SEQ ID NO: 103186 - DNA, 20 bp, Artificial Sequence
  Description of Artificial Sequence: Synthetic oligonucleotide
  Target: ATXN1; (+) strand; PAM type: NRG; PAM sequence: GGG
gcattttaggaaatgcacca

SEQ ID NO: 103187 - DNA, 20 bp, Artificial Sequence
  Description of Artificial Sequence: Synthetic oligonucleotide
  Target: ATXN1; (+) strand; PAM type: NRG; PAM sequence: GGG
cattttaggaaatgcaccag

SEQ ID NO: 103188 - DNA, 20 bp, Artificial Sequence
  Description of Artificial Sequence: Synthetic oligonucleotide
  Target: ATXN1; (+) strand; PAM type: NRG; PAM sequence: CAG
caccaggggattctaatttg

SEQ ID NO: 103189 - DNA, 20 bp, Artificial Sequence
  Description of Artificial Sequence: Synthetic oligonucleotide
  Target: ATXN1; (+) strand; PAM type: NRG; PAM sequence: CAG
aggggattctaatttgcagc

SEQ ID NO: 103190 - DNA, 20 bp, Artificial Sequence
  Description of Artificial Sequence: Synthetic oligonucleotide
  Target: ATXN1; (+) strand; PAM type: NRG; PAM sequence: GAG
gggattctaatttgcagcca

SEQ ID NO: 103191 - DNA, 20 bp, Artificial Sequence
  Description of Artificial Sequence: Synthetic oligonucleotide
  Target: ATXN1; (+) strand; PAM type: NRG; PAM sequence: AGG
ggattctaatttgcagccag

SEQ ID NO: 103192 - DNA, 20 bp, Artificial Sequence
  Description of Artificial Sequence: Synthetic oligonucleotide
  Target: ATXN1; (+) strand; PAM type: NRG; PAM sequence: GAG
tctaatttgcagccagaggt

SEQ ID NO: 103193 - DNA, 20 bp, Artificial Sequence
  Description of Artificial Sequence: Synthetic oligonucleotide
  Target: ATXN1; (+) strand; PAM type: NRG; PAM sequence: TGG
cagccagaggtgagaacctc

SEQ ID NO: 103194 - DNA, 20 bp, Artificial Sequence
  Description of Artificial Sequence: Synthetic oligonucleotide
  Target: ATXN1; (+) strand; PAM type: NRG; PAM sequence: TAG
agaggtgagaacctctggta

SEQ ID NO: 103195 - DNA, 20 bp, Artificial Sequence
  Description of Artificial Sequence: Synthetic oligonucleotide
  Target: ATXN1; (+) strand; PAM type: NRG; PAM sequence: GAG
aggtgagaacctctggtata

SEQ ID NO: 103196 - DNA, 20 bp, Artificial Sequence
  Description of Artificial Sequence: Synthetic oligonucleotide
  Target: ATXN1; (+) strand; PAM type: NRG; PAM sequence: AGG
ggtgagaacctctggtatag

SEQ ID NO: 103197 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 103198 - DNA, 20 bp, Artificial Sequence
  Description of Artificial Sequence: Synthetic oligonucleotide
  Target: ATXN1; (+) strand; PAM type: NRG; PAM sequence: CAG
ttttttttttttttttgaga

SEQ ID NO: 103199 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagaca

SEQ ID NO: 103200 - DNA, 20 bp, Artificial Sequence
  Description of Artificial Sequence: Synthetic oligonucleotide
  Target: ATXN1; (+) strand; PAM type: NRG; PAM sequence: CAG
cagagtctcgctctgtcccc

SEQ ID NO: 103201 - DNA, 20 bp, Artificial Sequence
  Description of Artificial Sequence: Synthetic oligonucleotide
  Target: ATXN1; (+) strand; PAM type: NRG; PAM sequence: AGG
agagtctcgctctgtccccc

SEQ ID NO: 103202 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcccccaggc

SEQ ID NO: 103203 - DNA, 20 bp, Artificial Sequence
  Description of Artificial Sequence: Synthetic oligonucleotide
  Target: ATXN1; (+) strand; PAM type: NRG; PAM sequence: CAG
ctgtcccccaggctggaatg

SEQ ID NO: 103204 - DNA, 20 bp, Artificial Sequence
  Description of Artificial Sequence: Synthetic oligonucleotide
  Target: ATXN1; (+) strand; PAM type: NRG; PAM sequence: TGG
tcccccaggctggaatgcag

SEQ ID NO: 103205 - DNA, 20 bp, Artificial Sequence
  Description of Artificial Sequence: Synthetic oligonucleotide
  Target: ATXN1; (+) strand; PAM type: NRG; PAM sequence: CGG
ggaatgcagtggcgtgatct

SEQ ID NO: 103206 - DNA, 20 bp, Artificial Sequence
  Description of Artificial Sequence: Synthetic oligonucleotide
  Target: ATXN1; (+) strand; PAM type: NRG; PAM sequence: AAG
gcgtgatctcggctcactgc

SEQ ID NO: 103207 - DNA, 20 bp, Artificial Sequence
  Description of Artificial Sequence: Synthetic oligonucleotide
  Target: ATXN1; (+) strand; PAM type: NRG; PAM sequence: CGG
tcactgcaagctccacctcc

SEQ ID NO: 103208 - DNA, 20 bp, Artificial Sequence
  Description of Artificial Sequence: Synthetic oligonucleotide
  Target: ATXN1; (+) strand; PAM type: NRG; PAM sequence: GGG
cactgcaagctccacctccc

SEQ ID NO: 103209 - DNA, 20 bp, Artificial Sequence
  Description of Artificial Sequence: Synthetic oligonucleotide
  Target: ATXN1; (+) strand; PAM type: NRG; PAM sequence: CAG
ttcacaccattctcctgcct

SEQ ID NO: 103210 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 103211 - DNA, 20 bp, Artificial Sequence
  Description of Artificial Sequence: Synthetic oligonucleotide
  Target: ATXN1; (+) strand; PAM type: NRG; PAM sequence: TGG
tcctgcctcagcctcccgag

SEQ ID NO: 103212 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtggc

SEQ ID NO: 103213 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgagtggct

SEQ ID NO: 103214 - DNA, 20 bp, Artificial Sequence
  Description of Artificial Sequence: Synthetic oligonucleotide
  Target: ATXN1; (+) strand; PAM type: NRG; PAM sequence: CAG
ctcccgagtggctgggacta

SEQ ID NO: 103215 - DNA, 20 bp, Artificial Sequence
  Description of Artificial Sequence: Synthetic oligonucleotide
  Target: ATXN1; (+) strand; PAM type: NRG; PAM sequence: AGG
tcccgagtggctgggactac

SEQ ID NO: 103216 - DNA, 20 bp, Artificial Sequence
  Description of Artificial Sequence: Synthetic oligonucleotide
  Target: ATXN1; (+) strand; PAM type: NRG; PAM sequence: TGG
caggcacccaccaccacgcc

SEQ ID NO: 103217 - DNA, 20 bp, Artificial Sequence
  Description of Artificial Sequence: Synthetic oligonucleotide
  Target: ATXN1; (+) strand; PAM type: NRG; PAM sequence: TAG
ggctaatttttttgtatttt

SEQ ID NO: 103218 - DNA, 20 bp, Artificial Sequence
  Description of Artificial Sequence: Synthetic oligonucleotide
  Target: ATXN1; (+) strand; PAM type: NRG; PAM sequence: TAG
taatttttttgtatttttag

SEQ ID NO: 103219 - DNA, 20 bp, Artificial Sequence
  Description of Artificial Sequence: Synthetic oligonucleotide
  Target: ATXN1; (+) strand; PAM type: NRG; PAM sequence: GAG
atttttttgtatttttagta

SEQ ID NO: 103220 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 103221 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 103222 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 103223 - DNA, 20 bp, Artificial Sequence
  Description of Artificial Sequence: Synthetic oligonucleotide
  Target: ATXN1; (+) strand; PAM type: NRG; PAM sequence: TAG
gagatggggtttcaccgtgt

SEQ ID NO: 103224 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccgtgttagc

SEQ ID NO: 103225 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccgtgttagcc

SEQ ID NO: 103226 - DNA, 20 bp, Artificial Sequence
  Description of Artificial Sequence: Synthetic oligonucleotide
  Target: ATXN1; (+) strand; PAM type: NRG; PAM sequence: TGG
tttcaccgtgttagccagga

SEQ ID NO: 103227 - DNA, 20 bp, Artificial Sequence
  Description of Artificial Sequence: Synthetic oligonucleotide
  Target: ATXN1; (+) strand; PAM type: NRG; PAM sequence: CGG
acctcttgatctgcctgcct

SEQ ID NO: 103228 - DNA, 20 bp, Artificial Sequence
  Description of Artificial Sequence: Synthetic oligonucleotide
  Target: ATXN1; (+) strand; PAM type: NRG; PAM sequence: AAG
ctgcctgcctcggcctccca

SEQ ID NO: 103229 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtac

SEQ ID NO: 103230 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtact

SEQ ID NO: 103231 - DNA, 20 bp, Artificial Sequence
  Description of Artificial Sequence: Synthetic oligonucleotide
  Target: ATXN1; (+) strand; PAM type: NRG; PAM sequence: TAG
ctcccaaagtactgggatta

SEQ ID NO: 103232 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtactgggattat

SEQ ID NO: 103233 - DNA, 20 bp, Artificial Sequence
  Description of Artificial Sequence: Synthetic oligonucleotide
  Target: ATXN1; (+) strand; PAM type: NRG; PAM sequence: GAG
agtactgggattataggcgt

SEQ ID NO: 103234 - DNA, 20 bp, Artificial Sequence
  Description of Artificial Sequence: Synthetic oligonucleotide
  Target: ATXN1; (+) strand; PAM type: NRG; PAM sequence: CGG
taggcgtgagccaccgcacc

SEQ ID NO: 103235 - DNA, 20 bp, Artificial Sequence
  Description of Artificial Sequence: Synthetic oligonucleotide
  Target: ATXN1; (+) strand; PAM type: NRG; PAM sequence: TGG
cgtgagccaccgcacccggc

SEQ ID NO: 103236 - DNA, 20 bp, Artificial Sequence
  Description of Artificial Sequence: Synthetic oligonucleotide
  Target: ATXN1; (+) strand; PAM type: NRG; PAM sequence: TAG
gccaccgcacccggctggta

SEQ ID NO: 103237 - DNA, 20 bp, Artificial Sequence
  Description of Artificial Sequence: Synthetic oligonucleotide
  Target: ATXN1; (+) strand; PAM type: NRG; PAM sequence: GAG
caccgcacccggctggtata

SEQ ID NO: 103238 - DNA, 20 bp, Artificial Sequence
  Description of Artificial Sequence: Synthetic oligonucleotide
  Target: ATXN1; (+) strand; PAM type: NRG; PAM sequence: AGG
accgcacccggctggtatag

SEQ ID NO: 103239 - DNA, 20 bp, Artificial Sequence
  Description of Artificial Sequence: Synthetic oligonucleotide
  Target: ATXN1; (+) strand; PAM type: NRG; PAM sequence: AAG
ggctggtatagaggatcttt

SEQ ID NO: 103240 - DNA, 20 bp, Artificial Sequence
  Description of Artificial Sequence: Synthetic oligonucleotide
  Target: ATXN1; (+) strand; PAM type: NRG; PAM sequence: TGG
cccctaactccatctgtcct

SEQ ID NO: 103241 - DNA, 20 bp, Artificial Sequence
  Description of Artificial Sequence: Synthetic oligonucleotide
  Target: ATXN1; (+) strand; PAM type: NRG; PAM sequence: CAG
ctaactccatctgtccttgg

SEQ ID NO: 103242 - DNA, 20 bp, Artificial Sequence
  Description of Artificial Sequence: Synthetic oligonucleotide
  Target: ATXN1; (+) strand; PAM type: NRG; PAM sequence: CAG
ctgtccttggcagtatgtct

SEQ ID NO: 103243 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 103244 - DNA, 20 bp, Artificial Sequence
  Description of Artificial Sequence: Synthetic oligonucleotide
  Target: ATXN1; (+) strand; PAM type: NRG; PAM sequence: CGG
ttttttttttttttttgaga

SEQ ID NO: 103245 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagacg

SEQ ID NO: 103246 - DNA, 20 bp, Artificial Sequence
  Description of Artificial Sequence: Synthetic oligonucleotide
  Target: ATXN1; (+) strand; PAM type: NRG; PAM sequence: CAG
cggagtctcgctctgtcacc

SEQ ID NO: 103247 - DNA, 20 bp, Artificial Sequence
  Description of Artificial Sequence: Synthetic oligonucleotide
  Target: ATXN1; (+) strand; PAM type: NRG; PAM sequence: AGG
ggagtctcgctctgtcaccc

SEQ ID NO: 103248 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcacccaggc

SEQ ID NO: 103249 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggtgtgcaa

SEQ ID NO: 103250 - DNA, 20 bp, Artificial Sequence
  Description of Artificial Sequence: Synthetic oligonucleotide
  Target: ATXN1; (+) strand; PAM type: NRG; PAM sequence: GGG
cacccaggctggtgtgcaat

SEQ ID NO: 103251 - DNA, 20 bp, Artificial Sequence
  Description of Artificial Sequence: Synthetic oligonucleotide
  Target: ATXN1; (+) strand; PAM type: NRG; PAM sequence: CAG
aggctggtgtgcaatgggtg

SEQ ID NO: 103252 - DNA, 20 bp, Artificial Sequence
  Description of Artificial Sequence: Synthetic oligonucleotide
  Target: ATXN1; (+) strand; PAM type: NRG; PAM sequence: CGG
gtgtgcaatgggtgcagtct

SEQ ID NO: 103253 - DNA, 20 bp, Artificial Sequence
  Description of Artificial Sequence: Synthetic oligonucleotide
  Target: ATXN1; (+) strand; PAM type: NRG; PAM sequence: CAG
tctcggctcactgcacctcc

SEQ ID NO: 103254 - DNA, 20 bp, Artificial Sequence
  Description of Artificial Sequence: Synthetic oligonucleotide
  Target: ATXN1; (+) strand; PAM type: NRG; PAM sequence: AGG
ctcggctcactgcacctccc

SEQ ID NO: 103255 - DNA, 20 bp, Artificial Sequence
  Description of Artificial Sequence: Synthetic oligonucleotide
  Target: ATXN1; (+) strand; PAM type: NRG; PAM sequence: AAG
tcactgcacctcccaggttc

SEQ ID NO: 103256 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcctgcct

SEQ ID NO: 103257 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 103258 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 103259 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagt

SEQ ID NO: 103260 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagtt

SEQ ID NO: 103261 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagttgggatta

SEQ ID NO: 103262 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagttgggattac

SEQ ID NO: 103263 - DNA, 20 bp, Artificial Sequence
  Description of Artificial Sequence: Synthetic oligonucleotide
  Target: ATXN1; (+) strand; PAM type: NRG; PAM sequence: TGG
caggtgcctgccaccacacc

SEQ ID NO: 103264 - DNA, 20 bp, Artificial Sequence
  Description of Artificial Sequence: Synthetic oligonucleotide
  Target: ATXN1; (+) strand; PAM type: NRG; PAM sequence: TGG
gttatttttatttttatttt

SEQ ID NO: 103265 - DNA, 20 bp, Artificial Sequence
  Description of Artificial Sequence: Synthetic oligonucleotide
  Target: ATXN1; (+) strand; PAM type: NRG; PAM sequence: TAG
atttttatttttatttttgg

SEQ ID NO: 103266 - DNA, 20 bp, Artificial Sequence
  Description of Artificial Sequence: Synthetic oligonucleotide
  Target: ATXN1; (+) strand; PAM type: NRG; PAM sequence: GAG
ttttatttttatttttggta

SEQ ID NO: 103267 - DNA, 20 bp, Artificial Sequence
  Description of Artificial Sequence: Synthetic oligonucleotide
  Target: ATXN1; (+) strand; PAM type: NRG; PAM sequence: CGG
atttttatttttggtagaga

SEQ ID NO: 103268 - DNA, 20 bp, Artificial Sequence
  Description of Artificial Sequence: Synthetic oligonucleotide
  Target: ATXN1; (+) strand; PAM type: NRG; PAM sequence: GGG
tttttatttttggtagagac

SEQ ID NO: 103269 - DNA, 20 bp, Artificial Sequence
  Description of Artificial Sequence: Synthetic oligonucleotide
  Target: ATXN1; (+) strand; PAM type: NRG; PAM sequence: GGG
ttttatttttggtagagacg

SEQ ID NO: 103270 - DNA, 20 bp, Artificial Sequence
  Description of Artificial Sequence: Synthetic oligonucleotide
  Target: ATXN1; (+) strand; PAM type: NRG; PAM sequence: TGG
gagacggggttttaccatgt

SEQ ID NO: 103271 - DNA, 20 bp, Artificial Sequence
  Description of Artificial Sequence: Synthetic oligonucleotide
  Target: ATXN1; (+) strand; PAM type: NRG; PAM sequence: CAG
cggggttttaccatgttggc

SEQ ID NO: 103272 - DNA, 20 bp, Artificial Sequence
  Description of Artificial Sequence: Synthetic oligonucleotide
  Target: ATXN1; (+) strand; PAM type: NRG; PAM sequence: AGG
ggggttttaccatgttggcc

SEQ ID NO: 103273 - DNA, 20 bp, Artificial Sequence
  Description of Artificial Sequence: Synthetic oligonucleotide
  Target: ATXN1; (+) strand; PAM type: NRG; PAM sequence: TGG
ttttaccatgttggccaggc

SEQ ID NO: 103274 - DNA, 20 bp, Artificial Sequence
  Description of Artificial Sequence: Synthetic oligonucleotide
  Target: ATXN1; (+) strand; PAM type: NRG; PAM sequence: GAG
tggtctcaaactcctgacct

SEQ ID NO: 103275 - DNA, 20 bp, Artificial Sequence
  Description of Artificial Sequence: Synthetic oligonucleotide
  Target: ATXN1; (+) strand; PAM type: NRG; PAM sequence: TGG
cctgagcgatccacctacct

SEQ ID NO: 103276 - DNA, 20 bp, Artificial Sequence
  Description of Artificial Sequence: Synthetic oligonucleotide
  Target: ATXN1; (+) strand; PAM type: NRG; PAM sequence: TGG
accttggcctcccaacgtgc

SEQ ID NO: 103277 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcccaacgtgct

SEQ ID NO: 103278 - DNA, 20 bp, Artificial Sequence
  Description of Artificial Sequence: Synthetic oligonucleotide
  Target: ATXN1; (+) strand; PAM type: NRG; PAM sequence: CAG
ctcccaacgtgctgggatta

SEQ ID NO: 103279 - DNA, 20 bp, Artificial Sequence
  Description of Artificial Sequence: Synthetic oligonucleotide
  Target: ATXN1; (+) strand; PAM type: NRG; PAM sequence: AGG
tcccaacgtgctgggattac

SEQ ID NO: 103280 - DNA, 20 bp, Artificial Sequence
  Description of Artificial Sequence: Synthetic oligonucleotide
  Target: ATXN1; (+) strand; PAM type: NRG; PAM sequence: GAG
cgtgctgggattacaggcgt

SEQ ID NO: 103281 - DNA, 20 bp, Artificial Sequence
  Description of Artificial Sequence: Synthetic oligonucleotide
  Target: ATXN1; (+) strand; PAM type: NRG; PAM sequence: GAG
gattacaggcgtgagccact

SEQ ID NO: 103282 - DNA, 20 bp, Artificial Sequence
  Description of Artificial Sequence: Synthetic oligonucleotide
  Target: ATXN1; (+) strand; PAM type: NRG; PAM sequence: CGG
caggcgtgagccactgagcc

SEQ ID NO: 103283 - DNA, 20 bp, Artificial Sequence
  Description of Artificial Sequence: Synthetic oligonucleotide
  Target: ATXN1; (+) strand; PAM type: NRG; PAM sequence: CAG
ccactgagcccggcctgtct

SEQ ID NO: 103284 - DNA, 20 bp, Artificial Sequence
  Description of Artificial Sequence: Synthetic oligonucleotide
  Target: ATXN1; (+) strand; PAM type: NRG; PAM sequence: CAG
tgtctcagtgattttaatta

SEQ ID NO: 103285 - DNA, 20 bp, Artificial Sequence
  Description of Artificial Sequence: Synthetic oligonucleotide
  Target: ATXN1; (+) strand; PAM type: NRG; PAM sequence: CAG
ctcagtgattttaattacag

SEQ ID NO: 103286 - DNA, 20 bp, Artificial Sequence
  Description of Artificial Sequence: Synthetic oligonucleotide
  Target: ATXN1; (+) strand; PAM type: NRG; PAM sequence: AAG
tccccactttgccaacacaa

SEQ ID NO: 103287 - DNA, 20 bp, Artificial Sequence
  Description of Artificial Sequence: Synthetic oligonucleotide
  Target: ATXN1; (+) strand; PAM type: NRG; PAM sequence: GAG
ttatatgctatgtccacaat

SEQ ID NO: 103288 - DNA, 20 bp, Artificial Sequence
  Description of Artificial Sequence: Synthetic oligonucleotide
  Target: ATXN1; (+) strand; PAM type: NRG; PAM sequence: AAG
gacaccacttcacactcatt

SEQ ID NO: 103289 - DNA, 20 bp, Artificial Sequence
  Description of Artificial Sequence: Synthetic oligonucleotide
  Target: ATXN1; (+) strand; PAM type: NRG; PAM sequence: TGG
ccacttcacactcattaaga

SEQ ID NO: 103290 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaacaaaacaaaaa

SEQ ID NO: 103291 - DNA, 20 bp, Artificial Sequence
  Description of Artificial Sequence: Synthetic oligonucleotide
  Target: ATXN1; (+) strand; PAM type: NRG; PAM sequence: TAG
aacaaaacaaaaatggaaaa

SEQ ID NO: 103292 - DNA, 20 bp, Artificial Sequence
  Description of Artificial Sequence: Synthetic oligonucleotide
  Target: ATXN1; (+) strand; PAM type: NRG; PAM sequence: AAG
aaacaaaaatggaaaatagc

SEQ ID NO: 103293 - DNA, 20 bp, Artificial Sequence
  Description of Artificial Sequence: Synthetic oligonucleotide
  Target: ATXN1; (+) strand; PAM type: NRG; PAM sequence: TGG
aaatggaaaatagcaagtgt

SEQ ID NO: 103294 - DNA, 20 bp, Artificial Sequence
  Description of Artificial Sequence: Synthetic oligonucleotide
  Target: ATXN1; (+) strand; PAM type: NRG; PAM sequence: TGG
tggaaaatagcaagtgttgg

SEQ ID NO: 103295 - DNA, 20 bp, Artificial Sequence
  Description of Artificial Sequence: Synthetic oligonucleotide
  Target: ATXN1; (+) strand; PAM type: NRG; PAM sequence: GAG
gaaaatagcaagtgttggtg

SEQ ID NO: 103296 - DNA, 20 bp, Artificial Sequence
  Description of Artificial Sequence: Synthetic oligonucleotide
  Target: ATXN1; (+) strand; PAM type: NRG; PAM sequence: TGG
atagcaagtgttggtggaga

SEQ ID NO: 103297 - DNA, 20 bp, Artificial Sequence
  Description of Artificial Sequence: Synthetic oligonucleotide
  Target: ATXN1; (+) strand; PAM type: NRG; PAM sequence: GGG
tagcaagtgttggtggagat

SEQ ID NO: 103298 - DNA, 20 bp, Artificial Sequence
  Description of Artificial Sequence: Synthetic oligonucleotide
  Target: ATXN1; (+) strand; PAM type: NRG; PAM sequence: GGG
agcaagtgttggtggagatg

SEQ ID NO: 103299 - DNA, 20 bp, Artificial Sequence
  Description of Artificial Sequence: Synthetic oligonucleotide
  Target: ATXN1; (+) strand; PAM type: NRG; PAM sequence: GAG
gttggtggagatggggaaac

SEQ ID NO: 103300 - DNA, 20 bp, Artificial Sequence
  Description of Artificial Sequence: Synthetic oligonucleotide
  Target: ATXN1; (+) strand; PAM type: NRG; PAM sequence: TGG
cgagaacctatgtgcatcgt

SEQ ID NO: 103301 - DNA, 20 bp, Artificial Sequence
  Description of Artificial Sequence: Synthetic oligonucleotide
  Target: ATXN1; (+) strand; PAM type: NRG; PAM sequence: TGG
gaacctatgtgcatcgttgg

SEQ ID NO: 103302 - DNA, 20 bp, Artificial Sequence
  Description of Artificial Sequence: Synthetic oligonucleotide
  Target: ATXN1; (+) strand; PAM type: NRG; PAM sequence: GGG
aacctatgtgcatcgttggt

SEQ ID NO: 103303 - DNA, 20 bp, Artificial Sequence
  Description of Artificial Sequence: Synthetic oligonucleotide
  Target: ATXN1; (+) strand; PAM type: NRG; PAM sequence: CAG
ggtgggaacgtaaaatgatg

SEQ ID NO: 103304 - DNA, 20 bp, Artificial Sequence
  Description of Artificial Sequence: Synthetic oligonucleotide
  Target: ATXN1; (+) strand; PAM type: NRG; PAM sequence: TGG
cgtaaaatgatgcagctgca

SEQ ID NO: 103305 - DNA, 20 bp, Artificial Sequence
  Description of Artificial Sequence: Synthetic oligonucleotide
  Target: ATXN1; (+) strand; PAM type: NRG; PAM sequence: TGG
cagctgcatggaaaacattt

SEQ ID NO: 103306 - DNA, 20 bp, Artificial Sequence
  Description of Artificial Sequence: Synthetic oligonucleotide
  Target: ATXN1; (+) strand; PAM type: NRG; PAM sequence: CAG
ctgcatggaaaacattttgg

SEQ ID NO: 103307 - DNA, 20 bp, Artificial Sequence
  Description of Artificial Sequence: Synthetic oligonucleotide
  Target: ATXN1; (+) strand; PAM type: NRG; PAM sequence: CAG
gttcctcaaaatgtgaaata

SEQ ID NO: 103308 - DNA, 20 bp, Artificial Sequence
  Description of Artificial Sequence: Synthetic oligonucleotide
  Target: ATXN1; (+) strand; PAM type: NRG; PAM sequence: CAG
tacagaattaccacatgact

SEQ ID NO: 103309 - DNA, 20 bp, Artificial Sequence
  Description of Artificial Sequence: Synthetic oligonucleotide
  Target: ATXN1; (+) strand; PAM type: NRG; PAM sequence: TGG
tgactcagcaattccacgtc

SEQ ID NO: 103310 - DNA, 20 bp, Artificial Sequence
  Description of Artificial Sequence: Synthetic oligonucleotide
  Target: ATXN1; (+) strand; PAM type: NRG; PAM sequence: AAG
acgtctggatatctaccaca

SEQ ID NO: 103311 - DNA, 20 bp, Artificial Sequence
  Description of Artificial Sequence: Synthetic oligonucleotide
  Target: ATXN1; (+) strand; PAM type: NRG; PAM sequence: AAG
tatctaccacaaagcactga

SEQ ID NO: 103312 - DNA, 20 bp, Artificial Sequence
  Description of Artificial Sequence: Synthetic oligonucleotide
  Target: ATXN1; (+) strand; PAM type: NRG; PAM sequence: CAG
ctaccacaaagcactgaaag

SEQ ID NO: 103313 - DNA, 20 bp, Artificial Sequence
  Description of Artificial Sequence: Synthetic oligonucleotide
  Target: ATXN1; (+) strand; PAM type: NRG; PAM sequence: AGG
taccacaaagcactgaaagc

SEQ ID NO: 103314 - DNA, 20 bp, Artificial Sequence
  Description of Artificial Sequence: Synthetic oligonucleotide
  Target: ATXN1; (+) strand; PAM type: NRG; PAM sequence: GGG
accacaaagcactgaaagca

SEQ ID NO: 103315 - DNA, 20 bp, Artificial Sequence
  Description of Artificial Sequence: Synthetic oligonucleotide
  Target: ATXN1; (+) strand; PAM type: NRG; PAM sequence: CAG
aagcactgaaagcagggact

SEQ ID NO: 103316 - DNA, 20 bp, Artificial Sequence
  Description of Artificial Sequence: Synthetic oligonucleotide
  Target: ATXN1; (+) strand; PAM type: NRG; PAM sequence: TAG
atattccacacccgtgttca

SEQ ID NO: 103317 - DNA, 20 bp, Artificial Sequence
  Description of Artificial Sequence: Synthetic oligonucleotide
  Target: ATXN1; (+) strand; PAM type: NRG; PAM sequence: CAG
ttccacacccgtgttcatag

SEQ ID NO: 103318 - DNA, 20 bp, Artificial Sequence
  Description of Artificial Sequence: Synthetic oligonucleotide
  Target: ATXN1; (+) strand; PAM type: NRG; PAM sequence: GAG
catagcagcattgtgcacac

SEQ ID NO: 103319 - DNA, 20 bp, Artificial Sequence
  Description of Artificial Sequence: Synthetic oligonucleotide
  Target: ATXN1; (+) strand; PAM type: NRG; PAM sequence: AAG
gcattgtgcacacgagccaa

SEQ ID NO: 103320 - DNA, 20 bp, Artificial Sequence
  Description of Artificial Sequence: Synthetic oligonucleotide
  Target: ATXN1; (+) strand; PAM type: NRG; PAM sequence: AGG
cattgtgcacacgagccaaa

SEQ ID NO: 103321 - DNA, 20 bp, Artificial Sequence
  Description of Artificial Sequence: Synthetic oligonucleotide
  Target: ATXN1; (+) strand; PAM type: NRG; PAM sequence: CAG
aacaacccaatgatcatcaa

SEQ ID NO: 103322 - DNA, 20 bp, Artificial Sequence
  Description of Artificial Sequence: Synthetic oligonucleotide
  Target: ATXN1; (+) strand; PAM type: NRG; PAM sequence: TGG
atgaataaactttaaaaatg

SEQ ID NO: 103323 - DNA, 20 bp, Artificial Sequence
  Description of Artificial Sequence: Synthetic oligonucleotide
  Target: ATXN1; (+) strand; PAM type: NRG; PAM sequence: GAG
atgtggtatatccttatgac

SEQ ID NO: 103324 - DNA, 20 bp, Artificial Sequence
  Description of Artificial Sequence: Synthetic oligonucleotide
  Target: ATXN1; (+) strand; PAM type: NRG; PAM sequence: AAG
ttcatccccctctccttaca

SEQ ID NO: 103325 - DNA, 20 bp, Artificial Sequence
  Description of Artificial Sequence: Synthetic oligonucleotide
  Target: ATXN1; (+) strand; PAM type: NRG; PAM sequence: AGG
tcatccccctctccttacaa

SEQ ID NO: 103326 - DNA, 20 bp, Artificial Sequence
  Description of Artificial Sequence: Synthetic oligonucleotide
  Target: ATXN1; (+) strand; PAM type: NRG; PAM sequence: AAG
aaatcttcaaacattatgct

SEQ ID NO: 103327 - DNA, 20 bp, Artificial Sequence
  Description of Artificial Sequence: Synthetic oligonucleotide
  Target: ATXN1; (+) strand; PAM type: NRG; PAM sequence: AAG
tcaaacattatgctaagtga

SEQ ID NO: 103328 - DNA, 20 bp, Artificial Sequence
  Description of Artificial Sequence: Synthetic oligonucleotide
  Target: ATXN1; (+) strand; PAM type: NRG; PAM sequence: AAG
aacattatgctaagtgaaag

SEQ ID NO: 103329 - DNA, 20 bp, Artificial Sequence
  Description of Artificial Sequence: Synthetic oligonucleotide
  Target: ATXN1; (+) strand; PAM type: NRG; PAM sequence: CAG
ttatgctaagtgaaagaagc

SEQ ID NO: 103330 - DNA, 20 bp, Artificial Sequence
  Description of Artificial Sequence: Synthetic oligonucleotide
  Target: ATXN1; (+) strand; PAM type: NRG; PAM sequence: AAG
gtgaaagaagccagacacaa

SEQ ID NO: 103331 - DNA, 20 bp, Artificial Sequence
  Description of Artificial Sequence: Synthetic oligonucleotide
  Target: ATXN1; (+) strand; PAM type: NRG; PAM sequence: GAG
tcatatgattccccttctat

SEQ ID NO: 103332 - DNA, 20 bp, Artificial Sequence
  Description of Artificial Sequence: Synthetic oligonucleotide
  Target: ATXN1; (+) strand; PAM type: NRG; PAM sequence: AGG
catatgattccccttctatg

SEQ ID NO: 103333 - DNA, 20 bp, Artificial Sequence
  Description of Artificial Sequence: Synthetic oligonucleotide
  Target: ATXN1; (+) strand; PAM type: NRG; PAM sequence: TAG
ttccccttctatgaggaatc

SEQ ID NO: 103334 - DNA, 20 bp, Artificial Sequence
  Description of Artificial Sequence: Synthetic oligonucleotide
  Target: ATXN1; (+) strand; PAM type: NRG; PAM sequence: TAG
cttctatgaggaatctagaa

SEQ ID NO: 103335 - DNA, 20 bp, Artificial Sequence
  Description of Artificial Sequence: Synthetic oligonucleotide
  Target: ATXN1; (+) strand; PAM type: NRG; PAM sequence: TGG
gaatctagaatagtcaaatt

SEQ ID NO: 103336 - DNA, 20 bp, Artificial Sequence
  Description of Artificial Sequence: Synthetic oligonucleotide
  Target: ATXN1; (+) strand; PAM type: NRG; PAM sequence: GAG
atctagaatagtcaaatttg

SEQ ID NO: 103337 - DNA, 20 bp, Artificial Sequence
  Description of Artificial Sequence: Synthetic oligonucleotide
  Target: ATXN1; (+) strand; PAM type: NRG; PAM sequence: GAG
ctagaatagtcaaatttgga

SEQ ID NO: 103338 - DNA, 20 bp, Artificial Sequence
  Description of Artificial Sequence: Synthetic oligonucleotide
  Target: ATXN1; (+) strand; PAM type: NRG; PAM sequence: GAG
agaatagtcaaatttggaga

SEQ ID NO: 103339 - DNA, 20 bp, Artificial Sequence
  Description of Artificial Sequence: Synthetic oligonucleotide
  Target: ATXN1; (+) strand; PAM type: NRG; PAM sequence: TAG
agtcaaatttggagagagcg

SEQ ID NO: 103340 - DNA, 20 bp, Artificial Sequence
  Description of Artificial Sequence: Synthetic oligonucleotide
  Target: ATXN1; (+) strand; PAM type: NRG; PAM sequence: CAG
aatttggagagagcgtagaa

SEQ ID NO: 103341 - DNA, 20 bp, Artificial Sequence
  Description of Artificial Sequence: Synthetic oligonucleotide
  Target: ATXN1; (+) strand; PAM type: NRG; PAM sequence: AGG
atttggagagagcgtagaac

SEQ ID NO: 103342 - DNA, 20 bp, Artificial Sequence
  Description of Artificial Sequence: Synthetic oligonucleotide
  Target: ATXN1; (+) strand; PAM type: NRG; PAM sequence: TAG
agagagcgtagaacaggcgt

SEQ ID NO: 103343 - DNA, 20 bp, Artificial Sequence
  Description of Artificial Sequence: Synthetic oligonucleotide
  Target: ATXN1; (+) strand; PAM type: NRG; PAM sequence: CAG
gagcgtagaacaggcgttag

SEQ ID NO: 103344 - DNA, 20 bp, Artificial Sequence
  Description of Artificial Sequence: Synthetic oligonucleotide
  Target: ATXN1; (+) strand; PAM type: NRG; PAM sequence: AGG
agcgtagaacaggcgttagc

SEQ ID NO: 103345 - DNA, 20 bp, Artificial Sequence
  Description of Artificial Sequence: Synthetic oligonucleotide
  Target: ATXN1; (+) strand; PAM type: NRG; PAM sequence: GAG
cgtagaacaggcgttagcag

SEQ ID NO: 103346 - DNA, 20 bp, Artificial Sequence
  Description of Artificial Sequence: Synthetic oligonucleotide
  Target: ATXN1; (+) strand; PAM type: NRG; PAM sequence: TGG
gaacaggcgttagcaggagc

SEQ ID NO: 103347 - DNA, 20 bp, Artificial Sequence
  Description of Artificial Sequence: Synthetic oligonucleotide
  Target: ATXN1; (+) strand; PAM type: NRG; PAM sequence: GGG
aacaggcgttagcaggagct

SEQ ID NO: 103348 - DNA, 20 bp, Artificial Sequence
  Description of Artificial Sequence: Synthetic oligonucleotide
  Target: ATXN1; (+) strand; PAM type: NRG; PAM sequence: GAG
caggcgttagcaggagctgg

SEQ ID NO: 103349 - DNA, 20 bp, Artificial Sequence
  Description of Artificial Sequence: Synthetic oligonucleotide
  Target: ATXN1; (+) strand; PAM type: NRG; PAM sequence: AGG
aggcgttagcaggagctggg

SEQ ID NO: 103350 - DNA, 20 bp, Artificial Sequence
  Description of Artificial Sequence: Synthetic oligonucleotide
  Target: ATXN1; (+) strand; PAM type: NRG; PAM sequence: CGG
gttagcaggagctgggagga

SEQ ID NO: 103351 - DNA, 20 bp, Artificial Sequence
  Description of Artificial Sequence: Synthetic oligonucleotide
  Target: ATXN1; (+) strand; PAM type: NRG; PAM sequence: GGG
ttagcaggagctgggaggac

SEQ ID NO: 103352 - DNA, 20 bp, Artificial Sequence
  Description of Artificial Sequence: Synthetic oligonucleotide
  Target: ATXN1; (+) strand; PAM type: NRG; PAM sequence: GGG
tagcaggagctgggaggacg

SEQ ID NO: 103353 - DNA, 20 bp, Artificial Sequence
  Description of Artificial Sequence: Synthetic oligonucleotide
  Target: ATXN1; (+) strand; PAM type: NRG; PAM sequence: TGG
gagctgggaggacggggcaa

SEQ ID NO: 103354 - DNA, 20 bp, Artificial Sequence
  Description of Artificial Sequence: Synthetic oligonucleotide
  Target: ATXN1; (+) strand; PAM type: NRG; PAM sequence: GGG
agctgggaggacggggcaat

SEQ ID NO: 103355 - DNA, 20 bp, Artificial Sequence
  Description of Artificial Sequence: Synthetic oligonucleotide
  Target: ATXN1; (+) strand; PAM type: NRG; PAM sequence: GAG
ctgggaggacggggcaatgg

SEQ ID NO: 103356 - DNA, 20 bp, Artificial Sequence
  Description of Artificial Sequence: Synthetic oligonucleotide
  Target: ATXN1; (+) strand; PAM type: NRG; PAM sequence: CGG
gggcaatgggagttgtttaa

SEQ ID NO: 103357 - DNA, 20 bp, Artificial Sequence
  Description of Artificial Sequence: Synthetic oligonucleotide
  Target: ATXN1; (+) strand; PAM type: NRG; PAM sequence: CAG
tgggagttgtttaacggttc

SEQ ID NO: 103358 - DNA, 20 bp, Artificial Sequence
  Description of Artificial Sequence: Synthetic oligonucleotide
  Target: ATXN1; (+) strand; PAM type: NRG; PAM sequence: CAG
gtttaacggttccagaattt

SEQ ID NO: 103359 - DNA, 20 bp, Artificial Sequence
  Description of Artificial Sequence: Synthetic oligonucleotide
  Target: ATXN1; (+) strand; PAM type: NRG; PAM sequence: TGG
acggttccagaatttcagtt

SEQ ID NO: 103360 - DNA, 20 bp, Artificial Sequence
  Description of Artificial Sequence: Synthetic oligonucleotide
  Target: ATXN1; (+) strand; PAM type: NRG; PAM sequence: TGG
agaatttcagtttggtatga

SEQ ID NO: 103361 - DNA, 20 bp, Artificial Sequence
  Description of Artificial Sequence: Synthetic oligonucleotide
  Target: ATXN1; (+) strand; PAM type: NRG; PAM sequence: TGG
ttggtatgatggaaacattc

SEQ ID NO: 103362 - DNA, 20 bp, Artificial Sequence
  Description of Artificial Sequence: Synthetic oligonucleotide
  Target: ATXN1; (+) strand; PAM type: NRG; PAM sequence: GAG
ggtatgatggaaacattctg

SEQ ID NO: 103363 - DNA, 20 bp, Artificial Sequence
  Description of Artificial Sequence: Synthetic oligonucleotide
  Target: ATXN1; (+) strand; PAM type: NRG; PAM sequence: CAG
tgatggaaacattctggaga

SEQ ID NO: 103364 - DNA, 20 bp, Artificial Sequence
  Description of Artificial Sequence: Synthetic oligonucleotide
  Target: ATXN1; (+) strand; PAM type: NRG; PAM sequence: TGG
ggaaacattctggagacaga

SEQ ID NO: 103365 - DNA, 20 bp, Artificial Sequence
  Description of Artificial Sequence: Synthetic oligonucleotide
  Target: ATXN1; (+) strand; PAM type: NRG; PAM sequence: TGG
aacattctggagacagatgg

SEQ ID NO: 103366 - DNA, 20 bp, Artificial Sequence
  Description of Artificial Sequence: Synthetic oligonucleotide
  Target: ATXN1; (+) strand; PAM type: NRG; PAM sequence: TGG
ctggagacagatggtggtga

SEQ ID NO: 103367 - DNA, 20 bp, Artificial Sequence
  Description of Artificial Sequence: Synthetic oligonucleotide
  Target: ATXN1; (+) strand; PAM type: NRG; PAM sequence: AAG
gatggtggtgatggttgaac

SEQ ID NO: 103368 - DNA, 20 bp, Artificial Sequence
  Description of Artificial Sequence: Synthetic oligonucleotide
  Target: ATXN1; (+) strand; PAM type: NRG; PAM sequence: AAG
ccgtgcacgtaaaaatgatt

SEQ ID NO: 103369 - DNA, 20 bp, Artificial Sequence
  Description of Artificial Sequence: Synthetic oligonucleotide
  Target: ATXN1; (+) strand; PAM type: NRG; PAM sequence: TGG
gcacgtaaaaatgattaaga

SEQ ID NO: 103370 - DNA, 20 bp, Artificial Sequence
  Description of Artificial Sequence: Synthetic oligonucleotide
  Target: ATXN1; (+) strand; PAM type: NRG; PAM sequence: CAG
tattatgcatattttgtcac

SEQ ID NO: 103371 - DNA, 20 bp, Artificial Sequence
  Description of Artificial Sequence: Synthetic oligonucleotide
  Target: ATXN1; (+) strand; PAM type: NRG; PAM sequence: AAG
agtcaaaaatttttaaaaat

SEQ ID NO: 103372 - DNA, 20 bp, Artificial Sequence
  Description of Artificial Sequence: Synthetic oligonucleotide
  Target: ATXN1; (+) strand; PAM type: NRG; PAM sequence: TGG
ttttaaaaataagtatgtca

SEQ ID NO: 103373 - DNA, 20 bp, Artificial Sequence
  Description of Artificial Sequence: Synthetic oligonucleotide
  Target: ATXN1; (+) strand; PAM type: NRG; PAM sequence: TGG
aaaaataagtatgtcatggc

SEQ ID NO: 103374 - DNA, 20 bp, Artificial Sequence
  Description of Artificial Sequence: Synthetic oligonucleotide
  Target: ATXN1; (+) strand; PAM type: NRG; PAM sequence: GGG
aaaataagtatgtcatggct

SEQ ID NO: 103375 - DNA, 20 bp, Artificial Sequence
  Description of Artificial Sequence: Synthetic oligonucleotide
  Target: ATXN1; (+) strand; PAM type: NRG; PAM sequence: TGG
tatgtcatggctgggcgcgt

SEQ ID NO: 103376 - DNA, 20 bp, Artificial Sequence
  Description of Artificial Sequence: Synthetic oligonucleotide
  Target: ATXN1; (+) strand; PAM type: NRG; PAM sequence: CAG
ttggctcacgcctgtaatcc

SEQ ID NO: 103377 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 103378 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 103379 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 103380 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 103381 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 103382 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 103383 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggctgaggcgcg

SEQ ID NO: 103384 - DNA, 20 bp, Artificial Sequence
  Description of Artificial Sequence: Synthetic oligonucleotide
  Target: ATXN1; (+) strand; PAM type: NRG; PAM sequence: AAG
ggctgaggcgcgcagatcac

SEQ ID NO: 103385 - DNA, 20 bp, Artificial Sequence
  Description of Artificial Sequence: Synthetic oligonucleotide
  Target: ATXN1; (+) strand; PAM type: NRG; PAM sequence: AGG
gctgaggcgcgcagatcaca

SEQ ID NO: 103386 - DNA, 20 bp, Artificial Sequence
  Description of Artificial Sequence: Synthetic oligonucleotide
  Target: ATXN1; (+) strand; PAM type: NRG; PAM sequence: CAG
aggcgcgcagatcacaaggt

SEQ ID NO: 103387 - DNA, 20 bp, Artificial Sequence
  Description of Artificial Sequence: Synthetic oligonucleotide
  Target: ATXN1; (+) strand; PAM type: NRG; PAM sequence: AGG
ggcgcgcagatcacaaggtc

SEQ ID NO: 103388 - DNA, 20 bp, Artificial Sequence
  Description of Artificial Sequence: Synthetic oligonucleotide
  Target: ATXN1; (+) strand; PAM type: NRG; PAM sequence: GAG
cgcgcagatcacaaggtcag

SEQ ID NO: 103389 - DNA, 20 bp, Artificial Sequence
  Description of Artificial Sequence: Synthetic oligonucleotide
  Target: ATXN1; (+) strand; PAM type: NRG; PAM sequence: AAG
gatcacaaggtcaggagatc

SEQ ID NO: 103390 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcaagaccatcc

SEQ ID NO: 103391 - DNA, 20 bp, Artificial Sequence
  Description of Artificial Sequence: Synthetic oligonucleotide
  Target: ATXN1; (+) strand; PAM type: NRG; PAM sequence: CGG
caagaccatcctggctaaca

SEQ ID NO: 103392 - DNA, 20 bp, Artificial Sequence
  Description of Artificial Sequence: Synthetic oligonucleotide
  Target: ATXN1; (+) strand; PAM type: NRG; PAM sequence: TAG
accctgtctctactaaaaaa

SEQ ID NO: 103393 - DNA, 20 bp, Artificial Sequence
  Description of Artificial Sequence: Synthetic oligonucleotide
  Target: ATXN1; (+) strand; PAM type: NRG; PAM sequence: TAG
tactaaaaaatagaaaaaat

SEQ ID NO: 103394 - DNA, 20 bp, Artificial Sequence
  Description of Artificial Sequence: Synthetic oligonucleotide
  Target: ATXN1; (+) strand; PAM type: NRG; PAM sequence: CGG
aaaaaatagaaaaaattagc

SEQ ID NO: 103395 - DNA, 20 bp, Artificial Sequence
  Description of Artificial Sequence: Synthetic oligonucleotide
  Target: ATXN1; (+) strand; PAM type: NRG; PAM sequence: GGG
aaaaatagaaaaaattagcc

SEQ ID NO: 103396 - DNA, 20 bp, Artificial Sequence
  Description of Artificial Sequence: Synthetic oligonucleotide
  Target: ATXN1; (+) strand; PAM type: NRG; PAM sequence: TGG
tagaaaaaattagccgggcg

SEQ ID NO: 103397 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccgggcgtgg

SEQ ID NO: 103398 - DNA, 20 bp, Artificial Sequence
  Description of Artificial Sequence: Synthetic oligonucleotide
  Target: ATXN1; (+) strand; PAM type: NRG; PAM sequence: TGG
aaattagccgggcgtggtgg

SEQ ID NO: 103399 - DNA, 20 bp, Artificial Sequence
  Description of Artificial Sequence: Synthetic oligonucleotide
  Target: ATXN1; (+) strand; PAM type: NRG; PAM sequence: GGG
aattagccgggcgtggtggt

SEQ ID NO: 103400 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggtgggcacgtg

SEQ ID NO: 103401 - DNA, 20 bp, Artificial Sequence
  Description of Artificial Sequence: Synthetic oligonucleotide
  Target: ATXN1; (+) strand; PAM type: NRG; PAM sequence: CAG
gtggtgggcacgtgtagtcc

SEQ ID NO: 103402 - DNA, 20 bp, Artificial Sequence
  Description of Artificial Sequence: Synthetic oligonucleotide
  Target: ATXN1; (+) strand; PAM type: NRG; PAM sequence: GAG
acgtgtagtcccagctactc

SEQ ID NO: 103403 - DNA, 20 bp, Artificial Sequence
  Description of Artificial Sequence: Synthetic oligonucleotide
  Target: ATXN1; (+) strand; PAM type: NRG; PAM sequence: GAG
gtgtagtcccagctactcga

SEQ ID NO: 103404 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcgag

SEQ ID NO: 103405 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgagaggct

SEQ ID NO: 103406 - DNA, 20 bp, Artificial Sequence
  Description of Artificial Sequence: Synthetic oligonucleotide
  Target: ATXN1; (+) strand; PAM type: NRG; PAM sequence: CAG
agctactcgagaggctgaga

SEQ ID NO: 103407 - DNA, 20 bp, Artificial Sequence
  Description of Artificial Sequence: Synthetic oligonucleotide
  Target: ATXN1; (+) strand; PAM type: NRG; PAM sequence: AGG
gctactcgagaggctgagac

SEQ ID NO: 103408 - DNA, 20 bp, Artificial Sequence
  Description of Artificial Sequence: Synthetic oligonucleotide
  Target: ATXN1; (+) strand; PAM type: NRG; PAM sequence: GAG
tactcgagaggctgagacag

SEQ ID NO: 103409 - DNA, 20 bp, Artificial Sequence
  Description of Artificial Sequence: Synthetic oligonucleotide
  Target: ATXN1; (+) strand; PAM type: NRG; PAM sequence: TGG
gagaggctgagacaggagaa

SEQ ID NO: 103410 - DNA, 20 bp, Artificial Sequence
  Description of Artificial Sequence: Synthetic oligonucleotide
  Target: ATXN1; (+) strand; PAM type: NRG; PAM sequence: TGG
acaggagaatggcgtgaacc

SEQ ID NO: 103411 - DNA, 20 bp, Artificial Sequence
  Description of Artificial Sequence: Synthetic oligonucleotide
  Target: ATXN1; (+) strand; PAM type: NRG; PAM sequence: GGG
caggagaatggcgtgaacct

SEQ ID NO: 103412 - DNA, 20 bp, Artificial Sequence
  Description of Artificial Sequence: Synthetic oligonucleotide
  Target: ATXN1; (+) strand; PAM type: NRG; PAM sequence: GAG
ggagaatggcgtgaacctgg

SEQ ID NO: 103413 - DNA, 20 bp, Artificial Sequence
  Description of Artificial Sequence: Synthetic oligonucleotide
  Target: ATXN1; (+) strand; PAM type: NRG; PAM sequence: AGG
gagaatggcgtgaacctggg

SEQ ID NO: 103414 - DNA, 20 bp, Artificial Sequence
  Description of Artificial Sequence: Synthetic oligonucleotide
  Target: ATXN1; (+) strand; PAM type: NRG; PAM sequence: CAG
aatggcgtgaacctgggagg

SEQ ID NO: 103415 - DNA, 20 bp, Artificial Sequence
  Description of Artificial Sequence: Synthetic oligonucleotide
  Target: ATXN1; (+) strand; PAM type: NRG; PAM sequence: AGG
atggcgtgaacctgggaggc

SEQ ID NO: 103416 - DNA, 20 bp, Artificial Sequence
  Description of Artificial Sequence: Synthetic oligonucleotide
  Target: ATXN1; (+) strand; PAM type: NRG; PAM sequence: CAG
gaacctgggaggcaggcttg

SEQ ID NO: 103417 - DNA, 20 bp, Artificial Sequence
  Description of Artificial Sequence: Synthetic oligonucleotide
  Target: ATXN1; (+) strand; PAM type: NRG; PAM sequence: GAG
ctgggaggcaggcttgcagt

SEQ ID NO: 103418 - DNA, 20 bp, Artificial Sequence
  Description of Artificial Sequence: Synthetic oligonucleotide
  Target: ATXN1; (+) strand; PAM type: NRG; PAM sequence: GAG
aggcaggcttgcagtgagct

SEQ ID NO: 103419 - DNA, 20 bp, Artificial Sequence
  Description of Artificial Sequence: Synthetic oligonucleotide
  Target: ATXN1; (+) strand; PAM type: NRG; PAM sequence: CAG
gagatcgcaccactgcactc

SEQ ID NO: 103420 - DNA, 20 bp, Artificial Sequence
  Description of Artificial Sequence: Synthetic oligonucleotide
  Target: ATXN1; (+) strand; PAM type: NRG; PAM sequence: TGG
cgcaccactgcactccagcc

SEQ ID NO: 103421 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 103422 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 103423 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 103424 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagagc

SEQ ID NO: 103425 - DNA, 20 bp, Artificial Sequence
  Description of Artificial Sequence: Synthetic oligonucleotide
  Target: ATXN1; (+) strand; PAM type: NRG; PAM sequence: AAG
taaatatgtcatgatcttaa

SEQ ID NO: 103426 - DNA, 20 bp, Artificial Sequence
  Description of Artificial Sequence: Synthetic oligonucleotide
  Target: ATXN1; (+) strand; PAM type: NRG; PAM sequence: CAG
atttctgttttgaaaccaca

SEQ ID NO: 103427 - DNA, 20 bp, Artificial Sequence
  Description of Artificial Sequence: Synthetic oligonucleotide
  Target: ATXN1; (+) strand; PAM type: NRG; PAM sequence: TGG
gccccgctccctcatctgct

SEQ ID NO: 103428 - DNA, 20 bp, Artificial Sequence
  Description of Artificial Sequence: Synthetic oligonucleotide
  Target: ATXN1; (+) strand; PAM type: NRG; PAM sequence: GAG
cccgctccctcatctgcttg

SEQ ID NO: 103429 - DNA, 20 bp, Artificial Sequence
  Description of Artificial Sequence: Synthetic oligonucleotide
  Target: ATXN1; (+) strand; PAM type: NRG; PAM sequence: AAG
cctcatctgcttggagctac

SEQ ID NO: 103430 - DNA, 20 bp, Artificial Sequence
  Description of Artificial Sequence: Synthetic oligonucleotide
  Target: ATXN1; (+) strand; PAM type: NRG; PAM sequence: AGG
ctcatctgcttggagctaca

SEQ ID NO: 103431 - DNA, 20 bp, Artificial Sequence
  Description of Artificial Sequence: Synthetic oligonucleotide
  Target: ATXN1; (+) strand; PAM type: NRG; PAM sequence: GAG
ttggagctacaaggatctct

SEQ ID NO: 103432 - DNA, 20 bp, Artificial Sequence
  Description of Artificial Sequence: Synthetic oligonucleotide
  Target: ATXN1; (+) strand; PAM type: NRG; PAM sequence: TGG
aggatctctgagatacctgc

SEQ ID NO: 103433 - DNA, 20 bp, Artificial Sequence
  Description of Artificial Sequence: Synthetic oligonucleotide
  Target: ATXN1; (+) strand; PAM type: NRG; PAM sequence: TAG
tctgagatacctgctggcat

SEQ ID NO: 103434 - DNA, 20 bp, Artificial Sequence
  Description of Artificial Sequence: Synthetic oligonucleotide
  Target: ATXN1; (+) strand; PAM type: NRG; PAM sequence: CAG
gctggcattagcctgtattc

SEQ ID NO: 103435 - DNA, 20 bp, Artificial Sequence
  Description of Artificial Sequence: Synthetic oligonucleotide
  Target: ATXN1; (+) strand; PAM type: NRG; PAM sequence: AGG
ctggcattagcctgtattcc

SEQ ID NO: 103436 - DNA, 20 bp, Artificial Sequence
  Description of Artificial Sequence: Synthetic oligonucleotide
  Target: ATXN1; (+) strand; PAM type: NRG; PAM sequence: TGG
attagcctgtattccaggac

SEQ ID NO: 103437 - DNA, 20 bp, Artificial Sequence
  Description of Artificial Sequence: Synthetic oligonucleotide
  Target: ATXN1; (+) strand; PAM type: NRG; PAM sequence: CAG
tgtattccaggactggacgt

SEQ ID NO: 103438 - DNA, 20 bp, Artificial Sequence
  Description of Artificial Sequence: Synthetic oligonucleotide
  Target: ATXN1; (+) strand; PAM type: NRG; PAM sequence: AGG
gtattccaggactggacgtc

SEQ ID NO: 103439 - DNA, 20 bp, Artificial Sequence
  Description of Artificial Sequence: Synthetic oligonucleotide
  Target: ATXN1; (+) strand; PAM type: NRG; PAM sequence: GGG
tattccaggactggacgtca

SEQ ID NO: 103440 - DNA, 20 bp, Artificial Sequence
  Description of Artificial Sequence: Synthetic oligonucleotide
  Target: ATXN1; (+) strand; PAM type: NRG; PAM sequence: AAG
tggacgtcagggcatccttt

SEQ ID NO: 103441 - DNA, 20 bp, Artificial Sequence
  Description of Artificial Sequence: Synthetic oligonucleotide
  Target: ATXN1; (+) strand; PAM type: NRG; PAM sequence: AAG
gggcatcctttaagccctta

SEQ ID NO: 103442 - DNA, 20 bp, Artificial Sequence
  Description of Artificial Sequence: Synthetic oligonucleotide
  Target: ATXN1; (+) strand; PAM type: NRG; PAM sequence: AAG
tgccctttctcacatccgca

SEQ ID NO: 103443 - DNA, 20 bp, Artificial Sequence
  Description of Artificial Sequence: Synthetic oligonucleotide
  Target: ATXN1; (+) strand; PAM type: NRG; PAM sequence: AGG
gccctttctcacatccgcaa

SEQ ID NO: 103444 - DNA, 20 bp, Artificial Sequence
  Description of Artificial Sequence: Synthetic oligonucleotide
  Target: ATXN1; (+) strand; PAM type: NRG; PAM sequence: GGG
ccctttctcacatccgcaaa

SEQ ID NO: 103445 - DNA, 20 bp, Artificial Sequence
  Description of Artificial Sequence: Synthetic oligonucleotide
  Target: ATXN1; (+) strand; PAM type: NRG; PAM sequence: GGG
cctttctcacatccgcaaag

SEQ ID NO: 103446 - DNA, 20 bp, Artificial Sequence
  Description of Artificial Sequence: Synthetic oligonucleotide
  Target: ATXN1; (+) strand; PAM type: NRG; PAM sequence: GAG
acatccgcaaaggggactgt

SEQ ID NO: 103447 - DNA, 20 bp, Artificial Sequence
  Description of Artificial Sequence: Synthetic oligonucleotide
  Target: ATXN1; (+) strand; PAM type: NRG; PAM sequence: AAG
aggggactgtgagctgtaaa

SEQ ID NO: 103448 - DNA, 20 bp, Artificial Sequence
  Description of Artificial Sequence: Synthetic oligonucleotide
  Target: ATXN1; (+) strand; PAM type: NRG; PAM sequence: GAG
gactgtgagctgtaaaaagt

SEQ ID NO: 103449 - DNA, 20 bp, Artificial Sequence
  Description of Artificial Sequence: Synthetic oligonucleotide
  Target: ATXN1; (+) strand; PAM type: NRG; PAM sequence: AGG
actgtgagctgtaaaaagtg

SEQ ID NO: 103450 - DNA, 20 bp, Artificial Sequence
  Description of Artificial Sequence: Synthetic oligonucleotide
  Target: ATXN1; (+) strand; PAM type: NRG; PAM sequence: CAG
gtgagctgtaaaaagtgagg

SEQ ID NO: 103451 - DNA, 20 bp, Artificial Sequence
  Description of Artificial Sequence: Synthetic oligonucleotide
  Target: ATXN1; (+) strand; PAM type: NRG; PAM sequence: CAG
agctgtaaaaagtgaggcag

SEQ ID NO: 103452 - DNA, 20 bp, Artificial Sequence
  Description of Artificial Sequence: Synthetic oligonucleotide
  Target: ATXN1; (+) strand; PAM type: NRG; PAM sequence: TAG
aaagtgaggcagcagtatct

SEQ ID NO: 103453 - DNA, 20 bp, Artificial Sequence
  Description of Artificial Sequence: Synthetic oligonucleotide
  Target: ATXN1; (+) strand; PAM type: NRG; PAM sequence: AAG
tatcatgtcattgctcactg

SEQ ID NO: 103454 - DNA, 20 bp, Artificial Sequence
  Description of Artificial Sequence: Synthetic oligonucleotide
  Target: ATXN1; (+) strand; PAM type: NRG; PAM sequence: AAG
cattgctcactgaagactga

SEQ ID NO: 103455 - DNA, 20 bp, Artificial Sequence
  Description of Artificial Sequence: Synthetic oligonucleotide
  Target: ATXN1; (+) strand; PAM type: NRG; PAM sequence: TGG
gctcactgaagactgaaagc

SEQ ID NO: 103456 - DNA, 20 bp, Artificial Sequence
  Description of Artificial Sequence: Synthetic oligonucleotide
  Target: ATXN1; (+) strand; PAM type: NRG; PAM sequence: CAG
ttctcccctgattctgtcat

SEQ ID NO: 103457 - DNA, 20 bp, Artificial Sequence
  Description of Artificial Sequence: Synthetic oligonucleotide
  Target: ATXN1; (+) strand; PAM type: NRG; PAM sequence: AGG
tctcccctgattctgtcatc

SEQ ID NO: 103458 - DNA, 20 bp, Artificial Sequence
  Description of Artificial Sequence: Synthetic oligonucleotide
  Target: ATXN1; (+) strand; PAM type: NRG; PAM sequence: CAG
attctgtcatcaggttatgt

SEQ ID NO: 103459 - DNA, 20 bp, Artificial Sequence
  Description of Artificial Sequence: Synthetic oligonucleotide
  Target: ATXN1; (+) strand; PAM type: NRG; PAM sequence: CAG
gtcagttccaccctctgaat

SEQ ID NO: 103460 - DNA, 20 bp, Artificial Sequence
  Description of Artificial Sequence: Synthetic oligonucleotide
  Target: ATXN1; (+) strand; PAM type: NRG; PAM sequence: AGG
tcagttccaccctctgaatc

SEQ ID NO: 103461 - DNA, 20 bp, Artificial Sequence
  Description of Artificial Sequence: Synthetic oligonucleotide
  Target: ATXN1; (+) strand; PAM type: NRG; PAM sequence: GGG
cagttccaccctctgaatca

SEQ ID NO: 103462 - DNA, 20 bp, Artificial Sequence
  Description of Artificial Sequence: Synthetic oligonucleotide
  Target: ATXN1; (+) strand; PAM type: NRG; PAM sequence: TGG
ccaccctctgaatcagggac

SEQ ID NO: 103463 - DNA, 20 bp, Artificial Sequence
  Description of Artificial Sequence: Synthetic oligonucleotide
  Target: ATXN1; (+) strand; PAM type: NRG; PAM sequence: CGG
tggaaaaccttgacgatgcg

SEQ ID NO: 103464 - DNA, 20 bp, Artificial Sequence
  Description of Artificial Sequence: Synthetic oligonucleotide
  Target: ATXN1; (+) strand; PAM type: NRG; PAM sequence: TAG
cttgacgatgcgcggccacc

SEQ ID NO: 103465 - DNA, 20 bp, Artificial Sequence
  Description of Artificial Sequence: Synthetic oligonucleotide
  Target: ATXN1; (+) strand; PAM type: NRG; PAM sequence: TGG
cggccacctagtaaatcgtg

SEQ ID NO: 103466 - DNA, 20 bp, Artificial Sequence
  Description of Artificial Sequence: Synthetic oligonucleotide
  Target: ATXN1; (+) strand; PAM type: NRG; PAM sequence: CGG
tagtaaatcgtgtggctttg

SEQ ID NO: 103467 - DNA, 20 bp, Artificial Sequence
  Description of Artificial Sequence: Synthetic oligonucleotide
  Target: ATXN1; (+) strand; PAM type: NRG; PAM sequence: GGG
agtaaatcgtgtggctttgc

SEQ ID NO: 103468 - DNA, 20 bp, Artificial Sequence
  Description of Artificial Sequence: Synthetic oligonucleotide
  Target: ATXN1; (+) strand; PAM type: NRG; PAM sequence: TGG
ttgcgggccatacacctctg

SEQ ID NO: 103469 - DNA, 20 bp, Artificial Sequence
  Description of Artificial Sequence: Synthetic oligonucleotide
  Target: ATXN1; (+) strand; PAM type: NRG; PAM sequence: CAG
acacctctgtggccattact

SEQ ID NO: 103470 - DNA, 20 bp, Artificial Sequence
  Description of Artificial Sequence: Synthetic oligonucleotide
  Target: ATXN1; (+) strand; PAM type: NRG; PAM sequence: CAG
attactcagctctacctctg

SEQ ID NO: 103471 - DNA, 20 bp, Artificial Sequence
  Description of Artificial Sequence: Synthetic oligonucleotide
  Target: ATXN1; (+) strand; PAM type: NRG; PAM sequence: AGG
ttactcagctctacctctgc

SEQ ID NO: 103472 - DNA, 20 bp, Artificial Sequence
  Description of Artificial Sequence: Synthetic oligonucleotide
  Target: ATXN1; (+) strand; PAM type: NRG; PAM sequence: AAG
gctctacctctgcaggctga

SEQ ID NO: 103473 - DNA, 20 bp, Artificial Sequence
  Description of Artificial Sequence: Synthetic oligonucleotide
  Target: ATXN1; (+) strand; PAM type: NRG; PAM sequence: CAG
ctgcaggctgaaagcaacca

SEQ ID NO: 103474 - DNA, 20 bp, Artificial Sequence
  Description of Artificial Sequence: Synthetic oligonucleotide
  Target: ATXN1; (+) strand; PAM type: NRG; PAM sequence: CAG
aaccacagataatttgtaac

SEQ ID NO: 103475 - DNA, 20 bp, Artificial Sequence
  Description of Artificial Sequence: Synthetic oligonucleotide
  Target: ATXN1; (+) strand; PAM type: NRG; PAM sequence: TGG
cacagataatttgtaaccag

SEQ ID NO: 103476 - DNA, 20 bp, Artificial Sequence
  Description of Artificial Sequence: Synthetic oligonucleotide
  Target: ATXN1; (+) strand; PAM type: NRG; PAM sequence: GGG
acagataatttgtaaccagt

SEQ ID NO: 103477 - DNA, 20 bp, Artificial Sequence
  Description of Artificial Sequence: Synthetic oligonucleotide
  Target: ATXN1; (+) strand; PAM type: NRG; PAM sequence: TGG
taatttgtaaccagtgggtg

SEQ ID NO: 103478 - DNA, 20 bp, Artificial Sequence
  Description of Artificial Sequence: Synthetic oligonucleotide
  Target: ATXN1; (+) strand; PAM type: NRG; PAM sequence: GGG
aatttgtaaccagtgggtgt

SEQ ID NO: 103479 - DNA, 20 bp, Artificial Sequence
  Description of Artificial Sequence: Synthetic oligonucleotide
  Target: ATXN1; (+) strand; PAM type: NRG; PAM sequence: TGG
ttgtaaccagtgggtgtggg

SEQ ID NO: 103480 - DNA, 20 bp, Artificial Sequence
  Description of Artificial Sequence: Synthetic oligonucleotide
  Target: ATXN1; (+) strand; PAM type: NRG; PAM sequence: AAG
tgggtggctgtgtcctgatc

SEQ ID NO: 103481 - DNA, 20 bp, Artificial Sequence
  Description of Artificial Sequence: Synthetic oligonucleotide
  Target: ATXN1; (+) strand; PAM type: NRG; PAM sequence: CAG
agcctcaaatatgcctgctg

SEQ ID NO: 103482 - DNA, 20 bp, Artificial Sequence
  Description of Artificial Sequence: Synthetic oligonucleotide
  Target: ATXN1; (+) strand; PAM type: NRG; PAM sequence: AGG
gcctcaaatatgcctgctgc

SEQ ID NO: 103483 - DNA, 20 bp, Artificial Sequence
  Description of Artificial Sequence: Synthetic oligonucleotide
  Target: ATXN1; (+) strand; PAM type: NRG; PAM sequence: TGG
atatgcctgctgcaggcctc

SEQ ID NO: 103484 - DNA, 20 bp, Artificial Sequence
  Description of Artificial Sequence: Synthetic oligonucleotide
  Target: ATXN1; (+) strand; PAM type: NRG; PAM sequence: GGG
tatgcctgctgcaggcctct

SEQ ID NO: 103485 - DNA, 20 bp, Artificial Sequence
  Description of Artificial Sequence: Synthetic oligonucleotide
  Target: ATXN1; (+) strand; PAM type: NRG; PAM sequence: TAG
atgtgttccctctgctctgt

SEQ ID NO: 103486 - DNA, 20 bp, Artificial Sequence
  Description of Artificial Sequence: Synthetic oligonucleotide
  Target: ATXN1; (+) strand; PAM type: NRG; PAM sequence: GAG
gtgttccctctgctctgtta

SEQ ID NO: 103487 - DNA, 20 bp, Artificial Sequence
  Description of Artificial Sequence: Synthetic oligonucleotide
  Target: ATXN1; (+) strand; PAM type: NRG; PAM sequence: CAG
tgttagagtactttccacac

SEQ ID NO: 103488 - DNA, 20 bp, Artificial Sequence
  Description of Artificial Sequence: Synthetic oligonucleotide
  Target: ATXN1; (+) strand; PAM type: NRG; PAM sequence: AAG
accagccaccgctcctccgc

SEQ ID NO: 103489 - DNA, 20 bp, Artificial Sequence
  Description of Artificial Sequence: Synthetic oligonucleotide
  Target: ATXN1; (+) strand; PAM type: NRG; PAM sequence: AGG
ccagccaccgctcctccgca

SEQ ID NO: 103490 - DNA, 20 bp, Artificial Sequence
  Description of Artificial Sequence: Synthetic oligonucleotide
  Target: ATXN1; (+) strand; PAM type: NRG; PAM sequence: CAG
ctgtcacctgttttctaatg

SEQ ID NO: 103491 - DNA, 20 bp, Artificial Sequence
  Description of Artificial Sequence: Synthetic oligonucleotide
  Target: ATXN1; (+) strand; PAM type: NRG; PAM sequence: TGG
tcacctgttttctaatgcag

SEQ ID NO: 103492 - DNA, 20 bp, Artificial Sequence
  Description of Artificial Sequence: Synthetic oligonucleotide
  Target: ATXN1; (+) strand; PAM type: NRG; PAM sequence: GAG
atgcagtggttcttatactc

SEQ ID NO: 103493 - DNA, 20 bp, Artificial Sequence
  Description of Artificial Sequence: Synthetic oligonucleotide
  Target: ATXN1; (+) strand; PAM type: NRG; PAM sequence: CGG
gcgtgcgcatcacattcacc

SEQ ID NO: 103494 - DNA, 20 bp, Artificial Sequence
  Description of Artificial Sequence: Synthetic oligonucleotide
  Target: ATXN1; (+) strand; PAM type: NRG; PAM sequence: GAG
gtgcgcatcacattcacccg

SEQ ID NO: 103495 - DNA, 20 bp, Artificial Sequence
  Description of Artificial Sequence: Synthetic oligonucleotide
  Target: ATXN1; (+) strand; PAM type: NRG; PAM sequence: CAG
tcacattcacccggagttcc

SEQ ID NO: 103496 - DNA, 20 bp, Artificial Sequence
  Description of Artificial Sequence: Synthetic oligonucleotide
  Target: ATXN1; (+) strand; PAM type: NRG; PAM sequence: TGG
ccagatgctgctgatgctgc

SEQ ID NO: 103497 - DNA, 20 bp, Artificial Sequence
  Description of Artificial Sequence: Synthetic oligonucleotide
  Target: ATXN1; (+) strand; PAM type: NRG; PAM sequence: CAG
tgctgctgatgctgctggtc

SEQ ID NO: 103498 - DNA, 20 bp, Artificial Sequence
  Description of Artificial Sequence: Synthetic oligonucleotide
  Target: ATXN1; (+) strand; PAM type: NRG; PAM sequence: AGG
gctgctgatgctgctggtcc

SEQ ID NO: 103499 - DNA, 20 bp, Artificial Sequence
  Description of Artificial Sequence: Synthetic oligonucleotide
  Target: ATXN1; (+) strand; PAM type: NRG; PAM sequence: CAG
tggtccaggaaccacacttc

SEQ ID NO: 103500 - DNA, 20 bp, Artificial Sequence
  Description of Artificial Sequence: Synthetic oligonucleotide
  Target: ATXN1; (+) strand; PAM type: NRG; PAM sequence: AAG
tccaggaaccacacttccag

SEQ ID NO: 103501 - DNA, 20 bp, Artificial Sequence
  Description of Artificial Sequence: Synthetic oligonucleotide
  Target: ATXN1; (+) strand; PAM type: NRG; PAM sequence: TGG
aaccacacttccagaagcac

SEQ ID NO: 103502 - DNA, 20 bp, Artificial Sequence
  Description of Artificial Sequence: Synthetic oligonucleotide
  Target: ATXN1; (+) strand; PAM type: NRG; PAM sequence: CAG
cactggcctcacccatcttt

SEQ ID NO: 103503 - DNA, 20 bp, Artificial Sequence
  Description of Artificial Sequence: Synthetic oligonucleotide
  Target: ATXN1; (+) strand; PAM type: NRG; PAM sequence: AGG
actggcctcacccatctttc

SEQ ID NO: 103504 - DNA, 20 bp, Artificial Sequence
  Description of Artificial Sequence: Synthetic oligonucleotide
  Target: ATXN1; (+) strand; PAM type: NRG; PAM sequence: AAG
tccttccatgtcacctcctt

SEQ ID NO: 103505 - DNA, 20 bp, Artificial Sequence
  Description of Artificial Sequence: Synthetic oligonucleotide
  Target: ATXN1; (+) strand; PAM type: NRG; PAM sequence: AGG
ccttccatgtcacctcctta

SEQ ID NO: 103506 - DNA, 20 bp, Artificial Sequence
  Description of Artificial Sequence: Synthetic oligonucleotide
  Target: ATXN1; (+) strand; PAM type: NRG; PAM sequence: TAG
gcctctcctctgtgcctcct

SEQ ID NO: 103507 - DNA, 20 bp, Artificial Sequence
  Description of Artificial Sequence: Synthetic oligonucleotide
  Target: ATXN1; (+) strand; PAM type: NRG; PAM sequence: CAG
attctcatccacacaccgtt

SEQ ID NO: 103508 - DNA, 20 bp, Artificial Sequence
  Description of Artificial Sequence: Synthetic oligonucleotide
  Target: ATXN1; (+) strand; PAM type: NRG; PAM sequence: AGG
ttctcatccacacaccgttc

SEQ ID NO: 103509 - DNA, 20 bp, Artificial Sequence
  Description of Artificial Sequence: Synthetic oligonucleotide
  Target: ATXN1; (+) strand; PAM type: NRG; PAM sequence: AAG
cgtttcctcgactatcctcc

SEQ ID NO: 103510 - DNA, 20 bp, Artificial Sequence
  Description of Artificial Sequence: Synthetic oligonucleotide
  Target: ATXN1; (+) strand; PAM type: NRG; PAM sequence: AGG
gtttcctcgactatcctcca

SEQ ID NO: 103511 - DNA, 20 bp, Artificial Sequence
  Description of Artificial Sequence: Synthetic oligonucleotide
  Target: ATXN1; (+) strand; PAM type: NRG; PAM sequence: TAG
ctatcctccaaggctccaat

SEQ ID NO: 103512 - DNA, 20 bp, Artificial Sequence
  Description of Artificial Sequence: Synthetic oligonucleotide
  Target: ATXN1; (+) strand; PAM type: NRG; PAM sequence: CAG
ggctccaattagtctaacac

SEQ ID NO: 103513 - DNA, 20 bp, Artificial Sequence
  Description of Artificial Sequence: Synthetic oligonucleotide
  Target: ATXN1; (+) strand; PAM type: NRG; PAM sequence: TGG
acccccgcatgccttcacca

SEQ ID NO: 103514 - DNA, 20 bp, Artificial Sequence
  Description of Artificial Sequence: Synthetic oligonucleotide
  Target: ATXN1; (+) strand; PAM type: NRG; PAM sequence: TGG
cccgcatgccttcaccatgg

SEQ ID NO: 103515 - DNA, 20 bp, Artificial Sequence
  Description of Artificial Sequence: Synthetic oligonucleotide
  Target: ATXN1; (+) strand; PAM type: NRG; PAM sequence: GGG
ccgcatgccttcaccatggt

SEQ ID NO: 103516 - DNA, 20 bp, Artificial Sequence
  Description of Artificial Sequence: Synthetic oligonucleotide
  Target: ATXN1; (+) strand; PAM type: NRG; PAM sequence: TGG
cttcaccatggtgggcatga

SEQ ID NO: 103517 - DNA, 20 bp, Artificial Sequence
  Description of Artificial Sequence: Synthetic oligonucleotide
  Target: ATXN1; (+) strand; PAM type: NRG; PAM sequence: GAG
tgggcatgatggttaatact

SEQ ID NO: 103518 - DNA, 20 bp, Artificial Sequence
  Description of Artificial Sequence: Synthetic oligonucleotide
  Target: ATXN1; (+) strand; PAM type: NRG; PAM sequence: TGG
atactgagtgtcaacttgat

SEQ ID NO: 103519 - DNA, 20 bp, Artificial Sequence
  Description of Artificial Sequence: Synthetic oligonucleotide
  Target: ATXN1; (+) strand; PAM type: NRG; PAM sequence: AAG
gtgtcaacttgattggattg

SEQ ID NO: 103520 - DNA, 20 bp, Artificial Sequence
  Description of Artificial Sequence: Synthetic oligonucleotide
  Target: ATXN1; (+) strand; PAM type: NRG; PAM sequence: AGG
tgtcaacttgattggattga

SEQ ID NO: 103521 - DNA, 20 bp, Artificial Sequence
  Description of Artificial Sequence: Synthetic oligonucleotide
  Target: ATXN1; (+) strand; PAM type: NRG; PAM sequence: AAG
tgattggattgaaggatgca

SEQ ID NO: 103522 - DNA, 20 bp, Artificial Sequence
  Description of Artificial Sequence: Synthetic oligonucleotide
  Target: ATXN1; (+) strand; PAM type: NRG; PAM sequence: TGG
aggatgcaaagtattattct

SEQ ID NO: 103523 - DNA, 20 bp, Artificial Sequence
  Description of Artificial Sequence: Synthetic oligonucleotide
  Target: ATXN1; (+) strand; PAM type: NRG; PAM sequence: GAG
ttattcttggttgtgtctgt

SEQ ID NO: 103524 - DNA, 20 bp, Artificial Sequence
  Description of Artificial Sequence: Synthetic oligonucleotide
  Target: ATXN1; (+) strand; PAM type: NRG; PAM sequence: AGG
tattcttggttgtgtctgtg

SEQ ID NO: 103525 - DNA, 20 bp, Artificial Sequence
  Description of Artificial Sequence: Synthetic oligonucleotide
  Target: ATXN1; (+) strand; PAM type: NRG; PAM sequence: GGG
attcttggttgtgtctgtga

SEQ ID NO: 103526 - DNA, 20 bp, Artificial Sequence
  Description of Artificial Sequence: Synthetic oligonucleotide
  Target: ATXN1; (+) strand; PAM type: NRG; PAM sequence: AAG
tgtctgtgagggtgttgcca

SEQ ID NO: 103527 - DNA, 20 bp, Artificial Sequence
  Description of Artificial Sequence: Synthetic oligonucleotide
  Target: ATXN1; (+) strand; PAM type: NRG; PAM sequence: AGG
gtctgtgagggtgttgccaa

SEQ ID NO: 103528 - DNA, 20 bp, Artificial Sequence
  Description of Artificial Sequence: Synthetic oligonucleotide
  Target: ATXN1; (+) strand; PAM type: NRG; PAM sequence: GAG
ctgtgagggtgttgccaaag

SEQ ID NO: 103529 - DNA, 20 bp, Artificial Sequence
  Description of Artificial Sequence: Synthetic oligonucleotide
  Target: ATXN1; (+) strand; PAM type: NRG; PAM sequence: TGG
tgccaaaggagataaacatt

SEQ ID NO: 103530 - DNA, 20 bp, Artificial Sequence
  Description of Artificial Sequence: Synthetic oligonucleotide
  Target: ATXN1; (+) strand; PAM type: NRG; PAM sequence: GGG
gccaaaggagataaacattt

SEQ ID NO: 103531 - DNA, 20 bp, Artificial Sequence
  Description of Artificial Sequence: Synthetic oligonucleotide
  Target: ATXN1; (+) strand; PAM type: NRG; PAM sequence: TGG
ggagataaacatttgggtca

SEQ ID NO: 103532 - DNA, 20 bp, Artificial Sequence
  Description of Artificial Sequence: Synthetic oligonucleotide
  Target: ATXN1; (+) strand; PAM type: NRG; PAM sequence: GGG
gagataaacatttgggtcat

SEQ ID NO: 103533 - DNA, 20 bp, Artificial Sequence
  Description of Artificial Sequence: Synthetic oligonucleotide
  Target: ATXN1; (+) strand; PAM type: NRG; PAM sequence: TGG
aaacatttgggtcatgggct

SEQ ID NO: 103534 - DNA, 20 bp, Artificial Sequence
  Description of Artificial Sequence: Synthetic oligonucleotide
  Target: ATXN1; (+) strand; PAM type: NRG; PAM sequence: GAG
acatttgggtcatgggcttg

SEQ ID NO: 103535 - DNA, 20 bp, Artificial Sequence
  Description of Artificial Sequence: Synthetic oligonucleotide
  Target: ATXN1; (+) strand; PAM type: NRG; PAM sequence: GAG
atttgggtcatgggcttgga

SEQ ID NO: 103536 - DNA, 20 bp, Artificial Sequence
  Description of Artificial Sequence: Synthetic oligonucleotide
  Target: ATXN1; (+) strand; PAM type: NRG; PAM sequence: AGG
tttgggtcatgggcttggag

SEQ ID NO: 103537 - DNA, 20 bp, Artificial Sequence
  Description of Artificial Sequence: Synthetic oligonucleotide
  Target: ATXN1; (+) strand; PAM type: NRG; PAM sequence: AAG
gggtcatgggcttggagagg

SEQ ID NO: 103538 - DNA, 20 bp, Artificial Sequence
  Description of Artificial Sequence: Synthetic oligonucleotide
  Target: ATXN1; (+) strand; PAM type: NRG; PAM sequence: TGG
aggaagacccaccctcaatc

SEQ ID NO: 103539 - DNA, 20 bp, Artificial Sequence
  Description of Artificial Sequence: Synthetic oligonucleotide
  Target: ATXN1; (+) strand; PAM type: NRG; PAM sequence: GGG
ggaagacccaccctcaatct

SEQ ID NO: 103540 - DNA, 20 bp, Artificial Sequence
  Description of Artificial Sequence: Synthetic oligonucleotide
  Target: ATXN1; (+) strand; PAM type: NRG; PAM sequence: TGG
agacccaccctcaatctggg

SEQ ID NO: 103541 - DNA, 20 bp, Artificial Sequence
  Description of Artificial Sequence: Synthetic oligonucleotide
  Target: ATXN1; (+) strand; PAM type: NRG; PAM sequence: GGG
gacccaccctcaatctgggt

SEQ ID NO: 103542 - DNA, 20 bp, Artificial Sequence
  Description of Artificial Sequence: Synthetic oligonucleotide
  Target: ATXN1; (+) strand; PAM type: NRG; PAM sequence: CAG
ctgggtgggcacaatctaat

SEQ ID NO: 103543 - DNA, 20 bp, Artificial Sequence
  Description of Artificial Sequence: Synthetic oligonucleotide
  Target: ATXN1; (+) strand; PAM type: NRG; PAM sequence: CAG
ggcacaatctaatcagctgc

SEQ ID NO: 103544 - DNA, 20 bp, Artificial Sequence
  Description of Artificial Sequence: Synthetic oligonucleotide
  Target: ATXN1; (+) strand; PAM type: NRG; PAM sequence: GAG
caatctaatcagctgccagt

SEQ ID NO: 103545 - DNA, 20 bp, Artificial Sequence
  Description of Artificial Sequence: Synthetic oligonucleotide
  Target: ATXN1; (+) strand; PAM type: NRG; PAM sequence: AGG
aatctaatcagctgccagtg

SEQ ID NO: 103546 - DNA, 20 bp, Artificial Sequence
  Description of Artificial Sequence: Synthetic oligonucleotide
  Target: ATXN1; (+) strand; PAM type: NRG; PAM sequence: TAG
taatcagctgccagtgaggc

SEQ ID NO: 103547 - DNA, 20 bp, Artificial Sequence
  Description of Artificial Sequence: Synthetic oligonucleotide
  Target: ATXN1; (+) strand; PAM type: NRG; PAM sequence: AAG
tgccagtgaggctagaatga

SEQ ID NO: 103548 - DNA, 20 bp, Artificial Sequence
  Description of Artificial Sequence: Synthetic oligonucleotide
  Target: ATXN1; (+) strand; PAM type: NRG; PAM sequence: CAG
cagtgaggctagaatgaaag

SEQ ID NO: 103549 - DNA, 20 bp, Artificial Sequence
  Description of Artificial Sequence: Synthetic oligonucleotide
  Target: ATXN1; (+) strand; PAM type: NRG; PAM sequence: AGG
agtgaggctagaatgaaagc

SEQ ID NO: 103550 - DNA, 20 bp, Artificial Sequence
  Description of Artificial Sequence: Synthetic oligonucleotide
  Target: ATXN1; (+) strand; PAM type: NRG; PAM sequence: CAG
gaggctagaatgaaagcagg

SEQ ID NO: 103551 - DNA, 20 bp, Artificial Sequence
  Description of Artificial Sequence: Synthetic oligonucleotide
  Target: ATXN1; (+) strand; PAM type: NRG; PAM sequence: AAG
gctagaatgaaagcaggcag

SEQ ID NO: 103552 - DNA, 20 bp, Artificial Sequence
  Description of Artificial Sequence: Synthetic oligonucleotide
  Target: ATXN1; (+) strand; PAM type: NRG; PAM sequence: TAG
tgaaagcaggcagaagaacg

SEQ ID NO: 103553 - DNA, 20 bp, Artificial Sequence
  Description of Artificial Sequence: Synthetic oligonucleotide
  Target: ATXN1; (+) strand; PAM type: NRG; PAM sequence: AAG
aagcaggcagaagaacgtag

SEQ ID NO: 103554 - DNA, 20 bp, Artificial Sequence
  Description of Artificial Sequence: Synthetic oligonucleotide
  Target: ATXN1; (+) strand; PAM type: NRG; PAM sequence: AGG
agcaggcagaagaacgtaga

SEQ ID NO: 103555 - DNA, 20 bp, Artificial Sequence
  Description of Artificial Sequence: Synthetic oligonucleotide
  Target: ATXN1; (+) strand; PAM type: NRG; PAM sequence: TAG
gcagaagaacgtagaaggac

SEQ ID NO: 103556 - DNA, 20 bp, Artificial Sequence
  Description of Artificial Sequence: Synthetic oligonucleotide
  Target: ATXN1; (+) strand; PAM type: NRG; PAM sequence: TGG
agaacgtagaaggactagac

SEQ ID NO: 103557 - DNA, 20 bp, Artificial Sequence
  Description of Artificial Sequence: Synthetic oligonucleotide
  Target: ATXN1; (+) strand; PAM type: NRG; PAM sequence: GAG
gtagaaggactagactggct

SEQ ID NO: 103558 - DNA, 20 bp, Artificial Sequence
  Description of Artificial Sequence: Synthetic oligonucleotide
  Target: ATXN1; (+) strand; PAM type: NRG; PAM sequence: TGG
actagactggctgagtcttc

SEQ ID NO: 103559 - DNA, 20 bp, Artificial Sequence
  Description of Artificial Sequence: Synthetic oligonucleotide
  Target: ATXN1; (+) strand; PAM type: NRG; PAM sequence: TGG
ccttcatctttttctcgtgc

SEQ ID NO: 103560 - DNA, 20 bp, Artificial Sequence
  Description of Artificial Sequence: Synthetic oligonucleotide
  Target: ATXN1; (+) strand; PAM type: NRG; PAM sequence: AAG
gccctcgaacacccgacttg

SEQ ID NO: 103561 - DNA, 20 bp, Artificial Sequence
  Description of Artificial Sequence: Synthetic oligonucleotide
  Target: ATXN1; (+) strand; PAM type: NRG; PAM sequence: CAG
acacccgacttgaagttctt

SEQ ID NO: 103562 - DNA, 20 bp, Artificial Sequence
  Description of Artificial Sequence: Synthetic oligonucleotide
  Target: ATXN1; (+) strand; PAM type: NRG; PAM sequence: TGG
acttgaagttcttcagcttt

SEQ ID NO: 103563 - DNA, 20 bp, Artificial Sequence
  Description of Artificial Sequence: Synthetic oligonucleotide
  Target: ATXN1; (+) strand; PAM type: NRG; PAM sequence: TGG
ttcttcagcttttggactct

SEQ ID NO: 103564 - DNA, 20 bp, Artificial Sequence
  Description of Artificial Sequence: Synthetic oligonucleotide
  Target: ATXN1; (+) strand; PAM type: NRG; PAM sequence: TGG
gactcttggacctacactaa

SEQ ID NO: 103565 - DNA, 20 bp, Artificial Sequence
  Description of Artificial Sequence: Synthetic oligonucleotide
  Target: ATXN1; (+) strand; PAM type: NRG; PAM sequence: TGG
cttggacctacactaatggt

SEQ ID NO: 103566 - DNA, 20 bp, Artificial Sequence
  Description of Artificial Sequence: Synthetic oligonucleotide
  Target: ATXN1; (+) strand; PAM type: NRG; PAM sequence: CAG
gacctacactaatggttggc

SEQ ID NO: 103567 - DNA, 20 bp, Artificial Sequence
  Description of Artificial Sequence: Synthetic oligonucleotide
  Target: ATXN1; (+) strand; PAM type: NRG; PAM sequence: AGG
acctacactaatggttggcc

SEQ ID NO: 103568 - DNA, 20 bp, Artificial Sequence
  Description of Artificial Sequence: Synthetic oligonucleotide
  Target: ATXN1; (+) strand; PAM type: NRG; PAM sequence: GGG
cctacactaatggttggcca

SEQ ID NO: 103569 - DNA, 20 bp, Artificial Sequence
  Description of Artificial Sequence: Synthetic oligonucleotide
  Target: ATXN1; (+) strand; PAM type: NRG; PAM sequence: TGG
taatggttggccagggctct

SEQ ID NO: 103570 - DNA, 20 bp, Artificial Sequence
  Description of Artificial Sequence: Synthetic oligonucleotide
  Target: ATXN1; (+) strand; PAM type: NRG; PAM sequence: GGG
aatggttggccagggctctt

SEQ ID NO: 103571 - DNA, 20 bp, Artificial Sequence
  Description of Artificial Sequence: Synthetic oligonucleotide
  Target: ATXN1; (+) strand; PAM type: NRG; PAM sequence: TGG
ggccagggctcttgggcctt

SEQ ID NO: 103572 - DNA, 20 bp, Artificial Sequence
  Description of Artificial Sequence: Synthetic oligonucleotide
  Target: ATXN1; (+) strand; PAM type: NRG; PAM sequence: CAG
ggctcttgggcctttggcca

SEQ ID NO: 103573 - DNA, 20 bp, Artificial Sequence
  Description of Artificial Sequence: Synthetic oligonucleotide
  Target: ATXN1; (+) strand; PAM type: NRG; PAM sequence: AGG
gctcttgggcctttggccac

SEQ ID NO: 103574 - DNA, 20 bp, Artificial Sequence
  Description of Artificial Sequence: Synthetic oligonucleotide
  Target: ATXN1; (+) strand; PAM type: NRG; PAM sequence: AAG
gggcctttggccacaggctg

SEQ ID NO: 103575 - DNA, 20 bp, Artificial Sequence
  Description of Artificial Sequence: Synthetic oligonucleotide
  Target: ATXN1; (+) strand; PAM type: NRG; PAM sequence: AGG
ggcctttggccacaggctga

SEQ ID NO: 103576 - DNA, 20 bp, Artificial Sequence
  Description of Artificial Sequence: Synthetic oligonucleotide
  Target: ATXN1; (+) strand; PAM type: NRG; PAM sequence: CGG
caggctgaaggctgcactgt

SEQ ID NO: 103577 - DNA, 20 bp, Artificial Sequence
  Description of Artificial Sequence: Synthetic oligonucleotide
  Target: ATXN1; (+) strand; PAM type: NRG; PAM sequence: GAG
ctgtcggcttccctactttt

SEQ ID NO: 103578 - DNA, 20 bp, Artificial Sequence
  Description of Artificial Sequence: Synthetic oligonucleotide
  Target: ATXN1; (+) strand; PAM type: NRG; PAM sequence: AGG
tgtcggcttccctacttttg

SEQ ID NO: 103579 - DNA, 20 bp, Artificial Sequence
  Description of Artificial Sequence: Synthetic oligonucleotide
  Target: ATXN1; (+) strand; PAM type: NRG; PAM sequence: TGG
cttccctacttttgaggtct

SEQ ID NO: 103580 - DNA, 20 bp, Artificial Sequence
  Description of Artificial Sequence: Synthetic oligonucleotide
  Target: ATXN1; (+) strand; PAM type: NRG; PAM sequence: GGG
ttccctacttttgaggtctt

SEQ ID NO: 103581 - DNA, 20 bp, Artificial Sequence
  Description of Artificial Sequence: Synthetic oligonucleotide
  Target: ATXN1; (+) strand; PAM type: NRG; PAM sequence: CAG
acttttgaggtcttgggact

SEQ ID NO: 103582 - DNA, 20 bp, Artificial Sequence
  Description of Artificial Sequence: Synthetic oligonucleotide
  Target: ATXN1; (+) strand; PAM type: NRG; PAM sequence: TGG
tgaggtcttgggactcagac

SEQ ID NO: 103583 - DNA, 20 bp, Artificial Sequence
  Description of Artificial Sequence: Synthetic oligonucleotide
  Target: ATXN1; (+) strand; PAM type: NRG; PAM sequence: TGG
gactcagactggtcaaccac

SEQ ID NO: 103584 - DNA, 20 bp, Artificial Sequence
  Description of Artificial Sequence: Synthetic oligonucleotide
  Target: ATXN1; (+) strand; PAM type: NRG; PAM sequence: CAG
ccactggcttccttgctcct

SEQ ID NO: 103585 - DNA, 20 bp, Artificial Sequence
  Description of Artificial Sequence: Synthetic oligonucleotide
  Target: ATXN1; (+) strand; PAM type: NRG; PAM sequence: CAG
cttccttgctcctcagcttg

SEQ ID NO: 103586 - DNA, 20 bp, Artificial Sequence
  Description of Artificial Sequence: Synthetic oligonucleotide
  Target: ATXN1; (+) strand; PAM type: NRG; PAM sequence: AGG
ttccttgctcctcagcttgc

SEQ ID NO: 103587 - DNA, 20 bp, Artificial Sequence
  Description of Artificial Sequence: Synthetic oligonucleotide
  Target: ATXN1; (+) strand; PAM type: NRG; PAM sequence: TGG
cttgctcctcagcttgcagg

SEQ ID NO: 103588 - DNA, 20 bp, Artificial Sequence
  Description of Artificial Sequence: Synthetic oligonucleotide
  Target: ATXN1; (+) strand; PAM type: NRG; PAM sequence: TAG
agcttgcaggtggcctattg

SEQ ID NO: 103589 - DNA, 20 bp, Artificial Sequence
  Description of Artificial Sequence: Synthetic oligonucleotide
  Target: ATXN1; (+) strand; PAM type: NRG; PAM sequence: AGG
gcttgcaggtggcctattgt

SEQ ID NO: 103590 - DNA, 20 bp, Artificial Sequence
  Description of Artificial Sequence: Synthetic oligonucleotide
  Target: ATXN1; (+) strand; PAM type: NRG; PAM sequence: GAG
acttgaccttttgatcatgt

SEQ ID NO: 103591 - DNA, 20 bp, Artificial Sequence
  Description of Artificial Sequence: Synthetic oligonucleotide
  Target: ATXN1; (+) strand; PAM type: NRG; PAM sequence: TAG
catatatacatctatcctat

SEQ ID NO: 103592 - DNA, 20 bp, Artificial Sequence
  Description of Artificial Sequence: Synthetic oligonucleotide
  Target: ATXN1; (+) strand; PAM type: NRG; PAM sequence: TAG
tcctattagtcctgtctgtc

SEQ ID NO: 103593 - DNA, 20 bp, Artificial Sequence
  Description of Artificial Sequence: Synthetic oligonucleotide
  Target: ATXN1; (+) strand; PAM type: NRG; PAM sequence: GAG
ctattagtcctgtctgtcta

SEQ ID NO: 103594 - DNA, 20 bp, Artificial Sequence
  Description of Artificial Sequence: Synthetic oligonucleotide
  Target: ATXN1; (+) strand; PAM type: NRG; PAM sequence: CAG
ctagagaaccctgactaata

SEQ ID NO: 103595 - DNA, 20 bp, Artificial Sequence
  Description of Artificial Sequence: Synthetic oligonucleotide
  Target: ATXN1; (+) strand; PAM type: NRG; PAM sequence: TGG
gagaaccctgactaatacag

SEQ ID NO: 103596 - DNA, 20 bp, Artificial Sequence
  Description of Artificial Sequence: Synthetic oligonucleotide
  Target: ATXN1; (+) strand; PAM type: NRG; PAM sequence: GGG
agaaccctgactaatacagt

SEQ ID NO: 103597 - DNA, 20 bp, Artificial Sequence
  Description of Artificial Sequence: Synthetic oligonucleotide
  Target: ATXN1; (+) strand; PAM type: NRG; PAM sequence: TAG
tcccctaactgctacttcct

SEQ ID NO: 103598 - DNA, 20 bp, Artificial Sequence
  Description of Artificial Sequence: Synthetic oligonucleotide
  Target: ATXN1; (+) strand; PAM type: NRG; PAM sequence: AGG
cccctaactgctacttcctt

SEQ ID NO: 103599 - DNA, 20 bp, Artificial Sequence
  Description of Artificial Sequence: Synthetic oligonucleotide
  Target: ATXN1; (+) strand; PAM type: NRG; PAM sequence: CAG
ggcaatcattcctaaactct

SEQ ID NO: 103600 - DNA, 20 bp, Artificial Sequence
  Description of Artificial Sequence: Synthetic oligonucleotide
  Target: ATXN1; (+) strand; PAM type: NRG; PAM sequence: AAG
tcattcctaaactctcagca

SEQ ID NO: 103601 - DNA, 20 bp, Artificial Sequence
  Description of Artificial Sequence: Synthetic oligonucleotide
  Target: ATXN1; (+) strand; PAM type: NRG; PAM sequence: CGG
actctcagcaaagccacttc

SEQ ID NO: 103602 - DNA, 20 bp, Artificial Sequence
  Description of Artificial Sequence: Synthetic oligonucleotide
  Target: ATXN1; (+) strand; PAM type: NRG; PAM sequence: TAG
ttttcacgtgttttcgtcat

SEQ ID NO: 103603 - DNA, 20 bp, Artificial Sequence
  Description of Artificial Sequence: Synthetic oligonucleotide
  Target: ATXN1; (+) strand; PAM type: NRG; PAM sequence: TAG
ccgtaaactccgatgctgct

SEQ ID NO: 103604 - DNA, 20 bp, Artificial Sequence
  Description of Artificial Sequence: Synthetic oligonucleotide
  Target: ATXN1; (+) strand; PAM type: NRG; PAM sequence: GAG
gtaaactccgatgctgctta

SEQ ID NO: 103605 - DNA, 20 bp, Artificial Sequence
  Description of Artificial Sequence: Synthetic oligonucleotide
  Target: ATXN1; (+) strand; PAM type: NRG; PAM sequence: AAG
ccgatgctgcttagagactg

SEQ ID NO: 103606 - DNA, 20 bp, Artificial Sequence
  Description of Artificial Sequence: Synthetic oligonucleotide
  Target: ATXN1; (+) strand; PAM type: NRG; PAM sequence: TGG
gactgaagttcacaacccct

SEQ ID NO: 103607 - DNA, 20 bp, Artificial Sequence
  Description of Artificial Sequence: Synthetic oligonucleotide
  Target: ATXN1; (+) strand; PAM type: NRG; PAM sequence: GGG
actgaagttcacaacccctt

SEQ ID NO: 103608 - DNA, 20 bp, Artificial Sequence
  Description of Artificial Sequence: Synthetic oligonucleotide
  Target: ATXN1; (+) strand; PAM type: NRG; PAM sequence: TAG
ttcacaaccccttgggtttc

SEQ ID NO: 103609 - DNA, 20 bp, Artificial Sequence
  Description of Artificial Sequence: Synthetic oligonucleotide
  Target: ATXN1; (+) strand; PAM type: NRG; PAM sequence: AGG
tcacaaccccttgggtttct

SEQ ID NO: 103610 - DNA, 20 bp, Artificial Sequence
  Description of Artificial Sequence: Synthetic oligonucleotide
  Target: ATXN1; (+) strand; PAM type: NRG; PAM sequence: GGG
cacaaccccttgggtttcta

SEQ ID NO: 103611 - DNA, 20 bp, Artificial Sequence
  Description of Artificial Sequence: Synthetic oligonucleotide
  Target: ATXN1; (+) strand; PAM type: NRG; PAM sequence: TGG
tctagggtgctgtccgtcct

SEQ ID NO: 103612 - DNA, 20 bp, Artificial Sequence
  Description of Artificial Sequence: Synthetic oligonucleotide
  Target: ATXN1; (+) strand; PAM type: NRG; PAM sequence: TGG
gggtgctgtccgtccttggt

SEQ ID NO: 103613 - DNA, 20 bp, Artificial Sequence
  Description of Artificial Sequence: Synthetic oligonucleotide
  Target: ATXN1; (+) strand; PAM type: NRG; PAM sequence: CAG
tatcttgtgtccatctcttg

SEQ ID NO: 103614 - DNA, 20 bp, Artificial Sequence
  Description of Artificial Sequence: Synthetic oligonucleotide
  Target: ATXN1; (+) strand; PAM type: NRG; PAM sequence: AAG
ttgcagtttgtcttccttac

SEQ ID NO: 103615 - DNA, 20 bp, Artificial Sequence
  Description of Artificial Sequence: Synthetic oligonucleotide
  Target: ATXN1; (+) strand; PAM type: NRG; PAM sequence: TGG
agtttgtcttccttacaagc

SEQ ID NO: 103616 - DNA, 20 bp, Artificial Sequence
  Description of Artificial Sequence: Synthetic oligonucleotide
  Target: ATXN1; (+) strand; PAM type: NRG; PAM sequence: AAG
ccttacaagctggttattaa

SEQ ID NO: 103617 - DNA, 20 bp, Artificial Sequence
  Description of Artificial Sequence: Synthetic oligonucleotide
  Target: ATXN1; (+) strand; PAM type: NRG; PAM sequence: AGG
cttacaagctggttattaaa

SEQ ID NO: 103618 - DNA, 20 bp, Artificial Sequence
  Description of Artificial Sequence: Synthetic oligonucleotide
  Target: ATXN1; (+) strand; PAM type: NRG; PAM sequence: AAG
aagctggttattaaaaggca

SEQ ID NO: 103619 - DNA, 20 bp, Artificial Sequence
  Description of Artificial Sequence: Synthetic oligonucleotide
  Target: ATXN1; (+) strand; PAM type: NRG; PAM sequence: AGG
agctggttattaaaaggcaa

SEQ ID NO: 103620 - DNA, 20 bp, Artificial Sequence
  Description of Artificial Sequence: Synthetic oligonucleotide
  Target: ATXN1; (+) strand; PAM type: NRG; PAM sequence: TGG
attaaaaggcaaaggatttc

SEQ ID NO: 103621 - DNA, 20 bp, Artificial Sequence
  Description of Artificial Sequence: Synthetic oligonucleotide
  Target: ATXN1; (+) strand; PAM type: NRG; PAM sequence: TAG
aggatttctggatcattttc

SEQ ID NO: 103622 - DNA, 20 bp, Artificial Sequence
  Description of Artificial Sequence: Synthetic oligonucleotide
  Target: ATXN1; (+) strand; PAM type: NRG; PAM sequence: TGG
ctggatcattttctagattt

SEQ ID NO: 103623 - DNA, 20 bp, Artificial Sequence
  Description of Artificial Sequence: Synthetic oligonucleotide
  Target: ATXN1; (+) strand; PAM type: NRG; PAM sequence: CGG
ataaaaaactgaactcatta

SEQ ID NO: 103624 - DNA, 20 bp, Artificial Sequence
  Description of Artificial Sequence: Synthetic oligonucleotide
  Target: ATXN1; (+) strand; PAM type: NRG; PAM sequence: GAG
aaaaaactgaactcattacg

SEQ ID NO: 103625 - DNA, 20 bp, Artificial Sequence
  Description of Artificial Sequence: Synthetic oligonucleotide
  Target: ATXN1; (+) strand; PAM type: NRG; PAM sequence: AGG
aaaaactgaactcattacgg

SEQ ID NO: 103626 - DNA, 20 bp, Artificial Sequence
  Description of Artificial Sequence: Synthetic oligonucleotide
  Target: ATXN1; (+) strand; PAM type: NRG; PAM sequence: GGG
aaaactgaactcattacgga

SEQ ID NO: 103627 - DNA, 20 bp, Artificial Sequence
  Description of Artificial Sequence: Synthetic oligonucleotide
  Target: ATXN1; (+) strand; PAM type: NRG; PAM sequence: TGG
agggacataaaataatgttg

SEQ ID NO: 103628 - DNA, 20 bp, Artificial Sequence
  Description of Artificial Sequence: Synthetic oligonucleotide
  Target: ATXN1; (+) strand; PAM type: NRG; PAM sequence: AAG
ataatgttgtggtatctgca

SEQ ID NO: 103629 - DNA, 20 bp, Artificial Sequence
  Description of Artificial Sequence: Synthetic oligonucleotide
  Target: ATXN1; (+) strand; PAM type: NRG; PAM sequence: GAG
ctgcaaagaatctgcccctt

SEQ ID NO: 103630 - DNA, 20 bp, Artificial Sequence
  Description of Artificial Sequence: Synthetic oligonucleotide
  Target: ATXN1; (+) strand; PAM type: NRG; PAM sequence: GAG
tcaaacatactttctcacgt

SEQ ID NO: 103631 - DNA, 20 bp, Artificial Sequence
  Description of Artificial Sequence: Synthetic oligonucleotide
  Target: ATXN1; (+) strand; PAM type: NRG; PAM sequence: CGG
tattaactcctgttacttct

SEQ ID NO: 103632 - DNA, 20 bp, Artificial Sequence
  Description of Artificial Sequence: Synthetic oligonucleotide
  Target: ATXN1; (+) strand; PAM type: NRG; PAM sequence: GGG
attaactcctgttacttctc

SEQ ID NO: 103633 - DNA, 20 bp, Artificial Sequence
  Description of Artificial Sequence: Synthetic oligonucleotide
  Target: ATXN1; (+) strand; PAM type: NRG; PAM sequence: CAG
actcctgttacttctcgggt

SEQ ID NO: 103634 - DNA, 20 bp, Artificial Sequence
  Description of Artificial Sequence: Synthetic oligonucleotide
  Target: ATXN1; (+) strand; PAM type: NRG; PAM sequence: AGG
ctcctgttacttctcgggtc

SEQ ID NO: 103635 - DNA, 20 bp, Artificial Sequence
  Description of Artificial Sequence: Synthetic oligonucleotide
  Target: ATXN1; (+) strand; PAM type: NRG; PAM sequence: AAG
ctgttacttctcgggtcagg

SEQ ID NO: 103636 - DNA, 20 bp, Artificial Sequence
  Description of Artificial Sequence: Synthetic oligonucleotide
  Target: ATXN1; (+) strand; PAM type: NRG; PAM sequence: AAG
cttctcgggtcaggaagtac

SEQ ID NO: 103637 - DNA, 20 bp, Artificial Sequence
  Description of Artificial Sequence: Synthetic oligonucleotide
  Target: ATXN1; (+) strand; PAM type: NRG; PAM sequence: GAG
acaagtataatatattgtgt

SEQ ID NO: 103638 - DNA, 20 bp, Artificial Sequence
  Description of Artificial Sequence: Synthetic oligonucleotide
  Target: ATXN1; (+) strand; PAM type: NRG; PAM sequence: AAG
atatattgtgtgagatgtta

SEQ ID NO: 103639 - DNA, 20 bp, Artificial Sequence
  Description of Artificial Sequence: Synthetic oligonucleotide
  Target: ATXN1; (+) strand; PAM type: NRG; PAM sequence: TGG
tgttaaagacacttgctata

SEQ ID NO: 103640 - DNA, 20 bp, Artificial Sequence
  Description of Artificial Sequence: Synthetic oligonucleotide
  Target: ATXN1; (+) strand; PAM type: NRG; PAM sequence: GGG
gttaaagacacttgctatat

SEQ ID NO: 103641 - DNA, 20 bp, Artificial Sequence
  Description of Artificial Sequence: Synthetic oligonucleotide
  Target: ATXN1; (+) strand; PAM type: NRG; PAM sequence: AAG
aaagacacttgctatatggg

SEQ ID NO: 103642 - DNA, 20 bp, Artificial Sequence
  Description of Artificial Sequence: Synthetic oligonucleotide
  Target: ATXN1; (+) strand; PAM type: NRG; PAM sequence: AGG
aagacacttgctatatggga

SEQ ID NO: 103643 - DNA, 20 bp, Artificial Sequence
  Description of Artificial Sequence: Synthetic oligonucleotide
  Target: ATXN1; (+) strand; PAM type: NRG; PAM sequence: AAG
caattatccaaaactaatta

SEQ ID NO: 103644 - DNA, 20 bp, Artificial Sequence
  Description of Artificial Sequence: Synthetic oligonucleotide
  Target: ATXN1; (+) strand; PAM type: NRG; PAM sequence: TAG
aaactaattaaagattgtct

SEQ ID NO: 103645 - DNA, 20 bp, Artificial Sequence
  Description of Artificial Sequence: Synthetic oligonucleotide
  Target: ATXN1; (+) strand; PAM type: NRG; PAM sequence: AGG
aactaattaaagattgtctt

SEQ ID NO: 103646 - DNA, 20 bp, Artificial Sequence
  Description of Artificial Sequence: Synthetic oligonucleotide
  Target: ATXN1; (+) strand; PAM type: NRG; PAM sequence: AAG
attgtcttaggctcaatctc

SEQ ID NO: 103647 - DNA, 20 bp, Artificial Sequence
  Description of Artificial Sequence: Synthetic oligonucleotide
  Target: ATXN1; (+) strand; PAM type: NRG; PAM sequence: AGG
ttgtcttaggctcaatctca

SEQ ID NO: 103648 - DNA, 20 bp, Artificial Sequence
  Description of Artificial Sequence: Synthetic oligonucleotide
  Target: ATXN1; (+) strand; PAM type: NRG; PAM sequence: CGG
tcaatctcaaggaaacacct

SEQ ID NO: 103649 - DNA, 20 bp, Artificial Sequence
  Description of Artificial Sequence: Synthetic oligonucleotide
  Target: ATXN1; (+) strand; PAM type: NRG; PAM sequence: TAG
atctcaaggaaacacctcgg

SEQ ID NO: 103650 - DNA, 20 bp, Artificial Sequence
  Description of Artificial Sequence: Synthetic oligonucleotide
  Target: ATXN1; (+) strand; PAM type: NRG; PAM sequence: TGG
ggaaacacctcggtagtctc

SEQ ID NO: 103651 - DNA, 20 bp, Artificial Sequence
  Description of Artificial Sequence: Synthetic oligonucleotide
  Target: ATXN1; (+) strand; PAM type: NRG; PAM sequence: TGG
tcggtagtctctggatttac

SEQ ID NO: 103652 - DNA, 20 bp, Artificial Sequence
  Description of Artificial Sequence: Synthetic oligonucleotide
  Target: ATXN1; (+) strand; PAM type: NRG; PAM sequence: AAG
gtagtctctggatttactgg

SEQ ID NO: 103653 - DNA, 20 bp, Artificial Sequence
  Description of Artificial Sequence: Synthetic oligonucleotide
  Target: ATXN1; (+) strand; PAM type: NRG; PAM sequence: GAG
agtctctggatttactggaa

SEQ ID NO: 103654 - DNA, 20 bp, Artificial Sequence
  Description of Artificial Sequence: Synthetic oligonucleotide
  Target: ATXN1; (+) strand; PAM type: NRG; PAM sequence: AGG
gtctctggatttactggaag

SEQ ID NO: 103655 - DNA, 20 bp, Artificial Sequence
  Description of Artificial Sequence: Synthetic oligonucleotide
  Target: ATXN1; (+) strand; PAM type: NRG; PAM sequence: AAG
ggaagaggtgtgtatttaca

SEQ ID NO: 103656 - DNA, 20 bp, Artificial Sequence
  Description of Artificial Sequence: Synthetic oligonucleotide
  Target: ATXN1; (+) strand; PAM type: NRG; PAM sequence: CAG
gacaacaattttgttgaaac

SEQ ID NO: 103657 - DNA, 20 bp, Artificial Sequence
  Description of Artificial Sequence: Synthetic oligonucleotide
  Target: ATXN1; (+) strand; PAM type: NRG; PAM sequence: TAG
aaaccagcctaaatcaatcg

SEQ ID NO: 103658 - DNA, 20 bp, Artificial Sequence
  Description of Artificial Sequence: Synthetic oligonucleotide
  Target: ATXN1; (+) strand; PAM type: NRG; PAM sequence: AGG
aaccagcctaaatcaatcgt

SEQ ID NO: 103659 - DNA, 20 bp, Artificial Sequence
  Description of Artificial Sequence: Synthetic oligonucleotide
  Target: ATXN1; (+) strand; PAM type: NRG; PAM sequence: AAG
cagcctaaatcaatcgtagg

SEQ ID NO: 103660 - DNA, 20 bp, Artificial Sequence
  Description of Artificial Sequence: Synthetic oligonucleotide
  Target: ATXN1; (+) strand; PAM type: NRG; PAM sequence: AGG
agcctaaatcaatcgtagga

SEQ ID NO: 103661 - DNA, 20 bp, Artificial Sequence
  Description of Artificial Sequence: Synthetic oligonucleotide
  Target: ATXN1; (+) strand; PAM type: NRG; PAM sequence: AAG
aaatcaatcgtaggaaggac

SEQ ID NO: 103662 - DNA, 20 bp, Artificial Sequence
  Description of Artificial Sequence: Synthetic oligonucleotide
  Target: ATXN1; (+) strand; PAM type: NRG; PAM sequence: AGG
aatcaatcgtaggaaggaca

SEQ ID NO: 103663 - DNA, 20 bp, Artificial Sequence
  Description of Artificial Sequence: Synthetic oligonucleotide
  Target: ATXN1; (+) strand; PAM type: NRG; PAM sequence: GAG
tcaatcgtaggaaggacaag

SEQ ID NO: 103664 - DNA, 20 bp, Artificial Sequence
  Description of Artificial Sequence: Synthetic oligonucleotide
  Target: ATXN1; (+) strand; PAM type: NRG; PAM sequence: CAG
cgtaggaaggacaaggagat

SEQ ID NO: 103665 - DNA, 20 bp, Artificial Sequence
  Description of Artificial Sequence: Synthetic oligonucleotide
  Target: ATXN1; (+) strand; PAM type: NRG; PAM sequence: CGG
aggagatcagctgtacacat

SEQ ID NO: 103666 - DNA, 20 bp, Artificial Sequence
  Description of Artificial Sequence: Synthetic oligonucleotide
  Target: ATXN1; (+) strand; PAM type: NRG; PAM sequence: AAG
atcagctgtacacatcggcc

SEQ ID NO: 103667 - DNA, 20 bp, Artificial Sequence
  Description of Artificial Sequence: Synthetic oligonucleotide
  Target: ATXN1; (+) strand; PAM type: NRG; PAM sequence: AAG
ctgtacacatcggccaagat

SEQ ID NO: 103668 - DNA, 20 bp, Artificial Sequence
  Description of Artificial Sequence: Synthetic oligonucleotide
  Target: ATXN1; (+) strand; PAM type: NRG; PAM sequence: TAG
ataaatgtttgttttaaaat

SEQ ID NO: 103669 - DNA, 20 bp, Artificial Sequence
  Description of Artificial Sequence: Synthetic oligonucleotide
  Target: ATXN1; (+) strand; PAM type: NRG; PAM sequence: AGG
taaatgtttgttttaaaatt

SEQ ID NO: 103670 - DNA, 20 bp, Artificial Sequence
  Description of Artificial Sequence: Synthetic oligonucleotide
  Target: ATXN1; (+) strand; PAM type: NRG; PAM sequence: GGG
aaatgtttgttttaaaatta

SEQ ID NO: 103671 - DNA, 20 bp, Artificial Sequence
  Description of Artificial Sequence: Synthetic oligonucleotide
  Target: ATXN1; (+) strand; PAM type: NRG; PAM sequence: GGG
aatgtttgttttaaaattag

SEQ ID NO: 103672 - DNA, 20 bp, Artificial Sequence
  Description of Artificial Sequence: Synthetic oligonucleotide
  Target: ATXN1; (+) strand; PAM type: NRG; PAM sequence: CGG
ttaggggtatgactcacact

SEQ ID NO: 103673 - DNA, 20 bp, Artificial Sequence
  Description of Artificial Sequence: Synthetic oligonucleotide
  Target: ATXN1; (+) strand; PAM type: NRG; PAM sequence: TGG
tatgactcacactcggtgaa

SEQ ID NO: 103674 - DNA, 20 bp, Artificial Sequence
  Description of Artificial Sequence: Synthetic oligonucleotide
  Target: ATXN1; (+) strand; PAM type: NRG; PAM sequence: GGG
atgactcacactcggtgaat

SEQ ID NO: 103675 - DNA, 20 bp, Artificial Sequence
  Description of Artificial Sequence: Synthetic oligonucleotide
  Target: ATXN1; (+) strand; PAM type: NRG; PAM sequence: TGG
actcacactcggtgaatggg

SEQ ID NO: 103676 - DNA, 20 bp, Artificial Sequence
  Description of Artificial Sequence: Synthetic oligonucleotide
  Target: ATXN1; (+) strand; PAM type: NRG; PAM sequence: AAG
ggctgacttctgaccctcaa

SEQ ID NO: 103677 - DNA, 20 bp, Artificial Sequence
  Description of Artificial Sequence: Synthetic oligonucleotide
  Target: ATXN1; (+) strand; PAM type: NRG; PAM sequence: TGG
tctgaccctcaaaagatgaa

SEQ ID NO: 103678 - DNA, 20 bp, Artificial Sequence
  Description of Artificial Sequence: Synthetic oligonucleotide
  Target: ATXN1; (+) strand; PAM type: NRG; PAM sequence: AAG
gatgaatggctcattttgaa

SEQ ID NO: 103679 - DNA, 20 bp, Artificial Sequence
  Description of Artificial Sequence: Synthetic oligonucleotide
  Target: ATXN1; (+) strand; PAM type: NRG; PAM sequence: CAG
atggctcattttgaaaagcc

SEQ ID NO: 103680 - DNA, 20 bp, Artificial Sequence
  Description of Artificial Sequence: Synthetic oligonucleotide
  Target: ATXN1; (+) strand; PAM type: NRG; PAM sequence: AAG
ctcattttgaaaagcccagc

SEQ ID NO: 103681 - DNA, 20 bp, Artificial Sequence
  Description of Artificial Sequence: Synthetic oligonucleotide
  Target: ATXN1; (+) strand; PAM type: NRG; PAM sequence: TGG
attttgaaaagcccagcaag

SEQ ID NO: 103682 - DNA, 20 bp, Artificial Sequence
  Description of Artificial Sequence: Synthetic oligonucleotide
  Target: ATXN1; (+) strand; PAM type: NRG; PAM sequence: GGG
ttttgaaaagcccagcaagt

SEQ ID NO: 103683 - DNA, 20 bp, Artificial Sequence
  Description of Artificial Sequence: Synthetic oligonucleotide
  Target: ATXN1; (+) strand; PAM type: NRG; PAM sequence: AAG
tgaaaagcccagcaagtggg

SEQ ID NO: 103684 - DNA, 20 bp, Artificial Sequence
  Description of Artificial Sequence: Synthetic oligonucleotide
  Target: ATXN1; (+) strand; PAM type: NRG; PAM sequence: CAG
ctttctacctccactgactt

SEQ ID NO: 103685 - DNA, 20 bp, Artificial Sequence
  Description of Artificial Sequence: Synthetic oligonucleotide
  Target: ATXN1; (+) strand; PAM type: NRG; PAM sequence: GAG
acctccactgacttcagaat

SEQ ID NO: 103686 - DNA, 20 bp, Artificial Sequence
  Description of Artificial Sequence: Synthetic oligonucleotide
  Target: ATXN1; (+) strand; PAM type: NRG; PAM sequence: AGG
cctccactgacttcagaatg

SEQ ID NO: 103687 - DNA, 20 bp, Artificial Sequence
  Description of Artificial Sequence: Synthetic oligonucleotide
  Target: ATXN1; (+) strand; PAM type: NRG; PAM sequence: CAG
ctgacttcagaatgaggctg

SEQ ID NO: 103688 - DNA, 20 bp, Artificial Sequence
  Description of Artificial Sequence: Synthetic oligonucleotide
  Target: ATXN1; (+) strand; PAM type: NRG; PAM sequence: TAG
ttcagaatgaggctgcagtg

SEQ ID NO: 103689 - DNA, 20 bp, Artificial Sequence
  Description of Artificial Sequence: Synthetic oligonucleotide
  Target: ATXN1; (+) strand; PAM type: NRG; PAM sequence: TGG
agaatgaggctgcagtgtag

SEQ ID NO: 103690 - DNA, 20 bp, Artificial Sequence
  Description of Artificial Sequence: Synthetic oligonucleotide
  Target: ATXN1; (+) strand; PAM type: NRG; PAM sequence: GAG
aatgaggctgcagtgtagtg

SEQ ID NO: 103691 - DNA, 20 bp, Artificial Sequence
  Description of Artificial Sequence: Synthetic oligonucleotide
  Target: ATXN1; (+) strand; PAM type: NRG; PAM sequence: AAG
gctgcagtgtagtggagccc

SEQ ID NO: 103692 - DNA, 20 bp, Artificial Sequence
  Description of Artificial Sequence: Synthetic oligonucleotide
  Target: ATXN1; (+) strand; PAM type: NRG; PAM sequence: TGG
cagtgtagtggagcccaaga

SEQ ID NO: 103693 - DNA, 20 bp, Artificial Sequence
  Description of Artificial Sequence: Synthetic oligonucleotide
  Target: ATXN1; (+) strand; PAM type: NRG; PAM sequence: GAG
gtggagcccaagatggcccc

SEQ ID NO: 103694 - DNA, 20 bp, Artificial Sequence
  Description of Artificial Sequence: Synthetic oligonucleotide
  Target: ATXN1; (+) strand; PAM type: NRG; PAM sequence: CAG
agatggccccgagttgtttc

SEQ ID NO: 103695 - DNA, 20 bp, Artificial Sequence
  Description of Artificial Sequence: Synthetic oligonucleotide
  Target: ATXN1; (+) strand; PAM type: NRG; PAM sequence: TAG
cccgagttgtttccagtcac

SEQ ID NO: 103696 - DNA, 20 bp, Artificial Sequence
  Description of Artificial Sequence: Synthetic oligonucleotide
  Target: ATXN1; (+) strand; PAM type: NRG; PAM sequence: AAG
agttgtttccagtcactagc

SEQ ID NO: 103697 - DNA, 20 bp, Artificial Sequence
  Description of Artificial Sequence: Synthetic oligonucleotide
  Target: ATXN1; (+) strand; PAM type: NRG; PAM sequence: TGG
gtttccagtcactagcaaga

SEQ ID NO: 103698 - DNA, 20 bp, Artificial Sequence
  Description of Artificial Sequence: Synthetic oligonucleotide
  Target: ATXN1; (+) strand; PAM type: NRG; PAM sequence: TGG
gtcactagcaagatggacaa

SEQ ID NO: 103699 - DNA, 20 bp, Artificial Sequence
  Description of Artificial Sequence: Synthetic oligonucleotide
  Target: ATXN1; (+) strand; PAM type: NRG; PAM sequence: GGG
tcactagcaagatggacaat

SEQ ID NO: 103700 - DNA, 20 bp, Artificial Sequence
  Description of Artificial Sequence: Synthetic oligonucleotide
  Target: ATXN1; (+) strand; PAM type: NRG; PAM sequence: CAG
atgggatgactcgctacctg

SEQ ID NO: 103701 - DNA, 20 bp, Artificial Sequence
  Description of Artificial Sequence: Synthetic oligonucleotide
  Target: ATXN1; (+) strand; PAM type: NRG; PAM sequence: AAG
tgcagctgttttcaataaaa

SEQ ID NO: 103702 - DNA, 20 bp, Artificial Sequence
  Description of Artificial Sequence: Synthetic oligonucleotide
  Target: ATXN1; (+) strand; PAM type: NRG; PAM sequence: GAG
ctgttttcaataaaaaagct

SEQ ID NO: 103703 - DNA, 20 bp, Artificial Sequence
  Description of Artificial Sequence: Synthetic oligonucleotide
  Target: ATXN1; (+) strand; PAM type: NRG; PAM sequence: CAG
ataaaaaagctgagtaatta

SEQ ID NO: 103704 - DNA, 20 bp, Artificial Sequence
  Description of Artificial Sequence: Synthetic oligonucleotide
  Target: ATXN1; (+) strand; PAM type: NRG; PAM sequence: CAG
aaaaagctgagtaattacag

SEQ ID NO: 103705 - DNA, 20 bp, Artificial Sequence
  Description of Artificial Sequence: Synthetic oligonucleotide
  Target: ATXN1; (+) strand; PAM type: NRG; PAM sequence: TGG
gtaattacagcagcctctcc

SEQ ID NO: 103706 - DNA, 20 bp, Artificial Sequence
  Description of Artificial Sequence: Synthetic oligonucleotide
  Target: ATXN1; (+) strand; PAM type: NRG; PAM sequence: GGG
taattacagcagcctctcct

SEQ ID NO: 103707 - DNA, 20 bp, Artificial Sequence
  Description of Artificial Sequence: Synthetic oligonucleotide
  Target: ATXN1; (+) strand; PAM type: NRG; PAM sequence: GGG
aattacagcagcctctcctg

SEQ ID NO: 103708 - DNA, 20 bp, Artificial Sequence
  Description of Artificial Sequence: Synthetic oligonucleotide
  Target: ATXN1; (+) strand; PAM type: NRG; PAM sequence: CGG
cctctcctggggctcacatg

SEQ ID NO: 103709 - DNA, 20 bp, Artificial Sequence
  Description of Artificial Sequence: Synthetic oligonucleotide
  Target: ATXN1; (+) strand; PAM type: NRG; PAM sequence: CAG
cctggggctcacatgcggcc

SEQ ID NO: 103710 - DNA, 20 bp, Artificial Sequence
  Description of Artificial Sequence: Synthetic oligonucleotide
  Target: ATXN1; (+) strand; PAM type: NRG; PAM sequence: AAG
ctcacatgcggcccagcaca

SEQ ID NO: 103711 - DNA, 20 bp, Artificial Sequence
  Description of Artificial Sequence: Synthetic oligonucleotide
  Target: ATXN1; (+) strand; PAM type: NRG; PAM sequence: TGG
gcggcccagcacaaagccaa

SEQ ID NO: 103712 - DNA, 20 bp, Artificial Sequence
  Description of Artificial Sequence: Synthetic oligonucleotide
  Target: ATXN1; (+) strand; PAM type: NRG; PAM sequence: AAG
cacaaagccaatggaacatt

SEQ ID NO: 103713 - DNA, 20 bp, Artificial Sequence
  Description of Artificial Sequence: Synthetic oligonucleotide
  Target: ATXN1; (+) strand; PAM type: NRG; PAM sequence: AGG
acaaagccaatggaacatta

SEQ ID NO: 103714 - DNA, 20 bp, Artificial Sequence
  Description of Artificial Sequence: Synthetic oligonucleotide
  Target: ATXN1; (+) strand; PAM type: NRG; PAM sequence: GAG
gaacattaaggacactgaat

SEQ ID NO: 103715 - DNA, 20 bp, Artificial Sequence
  Description of Artificial Sequence: Synthetic oligonucleotide
  Target: ATXN1; (+) strand; PAM type: NRG; PAM sequence: CAG
aaggacactgaatgagctgc

SEQ ID NO: 103716 - DNA, 20 bp, Artificial Sequence
  Description of Artificial Sequence: Synthetic oligonucleotide
  Target: ATXN1; (+) strand; PAM type: NRG; PAM sequence: AAG
gacactgaatgagctgccag

SEQ ID NO: 103717 - DNA, 20 bp, Artificial Sequence
  Description of Artificial Sequence: Synthetic oligonucleotide
  Target: ATXN1; (+) strand; PAM type: NRG; PAM sequence: CAG
atgagctgccagaagccctt

SEQ ID NO: 103718 - DNA, 20 bp, Artificial Sequence
  Description of Artificial Sequence: Synthetic oligonucleotide
  Target: ATXN1; (+) strand; PAM type: NRG; PAM sequence: TGG
tgccagaagcccttcagcat

SEQ ID NO: 103719 - DNA, 20 bp, Artificial Sequence
  Description of Artificial Sequence: Synthetic oligonucleotide
  Target: ATXN1; (+) strand; PAM type: NRG; PAM sequence: GGG
gccagaagcccttcagcatt

SEQ ID NO: 103720 - DNA, 20 bp, Artificial Sequence
  Description of Artificial Sequence: Synthetic oligonucleotide
  Target: ATXN1; (+) strand; PAM type: NRG; PAM sequence: CAG
ccaaactgctcctcctcccc

SEQ ID NO: 103721 - DNA, 20 bp, Artificial Sequence
  Description of Artificial Sequence: Synthetic oligonucleotide
  Target: ATXN1; (+) strand; PAM type: NRG; PAM sequence: CAG
ctgctcctcctcccccagct

SEQ ID NO: 103722 - DNA, 20 bp, Artificial Sequence
  Description of Artificial Sequence: Synthetic oligonucleotide
  Target: ATXN1; (+) strand; PAM type: NRG; PAM sequence: CAG
ctcagcgtcattaacttaat

SEQ ID NO: 103723 - DNA, 20 bp, Artificial Sequence
  Description of Artificial Sequence: Synthetic oligonucleotide
  Target: ATXN1; (+) strand; PAM type: NRG; PAM sequence: AGG
tcagcgtcattaacttaatc

SEQ ID NO: 103724 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaattgacactccc

SEQ ID NO: 103725 - DNA, 20 bp, Artificial Sequence
  Description of Artificial Sequence: Synthetic oligonucleotide
  Target: ATXN1; (+) strand; PAM type: NRG; PAM sequence: TAG
aaattgacactccctggatg

SEQ ID NO: 103726 - DNA, 20 bp, Artificial Sequence
  Description of Artificial Sequence: Synthetic oligonucleotide
  Target: ATXN1; (+) strand; PAM type: NRG; PAM sequence: AGG
aattgacactccctggatgt

SEQ ID NO: 103727 - DNA, 20 bp, Artificial Sequence
  Description of Artificial Sequence: Synthetic oligonucleotide
  Target: ATXN1; (+) strand; PAM type: NRG; PAM sequence: GAG
gtaggcaacaccctctgaat

SEQ ID NO: 103728 - DNA, 20 bp, Artificial Sequence
  Description of Artificial Sequence: Synthetic oligonucleotide
  Target: ATXN1; (+) strand; PAM type: NRG; PAM sequence: AGG
taggcaacaccctctgaatg

SEQ ID NO: 103729 - DNA, 20 bp, Artificial Sequence
  Description of Artificial Sequence: Synthetic oligonucleotide
  Target: ATXN1; (+) strand; PAM type: NRG; PAM sequence: CGG
actgtcaaattgactgcatc

SEQ ID NO: 103730 - DNA, 20 bp, Artificial Sequence
  Description of Artificial Sequence: Synthetic oligonucleotide
  Target: ATXN1; (+) strand; PAM type: NRG; PAM sequence: CAG
gtcaaattgactgcatccgg

SEQ ID NO: 103731 - DNA, 20 bp, Artificial Sequence
  Description of Artificial Sequence: Synthetic oligonucleotide
  Target: ATXN1; (+) strand; PAM type: NRG; PAM sequence: AGG
tcaaattgactgcatccggc

SEQ ID NO: 103732 - DNA, 20 bp, Artificial Sequence
  Description of Artificial Sequence: Synthetic oligonucleotide
  Target: ATXN1; (+) strand; PAM type: NRG; PAM sequence: AAG
aattgactgcatccggcagg

SEQ ID NO: 103733 - DNA, 20 bp, Artificial Sequence
  Description of Artificial Sequence: Synthetic oligonucleotide
  Target: ATXN1; (+) strand; PAM type: NRG; PAM sequence: GAG
ctgcatccggcaggaagtgt

SEQ ID NO: 103734 - DNA, 20 bp, Artificial Sequence
  Description of Artificial Sequence: Synthetic oligonucleotide
  Target: ATXN1; (+) strand; PAM type: NRG; PAM sequence: AGG
tgcatccggcaggaagtgtg

SEQ ID NO: 103735 - DNA, 20 bp, Artificial Sequence
  Description of Artificial Sequence: Synthetic oligonucleotide
  Target: ATXN1; (+) strand; PAM type: NRG; PAM sequence: GGG
gcatccggcaggaagtgtga

SEQ ID NO: 103736 - DNA, 20 bp, Artificial Sequence
  Description of Artificial Sequence: Synthetic oligonucleotide
  Target: ATXN1; (+) strand; PAM type: NRG; PAM sequence: CGG
tccggcaggaagtgtgaggg

SEQ ID NO: 103737 - DNA, 20 bp, Artificial Sequence
  Description of Artificial Sequence: Synthetic oligonucleotide
  Target: ATXN1; (+) strand; PAM type: NRG; PAM sequence: GAG
tttatttatttatttatttt

SEQ ID NO: 103738 - DNA, 20 bp, Artificial Sequence
  Description of Artificial Sequence: Synthetic oligonucleotide
  Target: ATXN1; (+) strand; PAM type: NRG; PAM sequence: CAG
tttatttatttattttgaga

SEQ ID NO: 103739 - DNA, 20 bp, Artificial Sequence
  Description of Artificial Sequence: Synthetic oligonucleotide
  Target: ATXN1; (+) strand; PAM type: NRG; PAM sequence: TAG
atttatttattttgagacag

SEQ ID NO: 103740 - DNA, 20 bp, Artificial Sequence
  Description of Artificial Sequence: Synthetic oligonucleotide
  Target: ATXN1; (+) strand; PAM type: NRG; PAM sequence: CAG
atttattttgagacagtagc

SEQ ID NO: 103741 - DNA, 20 bp, Artificial Sequence
  Description of Artificial Sequence: Synthetic oligonucleotide
  Target: ATXN1; (+) strand; PAM type: NRG; PAM sequence: GAG
ttattttgagacagtagcca

SEQ ID NO: 103742 - DNA, 20 bp, Artificial Sequence
  Description of Artificial Sequence: Synthetic oligonucleotide
  Target: ATXN1; (+) strand; PAM type: NRG; PAM sequence: TGG
tttgagacagtagccagagc

SEQ ID NO: 103743 - DNA, 20 bp, Artificial Sequence
  Description of Artificial Sequence: Synthetic oligonucleotide
  Target: ATXN1; (+) strand; PAM type: NRG; PAM sequence: GAG
tgagacagtagccagagctg

SEQ ID NO: 103744 - DNA, 20 bp, Artificial Sequence
  Description of Artificial Sequence: Synthetic oligonucleotide
  Target: ATXN1; (+) strand; PAM type: NRG; PAM sequence: CAG
cagtagccagagctggagcg

SEQ ID NO: 103745 - DNA, 20 bp, Artificial Sequence
  Description of Artificial Sequence: Synthetic oligonucleotide
  Target: ATXN1; (+) strand; PAM type: NRG; PAM sequence: CAG
ggagcgcagtcacgtgatcc

SEQ ID NO: 103746 - DNA, 20 bp, Artificial Sequence
  Description of Artificial Sequence: Synthetic oligonucleotide
  Target: ATXN1; (+) strand; PAM type: NRG; PAM sequence: TGG
tcactgcaacctccgcctcc

SEQ ID NO: 103747 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctccgcctcct

SEQ ID NO: 103748 - DNA, 20 bp, Artificial Sequence
  Description of Artificial Sequence: Synthetic oligonucleotide
  Target: ATXN1; (+) strand; PAM type: NRG; PAM sequence: AAG
aacctccgcctcctgggttc

SEQ ID NO: 103749 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcatgcct

SEQ ID NO: 103750 - DNA, 20 bp, Artificial Sequence
  Description of Artificial Sequence: Synthetic oligonucleotide
  Target: ATXN1; (+) strand; PAM type: NRG; PAM sequence: GAG
ttctcatgcctcagcctcct

SEQ ID NO: 103751 - DNA, 20 bp, Artificial Sequence
  Description of Artificial Sequence: Synthetic oligonucleotide
  Target: ATXN1; (+) strand; PAM type: NRG; PAM sequence: TAG
tcatgcctcagcctcctgag

SEQ ID NO: 103752 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 103753 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 103754 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggatta

SEQ ID NO: 103755 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggattac

SEQ ID NO: 103756 - DNA, 20 bp, Artificial Sequence
  Description of Artificial Sequence: Synthetic oligonucleotide
  Target: ATXN1; (+) strand; PAM type: NRG; PAM sequence: TGG
caggcgcctgccaccatgcc

SEQ ID NO: 103757 - DNA, 20 bp, Artificial Sequence
  Description of Artificial Sequence: Synthetic oligonucleotide
  Target: ATXN1; (+) strand; PAM type: NRG; PAM sequence: TAG
cgcctgccaccatgcctggc

SEQ ID NO: 103758 - DNA, 20 bp, Artificial Sequence
  Description of Artificial Sequence: Synthetic oligonucleotide
  Target: ATXN1; (+) strand; PAM type: NRG; PAM sequence: CAG
gctagtttttgtactttttt

SEQ ID NO: 103759 - DNA, 20 bp, Artificial Sequence
  Description of Artificial Sequence: Synthetic oligonucleotide
  Target: ATXN1; (+) strand; PAM type: NRG; PAM sequence: CAG
gtttttgtacttttttcaga

SEQ ID NO: 103760 - DNA, 20 bp, Artificial Sequence
  Description of Artificial Sequence: Synthetic oligonucleotide
  Target: ATXN1; (+) strand; PAM type: NRG; PAM sequence: AGG
tttttgtacttttttcagac

SEQ ID NO: 103761 - DNA, 20 bp, Artificial Sequence
  Description of Artificial Sequence: Synthetic oligonucleotide
  Target: ATXN1; (+) strand; PAM type: NRG; PAM sequence: GGG
ttttgtacttttttcagaca

SEQ ID NO: 103762 - DNA, 20 bp, Artificial Sequence
  Description of Artificial Sequence: Synthetic oligonucleotide
  Target: ATXN1; (+) strand; PAM type: NRG; PAM sequence: TGG
cagacagggttatatcatgt

SEQ ID NO: 103763 - DNA, 20 bp, Artificial Sequence
  Description of Artificial Sequence: Synthetic oligonucleotide
  Target: ATXN1; (+) strand; PAM type: NRG; PAM sequence: CAG
cagggttatatcatgttggc

SEQ ID NO: 103764 - DNA, 20 bp, Artificial Sequence
  Description of Artificial Sequence: Synthetic oligonucleotide
  Target: ATXN1; (+) strand; PAM type: NRG; PAM sequence: AGG
agggttatatcatgttggcc

SEQ ID NO: 103765 - DNA, 20 bp, Artificial Sequence
  Description of Artificial Sequence: Synthetic oligonucleotide
  Target: ATXN1; (+) strand; PAM type: NRG; PAM sequence: TGG
ttatatcatgttggccaggc

SEQ ID NO: 103766 - DNA, 20 bp, Artificial Sequence
  Description of Artificial Sequence: Synthetic oligonucleotide
  Target: ATXN1; (+) strand; PAM type: NRG; PAM sequence: CAG
tggtctcaaactcctgacct

SEQ ID NO: 103767 - DNA, 20 bp, Artificial Sequence
  Description of Artificial Sequence: Synthetic oligonucleotide
  Target: ATXN1; (+) strand; PAM type: NRG; PAM sequence: AGG
ggtctcaaactcctgacctc

SEQ ID NO: 103768 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatccgcccatct

SEQ ID NO: 103769 - DNA, 20 bp, Artificial Sequence
  Description of Artificial Sequence: Synthetic oligonucleotide
  Target: ATXN1; (+) strand; PAM type: NRG; PAM sequence: AAG
ccgcccatctcggcctccca

SEQ ID NO: 103770 - DNA, 20 bp, Artificial Sequence
  Description of Artificial Sequence: Synthetic oligonucleotide
  Target: ATXN1; (+) strand; PAM type: NRG; PAM sequence: TGG
cccatctcggcctcccaaag

SEQ ID NO: 103771 - DNA, 20 bp, Artificial Sequence
  Description of Artificial Sequence: Synthetic oligonucleotide
  Target: ATXN1; (+) strand; PAM type: NRG; PAM sequence: GGG
ccatctcggcctcccaaagt

SEQ ID NO: 103772 - DNA, 20 bp, Artificial Sequence
  Description of Artificial Sequence: Synthetic oligonucleotide
  Target: ATXN1; (+) strand; PAM type: NRG; PAM sequence: GAG
atctcggcctcccaaagtgg

SEQ ID NO: 103773 - DNA, 20 bp, Artificial Sequence
  Description of Artificial Sequence: Synthetic oligonucleotide
  Target: ATXN1; (+) strand; PAM type: NRG; PAM sequence: GAG
cggcctcccaaagtgggagt

SEQ ID NO: 103774 - DNA, 20 bp, Artificial Sequence
  Description of Artificial Sequence: Synthetic oligonucleotide
  Target: ATXN1; (+) strand; PAM type: NRG; PAM sequence: TGG
agtgggagtgagccaccgct

SEQ ID NO: 103775 - DNA, 20 bp, Artificial Sequence
  Description of Artificial Sequence: Synthetic oligonucleotide
  Target: ATXN1; (+) strand; PAM type: NRG; PAM sequence: GGG
gtgggagtgagccaccgctt

SEQ ID NO: 103776 - DNA, 20 bp, Artificial Sequence
  Description of Artificial Sequence: Synthetic oligonucleotide
  Target: ATXN1; (+) strand; PAM type: NRG; PAM sequence: CAG
tgagccaccgcttgggatta

SEQ ID NO: 103777 - DNA, 20 bp, Artificial Sequence
  Description of Artificial Sequence: Synthetic oligonucleotide
  Target: ATXN1; (+) strand; PAM type: NRG; PAM sequence: GAG
ccgcttgggattacagccct

SEQ ID NO: 103778 - DNA, 20 bp, Artificial Sequence
  Description of Artificial Sequence: Synthetic oligonucleotide
  Target: ATXN1; (+) strand; PAM type: NRG; PAM sequence: CAG
cagccctgagccaccacgct

SEQ ID NO: 103779 - DNA, 20 bp, Artificial Sequence
  Description of Artificial Sequence: Synthetic oligonucleotide
  Target: ATXN1; (+) strand; PAM type: NRG; PAM sequence: TAG
atttaatttatttttaaatt

SEQ ID NO: 103780 - DNA, 20 bp, Artificial Sequence
  Description of Artificial Sequence: Synthetic oligonucleotide
  Target: ATXN1; (+) strand; PAM type: NRG; PAM sequence: AGG
tttaatttatttttaaattt

SEQ ID NO: 103781 - DNA, 20 bp, Artificial Sequence
  Description of Artificial Sequence: Synthetic oligonucleotide
  Target: ATXN1; (+) strand; PAM type: NRG; PAM sequence: GGG
ttaatttatttttaaattta

SEQ ID NO: 103782 - DNA, 20 bp, Artificial Sequence
  Description of Artificial Sequence: Synthetic oligonucleotide
  Target: ATXN1; (+) strand; PAM type: NRG; PAM sequence: GGG
taatttatttttaaatttag

SEQ ID NO: 103783 - DNA, 20 bp, Artificial Sequence
  Description of Artificial Sequence: Synthetic oligonucleotide
  Target: ATXN1; (+) strand; PAM type: NRG; PAM sequence: TGG
ttatttttaaatttaggggc

SEQ ID NO: 103784 - DNA, 20 bp, Artificial Sequence
  Description of Artificial Sequence: Synthetic oligonucleotide
  Target: ATXN1; (+) strand; PAM type: NRG; PAM sequence: GGG
tatttttaaatttaggggct

SEQ ID NO: 103785 - DNA, 20 bp, Artificial Sequence
  Description of Artificial Sequence: Synthetic oligonucleotide
  Target: ATXN1; (+) strand; PAM type: NRG; PAM sequence: AAG
ttttaaatttaggggctggg

SEQ ID NO: 103786 - DNA, 20 bp, Artificial Sequence
  Description of Artificial Sequence: Synthetic oligonucleotide
  Target: ATXN1; (+) strand; PAM type: NRG; PAM sequence: TGG
aaatttaggggctgggaaga

SEQ ID NO: 103787 - DNA, 20 bp, Artificial Sequence
  Description of Artificial Sequence: Synthetic oligonucleotide
  Target: ATXN1; (+) strand; PAM type: NRG; PAM sequence: GGG
aatttaggggctgggaagat

SEQ ID NO: 103788 - DNA, 20 bp, Artificial Sequence
  Description of Artificial Sequence: Synthetic oligonucleotide
  Target: ATXN1; (+) strand; PAM type: NRG; PAM sequence: CAG
gatgggaatcctcctctatg

SEQ ID NO: 103789 - DNA, 20 bp, Artificial Sequence
  Description of Artificial Sequence: Synthetic oligonucleotide
  Target: ATXN1; (+) strand; PAM type: NRG; PAM sequence: TGG
ctcctctatgcagtaatcct

SEQ ID NO: 103790 - DNA, 20 bp, Artificial Sequence
  Description of Artificial Sequence: Synthetic oligonucleotide
  Target: ATXN1; (+) strand; PAM type: NRG; PAM sequence: CAG
tgcagtaatccttggacatg

SEQ ID NO: 103791 - DNA, 20 bp, Artificial Sequence
  Description of Artificial Sequence: Synthetic oligonucleotide
  Target: ATXN1; (+) strand; PAM type: NRG; PAM sequence: TGG
agtaatccttggacatgcag

SEQ ID NO: 103792 - DNA, 20 bp, Artificial Sequence
  Description of Artificial Sequence: Synthetic oligonucleotide
  Target: ATXN1; (+) strand; PAM type: NRG; PAM sequence: AAG
aatccttggacatgcagtgg

SEQ ID NO: 103793 - DNA, 20 bp, Artificial Sequence
  Description of Artificial Sequence: Synthetic oligonucleotide
  Target: ATXN1; (+) strand; PAM type: NRG; PAM sequence: GAG
tccttggacatgcagtggaa

SEQ ID NO: 103794 - DNA, 20 bp, Artificial Sequence
  Description of Artificial Sequence: Synthetic oligonucleotide
  Target: ATXN1; (+) strand; PAM type: NRG; PAM sequence: GAG
cttggacatgcagtggaaga

SEQ ID NO: 103795 - DNA, 20 bp, Artificial Sequence
  Description of Artificial Sequence: Synthetic oligonucleotide
  Target: ATXN1; (+) strand; PAM type: NRG; PAM sequence: AGG
ttggacatgcagtggaagag

SEQ ID NO: 103796 - DNA, 20 bp, Artificial Sequence
  Description of Artificial Sequence: Synthetic oligonucleotide
  Target: ATXN1; (+) strand; PAM type: NRG; PAM sequence: TAG
atgcagtggaagagaggtta

SEQ ID NO: 103797 - DNA, 20 bp, Artificial Sequence
  Description of Artificial Sequence: Synthetic oligonucleotide
  Target: ATXN1; (+) strand; PAM type: NRG; PAM sequence: GAG
agtggaagagaggttatagt

SEQ ID NO: 103798 - DNA, 20 bp, Artificial Sequence
  Description of Artificial Sequence: Synthetic oligonucleotide
  Target: ATXN1; (+) strand; PAM type: NRG; PAM sequence: CAG
ggaagagaggttatagtgag

SEQ ID NO: 103799 - DNA, 20 bp, Artificial Sequence
  Description of Artificial Sequence: Synthetic oligonucleotide
  Target: ATXN1; (+) strand; PAM type: NRG; PAM sequence: TGG
aggttatagtgagcagctgc

SEQ ID NO: 103800 - DNA, 20 bp, Artificial Sequence
  Description of Artificial Sequence: Synthetic oligonucleotide
  Target: ATXN1; (+) strand; PAM type: NRG; PAM sequence: CAG
tagtgagcagctgctggtca

SEQ ID NO: 103801 - DNA, 20 bp, Artificial Sequence
  Description of Artificial Sequence: Synthetic oligonucleotide
  Target: ATXN1; (+) strand; PAM type: NRG; PAM sequence: AAG
cagctgctggtcacagacta

SEQ ID NO: 103802 - DNA, 20 bp, Artificial Sequence
  Description of Artificial Sequence: Synthetic oligonucleotide
  Target: ATXN1; (+) strand; PAM type: NRG; PAM sequence: GAG
gctgctggtcacagactaaa

SEQ ID NO: 103803 - DNA, 20 bp, Artificial Sequence
  Description of Artificial Sequence: Synthetic oligonucleotide
  Target: ATXN1; (+) strand; PAM type: NRG; PAM sequence: AAG
gctggtcacagactaaagag

SEQ ID NO: 103804 - DNA, 20 bp, Artificial Sequence
  Description of Artificial Sequence: Synthetic oligonucleotide
  Target: ATXN1; (+) strand; PAM type: NRG; PAM sequence: TAG
ccttgctccctctttgcatt

SEQ ID NO: 103805 - DNA, 20 bp, Artificial Sequence
  Description of Artificial Sequence: Synthetic oligonucleotide
  Target: ATXN1; (+) strand; PAM type: NRG; PAM sequence: AAG
tgctccctctttgcatttag

SEQ ID NO: 103806 - DNA, 20 bp, Artificial Sequence
  Description of Artificial Sequence: Synthetic oligonucleotide
  Target: ATXN1; (+) strand; PAM type: NRG; PAM sequence: GAG
ataatatcgttctgactcct

SEQ ID NO: 103807 - DNA, 20 bp, Artificial Sequence
  Description of Artificial Sequence: Synthetic oligonucleotide
  Target: ATXN1; (+) strand; PAM type: NRG; PAM sequence: CAG
atatcgttctgactcctgag

SEQ ID NO: 103808 - DNA, 20 bp, Artificial Sequence
  Description of Artificial Sequence: Synthetic oligonucleotide
  Target: ATXN1; (+) strand; PAM type: NRG; PAM sequence: AGG
tatcgttctgactcctgagc

SEQ ID NO: 103809 - DNA, 20 bp, Artificial Sequence
  Description of Artificial Sequence: Synthetic oligonucleotide
  Target: ATXN1; (+) strand; PAM type: NRG; PAM sequence: AAG
cgttctgactcctgagcagg

SEQ ID NO: 103810 - DNA, 20 bp, Artificial Sequence
  Description of Artificial Sequence: Synthetic oligonucleotide
  Target: ATXN1; (+) strand; PAM type: NRG; PAM sequence: TAG
actcctgagcaggaagcaca

SEQ ID NO: 103811 - DNA, 20 bp, Artificial Sequence
  Description of Artificial Sequence: Synthetic oligonucleotide
  Target: ATXN1; (+) strand; PAM type: NRG; PAM sequence: CAG
caggaagcacatagttgatt

SEQ ID NO: 103812 - DNA, 20 bp, Artificial Sequence
  Description of Artificial Sequence: Synthetic oligonucleotide
  Target: ATXN1; (+) strand; PAM type: NRG; PAM sequence: TAG
tagttgattcagtgtcatgt

SEQ ID NO: 103813 - DNA, 20 bp, Artificial Sequence
  Description of Artificial Sequence: Synthetic oligonucleotide
  Target: ATXN1; (+) strand; PAM type: NRG; PAM sequence: CGG
gattcagtgtcatgttagac

SEQ ID NO: 103814 - DNA, 20 bp, Artificial Sequence
  Description of Artificial Sequence: Synthetic oligonucleotide
  Target: ATXN1; (+) strand; PAM type: NRG; PAM sequence: GGG
attcagtgtcatgttagacc

SEQ ID NO: 103815 - DNA, 20 bp, Artificial Sequence
  Description of Artificial Sequence: Synthetic oligonucleotide
  Target: ATXN1; (+) strand; PAM type: NRG; PAM sequence: TGG
tcatgttagaccgggctaac

SEQ ID NO: 103816 - DNA, 20 bp, Artificial Sequence
  Description of Artificial Sequence: Synthetic oligonucleotide
  Target: ATXN1; (+) strand; PAM type: NRG; PAM sequence: TAG
catttgataactcgtgactt

SEQ ID NO: 103817 - DNA, 20 bp, Artificial Sequence
  Description of Artificial Sequence: Synthetic oligonucleotide
  Target: ATXN1; (+) strand; PAM type: NRG; PAM sequence: AGG
atttgataactcgtgacttt

SEQ ID NO: 103818 - DNA, 20 bp, Artificial Sequence
  Description of Artificial Sequence: Synthetic oligonucleotide
  Target: ATXN1; (+) strand; PAM type: NRG; PAM sequence: AAG
gataactcgtgactttagga

SEQ ID NO: 103819 - DNA, 20 bp, Artificial Sequence
  Description of Artificial Sequence: Synthetic oligonucleotide
  Target: ATXN1; (+) strand; PAM type: NRG; PAM sequence: CGG
ctctccctcttttttgtcgc

SEQ ID NO: 103820 - DNA, 20 bp, Artificial Sequence
  Description of Artificial Sequence: Synthetic oligonucleotide
  Target: ATXN1; (+) strand; PAM type: NRG; PAM sequence: GGG
tctccctcttttttgtcgcc

SEQ ID NO: 103821 - DNA, 20 bp, Artificial Sequence
  Description of Artificial Sequence: Synthetic oligonucleotide
  Target: ATXN1; (+) strand; PAM type: NRG; PAM sequence: CAG
ccgggtctcactctgtcacc

SEQ ID NO: 103822 - DNA, 20 bp, Artificial Sequence
  Description of Artificial Sequence: Synthetic oligonucleotide
  Target: ATXN1; (+) strand; PAM type: NRG; PAM sequence: AGG
cgggtctcactctgtcaccc

SEQ ID NO: 103823 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcacccaggc

SEQ ID NO: 103824 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcacccaggctg

SEQ ID NO: 103825 - DNA, 20 bp, Artificial Sequence
  Description of Artificial Sequence: Synthetic oligonucleotide
  Target: ATXN1; (+) strand; PAM type: NRG; PAM sequence: TAG
ctgtcacccaggctggagtg

SEQ ID NO: 103826 - DNA, 20 bp, Artificial Sequence
  Description of Artificial Sequence: Synthetic oligonucleotide
  Target: ATXN1; (+) strand; PAM type: NRG; PAM sequence: GAG
cacccaggctggagtgtagt

SEQ ID NO: 103827 - DNA, 20 bp, Artificial Sequence
  Description of Artificial Sequence: Synthetic oligonucleotide
  Target: ATXN1; (+) strand; PAM type: NRG; PAM sequence: GAG
cccaggctggagtgtagtga

SEQ ID NO: 103828 - DNA, 20 bp, Artificial Sequence
  Description of Artificial Sequence: Synthetic oligonucleotide
  Target: ATXN1; (+) strand; PAM type: NRG; PAM sequence: AGG
ccaggctggagtgtagtgag

SEQ ID NO: 103829 - DNA, 20 bp, Artificial Sequence
  Description of Artificial Sequence: Synthetic oligonucleotide
  Target: ATXN1; (+) strand; PAM type: NRG; PAM sequence: CAG
tggagtgtagtgagaggtga

SEQ ID NO: 103830 - DNA, 20 bp, Artificial Sequence
  Description of Artificial Sequence: Synthetic oligonucleotide
  Target: ATXN1; (+) strand; PAM type: NRG; PAM sequence: TGG
agtgagaggtgacagcatac

SEQ ID NO: 103831 - DNA, 20 bp, Artificial Sequence
  Description of Artificial Sequence: Synthetic oligonucleotide
  Target: ATXN1; (+) strand; PAM type: NRG; PAM sequence: CAG
gagaggtgacagcatactgg

SEQ ID NO: 103832 - DNA, 20 bp, Artificial Sequence
  Description of Artificial Sequence: Synthetic oligonucleotide
  Target: ATXN1; (+) strand; PAM type: NRG; PAM sequence: CAG
cagcatactggcagccctca

SEQ ID NO: 103833 - DNA, 20 bp, Artificial Sequence
  Description of Artificial Sequence: Synthetic oligonucleotide
  Target: ATXN1; (+) strand; PAM type: NRG; PAM sequence: TGG
ctctctgcgcctcctctgcc

SEQ ID NO: 103834 - DNA, 20 bp, Artificial Sequence
  Description of Artificial Sequence: Synthetic oligonucleotide
  Target: ATXN1; (+) strand; PAM type: NRG; PAM sequence: GGG
tctctgcgcctcctctgcct

SEQ ID NO: 103835 - DNA, 20 bp, Artificial Sequence
  Description of Artificial Sequence: Synthetic oligonucleotide
  Target: ATXN1; (+) strand; PAM type: NRG; PAM sequence: TGG
ctctgcctgggctcccactt

SEQ ID NO: 103836 - DNA, 20 bp, Artificial Sequence
  Description of Artificial Sequence: Synthetic oligonucleotide
  Target: ATXN1; (+) strand; PAM type: NRG; PAM sequence: CGG
tgcctgggctcccactttgg

SEQ ID NO: 103837 - DNA, 20 bp, Artificial Sequence
  Description of Artificial Sequence: Synthetic oligonucleotide
  Target: ATXN1; (+) strand; PAM type: NRG; PAM sequence: GAG
ctcccactttggcggctctt

SEQ ID NO: 103838 - DNA, 20 bp, Artificial Sequence
  Description of Artificial Sequence: Synthetic oligonucleotide
  Target: ATXN1; (+) strand; PAM type: NRG; PAM sequence: AGG
tcccactttggcggctcttg

SEQ ID NO: 103839 - DNA, 20 bp, Artificial Sequence
  Description of Artificial Sequence: Synthetic oligonucleotide
  Target: ATXN1; (+) strand; PAM type: NRG; PAM sequence: GAG
ccactttggcggctcttgag

SEQ ID NO: 103840 - DNA, 20 bp, Artificial Sequence
  Description of Artificial Sequence: Synthetic oligonucleotide
  Target: ATXN1; (+) strand; PAM type: NRG; PAM sequence: TGG
ttcaccccgccgctgcactg

SEQ ID NO: 103841 - DNA, 20 bp, Artificial Sequence
  Description of Artificial Sequence: Synthetic oligonucleotide
  Target: ATXN1; (+) strand; PAM type: NRG; PAM sequence: GGG
tcaccccgccgctgcactgt

SEQ ID NO: 103842 - DNA, 20 bp, Artificial Sequence
  Description of Artificial Sequence: Synthetic oligonucleotide
  Target: ATXN1; (+) strand; PAM type: NRG; PAM sequence: TGG
tgcactgtgggacctctttc

SEQ ID NO: 103843 - DNA, 20 bp, Artificial Sequence
  Description of Artificial Sequence: Synthetic oligonucleotide
  Target: ATXN1; (+) strand; PAM type: NRG; PAM sequence: GGG
gcactgtgggacctctttct

SEQ ID NO: 103844 - DNA, 20 bp, Artificial Sequence
  Description of Artificial Sequence: Synthetic oligonucleotide
  Target: ATXN1; (+) strand; PAM type: NRG; PAM sequence: TGG
tgtgggacctctttctgggc

SEQ ID NO: 103845 - DNA, 20 bp, Artificial Sequence
  Description of Artificial Sequence: Synthetic oligonucleotide
  Target: ATXN1; (+) strand; PAM type: NRG; PAM sequence: AAG
gacctctttctgggctggcc

SEQ ID NO: 103846 - DNA, 20 bp, Artificial Sequence
  Description of Artificial Sequence: Synthetic oligonucleotide
  Target: ATXN1; (+) strand; PAM type: NRG; PAM sequence: AGG
acctctttctgggctggcca

SEQ ID NO: 103847 - DNA, 20 bp, Artificial Sequence
  Description of Artificial Sequence: Synthetic oligonucleotide
  Target: ATXN1; (+) strand; PAM type: NRG; PAM sequence: CAG
ctttctgggctggccaaggc

SEQ ID NO: 103848 - DNA, 20 bp, Artificial Sequence
  Description of Artificial Sequence: Synthetic oligonucleotide
  Target: ATXN1; (+) strand; PAM type: NRG; PAM sequence: GAG
ttctgggctggccaaggcca

SEQ ID NO: 103849 - DNA, 20 bp, Artificial Sequence
  Description of Artificial Sequence: Synthetic oligonucleotide
  Target: ATXN1; (+) strand; PAM type: NRG; PAM sequence: CGG
gggctggccaaggccagagc

SEQ ID NO: 103850 - DNA, 20 bp, Artificial Sequence
  Description of Artificial Sequence: Synthetic oligonucleotide
  Target: ATXN1; (+) strand; PAM type: NRG; PAM sequence: CAG
aaggccagagccggctccct

SEQ ID NO: 103851 - DNA, 20 bp, Artificial Sequence
  Description of Artificial Sequence: Synthetic oligonucleotide
  Target: ATXN1; (+) strand; PAM type: NRG; PAM sequence: CGG
gccggctccctcagcttgcg

SEQ ID NO: 103852 - DNA, 20 bp, Artificial Sequence
  Description of Artificial Sequence: Synthetic oligonucleotide
  Target: ATXN1; (+) strand; PAM type: NRG; PAM sequence: GAG
cggctccctcagcttgcgcg

SEQ ID NO: 103853 - DNA, 20 bp, Artificial Sequence
  Description of Artificial Sequence: Synthetic oligonucleotide
  Target: ATXN1; (+) strand; PAM type: NRG; PAM sequence: AGG
ggctccctcagcttgcgcgg

SEQ ID NO: 103854 - DNA, 20 bp, Artificial Sequence
  Description of Artificial Sequence: Synthetic oligonucleotide
  Target: ATXN1; (+) strand; PAM type: NRG; PAM sequence: TGG
cctcagcttgcgcggaggtg

SEQ ID NO: 103855 - DNA, 20 bp, Artificial Sequence
  Description of Artificial Sequence: Synthetic oligonucleotide
  Target: ATXN1; (+) strand; PAM type: NRG; PAM sequence: AAG
cagcttgcgcggaggtgtgg

SEQ ID NO: 103856 - DNA, 20 bp, Artificial Sequence
  Description of Artificial Sequence: Synthetic oligonucleotide
  Target: ATXN1; (+) strand; PAM type: NRG; PAM sequence: AGG
agcttgcgcggaggtgtgga

SEQ ID NO: 103857 - DNA, 20 bp, Artificial Sequence
  Description of Artificial Sequence: Synthetic oligonucleotide
  Target: ATXN1; (+) strand; PAM type: NRG; PAM sequence: GAG
cttgcgcggaggtgtggaag

SEQ ID NO: 103858 - DNA, 20 bp, Artificial Sequence
  Description of Artificial Sequence: Synthetic oligonucleotide
  Target: ATXN1; (+) strand; PAM type: NRG; PAM sequence: GAG
tgcgcggaggtgtggaagga

SEQ ID NO: 103859 - DNA, 20 bp, Artificial Sequence
  Description of Artificial Sequence: Synthetic oligonucleotide
  Target: ATXN1; (+) strand; PAM type: NRG; PAM sequence: AGG
gcgcggaggtgtggaaggag

SEQ ID NO: 103860 - DNA, 20 bp, Artificial Sequence
  Description of Artificial Sequence: Synthetic oligonucleotide
  Target: ATXN1; (+) strand; PAM type: NRG; PAM sequence: TGG
gaggtgtggaaggagaggcg

SEQ ID NO: 103861 - DNA, 20 bp, Artificial Sequence
  Description of Artificial Sequence: Synthetic oligonucleotide
  Target: ATXN1; (+) strand; PAM type: NRG; PAM sequence: GGG
aggtgtggaaggagaggcgt

SEQ ID NO: 103862 - DNA, 20 bp, Artificial Sequence
  Description of Artificial Sequence: Synthetic oligonucleotide
  Target: ATXN1; (+) strand; PAM type: NRG; PAM sequence: TGG
tgtggaaggagaggcgtggg

SEQ ID NO: 103863 - DNA, 20 bp, Artificial Sequence
  Description of Artificial Sequence: Synthetic oligonucleotide
  Target: ATXN1; (+) strand; PAM type: NRG; PAM sequence: GGG
gtggaaggagaggcgtgggt

SEQ ID NO: 103864 - DNA, 20 bp, Artificial Sequence
  Description of Artificial Sequence: Synthetic oligonucleotide
  Target: ATXN1; (+) strand; PAM type: NRG; PAM sequence: CGG
gagaggcgtgggtgggaacc

SEQ ID NO: 103865 - DNA, 20 bp, Artificial Sequence
  Description of Artificial Sequence: Synthetic oligonucleotide
  Target: ATXN1; (+) strand; PAM type: NRG; PAM sequence: GGG
agaggcgtgggtgggaaccc

SEQ ID NO: 103866 - DNA, 20 bp, Artificial Sequence
  Description of Artificial Sequence: Synthetic oligonucleotide
  Target: ATXN1; (+) strand; PAM type: NRG; PAM sequence: TGG
cgggctgcgcgcgttgcttg

SEQ ID NO: 103867 - DNA, 20 bp, Artificial Sequence
  Description of Artificial Sequence: Synthetic oligonucleotide
  Target: ATXN1; (+) strand; PAM type: NRG; PAM sequence: GGG
gggctgcgcgcgttgcttgt

SEQ ID NO: 103868 - DNA, 20 bp, Artificial Sequence
  Description of Artificial Sequence: Synthetic oligonucleotide
  Target: ATXN1; (+) strand; PAM type: NRG; PAM sequence: CAG
tgcgcgcgttgcttgtgggc

SEQ ID NO: 103869 - DNA, 20 bp, Artificial Sequence
  Description of Artificial Sequence: Synthetic oligonucleotide
  Target: ATXN1; (+) strand; PAM type: NRG; PAM sequence: CAG
ttgtgggccagcgcgcgttc

SEQ ID NO: 103870 - DNA, 20 bp, Artificial Sequence
  Description of Artificial Sequence: Synthetic oligonucleotide
  Target: ATXN1; (+) strand; PAM type: NRG; PAM sequence: AGG
tgtgggccagcgcgcgttcc

SEQ ID NO: 103871 - DNA, 20 bp, Artificial Sequence
  Description of Artificial Sequence: Synthetic oligonucleotide
  Target: ATXN1; (+) strand; PAM type: NRG; PAM sequence: TGG
gggccagcgcgcgttccagg

SEQ ID NO: 103872 - DNA, 20 bp, Artificial Sequence
  Description of Artificial Sequence: Synthetic oligonucleotide
  Target: ATXN1; (+) strand; PAM type: NRG; PAM sequence: TGG
gcgcgcgttccaggtggctg

SEQ ID NO: 103873 - DNA, 20 bp, Artificial Sequence
  Description of Artificial Sequence: Synthetic oligonucleotide
  Target: ATXN1; (+) strand; PAM type: NRG; PAM sequence: GGG
cgcgcgttccaggtggctgt

SEQ ID NO: 103874 - DNA, 20 bp, Artificial Sequence
  Description of Artificial Sequence: Synthetic oligonucleotide
  Target: ATXN1; (+) strand; PAM type: NRG; PAM sequence: TGG
ccaggtggctgtgggctccg

SEQ ID NO: 103875 - DNA, 20 bp, Artificial Sequence
  Description of Artificial Sequence: Synthetic oligonucleotide
  Target: ATXN1; (+) strand; PAM type: NRG; PAM sequence: GGG
caggtggctgtgggctccgt

SEQ ID NO: 103876 - DNA, 20 bp, Artificial Sequence
  Description of Artificial Sequence: Synthetic oligonucleotide
  Target: ATXN1; (+) strand; PAM type: NRG; PAM sequence: CGG
ggctccgtgggccccgcact

SEQ ID NO: 103877 - DNA, 20 bp, Artificial Sequence
  Description of Artificial Sequence: Synthetic oligonucleotide
  Target: ATXN1; (+) strand; PAM type: NRG; PAM sequence: GAG
ctccgtgggccccgcactcg

SEQ ID NO: 103878 - DNA, 20 bp, Artificial Sequence
  Description of Artificial Sequence: Synthetic oligonucleotide
  Target: ATXN1; (+) strand; PAM type: NRG; PAM sequence: CAG
cgtgggccccgcactcggag

SEQ ID NO: 103879 - DNA, 20 bp, Artificial Sequence
  Description of Artificial Sequence: Synthetic oligonucleotide
  Target: ATXN1; (+) strand; PAM type: NRG; PAM sequence: CGG
gggccccgcactcggagcag

SEQ ID NO: 103880 - DNA, 20 bp, Artificial Sequence
  Description of Artificial Sequence: Synthetic oligonucleotide
  Target: ATXN1; (+) strand; PAM type: NRG; PAM sequence: CGG
ccccgcactcggagcagcgg

SEQ ID NO: 103881 - DNA, 20 bp, Artificial Sequence
  Description of Artificial Sequence: Synthetic oligonucleotide
  Target: ATXN1; (+) strand; PAM type: NRG; PAM sequence: CGG
ggagcagcggcggaccccgc

SEQ ID NO: 103882 - DNA, 20 bp, Artificial Sequence
  Description of Artificial Sequence: Synthetic oligonucleotide
  Target: ATXN1; (+) strand; PAM type: NRG; PAM sequence: TAG
gcggcggaccccgccggccc

SEQ ID NO: 103883 - DNA, 20 bp, Artificial Sequence
  Description of Artificial Sequence: Synthetic oligonucleotide
  Target: ATXN1; (+) strand; PAM type: NRG; PAM sequence: AGG
cggcggaccccgccggccct

SEQ ID NO: 103884 - DNA, 20 bp, Artificial Sequence
  Description of Artificial Sequence: Synthetic oligonucleotide
  Target: ATXN1; (+) strand; PAM type: NRG; PAM sequence: GGG
ggcggaccccgccggcccta

SEQ ID NO: 103885 - DNA, 20 bp, Artificial Sequence
  Description of Artificial Sequence: Synthetic oligonucleotide
  Target: ATXN1; (+) strand; PAM type: NRG; PAM sequence: CAG
ggaccccgccggccctaggg

SEQ ID NO: 103886 - DNA, 20 bp, Artificial Sequence
  Description of Artificial Sequence: Synthetic oligonucleotide
  Target: ATXN1; (+) strand; PAM type: NRG; PAM sequence: GAG
cccgccggccctagggcagt

SEQ ID NO: 103887 - DNA, 20 bp, Artificial Sequence
  Description of Artificial Sequence: Synthetic oligonucleotide
  Target: ATXN1; (+) strand; PAM type: NRG; PAM sequence: AGG
ccgccggccctagggcagtg

SEQ ID NO: 103888 - DNA, 20 bp, Artificial Sequence
  Description of Artificial Sequence: Synthetic oligonucleotide
  Target: ATXN1; (+) strand; PAM type: NRG; PAM sequence: GGG
cgccggccctagggcagtga

SEQ ID NO: 103889 - DNA, 20 bp, Artificial Sequence
  Description of Artificial Sequence: Synthetic oligonucleotide
  Target: ATXN1; (+) strand; PAM type: NRG; PAM sequence: GGG
gccggccctagggcagtgag

SEQ ID NO: 103890 - DNA, 20 bp, Artificial Sequence
  Description of Artificial Sequence: Synthetic oligonucleotide
  Target: ATXN1; (+) strand; PAM type: NRG; PAM sequence: TAG
ccctagggcagtgaggggct

SEQ ID NO: 103891 - DNA, 20 bp, Artificial Sequence
  Description of Artificial Sequence: Synthetic oligonucleotide
  Target: ATXN1; (+) strand; PAM type: NRG; PAM sequence: CAG
tagggcagtgaggggcttag

SEQ ID NO: 103892 - DNA, 20 bp, Artificial Sequence
  Description of Artificial Sequence: Synthetic oligonucleotide
  Target: ATXN1; (+) strand; PAM type: NRG; PAM sequence: TGG
gcagtgaggggcttagcagt

SEQ ID NO: 103893 - DNA, 20 bp, Artificial Sequence
  Description of Artificial Sequence: Synthetic oligonucleotide
  Target: ATXN1; (+) strand; PAM type: NRG; PAM sequence: GGG
cagtgaggggcttagcagtt

SEQ ID NO: 103894 - DNA, 20 bp, Artificial Sequence
  Description of Artificial Sequence: Synthetic oligonucleotide
  Target: ATXN1; (+) strand; PAM type: NRG; PAM sequence: CAG
gaggggcttagcagttgggc

SEQ ID NO: 103895 - DNA, 20 bp, Artificial Sequence
  Description of Artificial Sequence: Synthetic oligonucleotide
  Target: ATXN1; (+) strand; PAM type: NRG; PAM sequence: CAG
gggcttagcagttgggccag

SEQ ID NO: 103896 - DNA, 20 bp, Artificial Sequence
  Description of Artificial Sequence: Synthetic oligonucleotide
  Target: ATXN1; (+) strand; PAM type: NRG; PAM sequence: CAG
cgctgtgctcaatttctcgc

SEQ ID NO: 103897 - DNA, 20 bp, Artificial Sequence
  Description of Artificial Sequence: Synthetic oligonucleotide
  Target: ATXN1; (+) strand; PAM type: NRG; PAM sequence: AGG
gctgtgctcaatttctcgcc

SEQ ID NO: 103898 - DNA, 20 bp, Artificial Sequence
  Description of Artificial Sequence: Synthetic oligonucleotide
  Target: ATXN1; (+) strand; PAM type: NRG; PAM sequence: TAG
ctcaatttctcgccaggcct

SEQ ID NO: 103899 - DNA, 20 bp, Artificial Sequence
  Description of Artificial Sequence: Synthetic oligonucleotide
  Target: ATXN1; (+) strand; PAM type: NRG; PAM sequence: TGG
gccaggccttagctgccttc

SEQ ID NO: 103900 - DNA, 20 bp, Artificial Sequence
  Description of Artificial Sequence: Synthetic oligonucleotide
  Target: ATXN1; (+) strand; PAM type: NRG; PAM sequence: CGG
aggccttagctgccttctgg

SEQ ID NO: 103901 - DNA, 20 bp, Artificial Sequence
  Description of Artificial Sequence: Synthetic oligonucleotide
  Target: ATXN1; (+) strand; PAM type: NRG; PAM sequence: GGG
ggccttagctgccttctggc

SEQ ID NO: 103902 - DNA, 20 bp, Artificial Sequence
  Description of Artificial Sequence: Synthetic oligonucleotide
  Target: ATXN1; (+) strand; PAM type: NRG; PAM sequence: CAG
cttagctgccttctggcggg

SEQ ID NO: 103903 - DNA, 20 bp, Artificial Sequence
  Description of Artificial Sequence: Synthetic oligonucleotide
  Target: ATXN1; (+) strand; PAM type: NRG; PAM sequence: AGG
ttagctgccttctggcgggc

SEQ ID NO: 103904 - DNA, 20 bp, Artificial Sequence
  Description of Artificial Sequence: Synthetic oligonucleotide
  Target: ATXN1; (+) strand; PAM type: NRG; PAM sequence: GGG
tagctgccttctggcgggca

SEQ ID NO: 103905 - DNA, 20 bp, Artificial Sequence
  Description of Artificial Sequence: Synthetic oligonucleotide
  Target: ATXN1; (+) strand; PAM type: NRG; PAM sequence: CGG
gccttctggcgggcagggct

SEQ ID NO: 103906 - DNA, 20 bp, Artificial Sequence
  Description of Artificial Sequence: Synthetic oligonucleotide
  Target: ATXN1; (+) strand; PAM type: NRG; PAM sequence: GGG
ccttctggcgggcagggctc

SEQ ID NO: 103907 - DNA, 20 bp, Artificial Sequence
  Description of Artificial Sequence: Synthetic oligonucleotide
  Target: ATXN1; (+) strand; PAM type: NRG; PAM sequence: CAG
cgggcagggctcgggacctg

SEQ ID NO: 103908 - DNA, 20 bp, Artificial Sequence
  Description of Artificial Sequence: Synthetic oligonucleotide
  Target: ATXN1; (+) strand; PAM type: NRG; PAM sequence: TGG
aacctccccctgcccctccg

SEQ ID NO: 103909 - DNA, 20 bp, Artificial Sequence
  Description of Artificial Sequence: Synthetic oligonucleotide
  Target: ATXN1; (+) strand; PAM type: NRG; PAM sequence: GGG
acctccccctgcccctccgt

SEQ ID NO: 103910 - DNA, 20 bp, Artificial Sequence
  Description of Artificial Sequence: Synthetic oligonucleotide
  Target: ATXN1; (+) strand; PAM type: NRG; PAM sequence: CAG
cccctccgtgggctcctgtg

SEQ ID NO: 103911 - DNA, 20 bp, Artificial Sequence
  Description of Artificial Sequence: Synthetic oligonucleotide
  Target: ATXN1; (+) strand; PAM type: NRG; PAM sequence: CAG
tccgtgggctcctgtgcagc

SEQ ID NO: 103912 - DNA, 20 bp, Artificial Sequence
  Description of Artificial Sequence: Synthetic oligonucleotide
  Target: ATXN1; (+) strand; PAM type: NRG; PAM sequence: GAG
cgtgggctcctgtgcagcca

SEQ ID NO: 103913 - DNA, 20 bp, Artificial Sequence
  Description of Artificial Sequence: Synthetic oligonucleotide
  Target: ATXN1; (+) strand; PAM type: NRG; PAM sequence: GAG
gcagccagagcctccccgac

SEQ ID NO: 103914 - DNA, 20 bp, Artificial Sequence
  Description of Artificial Sequence: Synthetic oligonucleotide
  Target: ATXN1; (+) strand; PAM type: NRG; PAM sequence: CAG
gagcgccgccccctgctcca

SEQ ID NO: 103915 - DNA, 20 bp, Artificial Sequence
  Description of Artificial Sequence: Synthetic oligonucleotide
  Target: ATXN1; (+) strand; PAM type: NRG; PAM sequence: CAG
gccccctgctccacagcgcc

SEQ ID NO: 103916 - DNA, 20 bp, Artificial Sequence
  Description of Artificial Sequence: Synthetic oligonucleotide
  Target: ATXN1; (+) strand; PAM type: NRG; PAM sequence: AAG
cccagtcccatcgaccaccc

SEQ ID NO: 103917 - DNA, 20 bp, Artificial Sequence
  Description of Artificial Sequence: Synthetic oligonucleotide
  Target: ATXN1; (+) strand; PAM type: NRG; PAM sequence: AGG
ccagtcccatcgaccaccca

SEQ ID NO: 103918 - DNA, 20 bp, Artificial Sequence
  Description of Artificial Sequence: Synthetic oligonucleotide
  Target: ATXN1; (+) strand; PAM type: NRG; PAM sequence: GAG
ccatcgaccacccaaggact

SEQ ID NO: 103919 - DNA, 20 bp, Artificial Sequence
  Description of Artificial Sequence: Synthetic oligonucleotide
  Target: ATXN1; (+) strand; PAM type: NRG; PAM sequence: AGG
catcgaccacccaaggactg
